United States Patent 9,328,346 (POLYCOMB-ASSOCIATED NON-CODING RNAS) - sequence listing, part 38

SEQ ID NO: 6656 - RNA, 17586 nt, Mus musculus
cucuaguuuuacgucaucucagugcgacgaaguccgcgagggagggguggggugagcgcuguucgcggugguuggggggcugcuuugaaggugucauggcugcugcugcggagcuuaguuccucaagcggcagcgagaggagccuggagcaaugcuccagcccccuccucacccgcgagguccucugcgaagucuuucgcuccuugcacacccugacaagacagguaagugggggugcggcggggaagggguggguggggagggagagcaucccgguccuuguccccuuaguucucucggaggcgggggucgcggagccccgcuggcacggugugugccgcuggugugccguggccgggcugugacacccggaagacccugggcccagcuccugggaccgggagaugccagcggcacgcuugauggccaaggucuggagaaaacugggguccuggcgacgaaagcuugcccaaaagaugccuaaaaggugaugagggugaaggagguuccuggcgaucacgguccuuuugccuccaguguauuuaucgcagaaacucacugguuaauauggccugaaacuuuuccuagcgccauccccacuccuuggggggugauuuacucugggguuuuuuguuuauuuguuuguuuuucuguuuuuuguuucucuugccauuuauugcaucucuuacucuuuuaaacggggagggauauauaaggauuuccacaauuucauuuguaguauaccuaaauuuuagugugaauuguuggaugaguuauguguggccacuucuaacuacauuacgacugucguguagcuuagcuaauugcucuuuacagaaaaugucacaguaaaccuggauuuuaaaaacuagguuacacuuuacuagauagucgugauguaaaugaggcaauguuuaaauaaggaacaaaaguauguuugccugcuuuuagaagaguuuugugucaaacauguuuccuaauuuguuuggggacugguuauagugcuugaaauggacacagcacacauuuaugucaagggcagugguaccaccagugagaauaggacauuuaccugauuugugaggauuauuuuuaaaauccuuaguuggaaaaccuuaguaaguuuauucugacuggcaaacuacuugaguuguacauucuguuugguguuacuggacuucgaaaaguuaaaaaaaauuaaacucaguugcuugauaagcaauuaggaaaaaaauucuuacaaagucuuaagcacuuuccuuauuaauauuucaguaguaacaucucagaucuuuaaauaguuuaaaaguuagagaacuuuuuggcguggauuuggaacuuaaagauuuauucauuuauauuucuaaugucaagaugagaaaaaucuucucaaauauuaugcuuagaaauugcaaaauaauuuacauugauaaauuauuugaauuauaaaauaucuaaauuuugcauacugaguuuuuuaauuauauaaauuuaucucaaagguucaaauggaaaaaugauuaaacuuaacuuaugccacuugccaaaaauguguagagaaaaugaaguuuuuguaacaguaaaggguccuuuaacaagugucaaauauaagauuuuuuaaaaaauuaauuaaaugcuauuuuaguaauauguauuuugagaugcgugauuaaggaugaaagccauccacacuuauaaaguugccccugcggaauguguccuuucgcaacaaauuaaagggacuuuuaagauguaaauuguaauaugucuaaguucaccuuaaauaucauugaauuauuagcgcuuuucgauagaaaguguaaaacugaauuguuaaaaagcauuuuuccuucaaaugcaacuaauguguuucuacugaacauacaugacugaguagucaguguuaauaguguguuaauagaaaaauuugaacgccugauuacugucccaaggauuaugggauaaaaauucauagaauccauauguuacuggggaauuugcugaaugaauaauuggauuauuugggggccauuuuuaaguuaauuugucaccuuacuguuugguuuccauaaaagaucaagugucuccaguugccuuugaaagcuuccauacugacaugagaauaugauccaaauauuaagauuucuuuccuauaauuauuuucucuagaaagggugaugcuuugcuuugguuuaagguuugccugcuuauuccccaaacauaaaucugccaagagcucuauaguugacuguggcaagaauaaugaacuguaaaaauaaaaaaacaagacaugaauuguccauggaaccaaagagaucucagguuccuauguuaagcacucuacuguauaaauaguggauacagaaaccuacugccuaagaccaggggcaucuaaguccacauuuggcaaacauaaagaaauaugaaauuuuacauaggcuauacugacauagguaaacuuacacuaaguuaagauuugacgauaagauuacuaagauaacugcauuuauuauugaauaugaaaguaauccaucagcacaugucuugguuuuuuauucuuacagcucuuuaaauuuguauuugagcucaugaaacaugcaucuuuacuuuguagaaaauaugacauaauuuuuaauaaauuauuauugcaaaauaaguacaauugacuuguuuccacuugaauugugucuagcaaaguuuauagugauucccuuauacucagucaaauguacagguggaagcuucucccucuaaaguuuugacugauuuugauauuaauuuuauauucuugguaguguucuggauauacuuuuguucuaauaaaucacuaccuggugagaaguuuccguguuaugagacauaucuuucuagaaaacccuuaggaaacacacuggacauugacuuuuggcuucguuguacugcuuugggaaaguacuugguuuuuaucucaauaauuucauaacugauaguuuaauuuuuauuugaaguaguuacugucaucugucccuaugugugaauaaucuuaagucuuaaauacuuuuuuaauuagcuaaguuugaaaacaauaaaaauaauugagaagacaucagaguaaugauauauuuuaggcauguguuugugugauauguaacaaagagaauacacuuucuggacugucguaguugaucuucgucuguugaaugccuaguugggauucaguaggauucugacuagggcagaucuauuuuuggauaccuuccaguggucuuuaaaauaucaaaguaucaaaagagguuuaucuuucauggauggcuuuucaaagauggccccaggaacagaauuaaaauaauaagacauguuuuuacuuuuuauuuucaaaacugugccuuuuggcuuuuuaaaauggcaacuggguaaagcauuuuauuaugucauugaaacuuaguaacuuugagcaaaauaggcaugcauuacuccauagaaaucuuauuuuugugauaaucccagauauacagcuuaaucguguaauuuuugugauguugcugguuugccucuuugaagcuuaaccucagagaugauguggugaaaauuacaaucgauuggaacaggcuccagagccucucagcaucccagccugcacugcuccuuacugcacuugaacaacacguuuuguauuuacagguaaauuucauauuagaaauauuuacuggauauugaaaauagaaauuaccuauaguuaaauuaacuggaguauuuuucaguucuaccucaacauucuguuaacaguauuauuaauaaaagguuauuaaaauccauauugagucuaggucuguuaauuucacuagugaucggaauaguuaugagaauauagcccaauaggccaauguggguaugagauugaauaaaugcaauucuauucaauucuaggcuuugcugaaaauucaauacaguucaucuaugguggguuauaauuaagcaauaagacacggcaggugugagucaugcuaugauaaugauuccaugccuugggugaguuuggaggcucauggagugcuuucagugguucaagaaguggcauuaucccagcaugauacauccuggagugucuauugcaauuaaacaguuucagcauaguuuuuaaaaagaaaguaauuucugugacauuaauguuucaucuuagugaguagccagucacuauuucaucuuaauaauuugaaauaauuuauccuuuauuggaagucaauauugaauuauuuauaaugguauuguuacauuuuuaauauuucaguuuaagaaaugaacaguauuauaaccuugcuguuguuguuuaacaucucugcgaguguaauugaugggaguuggagguuuucucucaucaggauaagcagaacugcuuuuucuggucacuuuacccuguugaagauguuagaagauuucagaagaguacuuucugggauguuuagcuguguuucaugauaaaaauaacaguuaacacuuuguuuaaagggcaagugaugagcuauagaacucaaauguggaccauauccagguggggaugacaggaaaggaagugaauuuccauuaugaagacauuuuuuuuaaccuacuguaguuggaaugaucuguuuccaacguguauagcauguuuuguuuucuuucuuucuaucuaccuaucuuccuuccuuccuuccuuccuuccuuccuuccuuccuuucucuuucuucuccccgugugcauuuucuuuugugaaauuucauuucaugucccaauaagauaucauacuaugacagagaaaggcugacuauucacucaggguaacaccuauauacuucauauccaugcucucucauucauuuuggccaacuguacuuugaaguggagagucucagcgauacagugauaaugcagggcuuugcugagugagcacugcccuccugcuaaggagggagaacacucagccuaguguucugaaugacauguuaauuaagaggcauccaggccagagucugaggcuuugauuuagcacaaaauaaaagaugaaugacagaaugauuuccucaaagaaaaauuuaaauguccucagguuuucuuucuuuucuucuuuuuuaaaaauaaauguacaguaaaugauaagggcaauguacaguaguagaaaacagcaaaccuguguguguuaagaucuguguguccuuguaugccagcuuuuuauguuuaauaacugauaauauucauuucuguagcagcagcuuagauaaaucuaucacuagcugagaugaguuugaaccugaacagauguaacuguguucuuuccagccuuuuuuagcaaaacuucagucuuuaaugaaagaaaacucaacagcuacagagauaagacagacagaagcagagaccaagagugaacuaagagccauacaucccaccgaggaccuacaagaugaagggaagcccaaagacugugauguaggagaugugaaaaagacacaaaaccuuuuugacccagaaguaguucagaucaaggcuggaaaagcagaagugaguguggacagguacacgggucaggguaacauuacuuugaaaaguucuguuguguuuagauuguuaaauuauuuguuguuuuagauugacagacgaauaucugcauuuauugagagaaaacaagcugaaaucaaugaaaacaaugucagggaauuuugcaauguuauugauuguaaucaagguaacuacaaguuuuuuuuuuuaacagaauuuuaaacaucuugacaacugcuauaauauuuuguuuuaaaaacauauaacauuaagaacaagauucuauuuugcagguguuuaguugauaauuaagguaguagaauuuuccuuuauuuaguaaugggcucuguugccaaacugauucucauuuugguuacauaaaaaauccaagugaaggccgaacucuagagacagauguuuaccacagguucaagaagaucagaguuccuuuagaaagugaaggugaaccagcgaaccuaguagcacuacuugcaccccucacaagggagcaguuuucuccugacuccugaguuucaugguggauacacccagcuugccaugaaguccuguggagccucagccccaggccucucccuuuucacacugcugucucaccuuugccguuucgccucugucucccuuuccucuucguuuggggcuacaguguuuccaggucugcagaggaccugcagaaccccauagacuguguagauugccacagaucauaaccaguuagcuuuguaauaaccagacuguaaguaguucuuagaaaaaaauuaugaaaaaagguuuguaauuggguugaccauuuuuuucuuacugccauuaauaucucuuaguuaaugauuauaaacaugaaauuguccguugaaccuggaaaugacucauaaucacauugauaugugacacucuuaacauaauaacgugggcuuacuguggauucuaaauuaaacuuuucugcuuuagcuuguguggaucccuagaauuagcucuuuagagcagguguaacaguggaaaaucucagguguggcaauccagcuguacacgccucaagagaaaggguuuguugagggagcaaggacaugugucacuaauguuauuccucuguuccuccugcuaacucuauuauuauaaaccaccaggggauagaaauugacaagaauugaaaugcucagcaggacuccuaagcccauucaguccuugcuggcucaaaacagugcuagccagaauugcuguggagagugacgagcauucccuguccccacacuaugcugcaugcucucugauggcucugugcauuugcaauguagcccuggaauggaugguagcuuuuuaaaaaaaucccuuagaccaaugaaagaauagaaagaaguguagacccccuuacauguauuuugaaguguuuccaaggaaaagaaaaugaguguuuaaucuuuaaauauaaaugauuaaguagguuuacaauuuuauuuauacuucaguuuaucacaggucuguuagacuuaagcuuaaaaaauaaauuuuaauguguugcuguauuuuuuaaagaccuuucaguuggucuaagaaaaaaguucaguuuuuaaaaaaaucggauuuuauggauuaacaaaggauuuuaacucaugucauaugcuuuuuuuuuuuuuuuacaaaauaauaugggaauuuaacaaaauuuacagccaauguauagcuuuacuguuacuucaagcauuaaucuguauuucuauaugucauuauuuuauauguguucauauauaaugauuaugcuaauauuuaauaguauagauuauuuuaacauauuucuaauuucuuuuuuauaaauuauuuguugagacauaauuuggaagaaauuguaguuuucacuuugguacaaauauuagaaacauuuucacagcauauuuuucccaaaaucacaguuuuuaaaaaguaggauuaaaaggaguuuuuugauuaggaauuuuaaaguuuguauugcacuugagcuuucauuguauauuguacucacgguuucagggccuuuuguuaaauguggaguucuaagauaaaaagucugagacauacaguuagucccccugguagaugucacuaauuuguuaugaacaaggauguugaaaaacuuaagauaauuugguagaguggguucugcuuaugugauagaguuagagucuggugcuauauaauauaugaguuacauaaugguucuuaugugauagaguuagagucugguguuauauaauauaugaguuauauaaugguucuuaguaaucugugugguucuuagucauugauuuucauuaaagacuauuagaaguugugccaccuaaugguaauaguuuucuauauguaaaucugaacacuagguacagauauugcaugugauucaauucugggggugaagaucacucaaaguaucccuguaugucacacuaauguuauuacuuuuauuuuaaauucucuuaugaauaaaaugugaauuacuagaaguuuaacauaaccuuguacaucuguaauuaagaacauauuuaaacuaagucuauccaaauucucccuagaaaauaguugugcaagaacugaugcugucuuuacuccuuauccuggauuuaaaagucauguaaaggguaagugaguggccaccguucagugucuccaucacuggcagaaguuuguuauagccgcuguacaauguggaguaagaaugccuuucccaucuaaacuuuauucucaaacaaaagcauuugcuuuuccuuuuuucuuucuuuucuucucuuuucucucucucucucucucucucucucucucucuuucuuucuuucuuucuuucuuucuuucuuuuaccauuguggaaagaauauaaaguacucuuuaggagagagaauuucuguucuugaaacauaaauuuacauaggcuaaaaacuucuuaacuuaguuucuagaguugugaauacauauggaccacagacuagaccugaaggaauugcagggucaggucacaaaccuacaggcaugcuucgagauugugguaaucaggcgguagaagaacgacuccagaauauugaggcucaccugcgauugcagacagguaaguggagagcugggucauaucugugaugugucuuugcaagucuuaagggaauuagauucauuuagauuccagauuuuccuugaaaauuuacucuaagccaucauucuagguacauaaagcagccaaagaaucuauaagcuucuugguccuuaugcuccuauccuuauacuucucucuacuugggaaacagauucuaaauaaacucuuuuagccuccguuuauuaaaguuacaacagaagaugaauguaauauuuuacuauggccaauuucggaaauugucugacaacucuaauuauuauuagucaccaacuacaaaauauggauaauuguggucuugguccucuaugcacucacagacaauaaacauauaaaugaauaaaugccuagggaaaaugaacccauauuuauugaacaguacuguuagucagugugaacaugucaugccuaugccagcauagcacuuaauaguucucuguggaggcguuggugcugucacuguuggagagcugguaagacugaaguucaaacauuugcccaagacgucauaggaaaugacaguuggggguugauucuccuuguaaugccccuagauguuugacuucccucucuccaucuacugcuguagaugaagugucuguggccucugucuucacuugucacugaacguccuccuagaggucacuuuucauccucuagccaaagcgcaguuuuucaggcucauaucugauaacuguuucuacccuagguaaaacuucuuuaauaguugucuguugcucucauacauauagcaagcucaccacuuacccaggagagccuguggugcucuagaccagggaggcugcaugugagguugaaggaguagaaagagucagaauguaguagugagcuguguguuuacaucauaucuuuaauacacuaugccuuccuccuugaccuugaugggaaaagcccuuuaaacauuauucuaggucaaaggacaaaguauaucaugcuagaagaaauagaagcugaagaaaaugaugggacauagcacagucaucaaguggaacugucaucuucucacugcaggauuucccuccugaguaccaacaccuauuagaaacuagucaguaucucagaaggugaaucucacaaaaaaacuguaacaacuugggaagcagaggcagcauuuagaaagcagaagucucuaauuugucucaaagaaugcagaacagaacucugagcuaaggaggaagccaugagcuaaggaguucaauugauuuugcuuucgucugcuuauuuucuuaaguuuuaaguguuuuguuguuguuguuauauauaaguguauuugcaugauauuuuaaaaauaaaaaugauaagaaaacagaacuauuaagauuucagcauuuuuuccuaugcauuuagguggcccaguaccaagagacaucuaccaaagaauuaaaaagcuugaagauaaaauccuugaauuggagggcaucucuccugaauacuuccaaucuguaguaaguauuaaugucuucuaaaaaccaaguguuacuuuaaagauuuucacuguguaauaauguacucauugacccacauucggaccacuuuuaaaauugagagaugaggacucaguaccaugagggugaguaucugccucuuuaaggacucugauucugaauauuuuacagcgcagggacacuuguccccaccuauggaaauucuguugagccagcuucacguugucuuaacuuagccuuuggugguccagccugcgacucugucgcggcugucuugugacauaguucuuugucuugaugaucugucccucaggaccguuucacucagcucauaaguagcuacauuucucacaacugaacaggccgugccugguacucucacccauuuuucuuagacuggccuguauuuauauaauuccuccgcucucuuguucgugcauucguucauccauccuuaacccccuuucucaaggacaugagaaacugguuuccuaauaagaaccuucuuuggcacaucaauauuuggcacaucaaacccugagcucacugcuucucaccaucugaugacguacuucucuucuuguuuuguuguuuguuuaaguucugagacagauucucacuauauaaccuguagcuugaacucucaaaucuucugugucagcuuccuuucaaagucuacuaacuaaccaucagccaugcccuuuucauuuauuuacuuacucacuugaugucuaguccauucugugugucccagugaugaacuguggagagguucaaaggagaacaagaaacagauguggggccaggagugguggcacucaucuuuaaucccagcacucaggaggcagaggcauguggauuucugaguucgaggccagccuggucuacaaagugaguuucaggacagccagggcuacacagagaaacucagucucagcaaagcuaaaagaagaaaaacaagaaaagacagagauguggaaacaucagugauugguucucuagugagagcgggcacagugggagcagaguguauuuaccuuguaugugcaguuuucaaguauugugauucaaaacuagucuuuaggaauacucauaaaguuugaaucuuuuaaauauacuagcacacuucagucuuaaaaacguugaauugcuaucuuaaaacauuuccauguucaccggucacauuuuuaaaauaauugcauuaaaagauucaacacauaccagugguggccacaccuuuaauccagugcuugggaggcggaggcaggcagaccucugaauuugaggccagucugguacagaguaaguuccagacagccaagaccacacaggaaaacccugucuccaaaaccaaaagaugcaguacauauugaugcuuuucauaauuuucugcuuuuuauaauaccuuauuagggaguuugguuuuuaucaaauggaaagaauuuuagugcucauuuuguuccaugaaucaaauauaauuuuuuccuauuaauuuuuaccuuuuuauaugguaugcuucaaugauacuuaggauagucaaccucuauccaguuucuagaagauucuacaaguuuagaauccaucuacaugugaaucuauauaaaaacauuucaaguaaaaucuuuucauaguucagaaauucaauuuccaacaaaaggucaauucuuaagacauauaggacucaguguuuacuuauguccuaacuggagaagcuggaauauaguccacauuacucuguagagagaagggcauauagacuucuugguuccucucagugugaagauaacccuugauuagcuuuacuccaggugagguguauggcuagagaggacucacucuguuaugggaugucagcauaaacucuuucccuuuggccuugugacauaucugugcauaggucuagaggacaguuagucucuaugcuuaaaccuuuccaguucugugcugacaacuugcauguccucucuagcacuaaucuguaggauuucuuccacucagagacaugauuuuaaagaucuagaaauccucuuuuuacauagcgccacuguuuccuaacuuguucccagcucuccuccugugaaugcaugacucaccuggcugaagugugucuguuucuaauucuuccuuccaaugcagcuguggagucaacaagccucacgucuuggaguguuguccccacuucucacucucuggguuucagccagcuucucaacacagauuaucucaacugccuuaaguauggguccuauaauuuagaaacuuauuuguuauuucugucuucaaacucuccucuacuuuucaauugacauuccacuaaaauagaucaccccucuagauuuccucauuucuguuaaugauagaaucauuuuacuacccagaaacuggacuuuuccuugcucucuucccauaucuaauuaucaacagcugucaguuuuucucuguuuguuuccaguccuguccccaucucaggaucuuauuucccagcuaagcugguauagcacuggcuccucauucuuaguuggucucuggucauuaaauuaucacaaaucuuagcaaugacuacuucaccagucacuucccugccacgugcuuucaaugcaucccugccuggaaagacagaaccgcuucuggguacagcauugacauuucugugacuucuacuuagcguagaacacauacacaauaaacuaaaaacccaaagaguaaggucgugguagucuguuuuuucauuaacuaaauccauacugagagucugugaacuagacucagagugaaggucucacuggaggaucugcuacaaccacacugucuuaugacaucaguucuacuguuaacaagaauugcacuaaauaagaagcugaccuuuagcuggcaugaacaaguggacaaacaguaggcauggcugaugcuuacguaguagacuuuggaacauguaugacucuugcuccaaagcaaugucuagauggaacuccugacuuuaagggacaugucagaggaagagaaagcuaaauuuaggccaauccauacaguauuuucagacuguaaaagugugugcuagaccugagccaugagcgaacauuuggauccaguuggaaacguagguaaauacagcucccugucugaaguguuaggaggcucaagugggagugagauuggagucaagggaucgaguuuaaauauuaugucauuguucaugcuagaaagacaugcaggucuaaauuguggcagagaaaacauacuacacauauaaaauuaacugcccuuuacagcugguuaacagaagguggucugcaggagauagcccccuuaccucugaguugccuuagugcacaaguugcguuguacaguaauaggaucaucucucauuaggacacaggcuuucuaaaguuagcuguaaauuaccugcuagugugaaauacaaugaagagacauuuguggauuaucugugugacugguuuugcugguuaagcgaacuucuaaauauuuucucucaaguguaaaacuuuguuaaaauguuuaccuuuauacucagguauccccauaccuaaaaaaacaucuauacauuauauguacuguaucuaaacguucuugugaaauaauuguauucagaccuaaacuaagccccagagacucaauucacuguauuuuuaagucauugauccacugcagaccuguucucauucugguauauuuuuuuuauuuugguuuuaugauaauagugugauuguucaugacacagagcuauuaguauuccauugauuaaauuguuggcaucacacaggaaaguguaucuaaaaagcuauuuuucagguagguaggagucugaaguggacagguuaaaguuaagcuccgccuguccaugugcccuaccauaggcacccagcucagccuggcaaagagaggagcagacuuaucugagcucuguuauuccaagucuaaucauucuggcacuuaaugacugcuauuuaguauagcugcucauacgaggcgugcuuaggugguauuuagaucagcuuuugacaugaaagggaaucugaguuuuaauuucuucuaaucuuuguggucauguauguucauuaaaaguucuucuaugcagcuagagacacgagcucuggggguacugguuaguucauuuguuguucccccuauaggguugcagaucccuuuagcuccuuggguaccuucucuagcuccuccauugggagcccugugauccauccaauagcugacugugagcauccacuucuguguuugccaggcaccggcauagccucacaggagacagcuauaucuggguccuuucagcaaaaucuugcuggcgcccaucaguggaaagagaggcccauugguugugcaaacuuuaucugccucaguacaggggaacgccagggccaagaagugggaggggggggaguaugggggacuuuugggauaacauuugaaauauaaaugaagaaaauaccuaauuuuuuaaaaaaaguucuucuguguacauucaucauggauuuuuuuuuauuuuuguuuuguuuuugguuuuuuugggggggguuguuuuguuuuugucagauauguucauuuaguaauuugacacccaaugauuucauuacaucauaguucaaaaggcugaauaguuugucucugugaguccaugagaaucuaacauucaggcaagcgugcaugugcauauacaccaccagggacugaacccagggcugggcaaguguuuuaccauugugccaucucuuuagccccguuacaagaaauaugaauuuaagucgacucauauaauauggaaauuauaaaacaacgagaacacaguuuucaggauugauguaguugcaaagucaagacuugaguucuugcuuuuuuuggaucuguuaguguuggcuucuuccauugauacauggcaaggcugcuauaauuuuuagguuuuuuuauccacauacagcaguaggccauaggaaccuuuguuuucucacaagagaaguuugcagaaaaguucucuuuaauccccagcagacccuccuuacucauuggcuacaauugggccaugugcaugucaguuucuaagcaagaacauugggugagguaggcacugccuugagucacacagaggggacaaagugcugcuugcuuagacuggcacaaugccuuccauggucaaagguaccugugugcacauaugcaugugugcacauaugcauguguuauguguaugucuacuucuuucuccuuugucucugccacuguugcuucucuuggucaguuuuccagagugggaggguccucacuugugagaagcugcuaacuacuggaaagcagggauuugccagagaggagcuguuacacugcuauauacucuuuguaacagugcccuccucuguggggagcuuuguaggcagugccugguaaguguggugauuugcuugggguucucaaaugcuuucugggucucuuucccacagucuuauguaugggaagucaugcggauguuuucuaaauagugauuauuuuguuacuuuuaaacuagaacuucucuggaaaaagaagaaaaguccaaccaccucaaguaagucauuuugucuuccuuugagcuucugaaauaaugaguuuuauaccuuauuaauaagugugucuacucuuguugcuuuuaggucauaccuugucagacuuuagguugaauuagggaagucguuuuauuucaagaccauagaaugauuucaauaggcuaauuaaauaaaaaaaaaucuucaccuuauuuuuaauagaauauuuggguuagaaaacacuuaagugccggaauaacuuuagucuccuccuacuuugccuuuuaugagcacuauuaguuaguauuaccuaaaucaaaaagaggugccaucaugucuagggagauggcuuagugggcagagggcuuauauagcauauucaagaaccugaguucugagcccuggcacugcuucagaugcagaacauagugguguggguauaacuaccucagcacugggaggcagcagcucucaggccagcccagcuagccaguuagcucuagguuuauuggagacccugccucaaaaagugugauggggaacaguugcggaagauacccacuguuugucucuggcggcuauaggcuuauguauccacaaacacacacucuguguccccugaacauacacaaaggcuaauugcagcuuagcugucuguccaaaauacuuucauaguugaauuaaaauaguauaauuuugccagccuuaaugauguaaauuaaaguuggaaaaaacuuaaaauuuacuguauuuuuagauauuauguugcuacugugugugaugauacauaccuggaauuguaguacucuggaagaugaggugaaagggucagaaguucaaggccagccugaacuacauagugaagucccgucucaguaugcccugucccacaaagcagcuuauuacauacuuacuguaaaaguuugagucgguauuugagagcagccucuguuuguagauuaguugguccuucagaaggaaaggucuaggcauuuuaggcaucuaagcuaaucuccaguguaugguuuuugcuauagaguaugaguucacaggguuuuuguuuuguuuuuuuuuaaaaaagcuuuuauuggucuuucaaagcacaaaaacuccagaaaagcuuugucauuaggggaaaaacacaggucaguaugacacugcauuuauauaugcauuuggucuguguugcuaggaugaaauccagggcuucauacauaucaagcaaacgcccugugcugagccauaugguuacaguccagaaaacaaacaaaaaaaacccuagaagccuuguuaauuuaugccucuaaauuauggcacagucacuauacacagcugucagccucaaaauuauuauacaguaauaugcugcugaauaguucgguauuuauagcuugcuuagaacuuuaucugccuuaagaaacuuaagucuuauucaggaauuuguguuucuagcagaacuauucacuggcugaacuggaugagaaaauuagugcccucaaacgagcccugcucagaaagucaagagaagcagacuccauggccgcucaccuuccaugagaccacucuugucacauugcuuuccuuuaagaugcauaugcuuaacuauuugcaguguauuccucaacauaaacuugucugacagcaaauagucagaugcugcaguguuuggaaaugauguacaucuugaccauugcacuguuggaacuuagucccuucuguuuuaaaggaggcauuuuggauauuaagcaacuuaauuugaaagaacuucuuuugguggacuaccagagauuauuauuuugauagugguauuuaaaaggacuuuauauuuguaacauugauuaaccauuuuuuuuuuaguuuauauuaguacuuuguacauaguaggcauuuagcaaacauuuauugacaaaaaauaaaacaaaaacugacaaaugaaugugua

SEQ ID NO: 6657 - RNA, 5605 nt, Mus musculus
guuuuaaucaggaaaaaaaccaucuuuuuuaauucguauaauuuauuagaagcuucuuaggaacuauauuuaagccaaauaucuacauaaguuacaacagaaaaaaaaaaaggauuggugcugcaaauaccaaacugccaaauaauauacacagguuugucaaugccccuugaaaaagugagggacuagggacugggacugggguucuuuuuacaacauaauguacagguuacuaaaaacuaggcauuuaguccaacuuuuaacagcauuuuacagcuacaaguucacaucaaaccuaaaacaauuuucugaaaggccagccuggacugaaccuguagggccagagggcgccugggaggggacacuuccuuugugucagguacaaauggguuaugcugaagacuuuccuaucuccagcgucuguccucccuucugaaacauacaaacaaacgaaaaauccugguauuuacaagcaagcucacuuugcuggcagggugcauccacagaaaaguuuuccgucuuuagaguucagggccauggaagcauagaacaggcuccaaaacugugccaugccuaagcuugggaacccauuugaacuaccagaaagacaccccaaauuuguucucuguccuucucuguuuaaagaauccguaaaggguugaauuugcuuggcuguuucuauuuucuuuuuauguuaaaaaacaaaaagucugcaaguuuuagauaguaaagagaaaggaaggggggaaagaugaaggaagaaggaaacagaagaggagggggagaaagaaaagaacgagcggggacaagaaggaggaagaggaggaggaggaggaggaggaggaggaggaggagaagaagaagaagaagaagaagaagaagaagaagaagaagaagaagaagaagaagaagaagaagaagaagaagaagaagaagaagaagucguccagcaguuuggucuuuguguacuuuuccuuggucuaaacauaaacagauucuuaaaaaaaguagaagcgcguggagcagcgggcgaaugguggucuuugcggaaggcagaggggaagcguugaggucgcgcggggcucaagcgcaucucacgucucaccagguccgaccauaaagcaagguagaacaagacauggcgccauaguccgagcccgaggaguucagaugggauaggcuggagaccuggcccugcagccccgcggggcuggcugcguggugcgccagguccggggacugcccugcgcugcccggcugguggccugggugugcuccuagacccgcgccaccgcugcccacugagauggccgcggcagccgcuugcgccgccugcgccugcugcugagcuuguugcugcgcguggcuuugcaggcuugcggcucccggggcaggggcgcccgccuggcaggguuugccgucuuugacuaggaccggcacggccacccggcgcggcgacugcugcugagcuugcugcugcugcgggcaucccgcaccgccaccgccgccuccgccgccgccgcuguccugcugcaguuguugcugcgccgccuuguccuuagccuggcgcuucaucuuguagcggugguucuggaaccagaucuugaccugcgugggugucaggugaaucaugcuggccagaugcucgcgcuccggcgccgacagguacuucuguugcuugaaacgucgcucgagcucguacaccugcgccugggagaagagcacccggcgcuuccggcggggcgcacugggcagcggggccauguucuugcucacgucccccagcgagcccaggccgcccaugccacucauauucaugccgcucgccgggcccaugaagcgggagacuguaagcgacaaacgcacagcggucggcuggggccggggccggggcaaccccgcuuucugugcccuuggccugcccgccccaacuuucgacggcauccuccucaccuaggccgccgccuagugcucuuucccaaaagaggcccagcuagcgggccgugccgucgaacuacuuaaggguuuaaagucuagcuacuccucauugguaucagugucccuuuagacccagaaugugcagugagggaaaaggguugcuuugacuccuuucaugcccaagccaggugggagacccaagggugcagagagcuggggucggacgguagaccaaguucaggagcuuaacaaaagggaguuuucacuuacaaacgccccagcuuccaggcgcuuggccucucuggcuuucucucuugcgggcucuaggugaggacagccacccgcccgacccacguagagccuccuccagagcugugcgcccucccaagccacccagagggagacuuuuagaaaucgaggcagcccgaccgggaugcaucccagcagggcggcucucucuacucgccccuccuggucccuaacuccucuggcccgaguuccuagccucccuagccgagucccgggugggccuuccuuagcucccugaagucuugagcaucaagucuguccuuggugccugcgguggucgggugcuagcaccuguccgcaggaccccagcucuucuaaguaccuccuuugaaacccuugcccagcggggggaagaaaguccagugcccucaccccacuccuacacaaggcuguucggcugcccaccccgaugcccagcgccaccggcgggcgccgcaccucgccggccgcgccgaccgcgccuccggugcuuagcccgcggccccgcggcggggcggccucacuuacuggcggggaagcgcgggucuggguuggcgccguaccauccggggcccgaagcgcuguuccgcaugguguccugguaaggcggcagcucgcucauguugcccagguugccguugcaguagccccccacggcggagugcgagagcuggggcacccccgccgccgucaugugguaggcggcggugacggcgccguggugccccacggcgugcugcugcauggccgcggccgguggggccgccuggcccugucuguacgcugcgagcggagccccgaggccgccgcccuccaugcccacuuucuuguagcuuuccuccaggggacucaagaugucagacacugagaacggagucgugugcuuuggacucaucgacaugauucggcgucggcuggaggaggaaggaagaggaggaaaaaaaaaagggagagggggaaggcgaagccucgcuacuuuuuuuuucucccuuugccaaauauucugguguuaccuuaacgccgaucuuguuggauguacacguaacggaguggaccgaguccgccuuaauuggcuugaguggaggcucgggggcugccucgcguuuguuuuagcccggcgccagguuuuaggcagccaccagaggcggggcauaagcgcuaaagcaacaagacaauagaagccuacaucuugcccgagauaauuagcuuacaugcugaugacaagguaaacaccuuuaagcuucacuugucaagauuuuuaggucucaaagagagaaagaaggagagagggagagagagagagagagagagagagagagagagagagagagagagagagaaccaaagcauuacuuucccccucccuuggacacccccacccccauuuuuguggggugccuguggcgcgcgaggaaaaggcgggggggggggaaggaggagggaaccgagagcgggagggccagaggugggguagagaauaaccuaaggggagggauggaaaggagaacggaaggugaauacugcuuugcaaccaacuuggggaguuacaaaguggaaccgcgguccaauuuggucgggguuccgaggucaggggcuggccuuugggggagaagggggcugaggagcagggagcgggauuucaccugagccugccggggcugcuccucccucccgcugcggccucccagccccgcgccuucccaccgccuccggaccacaucgggcuucgcugcgcugagccccagucaccaccaaaagagugugcgagucuggggaugaacccuggggcugcacuguuggucuaugugucugucagucugucugcuucuucugccgccgccgucagagggacaccucugcuccccgcccccuuuccccuuacccgagagaaucccagcgggcggagggggagcugaguaagggaacgacugccuccgggaggcugucaccgauccccgcgccaccccccaccaagcuccuggcucccuagcggaccagcccccccagcccaccccaccccgccgcucccuuucuccaccccuuuugccggcccaggcaaguacaccgcuggcccucugagcuacgaggcuaagggugcgggggauuaacaggagaguccaccacggaaguugccccaucucgaacaaaccuggugccccugacccuugcccauggccuggauacuucggcuucagaagcugaugcugucuuuccgaggacaucccagucccagcaccccagcucagauccccgcaguuuucccuuccgaugcuucagugaaagcccgggcggggagccgcgugagcgcccgcagauccguugcagaguggaacugagucugaacccggguggaacucguuguccgggaggaggcgaauaucucgacgcccgcagcccagcgggcgggaggcugggcugaggcucgccuccucccggagcucagccaugcaaaagugcacuugcuuccccgggaauaaccaaauaucuuugucuaaaguggcggcguaaauggccggucgcuuuguggccacgcuggauauuaguagaugaggaucauucugcuucaauugggcgccucucauccggcuaggaagaaacugcuuaggaggaaguggguuuccugucugagcguucccaggcuucaagugugagccccgcgccuugaggguccuugggcgccuggcaagggggagcugugggcugugcucccuagcgggcccgggggcgucagccucauugcuguuaccaggucaggaucagcagcuaaguggguuacccagccaagcccugcauggcacagauuuggagaccaccuccguuuuuuuuuuuuucuccuuggaauuuaagcguuuucguuauuguuuguuuuuguuuuggcuuugcuugucugcuguucgagcuuucuuggagcgcuagaggcugggagggcggagugcuuccuggcccggcaggugccuccuagacacuucggcggccagucaaggaggcuucuugauuuugguuuuuguuuucacauuuucuuuccccuccuuguagugagggagcucccgauaaugaacaagcaguuuugaacuacuuaauucagcaggguaggcuccuuuccauuaauagcaauuauaguauggaaaguuguuuuauuugcuuuuuaagaucucuccuugaagagugcucucuacucccucaacacaaagccgacgacuaaacuaacauuagcuuuccucaccaccuaccuccaucgugaagggaaggaaggcucugggcaucagcgggccucccaucugggcccgcauuuucgaaccgcccccgagguggcuuugaagcagggaaccccgacuuuaagcggccaggugcguugugucucuguagcuaaggacaagug

SEQ ID NO: 6658 - RNA, 3334 nt, Mus musculus
ccggcgccuguagguggcgcugcgaugaggugccggggugaagggaacucuggcugaagucugaaagacauuaaagggggaaaaaaaaaccugaagaaaauuuccacaacucccuuucugccucuccaccucggccugcuacuuuuauuucgggggaauagcggagauaauaccgcgggacucugagcucuauuaggggagagagcacagagaccgcuggacagagagauucuaccucacuguccagugucucgugcaaagaaaacauccugucaccagcuguccggagggaacgugcaaugauuuacuccuaggucgucgcaucaacgaauaugcuagugacugaccugaccgcuucuugugggcugaccuucaaaugccauaaaugaaccuucaaaugccauaaaugaaccuucaaaugucauaaaucgugucuaaagcccuaggucaacaguucgugcccauccaaagcuuggcuagucuagggcugccgacuggcccuaguaagugcucuucgaucccguagccugugagcagccccggaccccgacuguccgauaacccugcauagagcauaaccugaccacaguaacccgcacucaauucccggccuucacaauugcuguccugaaaucagaauuagaggcgcagccugguucuccuuuaucuuuuccaggcagcuuuaggcuaauagggucuuuccaggagucugccucauugagcuagcacaacaaacgcccauggggaagcucacaaaccacuguacuaaagggccccgcaguuuugcuuccccucuccccacgucccgccccccagcugcagcucucaaagucgaguggaagcguaaggucauucauugaaagaccaaggccagcuuccucgccaucauacauucacuacuaaaauugcaacccuggcaaaagcgaggucuccucuggacaauuacagggucaacggggccuuccccgacccccaaacuccuccuagucgccuucucucaguagagaccugauucaugcucgcaauugcugucccucagccaggaguauugcuccuugaacaaaaauacauucucauucucucucuaucucugucucucucucugucugucucugucucugucucugucucugucugucucucucucucuaauaaacaaacgcaaucauaccauaggaggcucaaagccauccuucuaaaagcaauuccacuguugaaaacugaaaaauggguguaauuugcguucagaaagugauguuagggucacggcaauuucccgggccguuauuuauuuuuacuuuaaagucuuuagggaagauuugcuuauagacucggauacaguaugagaaccccggcaaccccgcucgccuucaaagcgggagggggccugaagguggagaacaauuacugagugacgcuaauauggggaaacugaaaagaaaugucgauuguuuuuauuguaacagaaggagugagcaaacagaaaaaccaaccccggcugaucggaaacaggcaggcggagaaugaaaaguggguuucaggccgcaacaggccccucccuccccuggccugggaaggagcgagccgggcuaagcgcucgcuggacuccagcacuggcaucucgcgaccguccagccccugcucuccggggacgucuucccagcucucgcccacccucccgcagccucaccugccgcagaggaggaagccuucucgguaugcgagguuccuccaucuggcggaaggcugaacagccaguaagcaacgcuucgguagucagugggcuccaauugaaguccccugaagcuucuggcugcgcggguucguccacagcgucgucgucgccagcgagccaagggcaacaggucagugugagcgccccucucgcgcuacccuauccuucccugucagaagaucccuguagcuggcuccguccucagcccccagugcuuguuucuucuagcugcagccacccgccgcuugggacauagaguugcugggcgagccuucuugggugaaccuggccuggcugugguugcggggcgcgccgguugcccugacacuuucuggggagcuuaguugggugcgcugaacacugacccugcaaggcugggcccuaacugggaggccagauccgaaugagucuaguugcuuuuuuuuuaaagucaagugcaaugccacacucaccuaacacaggcgugcuguagaggaacucaacucgagguccagccuuugccugaaaacuucccccagacagcugcaagaacucacaguacugguuuuugugugucuuucuuucuuuucuuucuuucuuucuuucuuucuuucuuucuuucuuucuuucuuucuuucuuucuuucuuucuuuccuucuuucuuuuucuuauccauguccaggagcuguccuggacacuggcugcuucccaaggagcuucgguagggcauagugaccuggaccuugcuugacccaguaugcuccuagcaggggacaaguugcagaguucggugccuacauacucugcucuaacucccguguucaccucaaccgcgaguagaaaaagagacccuuccauucucgcgccucccccuacuuucucuuccacggucgcagucgaccuccagggacacagacgcugaguacucaccgagaucaagugagugcucacacacagccuagagugcugccuuccgauggcggcggcgacugcccggauacucugugagccgccgugggaagagcuagauuccacuuccugcgcaucucuccucagaccucgcucgugcccaaagggacuuggugcacugcaaguggcgggcccguggcauugggaccacugacagauuuaugaagacuuuacaagcaucgagccugggucguuggaggcaggguugaguucaacagaggaggagaagcccuggagauaaaacuccgcagcacugugcgggccuagcugccccugcauuucugggcuuggcuuccacagugggcugcccggugccaaguguguagaauccugguguaaccuccuccuucacacccucugguccucuagcuuccagucuccuacugaguaaauauuuacccagagaaggggucgccccagaggaggccuuggaguuuagagaaaggcuuuugguuuccuucuggcccgagccagcugcaggccuuucugguuguguuuugguuuuggucuuagauuuuuccuuucaguaaaaauucuccugauucccccaugaccucuuggauccagaucucaguaaccaggggcccuggaccucagugacccuugcucuuucuugaaguccugcaucucuauguccacuagggcucacug

SEQ ID NO: 6659 - RNA, 953 nt, Mus musculus
agcaacuuagagaaggcuuuauuuuggcuugcaguacaguguucaccaugguaaugaagggagcauggcaaagugcuuagucuuccaguuaaaaagcagagaacaaguggaaucugggcccuacgaccagugacccacuuccucuagcaaaggcucaccuuccaggugucccacaacucccaaacuccaacaagccaagcucagucaccgaucuuuaauaagccacaacuaauaaugggagucggggggaaaaauguauucagcguggacagaaugugaagaggaacauggagagccaaugcccucuccccauuucccaagucuauuucuaggacccuaauuagagggcagcaggaaagcaggcccaaucaaaagugugguucugcccuucaacaucaaacucuucugcaaaguguucugucaaguugauaaaccuaugugaacccccuuucuaggaaacaagaucuuccucuagcugcaucuuuacguugucuuccaugagacuucuggguagauuccaaauucuuaggguccauugccucaguagucugguagccgccaaaagaaaggacacaagugucucuuuaggauauuuccauucccgccauaacugugcugcgugaaauauaaaaaagcaucccacggaauugccagcuaggcacgggcagaccgccuaggucugucuccagcccagcgggcaggccaagcccauucuuuccuuuuagccagagccugucucacccacgcuaagcucccauggcuggcuauugccacgccagcucugcgcuucuuaauuccugcgacagacagggguguacucugguacacccaacucugccgccauaccuuucucuggaacccaguugaguugcugcgugaaggaaaacaccacacaaucuuaguuuagaguaaacagguaacacaauucuacauucuguccgccucccuucucc

SEQ ID NO: 6660 - RNA, 2361 nt, Mus musculus
ugaauuuugcucgggaugggggaggggccggaagcgggggcagcgaggagggaaaaggcuuccaacugacccaaguggaaagcuccaggggccgugggauccgccacgccacggaguaaacaguagcaccgaaaggccuuuggguagugagugcagcgccuuccugggaggggagccucaauaaugacuuucaccuuguguuuagaagcucagcucugaaacccuuuuaaaccuugauugaaaacaaaacaaaacaaaaaagagcccaagauaaggaaauucuauuuagcgcaacuaaaaacuccgaaguguucccaagcagaaggcagcucagcccgguuucugugagaucggccgagaucaccuucaaaucucaaagauaaaauccaauuucuauugucccuuaguggccucccacacuucagaaagacggaugggaaauaauaagcgaugaaaauaagcauaugcuagugaaguucuuaacuucugcuuucuuuuuucagaaggcggauuuuacugaaacuguuaaacauuuuuuuuuucucgaguuuaaccguuuugaaugaaccacgacaggagagaauuccaagaaugauaaaauuaggaaauucuguuguuuuggcauuuaaaauauugaucuuaguuccaggaaaaaugcuuauuaaguuucuuuacaaaaaaaccugccuugaucaauagaaauucuuuucauuacagacgaaaguaggagaccuguagcccaaauuaauuaaccuuuccccaagaucaauuggcuuucuguugauuuagcaguaauaucauagaacauuuagcuauaauguauuuuaaugugacacuucaauaugucaagagggaaaaaaccucauugaaaauaaaauugcuuaaauuauguaguauguauuuaauaaacuuuuaaaaauugucuugaaaauuaacuauuugcuugaauuguggauguguuuuacaaccaaaugcaguuagaaaaugccccuugguucaagauaauugagcgcaagaagagauuauuacaagccacccugaccuaaauagguaaucaaauuauguugaaauuuagguauaaaauuuacccaaauugaaaguguaauuacaccucaagagagucccaggagacuaagaauguaagggcaaaauagcauagcagagcucagaacgucauucgaaucaauccaccgcauagagaagacauuuuaaaaaguagccacauuaguucuaccuaagguuaguaguuagcuguccaaauacaucuaacauagacuucuuuaagucuccucuaccuuccaaauaguuaacuuugggacauaaugaugccauugguauuucucuuuuucccucccaggccagcuccauucauugaacuuugcacagcuggguuuacaagccucacccccgcccccuuuccuccagcagugugggacuggagaauaccuaagaaguucaguugucaccuguaaaacacauuuucauuccaaacauuuuaaaaccugaccuagggagaagucacucacuuuuacugacuuucuugccucuauuucucucuagcucuccaauugcuauagcuacgaucacacagcucugcagccccgcgagcggaggcuuagaaaugcuaccucaggauacuuuggagugcgcuaaaacugcaguggacuuggaauuucgaggcaggguaucaucccuuaaaaucuggggaggaaagggcuguguuccgggcuuuagaauccaggugagaugcuagucuguugaaauccgacacagaaccugaccuggggcacccggggaaacaggauucaaaguucuacucauaaagucgccuucuaccuucccaaacuccucuuaaggauuacacauaggggggcccugaagcccuugaaccuaagagaaaccaccuggaaauucuccccuccacuccaaagcauugccuggaaauugggaauaaucaaagaaaguagaagucugggguucuucccguuuccucugaaguuuguuccccuauugcuuguccaaucaccgccucagauucuccuuuucuucuucuuuuccccuuucucugacaucgagaagcuauuuuuaaaacgucgauugaaugagaagacuguaagggucucuguggagguuuguuucguuuauggauguaauuuuaaggguccuuuacgcaggagggaggaaaucagugucuuguaucuucugugcuccccaacaccgguuuucucugcacuaacuaggcggcuggaacguuuuuggugggacauuugucuagcuuuggguuccaccuaggagcuuugagcuucacgccuagacgcccaguuaugaccauuuuucagguggaggcggauacacugacug

SEQ ID NO: 6661 - RNA, 6438 nt, Mus musculus
uguaaaugcacucauuuuauuuuaauuauaucccuguuuuuccuugauaugaaauuucagaauuugaaaaauauaccauucagaagaccuauuuuggauucuaauuaaagaucuaguuuggauuuuaagugaaagagaaaaacagaaauucuuugucguuaacaugugauuuauuuaaauuccuuaacugcaaaugaucaggaacauaauccacagauuaaacucuuguauuauuuuuguuauugaaaucaaaauaucuuaauuacaaaucacaucgauaaaaauuaacaucuuaauuugucaauuuaaccaucacuuaaagcaauuucggcuguaaagaaaaggaguaaaccaugcaauaaauuaacauugagaaggcaaagaggaauaauaaugaaacccguuugucuaaaacuaacaccacguccaacuguggaaagugcauuaacacuggaugagccaagaauaggauggcaagaacuaaaauggccacaauugggauuuuggaauucgggaccaaauuuugaaaugcauuucuuauaacuucucucucaauaguaugauacuuccuuuuuucccccuggagugggggugggggaauccuuuaaacgguauacauacacaaaagcuaauuuuauacaugugaccucagcaugacaugaccaugauggcucucugaaaagcaagagcagaauuagggaggaaggcaguuccugaagaacuggauuuccagcguagguggguagagaggacaaguguggagaggcauccuuguaacuuggccagucaggcaauuuuugaaaaugucuaucaccuagcuauuaccucuacguguuaugcaaaguugaacgaggucuucauaucugggcaugauauuaaguccauagacauguauauucauuucacuuaaggacguccgagaucugaaugcauccagaauguaaggugaaagcaaagggcuccaaugugcauaaccgguuuauaccuuccugcauaaaggcagcacugccuuucaauacucucaagagccccuacugucuacuugguuucuuuaccacuuccaucuuuacugaguuaagaguauugccacagaccuguaaacucguguggugggccuaacaacaacaacaacaacaaaaagagcacgaacaaauauuuuacaaacuugaccaucuucuuuuuaaauaagcccugcaggaacuagaauguguccgcaggggaaggagugaaagggagaaaggggaggaagauuuucuauauauacauuuguggaucauuaaauguugccagaaaaaaaaaaguguugguauggagucgguaguauuugugguaauacacacaaugaguguugaauacaauaauaaaguaacaguccuuugaacuggggaaaauugugcgugaaaaauaaaacuauuuggaauuuuauuaugugguugguuuggugugugugugucugugugugugugugugguuuuguuuguuugcuguugguuuuucucuccugcuaccagguuggccaugcagacaaaacccucaguucugggagcuaggaaguauuuagcacgggucuggaauacacaccuugguaguaggcuggcuccagggcugagggcucgauggggcuccucguggccacugaggcgcugccaaggggcagacuggcgggcaagguagcgccauaaggagaguacugcagcgccugcucguaugccuugaaguccagcuugugcuguugcucggaggaggacaugagguuguugauggagaaggggugauuaaaggaguaguggggauccccuuucagaugcagcugagauucguggggugccaggccgugagccgggugagagggggguacagaugcuagcgccccuggcccggagcuuauggggggcgcagaugaagacgcuggagacuucaacuccgaagcgcccccugucgccguggccccgcugugguccagagucugggggcuggcggcgggcccuggggccggcgcgcccucuagcuggcuagccuuuccgugcacaccccggugaaggggugacucggcgcugggguuccccgggccugagggguccuugcgacuuucugggcccccuuuggagccgccgcccccacucccaccuccggcccccggcugcuucucacacuugaagcgcuuuuggcggcgcaaguagcagccguucucgaacauguugccggaguccgggugcagcguccaguaggagcccuugccuggcuuguccggggaucgugccaccuugacgaaacaaucguugaaggacagcgaguggcggauggaguucugccagcgcugcugguucuggcgguaauaggggaagagguccaugauccacugguagaucucgcucagcgugagcaucuugcugggcgccugcuggauggccaucgugaugagcgagauguaggaguaaggcggcuuggcgugaggguagcugcgcuugaaugucuuggcgucgccgccgccccccgcgcggcugcggcccagguuggacggcgcguacgccaugggacucaugcacggguucauggcggcggcguagggacccaggccguucauggagguggcgggcugcgcgcccauggagcccaugccucccgggcucagcgccguacccauggccgugacgcccgccgcagucaugcuguucauggcgccugcagaggccccuggcaugccagccacagcaccgggacucaggccggccccuaagcccguguuggcguaggacauguugaaggaagccggggucauguugccgcucguggucaugguguucauggucauguagguguucauggaguucauagagcccaggccggaguucauguugcugacagggacagaggaguaggccuggagcggagacagcgagggaagaggccccgaagggcgggguuaguagugugccccagaguuuggcuggcccagggugagcccggggcgagcuaacagcauuucugcaaagcuccggaacuccccagccagggcaaacuguuaggcgccuuuuccugaccacgcaaagauggcuuacauagcgggggcgugggggagaauccuagcgcugcaagcaggaaagauuaaugcucacagaaaauauguccccgggaagaugcauaaucgccuuacaagccuggaucaggggcuggcuuuuaaggucccuucauuucauccacggcaggcuagauccaaggauccaaucccagaccagccuagacaacuugccuuuuggcccggucaauuuugaaauuccgaaaauagaauuuaugucggagccccugcuucuucacuucacccacacaggccugcuugagugaucaaccggguaccagcuagacacccacccuguggagggcuggcaggcaccgcugaucgcacaucgggaugcaucgugcuggcugcuguuaaacucucacccauauuggccuauuugucaauaugacccucccuccgucccaauuacucaucucccagcaacuggcuuugucuuaagaguuggugccaaagaugacuuucuguuauuauauuuagaaauguuuuccaccuacuuguaacaaugauaguauuuuaaaaaagaagcaaacuuaucaguuaaauaaaguucugggaaaaaaaauaaaaugaaaaaaaaaaaaaagcugcacaccagaacaacgcggugcauacaauuaacuuuagcgugacuuugcauguauagcucuucacgcuauacaaaaccucgcguuaauucuguuaccuguuuguaguccucuggcaauugaaaacuuugguaacacaauucacacacacacacacacacacacacacacacacacacacacacacacacacacccuguaaccgauaguugcugcugcucacaccaaagccuaggcuuuagagcuauaguucggaccaacuuaaaauucccaagugaaacucuacuugcuuucucuuaaugcuauucugcuuccuaauucucagcuuugagauguaagaaagcucuuucuaugggggucuucucuggugggccgaggugauugcaucaaaauuaaacuccugaaaguggucugagcgccuacuaaaaguuaucgguaagcgaaaucuccauccguagcagucgagauaauaacuagguggcuaaaaaacaagaguccugacguauaacugcuuauuugguaaucuaacagaaaauauugacguccuuaaauuuauguucaucagcaaauguaacuccaugugaaacuauaagagaugaauagauuucaaaaagaagacucaaaaaagagaugguucccaaagaaacacagaaacgaauaaauaaaucgccgcgaaggucuuuucggacucuguacuuuucuguacagaucuuaaaguacuuugggauuuauuucuaguccucucuccaagaucgcacgaggcuuucucgguaagcgcuuucgauaacgguaauuacacuuuugaagguaaucggcagcuguuucuagaaaauacuuucaauagguaguggcccugccuguaccugauucuccucgcaaugcuuuugugcacaauguaaaauaaacccagugaacaugccaccaaggggacaaugaagagaaacagguucuuggccccgaguucuggaaaaagauucuguucgcacuagcgccacccagcgguccuagagacgaacgaauagacacuuuucuacaaauggcuuuugaagaauuaaguuuuauaaaauuuagaaaucauucuuuacgaaaaacuccaacuucugcaacagaucauuuuuauccaaagacgucggcuaauuacauggugugaccgagaggccucccgguaagcgagcaccgacucucucaguuauucuuuacucaagccagagcccgccugcccgcccgcggcucccggggcugggcuccagccccggcucucuagcgggcaaagacaagugcuucccuuccggagcccguguuuucaaagcccagaguuucccaaaacucuccgcugguugcaagcgccaggacccagcgggcagcgggcugaucgagaggucgggugggggccacacuggaagccgcgccucgggcgagccgcccccaccccgcccgccccaguccgggcaggagcccaccucgccugagucuccccggacaccgacucuggggacgccccaccgccuccccgccucucaccuccugcguguccgcguaguagcuguuccagucguugcucucaugcccuuccaucuucacagucccuaacauccuggagccagcccggccgacacaaccauccaacccugugcggagcgacgggcgggugcgcugcucggggcgggggaggggcgcggagccgcugcggucaccggagcgcucgagggcccagcgccacccgggcgaggaggaagcccggcgcugcggggcgcggcgugcgcggcggcggcggcgcggcgcggcgggagggggcagcgccggggacaggaggcggccgcggagcgcggcgcccggcagcgccuccgcgggaagugagcgggcggccugugcgaagcgagugcaguugagcugauguggaucuuacgucgccggagugcccaccuccucguccucuccccauuuguccgccgcacaaagacgcucgcaccuacaaagcccgaggugcaccugugaggcggccgcccgccaguccagccgccgcgccucccgccccgccgcgccagcgccgcgcgccccccgcgccccucccgccauccccucccccaaaccuggcccucacuuuguuuacaaagcaguauaauugguuuaagccucgcggcuagggaaagaggaaaauagggcgggugugugugugacccccuuuggaaaaggaaaaaaagagaaagaaaagaaaaggaaaaaaaagaagaaaaggaaaaauaggcggugccuuggaggacaggccagggcucuggacccaaagagcugugcugcgggagaaggaccugggugguggcaucagagcuacagcgcaaggaucgugcucgcugaaugaccccgaguucccuccuagaggugcucaccacccccuggaccuuacuacgacuccgcucuugguccacuuggcuccuuugcuccccucauccugauucuugacccaaaguucaacccuggaagacuaccccuacuucccggccuucggggcuuggagaggggaaaagccccacuuuugccucgucacuagaaacccagucaucugagucagccgagcaaagugacguuaggccgaccugggcuccuggcgagcagaacggaggcgcugccacgaaacucguaccugcggcuaagagcaggugagucacagcaccguuuuauauuuuuaugacauaacuuuuuuuuuccgccucaguccacuccacuccccuugucaacugcagcgaucagaaagaggaagaaacugcgcgcagauguuug

SEQ ID NO: 6662 - RNA, 492 nt, Mus musculus
auuuuuuuuuuuaacuuaagcagucuuuaaugaaagccgugcaugggaugucucuacuccuccaucuucucgaucguuucuuccuuguauuugcccuucuucuucccuacuugucgggacuuggcuuuccucuccaggaucuucuugcaguccuuguccaguuuuagccuggugauaaccaccucacugggguggaugcccacguggacaguugugcuauuagcuuucucucgauggacuuguucaauguggauaacguauuuuuuccuguacacuuggaccaccuugccaaucugcuggccuuuguagugaccucgaacaaccugaacuucaucauccuucugaaugggcauagaacaaacauuauacuucugucucagcucuuuggaaagaggggaagacaugaucuuccuccgaaugugagagcgugcauugaaaugccguuugugguucuugcuucugucagaagucacgaagggauugaacuucauu

SEQ ID NO: 6663 - RNA, 53639 nt, Mus musculus
uccccuuugacguggcagaggcggcaccagccauguuguccuggcccaggcccuccaagaggccgggggcggggcggggccgccccugauugcggugccacggcugcuacagggcuuuggagcggacugacgacugugcaaggcggaggcuguggccgucacggagcuucuagguagguacugugguaaggacuagcguggcagccaccucugcuccaccggggucuuagucggagcugggaggcgggcggcgggccggagugucaggauuguuggcucugucccggcugugcucucgcauaagcagcggggcgugccggaggcuguggcccagcgccgaaccgagaucgcugaacccugugcuugucauggcgacggagcgcccucgucuuuaguccucuuaguuuagguggaaggaccguagcaggauggagaccgagggucugagcaucuggcucugcacccacccccaccuccugggugacacgcuuugccaacccugcccaaggcuccugugcccuggggccucuagguucguuucuugacugcccaggagugcccuagacuuugaacccaggugacuacaucaccuguaauucggccuugggccuuauaaagguuaaagaaaaaaccaccagguauagcuagugccuggggccuugauuauuaaugaucagguuucagaacugagcaauaccaugcacuggggcauuuauucugucuguagagcuuuacuguuugugggagaggaacaggaagagguaaauaaauccauagguagaguagaguuggagaugucuaauucaucucgucagcuaaacuucuguccugucuuaacacaaccccacccuaaaccacggauagcuaggcacauuuacugaaagaaauuuaaauuuaaauguauacuaacaucuuccuucuuuccagcaucaucagagggccuuuguuuuuuaauuguuucaaugaccaauuuuauuauugcccccaaaauucucacauaacugaugugaaauuugaaggccagagaaguuuauugcccaagagcaaaaauuuguuacucagucuauuucauuggaaauuuuacaacugggccugggaagauggcucagaaguuaagagcacugguugcucauccacaugaauacacacacauacacgggcacagaaacacacacucacacagagaacucacuacuggcuuacaaccucuuguaauacacuuacacacacagugccucauuaccuauuuacaacgauuuguaacacacccacauaccuuucaucucaacccccagcucacuagugguuaacaagcaacuccauugguagaggauccaccacccacuucuggcuuccacagguacugcacacacauaguauacaggcagauacaggcaaaacaccaauagacaaaaaugaaauaaauauauauaaaagaaaacuugcaacugaaauguagggagguaaggugguaacagauaacuaauuuacuuaaaauuuguauguuuucccauuaggaaugcauaaggggguaaaaauggaauagagaaaaccgauacuaugggaagccuuucaggauguaggaaaguguuugcuguguuaugauaaagugacaugaggcuuugacucuaucaggagaaauuacuuaauuaaaauagucaucacugcaauaaauuauugaaaaaaugugacuuuuuuuuaaaaaaauggccuuuuguaucuuuaucacguuuuaagaagaugaguuuguaaaaucugcauuauaacaauauuucaggauguguguguguguguauguguuucaaacagggucuuacuauggcaggucuggaacugacaagagauccaucugccucugccuccuacgugcuaggauuaaaguccuguuccaacaagcuuggcucuauuuuucggcuaauguucguauuggaugaucaggcgcuugccaaauagaucaucacacuaaggagguuugugacaggacuuuggaggugggcuuugugauucgaagcgugaacgguuacuuuggaaagagaaggaagcugugcaugaccauguagcuggacaaaguaagaacagggugcugcuugcuucagaugacugcugggcagugagagugcuaagauguucagugaacagcagugaguggcauuggagcgcagagagagguugagagaaaaaaacugagcaagagggaugauacugugcucacauaucacucaggugacgcuuuguuuguccuaauaaaauaugaggguguggaguagaauucaguccaggggccggagagcuggcucagcauccagagcaucggcugcucuugcagaggaccaggguuuuucuagcacccauguucucacagcugucuguaacuccaguuccagggaaucugacauccucacacagacauauacaggccaaacaccagcggacauacaauaaacaugaaucauuuaaagaagcauucuggauggggguccaguacauagccuacuguagaaauuucacccugcuguugccuaagugugaacacuuucugaaucuuuuaauaaucuuucucacugagagaaaacgaaggcagugguucuuaggaccuucuucuacuuuuaaacaguauugaggauccaaagaaaaacauguuuacuuuuauauccuaaaaaaaacaaaaccaaaaauaaaacaaguaugugaagacugcauucuaacagaggaggggggaggggaagcaaaaaagaugauuuucauucaugcagucauuuucuuacguaugaccucuguuccuucgcucuucucccacuacuuuuaguuauguuucuuugagacaggguuucauucugucaacugguagcccagguuacagcaauccuucuaucuuaguguccccuagugcugggguugcaagcaugcaccaccaugccuuucucugcugguuauaccacuugggcuuuuugcuucuuuuuccgaggacagagccuagugaacaggccagcaacagauggaaagucauucaagccugcugguuuccaucagccucauccaucagugugcacggcucacagaauuaauccuagauaugacaacaucuaaguucuuuccaacuuggucuucucagcauuuuuauugacuagaaacuucucaguuuuggaagaaauccaaaucaagaugcuauauuggguaucuggugagggccugcuuucuggugcguacguggcacuuuguaguuuauuuuuacaugcagaaaagacagcagaguuuucuggagucuuuuaaaaguaaggccacaaauccuauccguuuaaaaucagguuuuuuccccauugucucucuuagcaacauuaauauccauauuuguucuucugacaauguagguccauggauuuuaaauuauuuuuuaaaauuuaauugaaaaaacuuguuuuauuuuuauggauguuuugcaugcaugaaugucuguguaccacgugggugcuucuugcuucagauucucgaggguacuagagucccuggagcuggagccauagaaucuggauguaagcuaucacguggacacuaggaauugaacccaacagccagugcuucuaaucacagagucaccucccuauccgugccuaccuccuuuuaaguuucuuuuuuacuuuuuuuuuuuuuuuuaauguguguggguucuuugcuugccuguaugucuguguacccacuugugugccuuagugucuuuggggggcagaagaaagaaucaaagccccuguaacuggaguugcagaugguuguuaguugccaugugggugcuggaaacagaaccaaguuguucugcaaagagcuaugaguauucauaacuauugccaucucuccagcuucauuuuuuuuuaaaccugauugucuucauuuugugcauuaguauuuguaauucuauaccuuugugcauuuguuuucuuuagccuucauucaugacuaaccacucuuuccagcuuuagagccagaggcaggacuguccucuagcuggggaagccagcacccuagccagccaguuagaagguaauaggauaccugguuguggugauacauguuuauaaucccagcacuugggaggccccagcuggagcagggagguuuucaggauaaccugguuuuagagugagacucuuucaaaacaaugacagcgacaaacaauagcuaggaagccuaaacccuccuaggaauguaaaguauuauguuaaaauuauauaucucaaaugcuuugacaaguuaggauuuaguuccugugagaggcucuguaagauguaaguccuggggauagcacuuaauaggcauuuuguuuaucaugccauuaguauucuccacccagcuucagaaauggcagaaauggggguggguggguaugggggacuuuugggauagcauuggaaauguaaacgaggaaaauaccuaauaaaaaaaagagaaaaaaaaaaaagaaaugacagaaguacuauuacauggucuccuggaaagucugaugagaacuugucacuuuauaaugaaaaacuaugcauauuuuauaacuuuaugauuuuuguaucuguuuauuaggagguuagagggcaccucaguucucucccucuaccauguuggucccagggaucaaacuguucaucagacccuccaucaagugccuuuaacccugucucacugguucuugucaacaauuugaagagugaacaucucuuccucuuacugccuugugaguguuaggcucaauucuuaugaggcuuuuggaucuuuaaauaucuuuugacuuauguuucagacagaaauaagaaucaagugcuaccaugacaaccuauuuggaauuuauccaacaaaaugaagaacgagaugggguccgguucaguuggaauguuuggccaucgagucgucuggaagcuacaagaaugguugucccaguggcagcccuguuuacaccucugaaggagagacccgaccuaccacccauccaguacgagccuguccugugcaguaggaccacuugccgugcaguuuugaauccuuuaugguaauuaaauacauggaaaaacuacugugcuaauacuguuuagaacugcaauuugugcucucuuagcuaagccaaggggagugcuuaccuagcacacagagggcucugggugggcucaaccccuagcuucacauaaaccagcacacaccucugaucucaguacucagagaguggaggcaggggaauucuguuaagauuaucuuuggcuacauagcaaauucagagccaaucugggcuacgugagaucaucucaacagagagaaaaaauagauuguuucuuguucauuuauauaagaaauccauuuuuuuucuguuuagcguuauagucaaguacaaagaacuuaaaauuugguaugcuagauauaguaaauugguaaucagacacaaaugucauauaaaaacuauuauauccuauuaagaauacuaaugguacuagcuauguaugaaccuaucuuaugacuuggucauaauugaguuggugugauauucaaaaggugcuaauauacuuugagacagaguuucucuguguagaccuuggcaggcauggaacucagagauuugccugccucugccuccugagugcuaggauuaaaggugugugccaaccaaaaggugcuaucauaucuaaggcaaaauuucagaaaacauuuuaaaaauuucuuuuucuucuacuucuucuaucuagucugcuugugaauguagugaguucuaccuccaaaacauuauggauucuuuguuuuuuacuugguauuugcuagugcuggauuagaggugugugccacucugccuggcucaaucugucuuuuguaucaaugugcuaucuuacaucuguuuucuuucugagccuugagcacaccaacuuuaccuacagccugaaaucuugcaaccuuuuccugugguugacuucuuuuucuucaggcuguucuucaaguucugcagucacuccuuuguuuuuauucgccuuuaucuuuguuguuguugauuuauguuuuugaggcaaucucacuauguggcuggccuggaacaugcucuguagccugaccagccuugaacuugaugcgcaguggucuugcuucugccucauaaggauugggauugcaaguguacugacauggcuggccagaaggcucugcuuaaaggagcuguuccaagcacauucucuagaacuaucuuuguuuucuuuaucuguuuaaugaaaaaauaauuguguguguguguguguggacauguguuugugugugugcacaugugugauacuguguguguggaggucacuggacaacuuuuuggaguuggaucucuucuaccauggcucuggguguuggacuuagguuguuaggcuuucuuggacagcacuuugacccagggagccaucuugcuggcccuuuaaucuuuauuacugcuacuuaaguaauguuuucagcugggugugauaguaaaggucacuccaaaaaacucaacccauucucaggguacaguuuaguuuagugauaaaugauugccuaguguguaaggcucgggguucaacuccucaugccccaauaaaaaccaaucacuuugaucaucaauuuaauccauucaugcauuugaaugaaauuaauuuuauuuaacauaagguccuugugaaauugaacugaaauguugccuaacuaaucuguuuuuucuuacaacagccaaguggauuaucgagcaaaacucugggcuugcaacuuuuguuaccaaaggaaucagguagggacaacuuuuacagaugcugaugcuguagugcuggucauauagggaaaugcuuguuuaaaaagaauaaagcaguuagaaaaaaauguucucuuuuucuuuuguuuucuuuuuuuuuuuuuuuuuuccgagucaggguuucucucuuagcuguccuggaacucacucuguagaccaggcugaccucaaacucagaaauccaccugccucugucucccaagugcugggauuaaaagcuugcaccaccacugacuggcacaaaauguuuucuuuucauuaaguuuauuggcugcguguaggugggcaugcauacgcaauggugaacggcagaggacaaaugagggguuugguucucugcuuaaaacuuacgggcccagggaccaagcuagugaggguuagaagcaauaccuugaucuacugucaucucaccagcuagaaauaccuucuuaguaauuauaugagacuagacuggucuacagugaguuucaggagagccaggacugcguggaauacccuguuucaaaaauaaaaacaaaaaagcaaaaaaacaacuccccccauucccgccauccaaaaaggcaaaaauuuaaaugauaaggaaauaauuuugaauuuaaaacuguauuucuguuucuggcaaauaauuugguaaucuuuuuucuuuuucuguuuguuguaguuuccaccuacauaugcugggauaucugaauugaaccagccugcagagcuuuuaccucaguuuucaagcauugaauauguaguucugguaaggacauagaaguagguauuuaagaaagcuauauguagauaagggcuuaugugaaaauugagaugacuuuaagggcaugccaacaaaucaaacugaggauuucaaagguaagaacugucaaggucaacuugcugaaagccauucccaacuggaauuaucuggugauuggucagauccuaggcaggacagugugacuugguuaguaagcuugagcguaugaacuugauuuuauaauuggaaguucucuugccguggacuuagacaaucaaaugcuaagucugcugaugugucccugaguuuaugaaugaacauguccuugaauugggaaaauaauuuuucuuccuagugugaacagcuuuacagcauugcuuauagauuuaauuguggagagcugggcauguuaggucaugccuguaaucacagaacuuugguuguggaagcagaaguaucaggaguucaagguuauuuuggucuguaaguuugaggccuaccuggacuuuaugaaauucugucucagaacaauaaaaauuaaaaaaaaagguagaaauuuaaaaacuaaauauauuuuugagacucugucugucucugaagcucuggauagccuccaacuuccuguguagagcaggcugccacugacugccuccugagugcugggauuaaaggugugcgccauuacaccuggccaauaaaaaaccacugaaugugguauaggaacagauauaguuauguuucacuugaacuagucacuacguuugucagaccuggguaguuuuugauuuucugaaaagucauccucagucuuagauaaauauuuuauaaacauuagcccauuauuauuuauuaguuuaaaaggauuuaaauaaaacugcuggucuggcucagugguuaagaauaguugaugcucuugcaggggaccugaguucaguucccaucucccguggcauuuuguucaaaacugccuguaauuguaacuccaguggaucugaugccccgcucuggacuugagggcaucugcauuaacauauccacauacccacacgugggaacucaaacauauauacaucacuaaacagugaaauauacccaaacacaaauaacuugaaagaugucuaugcuuacagaaauacaaucaugcuaauuaguagaaugcuauuuaacuuauucuauacaauuugaccaaaaacucaguacaugguuuauauuauuugguuuauuuuuuaucuagcacugaacuuugcuauuaaaccagggaaaucuugaauauauuguucuaagugaucccuccccaacuaaagacuaaaggaaugcccauaccugaccugaacuuuguagcuguuaaaguauuaucugaaaaauauuucaaaaauuauuauuauuaauguuuauucauuauuaguggcauagucucauguaugucaggcuggccucaagcuuacuauguagaugaagauggccuccaacucuguuccuuccccucugucuccccaaugcuugugcgcauacucagucugaaaaguaguaaaugcuuauaugaaauuaaacuacauguaaccaaauaggaaaccaaaguguucuuucuguguguggugugugguguguggugugguguguguguguguguguguguguguguguguguguguguguguguggugugguguaugugugugugguguguguguguguguguguguguguguguguguguguguguauguguguguuucuugagacaggaucuugagguauaguccuggauggccuggaacucaaagagaucugccugccucuugccucacaagugcuaugacuuaggguguguguuagcaugcccagauaaaugugcgugugugugugugugugugugugugaguguguguguauucugcuuuuuguggcagagucuugcugugaauucagauuggccuugacuguugauucuccugacugccuucugaguuuugacaucaauggugugcauuagcaugcccaguuauacauaugcuucuaaauuuaauuuuuacauuuaagauucaugaugaugaugaugaugauucugucucugugcgugcguguaugcagaugugugcauaccauagugugcauguagggucagaagacaauuuucagaagucaggacugaccuacuguggguccuggggauacacucaggucaucaggcuugucccauagugcuucuaacgcugaguuaucuugucagcccuuuaaacuuacucucucagugcugugcugugccuuggaucucucuccaggaccacacauggcauguuucauuucuguauagcuuucuuagaauuccauuguauacacucuuaauauauuuacuguuugcauuuuuaauuaguuccugauugucuugaauauugugcuaaaauguuaauaccuuucuuacugcacuuucuuuuuacagcgugguccccagaugccuuugauauuucucuaugugguugauacuugcauagaagaugaggauuugcaggcucugaaggaguccaugcagaugucguugagccuuuugccaccuacagcuuugguuggacuuauuaccuuugggagaauggugcagguucaugagcuuggaugcgaaggcaucucaaagagcuaugucuucagaggaacaaaggaucugucugccaaacaacugcagguaagggggagcgcgaggguuggaguguauauguuagugaaugcucgcuagaugcauguauuuuuuuaaaaauaggaugacucauucuguuauaauuguauuaauacaaggcuuuagcuuuaguguugacaucaguuuuauuucuugugcaauuuaacugucauacaaaugaaagacuuuucuacuuaacauagugugucugggguaucucuccauaaccacauauguaaccuguuucauuucugugauggcuuuauuagaauuucauucuauucacuuacuaggaucucacugugugcauuguuuagauagucacuauuucuguauaaaugcauguguguggguggaggccuuagggcaaccuaaugcauuguuagucaucagguguccucuacuuugucuuuuguuuuuugagacaggaucuagaacuugaugauuaggcuaggcuggcuggcccuugaagccccagggauccauucaccagucucuaccacucuaguggauuacagguuugcuccauuacacucagauuuuuuaaugcauugugggauugaacccaggucuucaugcuuuugaggcaaacacuuuacugacuacacuguagauagcccaagacuaucuacuuuuaacuguaccuuuaaauuuugaugugacugaaggcauuuuacuggugucuaccucagccuacugagugcagggcacauguuugcaucacugugccugucucuaaagccuguucuuuuuguagguuuguugauaaggaaagagacaguuugagaauuuguuaaagauccuuugagaugguugagugaguuuacguggaagagaaagagacuagagagcaugagugaaagagaugagccuagggcagcuuccgaggaggagguggcguucuguuuggaggacaggaggcagaaaaaggaggaccauuugguuuugugaagcuggagaaguggguacagguugaauauauagcauucuuugaaacagaagcauuuugcaaguuucaaacucuauguagaugguguuggucuuaaauucacagagaucugccugcuuuaccucguaaguacuaguuuuuuuuggaauauuuuuauacauggguaugggaagggugggauacauucucagaaaugugucauuaggcaguuuaauuaugaugguguggacauagaguacuucuaucaacuaagaaguuauggcacgauaggcgauguacucuuuuugugugguccauuauugacugagacgucauuauguggcaugacauuguauagaaagagauauuuuggggaugauauccaaguauaaguuaaaauaauugauguuuaauguauaugcuuauagacacaaccugaaugcaguuuuauggaauauguuuaguacaucuguacuucacuguagugcgucacaugacgccauguguggaauuucccauuguggcgcucuggugacacuuaggaacacucagguuuaggagcauucaggguuugaguuuuuggauuaggcauacaagccguuagaaggaugucugcuucucaggauggucacgagaauacaacagauuaugccuuuagaugcuugcuuucauuaauagcaaauuacacauauuuuuuuuuuuuuuuuuuuuuucgagacaggguuucucuguguagcucuggcuguccuggaacucacucuguagaccaggcuggccucgaacucagaaauccgccugccucugccucccaagugcugggauuaaaggcgugcgccaccacgcccagcuuaaauuacacauuuuuaaagagaaguuuaguucucacuguggucacuuaaauuauauaauacaaauguggcaucaagaacaggcaagugauugucaauacaacaaaaguguucuuuuaauauaacauuuuuaucuucuuucuguguucagcuaaaaagaaucuggccuuuuugcauaaauagucugagauuccaaugcuaaaaucuuauaguuguuuaauuguaaauuuauccuccuggugauauuuaguguaguguaaauagcaaaaucuggauuaaaauccuaugcuauuuacgcuaaguaaucuaaaauuuuuauaacugcccuuuuugucuuuuuauccucccaccuuuaaagauuaaaaaauguuacauuucuuuauucucccccccuccugugugugugugugugugugugugugugugucuaauaucacuaggauacugugcacacguugaaauuaagggacagcuugugguauugguucugucuuacaugcugcaugcaggcccugggaauugagucuaggcugucugguuugacagcaagcaccuucucaugcucagccaucccuucccucccuuuggaaaucacgccugucuauggaucccagacgggcuuuguuaaaucucuuuccggaguaguucgugcaucaccggaccagcuugucguuacuaucuuuugugagaguaguauuucugaagcguuuagcucagagcuuggugcauagugaaaguugcugcuucugacggcaguccaggagcgcuggagaagcaggucaguuauuuucuuugaggaauaugcagaguuucugauugcuaaguauuuuugccauaauacuaaacaauacuaggcauuucuagauuaagaaaauugcaguaaggugacauuuuuauguauagaagaaggauuauguacaucugugaaauccaaaacaaaacugggauuuuuauaagucauuuagcuugaaaaucuugaauugauuuauauccccaaugugauucuauguacuguuuuuuuuuuuuaaacagauuuuuuuuuaaagugugugugugugugugugugugugugugugugugugcaugagggcucaguugccugcagagguagaagagagcauuggauucccuggagcugggguuauauguggcugccggccaccugcuacaggugcugcucagacccuggucuucuguaagagcugcaaggcucgcucucagccgccacgccguccucccuccucucuuuaugugcuuccucaccgcgaggaacucacaguucuguacugcuuuaguagauagcuucauuccuuccagauuucuaaccaccaugggagcaucgaggguguucuuaaaaccacgguauuccugcuacagaguagguauuuaagauaauaguugcugaaggggaugaaugcguuuaagcuaagaaagacagacauuuauguucgucauuaauguauuaugacuucauuggguaagaaagaaguacuucuaaauuaauauccuuuuccuuccauuacaccuuguacuugcucuucuggggaauugcuguggaugggucagccuccacagcuagacuguuugccuucugggaaaagcaaacuuaugcuuauuuuggauuucuaauuuguagcaccuucaacaucuuaagaagcugauaaauaauguggaaguaaguaaacugaucugaucaaaaucaugucuuuacaggaaaugcugggacucucuaaaguaccuguuacucaagccacacgcgguccucagguacagcaaccgccuccuuccaauagguaauuaauauagcaaacagaauccucuaguucaggcagguacuugaaacauaucaugcccucaacuuggccaaagauauuaggugauauguaauauuaaguauuguuaagaauauaaauagauugcaguaguaguauaugguuuuaaaaaacaaacuauaauuucuuguggccauuucuuuuugacugaaaugguucauuuuuuuuaucaucgugauguuaggagcuuaguuuugauauguuuguuuuuauuuuuaauucauagaaucuucaugugguuuguggacaacuaugcaaaaaugggccucagaagcuuuuaauuugucuuuacugguagcuuuuucuuguaagcagaggugcuauuacacaaauugaguuaauugaucuaucuucuaauuauuuugguaaacuuagaacuuuaaaucaauugauaguaauugucuaaguuccuugccuguagcagcacagcagcaucccugggagugguauacagacuguagagugaggccucagaauagcaguccccuuuucugggggacauagucucaucucauguagccagguugggcuuagacuccauagacauuugaugaccuuggucucuuuauuguccugccuccuccuccucagugcgaggacuauaggcaugaccagcaugugggacuccuuccucucuccuuccuccucugcuuccuucuuccccucugccgccucuccuucccccgcccacuggagcauguauuucugugucuguugcuggggauccagccuagggucucacacuugcuagaugggaccucugcugacugagcuacaucuccaauagcagcaguuuucaaagaaacacuccaguccauucugcugcacacagaacaugagaacuguuggacugcugugugucauacuuuuuuucuauuuuuaagagaaauuuguaaaauaucaaauuguaaauggcuuuuguuuacuguuguuuugcagauucuuacagccaguacagaaaauagacaugaaucucacagaucuucugggagaacuucagcgagacccuuggccuguaccacaaggaaagagaccgcugcguuccucaggaguggcgcuuuccauagcugugggacugcuugagguaguaaugaugaaagcuuaauuuugaaauguaagaguuugugugcguguaugcaugugcgcacauggaaagaugugagcaaagcacauggugaugcuugguguggguguccuuuccuuuuuuucuucuuucuuuuccuucaucuuuacuccaccuccaucuuugccauccuuuucuucgguuuuacugcacaguugaguuagugcugagcuuaucugacagcgguuuaggagaauuuagccucugaaugucggucugcuauugugcaccaccgugcgugauggaucuuuucucucacucuguaaucagggugcaguacuuucuuuucuuuguuuuucgagacaggguuucucuguguagcccuggcuguccuggaacucacuuuguagaccaggcuggccuugaacucagaaauccgccugccucugccucagugcugggauuaaaggcgugcgccaccacaccuggcuuuacuuucuuuuuuuuaaagccccacacaaacaguagguugucgucuguacuucugucugugaguuggguauuucuucaggcugauuauuuuccuguaguggcuggcuccaugaagguagggaagcccuuuccuuacgugucaggauaaagagagugaacaguggccacaccugauagaagcaguucauauagcucagacgugagaggaagggcaugacuucucuccacaccacacaccagaaagcaacagcggcucagcuauccaggaacuccccaaauccaguuuauaugaguuucaguuaugucucugugugucugugugugcaugugaguagacaugcucuuggcggucagaggcagagcuggaguuagggguguuugugagccaccugacauaguugcuggaaaucgaacuggguucuucugguuggagagaccucuagccccugauuuauuuguuuauuuuaagguuuauuuguuuuuauuuuguguuaaugaguguuuugccugcauguaugucuguguaccacauaaaugccuggcugccccuggaggccagaagaaggcauugguuccccuggaacuggaguuagagaugauugugaacugcuguguggcugcugggaaccaagucugggucuucugcaagaacugcaagugucgcuaucacugagccaucucugcaguaccccacaccccacgacugguuagcgaagcuucacugcagaggggagauugacugcaucauuggcuaguggugcucaacuuacaaucuuucuuuauucuugaucuauuaguaggaguguuguguaaauuuucucuagaaccuggugggcucauguguuuuauuccucuaacacuuucuuggauuauacuuacuaguuuucuuucauuccucuuucuucuuuccccuuuucccucccucccucccucccuccuuuccuucccucccuaauucucgcucucucucuguucuucuugcucucuuuucuugagaugagguuccuauacucagcauuacuauaggcagcuaaggaaugcugaaaggggggaaauagucuucccaggaagagcacaccaguugguuauccaguaccuaguggucugguuauuguguaguacuggcuggacuggaaaaguauugucacacagcucugccugccucugccuccugaguucuguauuaaagacuaugacccaaagcaacuugggaaggcaaggguuuauuucacucacaguuccauagaacagcucaucaucaaaagcagggagggcaggaauccaagcugggcaggacccugaaggugggagcugauaaagaacaagcuauggaggcuuacugccuuguuccucauggcuugcucagccuguuuuuuuuuuuuuuuuuuugauagaauccaggaccaccagcccccaggguggcccccucauaaugggcuggacccucccccauuaaccacuaauuaagaaaauucccuacaggcuugcuuauagcuagaucguauggaggcaauucugagguucccgucucucuuagggcccuagcuuguaucaaggugacauaaaaacuagccagcacaacuaccaugucuggucgcccuuuucuaaauacaggaguuuauuugucuuauugcagagggaaaguccauaauggcuggggaaggaauggcagcagccagccagggcagggaacugagcugccauguacucagucacagcagagagcgcuggcagcagugggaacaacugugugcuccuauagauacaucucuccagccagcugcaccgccccauaccucccagacagcacggccagaugcagagggagggucccagugccugauugagccugugggggggggggcauuucuaauugaaaccaccacaaacugucuacuauauuuuuuaucuugacuuaauuguaguacaucuguacaucuagaaaugcauccauuuuuuuuucagauuuccuaaaauuguagaaucaagguuuuuuugauguccuaaaauuucauugguaucauugguaucuguugguauuuuuccauuuuaaauaauuuuugauuuguuaaaaauugcaguauaauuaugucauuucccuuuuccccucuacucuuuucaaccccccccccccauucuuccaagccuauuuuaaauuuuguauguaugcauucucagagcugaacauugggcauuggauaauuggugugcuuuucccugggaagacuauccccccccccccccccuuucagcauuccuuagccaucuauaguucucuguguauaguugaggccuuaugggccaugccccuuccauguuagccugucugcuggugucauaggcagccaugcugaugagacaucauggguguagcuccucugacacugcuaggagacacaaucucacaacaacuuuccuguuuuucuugcuuguaagaucucucugcuccuuucuccacaaugaccccugagacuuaugugcaggagucaugcuuuagacauagcagcuugcgaugggcucuaccguucugcauuuugauuggcuauggucucuguugcaaaaaguaguuuccuugaugagugguaaaaacuacaauuacagcuaggcagugguggugcacaccuuuaaucccagcacuugggaggcagagacagguggaugucugaauccagccuggucuacagaugaguuccaggacagccagggcuacucagagaaacccuaucucgaaaaaccaccccccaaaaaauaacucccaaaaaaaccaaaacaaaaaacaaaccccuaaaacaaacaaauacacaaaaaaccccaaauuacauuuaccugacugaagaaaggugucuuuuuuaaaaauugugagugugugaguguguguguguuacuaugugugugcagcagcccuugaaggacagaggagggagucaaauacacuggaacuagaguugcagucaggcucuuaacugcggagccaucucucucgccccaaccacagccauuucugagcacuguaucuucuuuacucuuuguugcuguguuuauggugugacucuaaauacagaggcacauucacaaacauuaucauguauuaauacacauguguauauguaguuuugauuuuaauuuuuuuccuuuuaagaacauuuuuaaucaauaauagucugaauuccucauuauuucuugugugucaauagcauucuuuuuuauguuuccauuuuauuuacuuauuugaaguuguguguggcgcugggguucagccugcgccuugagauugcugggaaagauuucccucugagcuuugcuugcagcccugcuucccuauuuuuaaagaggcaggcacccuuucuccauuucaugggcaucaugugauaaagagaaaguagauuggaguaguuaauccauuagcuucaguuacacauauaaauaaugcuuauguuuuauuuuuauuuuuuaauacagauucucauaggcaaggcuagacucaaacuugccauguagccaaagcugguuuugaacuucugaucuuccuuucccuuccuaagugcugggguuacaggcaugaagacugugucugguuuuauguggugcuggggauccaaccuaggcuuuguggauacuaggcaagcauucuagcaacugugcuguuaccuaagccccagcaauacucccauuuuaaauacagaaaacaagaauaaaacccagaagacaaugucuucucuuuuacccacuucaacagcuacaaagcaggaaacauaaccuuugcuauaggguaaguuuagagauugcuuuaaaacuaagaauguaguacuguuuaggauuuagaaagaaaucuauccaaauaaaugucuuccuuuuagcauuuacuuauuauuauuauuauuuuuuuucaagacaggguuucucuguauaguccuggcuguucuggaacucacuuuguagaccaggcuggccucaaacucagaaauccgccugccucugccucccgagugcugggauuaaaggcgugcgccaccacgcccggcuuucuuuuuuuaaauaaugcuuuuuuuuuuuaaauaaaggauuuacuuacuuauuguauguaugugaguacucaguacacugucacuuucuucagacacaccagaagauggcauuggaucccauuucagaugguugugagccaccaugugguugcugggaauugaacucaggaccucugaaagagcaagcagucagugcucuuaacugcugagccaucucuccagccuacauuuacuuauuucuuaucaaguacauguugcuuucuaggaacaauacauuaaaaugcguugucagaagugcauauaccugcuuuucguuauccuuugcacuguuugagugaguuccuuuuuuccaauaguguacuuuccccaacacuggugcucggaucaugauguucaucggugguccugcuacccaggggccuggcaugguggugggagaugagcuaaagacaccuauaagauccuggcacgacauugagaaggacaaugccaaauauguuaaaaagggaacuaagguaauuuuuucuugugaguuuucuguuuguguaacgucacauucggguguuuugcaaaagcgucuguuggugacucugaggccuugguguugcugcucuugcugcuaugaggauuuuuuuuuuuuuuuuguuuuuaauucaggcuuuuaguuuaguucucuauacuguuugauauuuuugguagccauuguuaauauauuacuaguaauugaugucauaauuuuuuuuuuaaagauuuauuuauuuauuauauguaaguacacuguagcugucuucagacaccccagaagagggcgucagaucuuguuacggaugguugugagccaccaugugguugcuggaauuugaacuccggaccuucggaagagcagucgggugcucuuacccacugagccaccucaccagcccgaugucauaauuuuuaauacugagugcuuuuugucugcuaguuagguuccuuuuugagcuugggaauuuuauuuuauuguaaaaguuggaaaaacugcucuaaauuugcuuauccucugguuuuauuuuauuuuuucucuuuucugauguguuuuuacauaaugcuuacuugacuguagauuuagcuaggaaaaaaaaaguucuguuuuguucucuuguguuuauauugaaguagagaauguuuucuauaccauuguuuaguuuugcuucacuuagggacaugucuaaaaauaguggcuuuuauaucaaagaauguuaaaauaucagacuuuauuuugagacagucuuucuauguaaugcauccuccuguuguagcuuccuuccccagggcuggauuuccaaaugccugucacuuguuugucuggaagucauauuucuagaaauguuaucaauuuuaugaaacuauagaaaauuaaaugugacuaggucauguguaaauuacgaugaauuauucuuuuacucuuaaauuacuuugaucugcuaauaggaaaaagauucaugggauggcgagguuauauauuugauuagguuuuacauauauuuugauauuaauuaaaauaaucuguagcauuuugaagcguuggcuaaucgagcugcuacaacggggcaugucauugauaucuacgccugugcguuggaccagacaggccugcuggagaugaagugcuguccuaaccuuacuggguauguaugugugucuuuaauaaugaccgcuuauuugcaaaugugagccaacgcugacagcucaggaaacggaaagcucguugucaauguuugcuaacagcauugcuguguguuuggagcucauguuucauuuuuuuuucuuugaaaagauuaagguacaaguucuuuugaaaaaguuuauuauaaaguuacuagguuguuuuaguaguguuuugagauagaaagccaugaaauuuauccacuuaaaauguaugauaagguuguaguauguucacaaggcauauggucauuauuaugauugaauuagaacauuugcaauggcccuggagagacuuugcuugcuaccugucaaucuccguuccuccuccuuucucacuccgcccuccugcccucggcaacacuacucaccacuccuggauguuuccuguaaguggaguaauaagugguguuuugccugccauugacuuuuaaaaacuguuuaugugcaugaauguuuugucuacauaaauguaugugcacuaugugccuugccugucugguacucaaggagguuagaacagggguugacuccccuggaacuggagugacaggugauuuugagcagccuuguaggugcugggaacugaacuggguccuuugcaggggaaacaaaugcuccuggcuacugaagcaucucuccagcccccacggacaucuuuuauucaguaugcuuaauuuaugcauauuuaagaugugccaggauuucauuuuauugcugaauaaaagugaaguagggguucagcuucauuaauauucucuuagauauauaccuaaggaaaugucaacaagcagaaaguaaaggcccuggucagcugugccaggcacacagauacaaaccaaugcaggguggagaguaagcacuucagcauugugcagccucugaaaaccuuacuaaaugugaaagcugauccuagagccaauuggaaagacaacaggaggagagacuugggagcagcugguauggacaagagcugcucagguauuaacuuguacagauaacuuguguuuccuguuuggaccacacuuugagaagcaaaaauauagacaacuuuuauaaacaccaacugugaaaaggagcagucuuaaguaaaugaugcauuaucaagcauauuauaaaaugaauaaucuuagaugaugcauacacaaggagaaaaucuggcugugggcugcucagugaguaaaggcucugauggcauggugggagggaguuggauacuugggacacacaauguggacggaugguggaaaguuguuuucacaccuacagaugaacacugugucaugugcacacccuacacacagugaguaaagguaauuaaaaauuauuaauacaaauaacauuaauaacauuuguuuuggggaauaucuuuacuauuuguucauagucuaaguaauuuauuuuuucugguaauacaugagcccaguuaauuuguauguugugcuugccuuuuucugugcagaggauacaugguaaugggugacucuuucaauacuuccuuauucaagcaaacuuuucaaagagucuucaccaaagauauacauggccaguuuaaaaugggcuuugguggcacauuagaaauaaagguaagaacccagacuugacaugugugacaugugugauacgucuaucaguugagacccuugaaggcggugguaacugugaaauauuagucaaguucagaugaucuuuaaaaaguaaugguuacuuuagaacuuugaguuagagauuuuguuucccagaaagagguguugucauuauauguacaggagacugggguuguuuugaaugaugguaaaguaauguaagcaaaguuucuuauauuggauauuacuguuucuuagagcuaagucucauucagucugucuucuaacuccugauccuccuacuucagcuuuccaguugcugugaugcagcuguguucuacuguggcuggcacuagacguuauauauuuuuauacucaauuuauauuauguuagguuuuuuguuuauucguuugcauuguuuuuuugagacaggguuucucuguguagcucuggcuguccuggaacuucagauuugccuuaaauuuagauauucaucugucucugucucccaauugucugggauuaaaggugugcuucccuaugcacagcauaguuagauuuuuguuuguuugagacagaguuucucaguguagcccugacuguccugaaacucacucuguagaccaaguugggcuugaacucacagagauccgccugccucugccucuugagugcugggaucagaggugugcacauuccccuccugcuauguuuucuauaaugguggauauuaucuaauuugagaggaaauuauuauuuugcuuuauuagauuaguguuggguguacaagugcaucauaaauuucaaauuuugacuuaaaacacuuggaaggccuauuguuaauuacauguauauuacaaaaccauugguuuugaauuuucauuaaacauaucuuauuggcauuucauugauggcuuacuauguagucggcaugaugguaggaaauuguaaagaugugauugggucucuaagguggaggucuuguuauagggaaacuuaauuuugagagauuaaauugaaagacuccgagaggagccccucucucaggccucgggacaauagcggacacccaagaacucaggagagaccaagcuugauguaaaccacacgaggcuuuauuuggggaaagccagagcucuggggacgacucauaucccacgcagggguagaggagucgaccacgaggggaaagaggucccaguuuuuauagucccucaggggggaaaggagaagggggagaguaggggauuuccagaucuaaacaaugucuauucucaagaaauggguaugggagggguacaaggaaagagucuggugcagguguagcaacuccggauuagcccgacugugguugcuggggagauuuuccgacucuuucccagcaaccaauaucacaaacaccuggcaaugggcuucaucagugggcacacacauggguucaaggaacggucaaaacauuggcagacacacggguucaaggaguggccagagcauugugcaccucuauuuuucuaaaucaguaaagcuaguucugcuaacacugacaucuaucuugucaauuucagggcuucugugaacuuuuacauucugucaggaucuuucaaaaucauauaugauuuaauaaacuaacaguagaaaacaaagugauggagaaguuuaagaagagaaucaacagcuccauugauucuugggugccuccuuaucccaggucucugucuuuuucuggagaugcucucaccucccaacccugucaguuacagauuuccaaucauucucauggucguguggccaucccuccuguuccuccccacuccugauccugaacuucccaaccaacgauucuccccauccccucucccacccagcucucacagcuggaggugggggcuauccuaaaagcuguugccugcaugugggauaugcucuagaugggcuaccuugccuggccucagugggagaugaugcaccuacccucacagagacuugauaugccagggugggggauacccagggagcauccaccuacucagaggagaaagggaggagggaugggggaaggaaugugggagagggugacugggagggagggcagugaacaggauguaaagugaauaagaaaaaaaauacuaaaaauuaauuaaaaaaaauaaagaagagaauugagagcugugcacgguggcucaugccuuuaaucccagcacucaggaagcagaagcaagcaguucucuugaauucaaggucaacuuggccuacaggguaaguucuaggacagucaggacuacacagcgaaaccuugauuugaaaaauaaaaugaacaaacaaacaaaauccuaacaaacgaaaaagagaagugaguauauccaggauaccguuuauuccaggggaauguggcuuauaguguuuuucugaaugaugagaggaagugaauuuuauucaggagaccaacauaaaaguugacaguugagaggaaugccuugugagagugggugguugaaauauaagaaccauaguauugcugggcggugguggcgcacgccuuugaucccagcacucgggaggcagaaucagguggauuucugaauuugaggccagccuggucuacaaaaugaguuccaagacggccagggcuauacagagaaacccugucucagaaaacaaaacaaacaaacaacccccacccccaaaccccauaguauuaauuaugugagcuguuguagauuggagaugcauagaucugucauuuguagguuaaggaaaaucauauuucuuuguauaaucuugcuggccuggaacuugcuauguagacacuggccucagccucacagagauccaccugacuuugccuguaggugcuggaauuaaagauguccacauucuaaaguccaugaguuuuagaauucauggacuuuagaauuuuaaauaugaagauugucuucuuuuuuaacacucuuauaaacaucugaacguauuaacauuuuuauuacauuuauuuguguguugccaugcuacaauguuugugugggaugugaggauggcuuaggagucaguucuucccuccuacccugugacccugggacucagacucaggcuucggggcacguacuuuauccacucagccauccugccagcccuaacuucaucuuuagggaaccaaauguaucauguucuuauuuucagacuucaagggaaauaaagauuucaggagcuauuggacccugugugucucuuaauucaaaaggaccuugcgugucugaaaauguaaguaauguuuguucuaaauaauauagcuaaucucuaggcuagugcaaagacagacccaucauggaaggcucuaccauuucuuugaaguuguguggcugaccuuccaucaguauauuggcaugcgugcuucuuggcacacaggcuacugccaaggcucuauugcauaugacuaagcgagucuuugucuuagugcuuugaaauaaguuuagaaguuuuuagguuuuaaaaggcaacacuaguuccaagugguuuuugucacuagaauuagcaacagagcaaccaagucagaggaguuuuaaguuucagcuccuuucuuuccucugccuguugagagacuauaaugcauuucagaauuagugucaugugguugcagcuacgaugauaagauaguacacgguagauaaccagcuuucaaaaacgacaaagauacaaaaucaguuuacaugcuguuuguaugguaaggaccugugucuaaagugucuuggcccuuagaaugcuuauaaugcagagggccuauucauauauauguauguagaguccuuuauacagauaggagagugggguggaaagguaaggaauugguugguugauccuucauuaaaaagugcuugcuucaaaggaccuuguauccuuuuaguuuacuuaguaaaccuuuuaauauucuuaauauuuuaucauguaaaaucgcuuaaauuuacuuuauguguuugugauauaguguuaaaaauuuuaagcuuuuaacauuuacugaauuaaucugaaagguguguguuuuuccuuaccagaggcguaucccugcucuucuucuuauauauuaauaaauaagguucuuuagcuuucaaacaccuuguuuuuuauuuuugcaggagauuggaacaggaggcacuugucaguggaaaaucuguggccucagccccaccacaaccuuagccauauauuuugaaguuguuaaucagguaugacugccuauccuuaaaaacaaauuuauuuucauuuucauuuauuuauuuauuuuugguauuuugagacaggguauauagcucugacuaucuggaacuuauuauguagaucaggcuggccuuugaacuuacagagaugccucugccuccuaaauccugggauaaaggugugcaccacuaugucuggcugacugcauuuuaauacuggaagguaaacagauacuuaauuuagacacugaaucuuucguaugaauugcaggauuuauuuuccaguucugugagccaugccauuggaauuuugauagguuagcagugaaucgguagauugcauuggguaguguagacauuuuaacaauacugacuuuucccguccaagaacaagauaucuuuccuuuuguuuauauuuuuguuuaauuucugucaauuuuguuuggauuuauuuauaguuguuuaguuuuauugcuauuguagaugggauuauugccauaacucuuucuuucucagcagugcuggggauugaacccaagucuugacucuugcuaggcaaugcuccuuccaugacugaacucuccuugccuagcccuugauuuccauuuagagaguuugguauagauguauaacaguguuacuguuuuuucuuuuuuuguuuuuaaauagacacagucuucuguagccaggcugccuugacucuccuguguagguggugauguccuugaacuucuggcacucuacuucucaagugcuaggaugccgcaaugccuguuuuguuuuguuuuguuuuguuuuuuuggaaaguaauuauuuuaaaauuauguguauguguguggguuaugugcaugugcccacaaaagacagaggcaucaaguuccugcagcuagagcuuaggugguuguaaaccaucauccaguguggguucuacagaucaaacuugaguccucugcaagaacaguauucucucuuaauauugucuucucuccagcuccuuccuccccugacuuuaaagagcaguuguuuucauuauuuuuaacaguucuugguugaguguguagagauuucugcaugagggauagucaugucaucugcagugucaguuugacguccucuguuccaauguugaugcuuuuucuccuggcuaggacuuuuuguaguacaguguuuagugacagugguaaaaugggaauccuaauuuuuuuucuuuuaaagauuuauuuauuuacuauauguaaguacauuguagcugucuucagacacuccagaagaaggagucagaucucguuacagaugguugugagccaccaugugguugacugggauuugaauuccggacauucggaagagcagucgggugcucuuacccacugagccaucucaccagccccgggaauccuaauuuuauucuagauguuagagagacacuuucaguuuuuccucuuagugugauguuaguuauaaccuuuuaaugcauggccuuuguuauguugggauagaguccuucuauaccaaauguguuuagcauucuuaucauuaaggagugcuuaauuuuaucaaaugccuuuucugcgucuauugaaaugacauaugguuuuuguuuuucauuuuaaugauauggugcuaucauaucauuaauucaacugcaucuauugagucaauccauagggagaaucccacacugagaagauuaguauuaguucuuuguugucacccuacuuggugauguaaaccugggagagagcggcccuaaaaaugagguagaaugaagucucaugcagcaaccaacuuuauucagagcauaaaggguuaagaagcgucaccugaguaaagugucagugacaaggacaagcugccgguggugaaacauguuuuuccauagaggaauauaaacaguagccagcuguaaugacuaaagugaacucacuccugucugcucacuugggacaggcaugaaaacccauucuaaggacaacuugugugaugggggaacagagaugaugagacucaugucuuguuaacucaguuuucucaucgugucucaucagguccucacacagcuuugugagacuguggacuguguucugacggcucuuuaaauauuuacugggcuccgucaguagugagggcauccaacacugggccuuuauuccauccuuauauuuauuuuauaugugugacuguuuugcuugcauguaugcaugugcacuaucugugugccuggugccugcagaggcccgaugagaguguuagaugacugaggguugugggccacugucugggugcugggaacugaaccugcauccucugaagugcuuuugacugcugggccaucucuccagccccugggcuuuuccuuguccuacagugauuuucuuagugguagagaguauguuauuuuugauacugugacauuaucaugguagauuuugccuaguucuuacuucuuuauuuuuaugcauacagcauaaugcuccaauuccucaaggaggacgaggugcaguccaauuugugacccaguaucagcacucaaguggccagagacgcauccgagugaccacaauugcuaggaaguaaguuuuuuuuuuuuuuuuuuuuuuuaaauuagaguuguaauuuauauauaaaaacuauuuuaggccauacucccaagcuggguuucugaguaacauuuaugccuagaaaaauaaacauuugugacuaagggcauuuuaugucuuuuaagccuagcuuauuuuguaaaauagucaaugacaaguauaauagcaguuuuuuguguuuuuuguuuguuuguuuguuuuuuuguuuuuuugagacaggguuucucuguauagcccuggcuguccuggaacucacucuguagaccaggcuggccucgaacucagaaauccaccugucucugccucccaagugcugggauuaaagguguacaccaccacugcccagcuauaauagcaguuuuuaaaaguacuccuagggguggggagggaggccaguugguaagcaagcaugugggccucaauuugguccccagaacaugggaagaacaaaaagcuagaugugcuggaacucaugugcaauugcauccugggggauggagacaggcgaauccuggguagcuguagcuagccuagcuuaucuguggaguuccaggucagggagaaagucugucuuuagaagacaauauuuuaccagacuaagauaucuuacucuuauuuacuggaaacauuuaaauauuguuggaugagagaaaauuaaaaacagagaaaggggcuugccuuagucauugauuuauugcugugaagagauaccauaaccaugguaggucuuguaaaagaaaacauuuaauuggggccuaccuacaguucagagguuuaguccacuugucagcgcagcagggcacauggcaacacuuaggcagaaguggugcuggaaagguggcugagaauuuuacauccagauucauaggcaacaggaagugaaagccacugggauuggcuugacaaaagcccgcccaccaccugcugauagacuucuuccaacaaagucacaccuacuccaaguagguuucaccucauaaucccuuucaagucgugccacucccuaaugcauucaaauauaugcacccaagggggccguucuucuucuaacuaccucagggcugggguccugacucagcauuuaaggggccauucuucuucuaacuaccccagggcuggaggccugacucagcauuuaaggggccauucuucuucuaacuaccccaggacuggaggccugacucagcauuuaaggggccguucuucuucuaacuaccccagggcuggaggccugacucagcauuuaaggggccguucuucuucuaacuaccccagggcuggaggccugacucagcauuuaagaguucuugcugcucuuacagaggacuauuguuuggucguguucccccaccccccauacccagguucgaugguuaauaacuacugauaacuccagguccaggagaccugacacccuguucuagcuacuguagacaucugugcucuuguguauacauauauacagauauauacacauacacaugaauaaaaauaaaacuuaaaaggcugaaaaaauuaaauuugucacuauaaaauacauuacauauaaaguaacauaucuaaaguaauauauaugguuuagggguugggucaguggguucaauccuugccuguaccugaguuugaucacuagaguccauguggaaaagguagacauggucugugcuuguaaucccaguguagaggaagcagagacaggaguaucccuauggcuugccauccagacacuuuaggcuaauuggugagcugcaugccaaagagcuacugucucaaaggagauggauggugcucuugagaaugcauccaggguuguccucuggccuccauaggcaucuggacacagugcauguacacgccccacaugaccauacauguacaacaacuuacauacaagccuuacacaaagaauugccagucuuguagaggaugagaugcuuugcaucuaggaucagcagaaguguuaaaaacaaaccaaucccccagaauuaugucuuugaaauuaaaaaaagguucuaucuaaagaaaguuugacuggauuaaguuuauagaacauaugaccuucuuugggaagcagaggcaugaagagcuauucugugaguuugaggccagccaggcucacacaguuuauaauacuaucaaccccucagacugaaauucucauuuucccuguauguauauauguguguguguguaugcaugggugcaccaagcgugaucguguggaaaccaggggucagaaucaagugucuuuuucugucacucuccauccuagcgcuugaggcgggaauucucuuccugaaugaaccuggagcucacuguuugccuaccggauugcugccugccugugguuuccuagcaauauugcaggcaugccccugcaucagcuucuuacauuaagaauuauaucauauccauagauguguagguaucucuccuaggaagcugacuuugacucuuugagaaugguauaguuggauuauauggaaguuuaaaaaauacuuuuauuuuugaauuuuguaugggggucuguggaguacaauuuugaguacagguaucuguggagguaggaggagggcaucgcagcaggggcuggacuuacaggcaacugggagcuccuugauguggcuucugggagccgaauuaggaccucuggaagagcagccagguucuuaaauugaugagccaucucucuagcccuagaaguucuaguuuuaauuuuuugaggaaccuuaaaaccuacuguguuccaugaucuuagagacaggaucuccuagaguccaggcuggccucaaauuugcugcguaguugagccugguuugaacucccgaucuuuugucuccaacucccaaguaaugggauuauaggcuuauauucccauacuaaauucucuuacuuaauuuugauucgucuuggucaguguauuaacauggagaaaaguacagcaguuuuaauuuaugugauuucuaucauugacauuuauugauuucuaucuaaagacuaaugagaauaaaauucugauguuuuguccuucaguguaacaaaugacacuaagauugaaaauaaaaccuuuacuuuuguaaauucauuuuuuguuuuucuaaaauugaauacauuaaaauucaucauagagggggcuggagagauugcucugugguuuagagcacuggcugcuuuuccagagguucugaguucaauucucagcaaccacaugguggcucacaaccaucuguaaugggauccgaugcucucuucuggagugucugaagacagcgaaaauguacucauauacauaaaaaaaaauuagcauagacuuacguauuaagguaaaaagaaugauucuaucuauauaguuuaugcaaauguauaugguauuuuuuuaauuuuaaguguguguauauauaaacuccuaaguucuuaggaaugucaccauaaggauuucuauaucauucaaacauucuauuuuauuaaaaaggauuuugugugugugugugugugcauaugugccagucacuguaugcaggcagaugucagaggacagcucuaggagucaguuuccuccuuucccaucguugagucugcuacuugagcucaggugguaggucuuggugguagagugucuaccugcugagccaucccccugaccuccacacauuaucuuuacuuauaaaaggcuuguuguauuaaagaacauacuccuuuagagucauuuuagaaaacauuuuaaggucugguuuuguuuuuaggaaaaucaauguaauaaacaguuauuugugauacuuuaauaaugcuaauuaaucuguguaguauuagaaucuugaaauacugagguggcauucugcauucucuaaguguagcugugugugguaacuaaguguggaguuaugauauaacucagcuauguuucugugcuuucuuauuucuuuagcugggcagaugcucaaacucaaauccaaaauauugcugcaucuuuugaccaggaagcagcugccauucucauggccaggcuggcaauauacagagcagaaacagaggaagggccagacgugcuaagaugguuggacagacaacucauucgacugguaagaaguggacauugugcuuuucucagcuugucagcuuucauuugucguaaauacccuuuaaagaccuuacaguggguguggagaacuguuggaagaacagaacuagcaauaaauagcaggguuccacucacuuccaggaaacuagaaagccccuuuccuuaaaauugaauggcaguaugcaacuuauuauuuuggcuuguaugaagugaguguggaaauuaauuuuuuauuauugauuuuaugaauuuuguuuuuguuuugaguuagggucuuuguagccuuggcuggucuggaacuugcuauuacugcuguguguguguuuagucuuuacuguggcuuuuauuuucugcuuuaauuucaguugaauauaacaauguagccuaggcuggucuuaaacuuauucccauguccugggauuauaggcuuaagcagcucuuaacaccuaauucuuacuuuauaaacucuguccuguacuuuuucauuuacucuucaacuuaaauaccuuguugagaauucucuguuaagcuaccaaacucaagagaggugccuuuagccugucugucaggugucaugagugaacuuguuuaaaguuagcuacuuugggggcuggagagauggcucagugguuaagagcacugacugcucuucagaagguccugaguucaaaucccagcaaccacaugguggcucacaaccauccauaaagauaucugaugcccucuuuugaagugucugaagacagcuacaguguacucacauauaauaauuaaauaaaucuuagaaaaaaaaaguuagcuacuuuuguaguacuguugagauuuuucccuuauaagagcacccccuuucucccaacaugucuuugugaagaaaucagaguuugguauuaaaugugucuuaaaaugagcuuuaacuuuguauaguccaucaaugaugggguacuguuaauacaaauacuggcacagcuccucugugggcucuuugauucuagauggggaugaauauuuaaguaucucaccugagcuucuucaaaacagcagaagaaugucauguagccaagaaguuuucuugacuaucaccacuaucaauagaagagugauacacaauccugaacuucccacccugacagagaagcuauucccaguuuauugcacaggcuucuuagcaucauguggccuguacccagugcuuugauucagugcucugcuuuguuuauuuuuuaaauuuauuuacguauuuugaauguaggaguacucuuucugcauguacaccuacaugccagaagagggccagcgccaccaugugauguugcugggaauugaauucuggaagaagagccaguguuccuaaccacugagccagcucuccagccccaguacuuuguuuuaaauggaacuuuuaaaaaaccuuucuuguguugguaauuguacucaaggccccauccagccagugugcugacuccuuagcucuuguacugugugcuaaaauagaagggcuccuguuuccuggguugcacuuugcccuagcauuuuacugacuaauuuuacauguuaguguuuucaugucaccaaccaugugagcuuuccauguggcuaauaaauugugcucugaaauggauugcuucuugggccuuuucauagaaaaugacuuugucuucauaaauguuguguuguuuuaagggucuaaaagcugaaguguccagugugugcacuugggcaguagcugugaccugcaguacaguguccugaccaucuugcuggagcuauugcauucacagguugucaugcauggcacuacaguuuuauagugcacucugcaccaucaacuugcauaaaacccauuggacaccuucuauugaaaaauuuuuuucuuuuucuuuugcaaaagacgcaggauugcaauuuuucuuuuuuuugagacaggguuucucuguguagcccuggcuguccuggaacucacuuuguagaccaggcuggccucgaacucagaaaucuuccugccucugccucccgagugcugggauuaaaggcgugcgccaccaugcccggcuaggauugcaauuuuuaauuuuuaaggaguuuuuuuuuuuuuuuuuuuuuuuuuuagcaaguuuaggcuucucuuuuaucucauaccucaacuucacaaacugcuguaauuaucugauauauuuuuaaaagagaaacacugauuaaaaaucauuaggaccuagugaauaaccaaacgagacaauugcaucaagcacaaaauuuaaguuuccucacuaugcauagcaagcuguuagccacacagugaacauuuuacaacauguacacagaggacagguuauugauagagcagugaaaaguuuacuuugaucuugugucacaucaagagaccaguggagguaauuugggagaaaggcagauagucuuuuuugacuguaucuacuuuuuguguaacaucuauugccuguuuuaugugccuugguuguaugagguccaaaacagaauggcauuauccaaauguuagucauauuuccuucaccccaacagagaaagcucuauuucagcucaucguucagagguugcgguuuauggccuauggcuuuaggccugugugacgcugcaguaagaaagacugauucuacaguucucgucaagaaaugcuuccuucagugaccaaaauaccuccuauugggcacucuucccccccccccccccccccccccugugagcuggugaacaagccuccagcacauaggccuguggggcagagacuuacuuaacacagugaggcuggugggugaggucauggcuguuguaguaggagcucauccuugggugaggcagcuggaugccucuugccauggucucgagaauacaugaccugcuucucuguugccugugacaugacuuaccucagucuaacuucugacucuguaaaucuuuuucuucacuaggcuugguuuuccuuugacucuuuuucuuuugggcacuuuuucuuuuuuauuuuuuaagauuuauuuauuuauuuauuauauguaaguacacuguacacuguagcuguccucagacacuccagaagagggagucagaucucgugaucggaugguugugagccaccaugugguugcuggaauuugaacuuccgaccuuuggaagagcagucgggugcucuuacccacugagccaucucaccagccccgcacuuuuucuuuuuuuauguauaugaguacaucauagcugucuucagacacaccagaagaaggcaucaaaucccauuacagaugguugugagccaccaugugguugcugggaauugaacucauggccuugggaagagcagucagugcucuuaaccucugagccagcucuccagcuccuugggcacuuucaguauagcauacuuuguaccagaaguuuauuuuuguagcuccuguagugcauugauugugugucuuucuauccguggacaguauugaaaaagauacggugguagucuuaggaaguuucuguuggccuccuccuccucccauuggcauuacauauucucuauuugcuacaaaagacauuugcuuauaacaacaaaucuaaacauuuuagggugaguuguugcuauauuuccgaaauucaaauaguuuuuuuuuuuuuuuuuugguuguaaucagucccuugcuaagucaauacauaauauuccaacuuuacccuauguugaguaucuguuucccuaaaauuagcaacuuuuuauaaauagauuuuuagugggcagaauuuucaguuacuuuaccaggaacaaauugcuaauguuuuauuuuauucagugucaaaaauuuggagaguaucacaaagaugauccaaauuccuuccgguuuucagaaacauuuucucuuuauccucaggugaguaagccaaaggccacuuucuuuuuccuuauuaccaguagcauugaguuucaucuuuuuuguuguuugucuuuuaguaaucacauaugaacauauuuuuacuggauuauucuuuuaguuagguaaauuuugggauaacucagaaguuaauuuuaugcuugugguaaaugauaaaauaucccuacauggggcuuacaaauaguuauuauuuauuugcggugcuuggagacuuacuaugggcgcaagcaagguuaaacccuguuagcuugccaucugagauaagggguucgaaauacagugauaccaaauaaacuuaugugguuauuuuaccacauaaugggauaauggccuauuaucauccccugugaacaguuuuauaaugccaugccagguaagaagugugagcuuaaacuugccuuacaguuucuuuaccaucucugguuggucugccuuuuuguuuguuugcuuguuuguuuuguuuuccuguuuuuaauacagggucuuguuauguagcuaggguuaguuuugaacuugucauguucuugucuuagucuuccaagugcuaggaucguaauuuugcaccuucaguauuucagugaaauucauuuuugccuuaaaaagcuuuguccugaaacugcaaccuuuuuuucccccuuguuuaucucguuuuuuugagauaggguuucuccuguaacucacuauguagacuaggcuggucucaaacauacagagaccccuugccucugcuuuccaagugcuuugauuaaaggcaugugucaccacugccuggcccuuuuuuguuuuucuuuugaggcaagcucuccagcugaaauaugccuugcccuuccuguaaagcuuguuauuugggugggugguggagcagaacuccaauccucaugcuuugcaagcucacuuaacuuuggggccguuucacuagcccgcuguagcucauaaacaucaggauaauccuguuuuuuaaaaauuauuuuauuuacauuucaaguguuaucccuccuccuucuccccccccaagcccccccccccccccauucccacucccaccucaccccucuagcauccuccuucucugggcaucaagccuccaaaggaccaagcacauuuccucccacugaggucagacaaggcagcaggacaaguuuucuugugauauacuuuauaauauucacuucuguauuuauuuauguauguauguauuuauuuacuaugucugucugugucccuguauaaacuuauguguacuaccuaugugcaaaugccuacagaggccaggcuucugauaacuugaaauuaaguuacgggggacgugaaccacgcaguguggguucugguaacugaacuaacuucuggguccguaaguaacugcuagccaucccuccagcacuacuuuaguguauucuccacagaccuugugucuucauguacaguguaagcaaagguuuuguuguuagagaacugcuauugccauaguaauaccaauaaaagcuauuuuuaaaucucaccugcuuugucuuguaguuuauguuucauuuaagaagaucuccuuucuugcaaguuuuuaacaauaguccugaugagaguucauacuaucgucaccauuucaugcgucaggaucugacccagucucugaucaugauucagcccauucuguacgccuacuccuucaguggcccgccagagguaagcaggggagagagcugacugcuacugugcgguguggcacuaagacagugacaacugcuuguuguuuugaaaugaaguuggaauuuguuaaauuauuaucucaagaugccccauuuaaagguauuuaugaguauuuauguauuaggcuggguauaucauaaaguaauacgaaaguauuaaaacaaugcaaaaauacuauaaaagauacucuugggugacuguguuuaguguuugguugguaaggcugccuaggguugaugacucuuuaucuuccuuuaagaaagcgcagaaaugaucacgauucuggaagagauggcuaauuucauagcguaguguuugacaggacaaucugucaaaauuaagucucuucacauaccucguuuuccuuuguuccuuugagaauauaagauaugacugauagagccaccuucugggcuguuuuggaaaaguguucaacacacuuuuaucuguuaucaaauaaauagcuuuccuucuaauaguuugaauuguucauuucaccauuuaaaacuauauaguggcuguguuuggaaauaguaccuuaggaaaggucaguauaaguggguguuuaugauauuuguuacuuuuuucuuuuggucuuuuugagacaggguuucucuguguagcccugacuguccuguagucagaauuaucugaaguuguacgcugcuugaugugaguucugggaccugaacucagaacauuuggaagagcaucaaguacaguuaaccacugcauuuuuucuccaacccuguugucuauaguuuugaccuccuucucagcuuauuugaagcaaaauuugucccugaaauaauauaauauaauauaauauaauauaacauauaauauaauaaucaacaccaucagugcugggcagcaagcauccucuaacaaacucucagucuuuucauuuuccuuaucuucaguuucucugaaugauucagucuaaccccauagcuuugguugccaucuuuguacauguguuacucaaacuuauaaucaauucaugaugcuccauuucauauucagaacuguuuucucugcagccuacauuucuuauaucccaggccuuuuauuuaucucuccuucacuuuacugucagcaggcuuagugaccaucuuugauaucuuaaaucuuuaaaaaaguuuuuuuuuuuuuuuuuuuuugauacaaucuguuuauaaccuuggcuggccuggaacuugcucuguauuccacgcuggcuuggaacucauagagauuuaccugccucugccuuucaagugauuaaaguuguguacuguaaugccuggcauauugacuuuuaaaaauuauuucaguauuagauccuuagaaaauuaaaauagauugagaauucacagugucuggaaguguuuggcaaauguaaaauccaagagcuaagaugaagggagagcaggagcuacagaagcgcgcucuguuagacggugugaugaugucuagcacuggcaugcagauuuaagacaagggaaaggauuaagaugcuaaccuuacccuaucauugcuucauuuuagccaguucuucuagacagcagcagcauucuugcagaucggauucuccucauggacacguucuuccagauuuugauuuaucacggugagguaagaugguagauagauuuauguaugugaaauaguuuuacucugaggaaaaaaauuuucuugucuaauauguagcucauauuuaggcaaugauaaucuuugguuuauguuuuuauaaaauauaauuucucuaaauuuuuaauuaaaaauaucuuaauaaauauuuauaaaauauuugacuauauuguccaaaaauuaaaaauccaaacauuuuguguacuaaaaugcuacaaauaaaaaaucgcauuuuuucauguucaaaguuauuauuuaacuuuuuaaaauaaaauugguuuuguuuauuuuauguguagagggggaguguaugcacaagagcagaggucaaaggauaacugugggaaucaguuguuuuccuccacucuguaagucccuggcauuaaacuaagucaucaggcugcgaagcaguugccuuuacccacugagccauguugcuggcccuauuacucacuuaaauguauaggauaacuuuuugagauauaaguauuuaaaacguaaauacauuuuguguuuacacuugguucccaucuucaaaguauuuuaauaagaauuuauacauauuggggccuagcaaacacagaaguggaugcucacagucagcuauuggauggaucacagggcccccaauggaggagcuagagaaaguaaccaaggagcugaagggaucugcaacccuguagauggaacaacauuaugaacuaaccaguaccccagagcucaugucuuuagcugcauauguaccaaaagauggccuagucggccaucacuggaaagagaggcccauuggacuugcaaacuuuauaugccccaguacaggggaaugccagggccaaaaagugggaguggguggguaggggagugggggggaggguauggggaacuuuugggauagcauuggaaauguaaaugaggaaaauaccuaauuaaaauauuuuuaaaaaaguaaaaaaaaaagaauuuauacauauacauuacauauacauauaaauacaugaaagugccugaaauccauagcacuuguacucucaaggauuuagguagaaaauacucaacggguauacauacauacauacauacauacauacauacauacauacacacacacacacucacacacagacacacacacagugugauucuucaugguauaggguuuuaggugucaaucauacugauccuuguguugauuuuguuguuuuguuuacacacuagugggugaauagauuugcacacagcauaguacuaugaaaacauaaacagggacgcagagacgaagggcaggagucagccuuugucaguggguaaacuugcucuucauuacucuauguaacaugaagauuuuucuaugugcuucauauaccuaaaagugcauugacagcaugaguagaaguguauaaguuauugaggugaugcgugguugaagaguaguguggguagcuucugggcuuccauguggguguuuggcagaggucugccccugcguguauucauucagccagugccucagcacgcucuguggaugaaaacaccacucggagcaguuugcacggcacauucauuuuuccugugcucgagcuucucguguaguauagugcaucuuagauggccucauuucucuaguuaccuuauuuguaacuuuagauuucacuuauuggugaggauggcugaguguugagacgcugauaugauagcccagccuucucuuauauucagaauacuucuaccucaaccuucugugcugggauuacuggugugagccaccacaccugaccuucuaguauccuuuuaaauagaacuauccagugcuuuuacaaggauuuauuuacugggcauggcgaugcaugucuuugaucuagcacuuggaaggcagaucucugugaguuugaggccagucugaucuacauagcagguuccaggccagccauggcuauaugaucaaacacugucucauuuuuaaaaaauuauuauuuguugccagacaguaguggcacacuccuuuaauccuagcacuuggaagcagaggcagguggauuucugaguucgaggccagccugguuuacagagugaguuccaggacagccagggcuauacagagaaacccugucucgaaaaaccaaaaaaaaaaaaaaaaaaaaaaaaaaaaaaaaaaaaaaccaaagaaagaagauaaaacuuccuucgaagaaaaaucuacucaagaauuuuagguuaccaagaaauuuaaaauaauuccuuuaauuauuuuaaaauuagacuauagcacaguggcggaagucaggauaccaggacaugccagaauaugagaauuuccggcaccuucugcaagccccaguagaugaugcacaagagauucuucacuccagauuuccaaugccgagauacauugacacggagcaugguggcagccaggugaggaacacccuguguuguguaugcagggcugccgugaggugauccugcuuguguucugauuguauuaggagcuaucugccacucaaggccaagggcaagggaaggaggcagaugggagggaacaaagcaauacaguuauugccuaguugcccaaacagccaguuuuuucuaauucugcuuccaucauagcuguuguaaucgccauaaugccauccagacagugugccagcuguggguuagcaaagauacaagggcagcuugcaagacaauuuagugugcuuuucuuaaauuaaagccuaugaggguucuaauuuguuucaguuuuauagaaaguaacugucagguucaagaaagcauugugguauucaaauggguuuuaugguucuuagagcucaaaggagucgugcacauguggucaggccagggcugcuuagcacaccucaggaaaccuuucugagcagagcuggaacaguacuccuagugugaguugucacacauuuuacuucuuccauaaguaaagcagggagauaguuuguuuaguguugugucucucucucugacacagugauggaucagcaccgacuuuauguacaguggugauuauuaguuuuacuguguuuauaacaggagcugucuaucauguacggagacuuugcaagcauuuuccaugccuccuucauuugagccucauaccaauucuauuauuaucucuacuuuauauauaauagaguuaagacuuguuauauguacuaucaaggaagcacauugaguggagcuagguuuuuuuuuuuuuuuuuuaaagagauagugucuuagcuacauagcucagguggaccuugaacauucuuucugccucagucuccuagauacugagauuacauuuguaagcuugccaauccuaaguaggaguuaauugaauuccaggcuucuuauucuaggacuagagcuacuuagggaauagaaaaacauuuuucaaaagauuaaauugcuuuuguucuucuagaaugaauuaagauuuuugaugaauucauucaucaauaucuuaauguguauuguuauuuuccuuaucuaauuacucauuuauuuauugauugauuagcuguuguagaggauggauaaauguugccuaaguuaucaccuguggauuaaaaucauuuuuacgaggcuuuagacuucuuuuguuucagaguaguugauaaaacuguauuuucacauucauuuuaaaauaagguuuguguuaacaaauaaacauuugcagucuuauuuuuauuucauguguuugggugcuuugccugcauugauguccguauaacacaagcaugcagcacuggaagaagucaggagagggagucagaugcccuagguuaaagauaguuacagauaguugugugucaccaguggguucugggaauccaaccaacccagcucuucuggaagagcagucaugcucuuaccugcugagccaucucucuaguccuguacauacaacuuuuuaucuguugaguuugggauucaguagucuauuaucuuaugaaugcuacaaauauguaauguuggaagaguauauuauuuguauugugguuaaugcauuuuuuucgguugaugcauuuuaaaauuuaacuuuguaaguauuacauuuuaacaaaauuaccaaaauauucaguuaaguuggguuuaaaugguauauugucuguagcuuaucuuacuaagucuguguuugaucagcacuauuuauuuauuuauuuauuuauuuuuacuuuuaaggcucguuuccuccuuucgaaagucaacccuucacagacucauaauaacauguaugccugggggcagguaagugugaacagcagucuuggaaagaacuucuuucuuuguccuuaguuauuuuaguaaaagcuauauuucccuuauauauuuaaugauaauuucugugagaaaauauaaggggacaguagaaaguguaacugguaguuggugcuccauuggaaaauaagaaaaugauccugucgcauagaaccuucggaguccgaguuuagcugcaguccacuggaggcaaaagcagugaacucuguuccaugggcgucugauggcccugcuuuucucuccacagagcgagcgagccagugagugagcucuacuuccaaggcuccagcugguuccuauaacccccaucccuucucugccugcucacacccguuuugccuauuucgcuugccauucccucucauccauuggccacagccaugcgcuguuacugcugugacaggcagcacagcaguuccuugccugggaauuaugacccuucugccucauucuucugagugugcgccaccacaccuggcccgauggccuuucgugaccugugauuaaaaaucaguauuuauaagucgggcgugguggugcacgccuuuaaucccagcacucgggaggcagaggcaggcggauuucugaguucgaagccagccuggucuacaaagugaauuccaggacagccaggguuauaaagagaaauccugucucaaaaaaccaaaaaaagaaaagaaauaaaaaucaauauuuauuaauguggguguguacuacuacgcagagugaguguggaagucagaggacaacuugccagaguugaugcuuuccuccuagcugugguucccaggguggacuucagcauugggcagaugccuuuauccauugagccauuugcuguccuucuuacagugacauuauuuuuuuuuaugcacuuugauuuaauugcuaaaauuuauaugaagcauauguuauuaauucucccacuaggagagaaaauugggguuagaacuacauuuuauuuauuuauuuugccuacaaggaacaaguguguggaggucagaggacaacuggggaguuuguuuuucccuucuccuauauggguccuaggggcugaacucaggccagcaagcuuaccggcagauacuuuugccuggugaaccuucuugcuggcccagggcccuguuuuuaacccaagccacacuaacugcagauuuagaauugauaguuuaaguuaauuuaaugauucuagcuugggaauuaacuagcugaauauuuugcuaacaaugaauggaaucugaccucuuacuauucuuauugcuagaaaucaagaacccagugauagcugggcaugggguuagcaugggguacaggucauuguaucaaaaaaacaaacaccaaaacccaaaaacaaacaaaaaaacaaacaacuuuucugccucauggacuaugaggaugaaguccauucuuagcauucagaugucagcauugaggaaaauaccaacgucacugugaaggaugcaguuauugugaaguuucuagaggaaguucggucgcauccaugucagacucacagaugugagugcgaugugcucugggcugaugcaggugggagauggaaaggagccgcgacuguuggugcuguccugagugaaugcccggugagcacagcaugaugggagcacaacgugggcuuccuuccgcacaggccgaggucugcguaugcucaccuuucuuuagcguccuuccucgggagugggacgcuuauucaagccggaaacuugauaagugaauaauauauccacaguuccagggaggacgugugcugcuugcucaguaucucaguuccagaagaugaguuaguucuugaggggaaugaagguggccucgguucaaagucagcugccuugauucagccagugacaaguuggaacuaggaugucacagacacuuuggaugauagcuaugcuuccggaaaaagcagaaacagaugaacaaucaaaguauagacacaagaaaccuguggggaaaaagacuucucaugaugauguuuaauaaugaaaaaacaaaaaagaacacacacagaacccccacacaaacacaugcacacucacaaacucacacauguucucauucaaacaaaacuccagugguaagcaauacccaugacuggccugcagagggcaucgcugcaacacuguuaggccaugcuuuauauccucagugcuguaaggcuugagccuagcuagcuaaucccggaugugcuuuauuuguuaaaauuuaucuuauuucuuauuauugguguguguaguauauauguauguacgugugucugugugcacacaugccacaauacacauguagaggucaaggacaacauucaaguuagcgcucacuuucaccuuuauguggguacagggacugaacacaagucuucaggcuugcaugucaaguaccuuuaccugaugagccuccggauauauuuuacuuacuuuuguuucuuuuauuaauaauagauuuucccuucacacaauacauccugauugugguuuucccucccucugcuccucccaguuccuuccuaccucccuuccugucuagauucacuccuuuucugucucucauuagaaaacacaaacaggcuucuaagggacugugauaugauauaugauaugauaugauaugauaugugcuaugcugugcuaugauauaagcuaacacaucaaauugcaugaaacaaacaaacagaaggaagagagccaagagaaggcacgagaaacagagacucacucgcucacacacucaggacucacauaaaaacacuaagccggaggccauaguggacauuacaggacaugguauggcucugcacaggccugugcgugcuaccccagccucugugaguucagaugagcuuugauuauguugacuuagagcaguuuuucaacauguggguugugacccuuuugacaagccuucauuuccaaaaauacuuacauuacaguuuuaacaguagcaaaauuccaguuaugaaguagcagugaagauaauuuuaugguuggucaucacaacaugagcuaucaggguugaagcaucaggaaggcugagagccacuaauuaagagggucuuguuuucuugguguucuccauccccucuggaucguacacucuauggccuccuuuccuuggggaucacugagcucugaagggagggauuugauggagauccauguuuaggaaugagaauuccaaggcucucacuguuucccuaaggucuggcugugggucucuguauuuguucccaucugcuacaggaggaagcuucucugaugauggccgaccaaggcacugaucuaugaguauuuagcagagugucauuagggaucauuuuauugcuauguuguuuucggaacaguaguauucgguuuuauccuaggucucagggauguccauucucgggcucuugguuacucaaacaguguuggguguggguuccaucucauguagugggcuuaaaucaaaucacguauugguuggucacucucacaaguuuugugccaccauugcccugcauaucuuucaggcaggacaccauuguagauaaaggauuuguagguuagguugguuguucacauuucucuuuugguauauuuuaaacagaaaaagacucacuugaaaaauagauaucaacucccugcuacuuuuugauagaauugagcauuaguauuuuauacauuugaaauaauaucuuuguacuagguauaaauaaacaacauaggagauacagagaucuaggaguggauauguugagguguaaacuaaguaaaacaaaaaaaaguuuucuacaggaagaacacaagcaauagccacuagguuguuguugguggcaccugagcucuccugaggaaauggcgaguauagaaugaggacagauuugagugucauacagugaugauuucccaaacauguguccugacaugugcuuacugagugugcugccugcuguccauugccuugugcugcuucggucauccuuacagcacuggugggcauagggaagucugcagcugcagaaacacacagacucagugggcucugagaagcaacagagacccaggaacccaggccuucugacuccauuuccucaguuccagcacauugccccuuccuugccaguucuuucacguccuuaggcauuaacauguuucaugauuuuuccuuaauucagaauauguuuuggcaugucuguggcaugccagaguaccauggaucugugaauucucauauaugcuacuaaucugcugauuucuauaauuuuccuguuuuuaaacuuaaaaauuuuacuaaugcuggaauuugugaaucaggagaaaaugaaaaaauucagaaauguagacuccugggaaauacuuuuacuugccauaguaaaauuucguugccaauugauuggguuaucaauauaguuuucuaauguaguuuuuauuaaaauggauauuagaaaauuuccuucauuccuguuaauuauacaaaaucaauuaaaauaaauagaaaaauugauaaucauaggcuauuuuaaaauaauauuauaagcugggcauaguaugcacaccuuuaaucccagcagucagugaauuccagaccaucuuggucuguauaagguccgggucagcuaggacugcacagugagaaccuuacucagaaagaaagaaaggaggugaagggagggagcgagggagggagaaaaaggaagaaagaaggagggaaggaaggaaaggaggagggaaggaaaagaagaaaggaagagagagagugagcgagcaagagagagagagagagagagagagagagagagagagagagagagagagagagagagagagaaaaugaaugaaugaaugaguuugcuuccuuuuggcuagcauuuuuguuaaaaaugccagggagaagggagucuggagaucaagguaucuuaguaaagagagagaagauuuauuauuauuacgugugugugugugugugugugugugcgcgugagugcgcgcgcacgcgugugcaugcaugugcaugcaugcgggcucugugggaguuuaugugcuccaggaggccagcgaaggcagaagagggugccagauccccuggagcuggaaccguaguuaggaguguacugccaugugugugcuagaaaccaaauguggaucuucugcuagagcaagugcccuugauugacugaugagccagcucuguaaacucuagcuauuuucuuuuuaauuauuauuaauuuuuaaaauuuauuuaaaaacuuauuuauuauauauaaguacacuguagcugucuucagacacaccagaagagggcaucagaucucauuacagaugguugugaaccaccaugugguuccugggaauugaacucaggaccucuggaagagcagucugugcucuuaauugcugagcccuauuauuuauuaauuuuuaagguuagaauacacagugauauuuacuuaugguaucuucaaaauuuccacuuaugguuuuaauuuaauuuuauuuauauacuuauuuuuuaagacaaggucuuucuuuguagcucugcugucuuagaguuuucucuguagaccaggcugaccuagaauucacagagauugaucuacuuuugucucuugagugcuagaacuaaagaugugugcuacuacacuuggcgggauuuuguuuuuaauuauguguauaugugugugucuguguguaucuguggagugcuugugaaggccagagguagccacagauuccuggggcuaaaguuauaggcaauuguaugccaucugauaaggguccuuucuuaguaucuaacucugguccuccaaaagaguuucaaacucccugagugguuggcgccaccccuccagccuucauuauucuuuauucuaguuugucauccagucccucuacccuuaucagucuccacugucccauuuccucuucucacacuaaguuccugcuucagcuuugaugccaaauauaucccauugcauuaucuccucucccauuaaugugacuucucccucucucagccuucuuccuagucuacccuacacauauguccauguaugugugagccaaugaagaugugugugugucuucacugaaaaugaaagcacauacauacacacccucaagucugggucugcauaucagaagaaacauguuuguuuuuuugacuguggcuuacuuuucuuaguagugauuucaaguuucauccauuuuucuacaacugccaugguuucuuuguaugugaauaauguuucagugugcacugcacugcauuuucuguaccuguucauguguucaucuuggcuaguuccauagucuagcuguuguggauguaguguauaaugugagugugcaugcaucucugugcaggccucagauccugagggacaggcucaggagugggacacuggaucauagggcaggcagcuguggucucccuuuguuguuugaaugaauuuuuaacauuuucauugguuuacacauaacugaaaacauuaagcaguguguuugaagcaucuguaaugauuucugugguggcuggcugaguuucuaccagcagugaaggcucaccaggucaggccaucugagagcccuaaccauucacucugccacacuggugguccuucugguaacuugccccagccugagauaguucauuuacuagcagaaauuuuaauguuuugggagcagucccuauacaacaaagacaguucuguuacucaggaaauccuaggaauuuagaugaguuucacucucaggaucuaggguccuuaugguggccauuacucuguuuaaaaggauuugucuguuuugagacuugcauggacaucuucagugacaccuguguucuaauuacaaauccuucucuuccuccaggaguccggagcaccaauucucacggaugauguuagcuuacaaguguucauggaucauuugaagaaacuugcagugucgagugcugcuugacaugccagaugugucagacacucaacugacauuacuacuuuaguuccuuuugcuuuuuucauuuaucuguggaaacaacagaggucucucucuaaaccuguuuugugucaguuuggugugaggugacauggaaaaauguugaugauuguagauuaagcugaaacauauaaugagagcaaugagaacaaguuuguuuugccugauacaguauuauaauugguuuuguaacuuugaagucuuguaugauuuaauuauguuuaaugaguuagaaugguuugcuuuguauuacagauaccacuuauuuguauacugcagacagcucuagaguggcacugggcauccucccugaccuguuagggguuauuuaauaagagccaggaacaaaucaauagugaugauauauggcuaguuugcuuuuuuugugaaguaauuuucugguuuucuuuuuagcauacauuguauaugccauucuguauuuuguuaaauuggauuuauuuuauggcuuaagaauuauuugacuuuauaguagcaauuuuuuguuaagguaauuuaauauuuuugguuauuuaaaaaaauuauuuagagcuaaaaaauuugagugagguaauaaacccacagcagacauuaaaugugaaauucccacagagagcccaacucacauuacuaacuagaguaauuuuuuaaagaaggacguucucacuacuaaccauaucuuuuuuuuuguuuuaucauuuauuguuucccuucuuagauaauuucccauuguguucuucaguauuuuaacacuauucuaggaguuuucacuucacucuuuguuucuguuuccuugugaauuuaugaauuugugguucuuacugagacaguauuaauauaauguuuaauuaugucauguggagaugguucuguuugauuuauugauuaguaucauucacuuuuaccuuuuaaaguuuacuuguagcaaguguuuacauugcugagcagauaagucugacaaugaaauguauguaucaagugcugcacauguaagggugcucuggugggcgcagcaguggggacugacugcacccgcaugaacacaaucagacgacggcgaagcagaaacguaaauuguuauuauacucaacuaucuaaauaaauuacuuuguucuguuuuauuugaauugaacugugcuaggccaaaaugccaauaaaauauaccuuucucuguuuucuuaguuauuuuaaaaucuaguaaaagccugggaaacaucauguaaaauaagagugcuuuuuuuguuuuuuuuguuuuugccagggcuucauuacguuacucuggcuguccuggagcucauuaguagaccagggugaccucaugcucacagagaucugcaucccucccugguggugggauuaaaggcaugcaucaccacacugggccuacauuuuuugauuggcacacagcuguacaaauguauuaguacaaugugauaauucaauaccuguucauagaaauggucagauuaccuuaauuaguguuuucauuucuucuaaacaacauugcuuuguguuggaaacuuucagaccuuucucucuuaauucuuauaaaaauaugcaauaaauuguuguaaacugccauca

SEQ ID NO: 6664 - RNA, 15082 nt, Mus musculus
uguagccgguggccucggcggaggucgcuuaggcgccugcgccgugccuacucugggcgccgauugagacuggcgggagcgagaaccauggcguggguuccagccgagucugcgguggaagaguugaugccacgguuguuaccuguggagcccugugacuugacggaagguuucgaucccucggucccccccaggacgccucaggaauaucugaggagagugcagugagugauuucgccccgugcgagugggcugguugucgugccccuguguacagcccuggugccgcgccugacccuuggugugcaacagucccuccucuguuugcguuccuaucuuucgggagguccgggaaauuuaagaucuuauuacacccuacgguuggcagauaacuuuugaacuugauugcacguuaagacguguguucuuaaauuucuuugcuuuucaucuaggugucaggcguuucguuuuuucauugggagcuugcacuuuuauuucccauuucauaauaaaguaaaacacaucucucuauucuacaaagcgaaauaauaaguaucauguauguauuacuuaauuguaggaucgaagcagcccaauguccagauguugugguagcccagauugacccaaagaaguugaaaaggaagcaaagugugaacauuucugugaguuuaaccaaccaccugggaauauuuuaacaacacacacauauacaacacgaacauuuuccuaucauaucaaaaauauaaguuaugguguguauaagauuagauugcuccuuauaaaguuaggcaccacuuggaagcuaacacagaggcguuuuggucuggaggccagccuacauugagacccucuggaaaaugugugugugugugugugugugugugucauuuaaaagauuacuuccccuacccccaaaaaguacuucaauuguuuacuaauauugaccuuuauagccgggcgugguggcgcacgccuuuaaucccagcacucgggaggcagaggcaggcggauuucugaguucgaggccagccuggucuacaaaaugaguuccaggacagccagggcuacacagagaaacccugucucaaaacaaacaaacaaacaaacaaacaaaaguacuucaauuguuuacuaauauugaccuuuauaaauaauuaaggauauuuuuuucuggauauaccuuuauaguuauuuuucaggguggugcauuguacacuuuuucaauuugaccugguaucauuuucucaguauagaaacacagcugucuuggcagcuuucuguccauauucuuuauucauuugcuuagccagcacacuuuuuauugagcaguuagguugugcugggcacuaagaacacaacagaggaucauaaagaaaaggucccuaaagaccaggccuguugguaagcacgcuuguaauccuagcacuuggaaguagagacaaaagggucaagaaguccagaucauucucaacuacauagaagauuccaggcuacccuggaauauauaagacucucaucucagaaacaaaggagaaaacuucccuaugcuuguacaguaucggucuccugaagggcacaaagaauagccaaauaauuacaucaucuggucauugcaugaagaaaauaaacagcacucaguagucaaaacuauagggcuagagagauggcucaguggaguccuuccagaggaugcagguucaauucugagcagauaguggcucacaaccaucucuagcucuaguuccaagggcucugaugcucucuuuacaccuuuucagguaccacgcguggauaugauacauagacaugcaugcagacaaaacacucauacacauaaaguaaauaaaacuuuuuaguuuaaaaaaaaaaaucucagccauuuacgguaguacaugguuuuaauaccagcacaaaugaaucagaggcuagcccagucuacauagugauuuacagaacauccaagaccacauaaggagacucuaucaggaaaaaaaaaaacaaaacaaaacuugggaguaggaggguguuuccucagggaagauuauaugaaaccugaggucagguuuuuccguuuuucaagguuuuugacaauguauguuugaaguaauuccucuaauguuuauaauuaggacauuuuaauucaugcacuauauauaaccuuacauguuuucacuagacgcacacgaguucauguguacuuggucuuuuuuccaauuuaccccacugaguucuguuagaaggugauaccugauuauuugggguuuuauaaaacauuuuuuuagacuuguuuccguuuuuguuguuuauuuuauguaugagugcucugcugcauguaaaccugcaugccagaaaaggacaucagaccccauuacagaugguugugagccacuacaugguugcugggaauugaacucaggacucuggaagagcagccagugcucuuaauggcugagccaucucuccagcuugacaccugaucauuuguuaacugugugcuauuuuggaaaauaaaaguaagacuuggcauguugaguauuuagccaccuuguuugacaacucugggguuucaaucaucaccaugccaauccccaccugucuuaguuaagguuuuacugcugugaacagacaccaugaccaagacaagucuuauaaaaacaacauuuaauuggggcuggcuuacagguucagagauucaguccauuaucaucaaggugggagcauggcaguauccaggcaggcuuggcacaggaggaacugagaguucuacaucuucauccaaaggcugcuaguggaagacugacucccaggcaacuagggugaggaucuuauacccacacccacagugacacaccuauuccaaccaggucacaccuauuccaaaaaguccacaccuccaaauggugccacuccuugguccaagaauauacaaaccaucacaccacccaucaacaaaguaaaggaaaucaaguagaccuuuucacgucuuuaaguuauuggguauauuuugaccuucccaaauucuuuauuugggguauaucucuuuuuuguuuguuuguuuuucuucacuguucuagaaucaucagccagcuggugguggcacacaccuuuaaucccagcauuugggagacagagacagguggaucucuuugaguuugaggccagccucaacuagugaucugaaggaguuccaggcauccaaggcuacccaaugagaccgggggaggggggggggcaguuauauucuuaguucauagaauuuagauuucauagagacuucacccauaaucauuuaguccguauuuuuuaguaagaugccaaagaaucuguuuuaguaacugguacauagauuguaaagugagcugccugcuuuucugcucugauaaaauguaccuuuauuuucuuauauaaucuuagacauaagauucuaguuacaacacuaacauugacucuaacauguguggacugauuuucagcuuuccggaugccagccugcgccugaagguuacucuccaacacuucaguggcaacaacaacaaguggcacauuuuucaacuguucgacaggcaagugucccuuuuaaugaaauuaaccuccuucggguguauuucuguucuaagacuaaaaaauuauaaauacguaaguauuuaugagugaguuaccaaauuguucuaauccuuaaacauauuaguauguauuuucugugaauguuuaaaauuuuauacaaaaacuuuuuuguuuuucauucuuugaagagcauuuauuuuucuuccuuuagaguguacacaagcauagaaaucacuggaaaucacaacaguuggacaguaauguggcaaugguaaaugaguuucuuggcuuaaauugucuaguauauaccugugugaaauaauccauagucuagucuuuaaagaguuaauugguuauuccuauuauuuuuauuuuucaucauaugccauuauguaaguuuaucaauuugcuauaguaauagucuggaccaguucauauuuuuuucuucucuuuauuugagaguaucacuauaucaccccagcugguauggaacucauucuguagaccaggcuaacucagacacggggaucugucugcuucugccucuggagugccggcguguucucaugccuggcccaugacuguuuuaauuagccuuaucuugagagauuuacgguagauguuguugucagggucaaaauagaauauuaaugguauaucaguuguaguaaaauaaguaaauaaggcugagaaguuggaaaguguucuuagguauuacugccuuguaauaguuguucuuuaugugcacacacaagugaauaauagagaggccaugugauuggauuagacuucacucaugccuccagcugcagucacagccuacaguucuggcagugagagcugcagcauagggauuuaaagggcagcauacuuacgcaguuauguccuuaacuaguaccgcgucuuuguguugggaacagucaggaugugugaaaccuucacuuuuuuuuuuuuuuuuuaagaaaaugugccaaaauuuuuaguuguuuauuucuugcauuugaaguauccuucagugauuucguuggcuucauuuuuuuuacuuuuuccuucagccaaaaucugaagaugaagaaggcuggaaaaaauuuugucugggugaaagguuaugugcugaaggggccacuggaccgucuacagaggaaagcccugggaucgauuauguacaaguagguggugccauagguaaacacaccaagugacacagagggcagacaucuguuaggcgaucggaacgaucaguccacagccucugccagauucagaccgcagccugcuuguguguaccucaugaccugagagucacuugcucuuucacaggcugagaaagacaaagccgagucccagcacuugugaggcagaggcagguagagcucuguguguuugaggauagccuggacuacacagagaaauccugucucaaaaaaaaaagaacaagucugaccaccgagauguugugugacuggcaaagaucaggacuguccaauucuguguaggagaugcuugccaggcucucaguuaggucauggcugguugacuuagagagugucagucaaguuuguaaaauaauguaccaggcuccuaucucuuuaguguuagauauauaauaaucuuauaaauuaaaagauauucuuuuaguaaagggaguuuuuguuuguuuuauuuugggacagggucuccuugccuggauggccuugccacuccuucuuccccccagagucaucuggauagcuaggguacugaguguauguuauccuuucuuccuaggauucagggcuugguacuuuguuuguucugaucaggguauuuugugaagcaggauuaggaacuaauaaaaacauuuuaauaugaauucaaaacacagagacuaguggagaaagaggcacucagaauacacacccuagaacaucaguguggacuucucaagagucacuuuaggguuuugguguuuugcuuuguuuucaaaauuauugggccuggauuaaauauuaaguuuuaaguagucagaaacaaagaaaaacauauaauuagagaacuuuuuuuuuaaagauuuauuuaucacuauaaguacacuuuagcuagagggcaucagaucucaucaugaguggcugugagccaccaugugguugcugggauuugaacucaggaccuucggaagagcagucagcgcucuaacccacugaaacauguugccagcccuagaaaacccuuguuuuuguuuuguuuuguguuuuuugucuucuugucagauagggacucacuguguaacccuggcuggccuggaacuccuguguagaccaggcuggccuggaacuccuguguagaccaggcuggccucaaacucagagauccuccugcuucuguuuucugagugcugggagucauaccuggcccaauuaggaaauuuuuagaguaauuaauacauauccuucacaugaaaucuugagaguauauuuuaguuuuuggugacuuuguggaggacauugagacaguccuagccaggcuggccuauaagucacuguguaagccagaaugaccugacuucaaauccucaugauaccacacccaaaccaugugcguagcuacuauagccguacauguugugccuaacuccuuguucuucacgauugaccugcaucuaaguuugaagguaccuccaucacacgcguuguaagugccagcagacggcucagugccuucaagccugacaacuugaguucagucaccagaacccacaugguagaaaaaguccauggagaaagucaacuccugaagauaguccuuccauguacacacacauacacacacagucacagagauacaugaaauuuuuaaaaaucacucagugauccuccugccucagucucacaaguacugagugcuaagauuacaaccaccauugccugguuaagaauaugauuuuaauaaauaaaauuuuuaaaguaugaaauguuuuaaaaugcuacuuaaaaacauuagcuuucuuucauuugaagcaguuuuauauauucuacaauagcaagccaagugaauaacaguuuauaagagagucgagugaggaggcaagcacacaugcuuuguaccuacagaggcuacacaggggcauuagaucccaggagcuggugucucaggugauuugagagccaccuguaugagugcugggaccugaacuuggguuagcaaauagccuucacugcugagccaucucuccagccacuuuuccucuuauuuauuuguuuauguuccccacaguaccaagacuuaaguccagugucuaacucauacucgccaagugcucuaucacagagcuagaucccuagcccuuggguuuuuucugucuuuuauuuggcaagaaacuuaccaguuugcacagaaguaaaugaagccccucuuguguugucauuuaguaaauaccuuuuuuuuuuuuuccagguugguuuuccuccuuugcuuaguauuguaagcagaaugaaucagguaauugucaccaaauaauacauacagucuuuugcuuacagugcauaugaaaggguuugaaucuacuuacccaguguuuacagccuuauccuaggccuucagugauucggauuacguuuuaguguaggaaauuaauguuaauagcugugucuuauagcugaggaaacaggauuucaucauguaaccaagaauccccugacaguggagcuuguguuccugacaugguacuaagucuucauuuguguacauuccaauuauaagcgcuaagucugcauccaaagcucacuaaguaaggccaagacacaauuccaguuguaaagggccugccucggccugcagucucugaaaacugauaacuuacuggaccaaagcgggaaacaaaugggauuucauucuucagucuuugaggaauagagacuuuuuaauguucagcagugaagccgguuagugcaugucuuuaaucccagcacucagaggcagcggcaggugugucucugcguuugaggccagccuggucuacauaucaagcuccagcauaucgaggucucugucucagaaaggaaagacguacuuauaguuaaggucucuuauugaguuuucuauuaacauuuaaggaaggaaauauucugaagcauugauaauuucauuucuauaauuuucaaacauccuucucuagccaaguuuguuucuccugagauuugguuuucugguuaaucugaauugguaaguagacugaagggucuuuuguaggaguguuugaaauuuuucaguaguuacaaacuacuuuuuaagccuaagauuuaaagccuaaguuuuauacuucagaguauaaaaauauuucucuuaaaggauuuuauagccauguaugcagacucaugccuguaauaguagcacuccagaggcaaaggcaggaggauggccacaaguucaaggccagucugcuccauauugugaauucgggcagaccagggauacaaagugagacacugucucaagaaacaaaacaaaaagccaguugcuauguguaagccaucuaaugaaauuacuccuuacucauggugucaagaacaaagacauuuuaacccucagagcugcuuuuuaaccgcaguuacuugaacucauguugaacuucucaguauuuuaccgcuaaugucacuguuuccugccccgccucucccucccuccuuuccuucuuccaccccacccccacccccauccuugucucuuuuuaaagacaaccauuacuagugucuuggaauaucuaaguaauugguuuggagaaagagacuuuacuccagaauugguaagauugcaucuuuuucuuuucauuauauaggcaaaauuacauuuacuuaugugaggugugacugcagguuuuuuuguuuuuguuuuugcagggguuuuuuuuuaagauuuauuuccuauuauaucuaaguacacuguagcugucuucugacacaccagaagagggcuucagaacucauuacagaugguugugagccaccaugugguugcugggauuugaacucaagaccucuggaaguguagucagugcucuuaaccacugagccaucucuccaggccccgugacugcaguuuuuauacuugugggugggggggugggugcaugcgcacgcacacauauaaguauucauguguucugcauauaaaauucaaaucuuguauauaaauguauuagucaggguucucuaaagucacagaacuuauaggucgucucuauauaguaaaggaauuuguugaugacuuacagucuacaguccaacucccaacaauggucagcagcagcugugaauggaaauucaaggaucuagcaguugcucagucccacauggcaaacugucaaagaagggagaaagccuuccuucuuccaauguccuuauguaguucuccagcagaagguguagcccagauuaaaagugugugccaccacaccuuuaaucccagaugaccuugaacucagaaacuucuaccucccagccuccagauuaggaucuauggugagccuuccaauucuggauuguaguucauucuagauauagucaaguugacaaccaggaauagccacuacaauaaguaaggaccuuauaccagaagauaagucaauauauucuccuccuugagaaagccauagagacugggaaugucaugacauccaccuguaaauugcaguucuugagaagcggacacaggagugugagggcagccuuagcuucauagugaauugcagcucauccuaggcugcagaagaucuugucucaaaaguagaaacaagccgggcagugguggcauaugccuuuaaucccagcacagguagauuucugaguucaaggccagccuggucuacagagugaguuccaugacagucagggcuacacagagaaacccugucuuggaaagccaaaaaaaaaaaagaaagaaacaaggagcaaacaauaguagauaauacuauuagauagauaauaauuauuaguagauaauaaugcauugaaugcauuauucuacaaccauuuuauacaauucuucacuaacuaagcccccuuuuacagguaauaaaauauagcugaguuaguagauuguuuauagucacacagucugucagaggcagacuguauaacuuuacuugggguuuucucauccacuuuuuaaaaauggaguuggaguuuauuaaagauaauuuaauacaaaauuuaagcacggacauuaaaggaaaaacuuucuaaagaaaauuaaggcacaccaggaaccuggguguggucuucucugagagccacccuuucacauccucaggcagguguagcacaugaaccugcaauccuagaacuggguaggcaagggcgggcaaaucacgugaguucaaggccagccugggcuacagagcaagccugagugaggccagcuaggacuacgaagaaggcccuaucuuaguaaaaacaaguuuuaauauuuuuucaugagaugauacacauuaaaaucaaugcuacugauuuugcccuagggucagacccgucuuucacauaguuuuaaucaucuuauauauuguaacauccugaauagcaaacauuucaaaaaucagaaauuuuagcuagaugacaaagacaagaaauguuucuuucgggcuggugagauggcucaguggguaagagcacccgauugcucuuccgaagguccagaguucaaaucccagcaaccacaugguggcucacaaccaucuguaacgagaucugauucccucuucuggagugucugaagacagcuacaauguacuuacauauaauaaauaaauaaaucuuuaaaaaaaaaaaaaaagaaauguuucuuucuauuuucuuaauauucuuaacauuuuuauguauaaacuauuacuacuuuuauauuuuguaauugaaauagcauucaagaguauuccuacagauagccccagaauauugugggguuuuuuucaauguuuauuuauuuauuuuuaaugugccugcauauaugucugugaagguguugaaucccucuggaacuggagauauagcuaggugcaagcugccaugugggugcuaggaacugaucucugguccucaaaagagcaaccagugcucuuaacgacugagccgucucuccagcccccagguugugggcuuuuuuuuuuuuuuuuuuuuuuuuaaggaagggguauucacuucggcucagguccaggguccucauucccaugcugccuggcuccauuguuccuggcuacacagagcgucaugaaggaagggacaagcaggugcuuuacagugacccucagcccucaguuacuacugcauuuccagacacagucucaguaaauuggucaggcuggccuugaacuuguagaccuccugucucaaccucccaagacucuagcacuacacguccaccaaaccuagcaauuuagaguuuugcuuauauaccuuuagcuuuauaaaucuuuaaucguagcacccuagaggcagagacaaacaucucugagcugaagacuagccagagauacaugagacucugucucaaaaaaacucagaacauuuuugcuuauaauagagaaucucaggacaaggcauucacgaggcagagcaauagauuucugugaguuccaggccagccagggcuaugcaguaagacccugucucaaaaaggugugggagggggacuagagagauggcucagagaguaaaagcacuagcuguucuuccagagguccugaguucaauucccagcaaccacaugauggcucacaaccaucuguaaugggguccgaugccuucuagccugcaggcaaaauguuauauaccaaauaagggaagcgaggaccucaauuguaguacaaauauagacauaaguucauugggaaucaggaacuauuuugaaguauguaguggccuaggucugugguuagaaaacaaaaguauucaccucucuagacacugccuugauucauuuguagcggguaagcagguaacaccaucgagcauguagaaaaacacaauaaauggguucuucauuguuugucuauuaaucacuucuuaaauuuuuucuuagggaagaugguuuuaugcuuuguuggcuugucuugaaaagccuuuauuaccugaggcucauucacuaauccgacagcuugcaagaagauguucugaagugaggcugcugguggugaguuauacuguacuauuucagagucugucuacuaugguagaaaagaagauauaugagauaaaaaaaaauguggaauguuauuaguugggauuaaggagucuacagaaacaaaaaacucaaauagaguauauuaaauaacaaaacuagauaugguggcacaugacuguaauucagcaucuaggagauggaaaggggaguauugcaguucaagugcaaacugggcaauagcagaaaagaccuucucuagaaaggggggaggccaagcaugaugaugugcaucuucaaucccagcacauggagggcagaggccucgcugggaggccaaccaaggcuacauaguaagaaccuuaucucaagaaaauaguauggggcagggggacaaugaaguuuguuucucuccaguaaaggaagucugaagguccagacgagaucuaacaugacaagauccuagucauugguucugcuguuaugacuucauccuucucuuaguuuauuuuuguugcuguagcggaauaccugaagcugcuguuuauaagcacagaggaauugagucaggaccuugacuaugcuaggaaaacccucuauccaguuuacaaagaaauugauuuuaguucaguuuugagagcucaaaauacaagcucaaaggccccgucuggucuaccuuauauuuauaucauccuuuuagggaggaucaucuaccaggaguaagcuaagggcaguuccuggcugacguucaagaggggaagugucaaacucacucuauuuaaacccucaguuuccauaaaacuacaacccuugaaaacggcaauacagccgggcaugguggcacaccccuuuaaucccagcacuugggaggcagaggcaggugaauuucugaguuugaggccagccuggucuacagagugaguuccaggacagccagggcuauacagagaaacccugucucgaaaaaccaaaaagaaaaaagaaaacagcauuauaaguccuucagaacagcauuauucucuaaauagugaucuuaggcuggugauuugaguuugaucccuccaaacacacacacaccaaacacacauacuaaauagaaacguaauuuaaaaauaaagagauuguagcuggggcuguagcauuguuaaucacaaugcucacccaggaugcacaaagcucaagguucuaaacacaguacugcauaguucaagugugggaccccaagccugucagcacugaggaagcagaggcagaggaccaaggacagccuggugacuacuuaggaauuuugaggccuggcugggauacaugaaacauugccccagaauaaaacaaggggccucuuauaaguaacuaauaaacccugguaucugggaccucccuacccccaagugguuguccuuaaagucauaugcauacaaggaaucauauaugcacugaacagauuauauauucaagagagagagggcgagagagagagaguguguguguguguguguguguguguuuguuuguuuguuuguuuguuuguuuguuuugugcuggccucaaacucagaagagagucaugauauugagagagcuagauuggagagaggaaauuugggaccagggaaagugaucuauuuauauuuuaauuuuauaaaugaaagaugggcaggugagaaacccugucucaaaaaaccaaaagaaaaaaaaaaagaaagaaagaaaauacuuauggaaaaaaaaaauagccuuuuucuauuuuucagggcaguaaagaugacgaaagagucccagcuuugaaucugcugaucugcuuaguuagcaggugaguuaagaaauuuaacuucauguuuuuccuuguuaucaguaguaggcagaacauguuuaaugcuguguuaauuuucauuugcuguguauuuuuaucuaguauguuugauuacauuuccuuuugucuuuuaaucuguacuggauggaaccuguaccugucaggcagggagucuaccaaccaagcucuaucucguuccuucuaucaaaguuccugcugaauugauuugaaaauacagccuguaucuaaggaaaggcacacauugauuuuaggucucuuccuggacaugcuuugcucauugaucagcaguuuguuuugagguuugguuugguuuugucuugcuaacaccucucuaaagcuucauauuaacuaaauacccucaaguuauccuucccuccaccaaacaagauguauuuuugaaaauacacacauaguaaacaccuaguucuugaucuauaaucacuauguuuaauuuuccuggugcuuucuuccaagcauuuuucuuagugugucauaauaggaacucauuuaauccuauaccacccaguuuagagaugagaaaacuggcaaaagaaugcaaagugccuuugcugcuuccugaacaucacagagcuagcuaguguauggcagagacaggacccaaaccuaggcagcuuuacagaagagcuccgcauucccccacacccuuuguaugugugugaguguuccccuguuggguagaugugcugugguuuagucuuuguugagucauugugugcuuuugcuucuacaagcagugcuguccuugauaagugugcacacacugaauucuuuuucuuacuagguauuuugaucaacgcgauuuagcugaugagccaucuugauggcgcuuaccuccuagggauggaagaugauucuguggaaggagccuaagucugagaaacacaguuccaaccugaggacagauuacaucacuucuucaaguuaugugaagggcuucaucuuaaucugcagcucaagcugauauucaaaauauagauuugauugguuuaaagugucugaaaugucugugaaaaagcccauuugguaucugaugagcaauuggaacaguuuucucuuuuuuugggggguggggggugguggauauggagacaggguuucucuguguagcccuggcuguccuggaacucacucuguagaccaggcuggccucaaacucagaaaucugccugccucugccucccgagugcugggauuaaaggagugcgacaccaccgccgggcuggaaguuuucuuaaguugcaugcauugaaaagaggucaagugugacuuacuacuuaagcagcuuguauaaaaacugauggcauuuuauacaggccccuggggcugcuucauuggguuuuuuuuacaaguauacauauauauuuauguugaaauguauuuugucuauggaaauuuuuuugacucuugaacaaaauaaaagacacuggaugucuuuagaguugaaguucauacagaugaaauggcaaaucuguucauagucgacaagacuaauccaguguucauguuuaaacucaau

SEQ ID NO: 6665 - RNA, 19073 nt, Mus musculus
cgcguccggguaccgggagaaccacgguuuccucggaagcagcgcggucgccuccgcaucccugguccguucgagagaggauuucgaggucguugcccgggccggccggggagcacuugcuugcgguacggaaagucagcggcgugcaggccuccccgcgccagcuuuuccccccucucagccgguccgagugcacuugguuccgccgaggcgcacgacgguuccgcccccuucuuccuugucauugauguuguuguucuugucagugccgcaaccccgaccgccgggagcgcgaacccgagccggggccgcccgguuggugcgguggcggcggcggcagcggcugcggcugcugcagcugcgccggcugcgggggcugcugcgaggacugcgcaggcggccggggacgggcggccggcggccgagccggauggcucugugcgggcaggcggccggcgccgcgucgcugcccagcgagcucaucgugcacaucuucuccuuucugccggcgcccgaccggcugcgggccucggccuccugcucgcacuggcgggagugccucuucuacccagcgcuguggccccagcuccgcaucugccuccgcgucucgcccgcggagcagccgcggcuagaguuccucaugcgcaagugcggcugguucgugcgggagcugcggguugaguucgccgcggagaauuaucugagcggaggcggcggcccgggcgacggcgguagcggcggcggcaccgacacgggcaccggaggggaagacggggaggcccugcagcucuccucccgcuggcuggaaguacugcgcaucuacuuggagcugguguugugcgugcugcucagcauccggaacaacagguaggcuugcguggggaccgagagggucuggccuuccgcuggccuugggaaagaucccguggggugugccggccggccucaggauggccuuguguaggugcagcuauccguuccugaccagacuauuuccggagacagaagaggugauaacgggacuccuggagcgucucaggcaugcuuucauucauccguucuuguccaugggcuagagcugcugggcaaugccauuaucuuaugcgugggaaaguugugaguuaagggugaggccuguacaaaaaaauaaggugguuuucugauucugaauuugaccauuggugauggguaauuaauucauagugacgaggugaguaaguuuccuugcugauguccaugauuacaagaauuaaccuauaagaauucuuuaacaguccuuuucuuaccugaaauaguuuuacuagccugggccauguccaaagacugggaggagugcuaguuaaaaucauuaggggaggaaaauugucagacuugaagccgcaucccauacaccaucaggcuggacuuacucccagugauucacacaaaaguaacgcuaccuaacuuggggugggauaaaggagcugggcauacuguggggguuaaguaugagacucauugugcaucaggacuuuaguguaauuccaccuagagcucauggcccauauucggacuccagcacagagucccuaugaaagucuagugccugccaaaccauauuuauauuuucuuuaucuggauauucauuccaaacuuacaaugucacucuuaauuuggaagaaaaauaauugcagcaguuuacaaauaauuauuagugauuggacauuccaacacugcuagggucagggcagaaaauauuguacuguagagagcagaacugggugcuuacuaggucaagugauguacaugcuguuguguggcaguuuuccucuaagcaguguccuuccuuccacaaucuauaucccaccaucuuuauguuaaauagaguugagaauagauugugauuaauacuaagucauaugugucauacauauuuucgugaucuauaauuaaaucaagaguuuaagcagggugguggcagcacacgccuuuaaagcuagagcuugggaggcaaaggcaggaggaucucugccuuugaggacaaccuggacuacagagugaguuccaggaaagccaggguuucacagagaaacccugcuucaaauagguuaaacuguaaguauucuagccucauuguguauggaagccaggcaugauacagaucuggaaucccgggaccugggagcuagaggcagggagcuuaagugaguucaaggucaucaucuugugcagagcaaguucaaggccagcaugugcuuugugaacuccugccucaagaaacaaaacaagaccuggugugguggugcacgucuuuaaucccagaacuugggaggcagaggcaggugaauuucugaguucgaggccagccuggucuacagaguuagugaguucuaggacagccagggccacacagagaaacccugucuuaaaaaaucaaaaaaaaagaaaaaaaauuauuuaugggaacaaggcuccauuuuuuccagugcccuguuuccuaagcuuucacgugaacccauuccacuuccuugcuuugauuuuaucuguuaagauaaccaaagcuaaaauuuuucuuaaucagguucggggcuuucucaaaguugagcauagcuagagaccagcugauuuguucuguaaucaaccagcccugaaaaaaaaaaaaaaaaaaagucgggagggagggcauagugccuuugauucaaguaagaacuucucagugccuaguucuuuuugguauuuuaaucaucuauggauggaucuauagcauauauacacaacaguacuguaccacauuuugucuuuaauucuuuuucuuucauccuuaccauuuaaguuucuauccuaauguaacuuguuugugaaacccugugugucugcccuucugagucugcuuucacuucugcucacagcuguugguuguccacgagagaguacacuguggugccuaguagcguguucacuauggacauucguauuuguacugauguugucucuuuuuaaauuaaaucauauuggacugggguguggcuuaguugauaggugcuuuuaacuauuagugacacuugugacucugugauuaaaaacuacaacccuaaaacaguguauuaacaaugucacuuagaaguuuuuuuguuguuuuucuaguguugaaguacaaguguguucaaccacugccaguuuaagugcugcugggaacugaaccgagugcuuccuguacgccaaaaacuuaauaacuaauaagaaguguaaacauacauucuuuucauuuauaaugcucuugcuuuaugauuucugccauuuuuuaagcagaaguguaucagccauuccgcuuccgggcuuugugcugaauugccuuacucaaugcauagucaugccccacaggaaaagagcuaugcuaaccuagaguuguaggguauaaucagugguacugaucuucugagagaauaacaguuggcuuguuuugauuugucagagugauuauggcugccauacugguauugaauguguuaagaacagaugauaaucaacaauaaagaguaccucuuugccaauaaaacacaggguuucagaaaucuuuuucuaaaggaggccaagaccuccugcuugucuggaacugcaguaagagcucauuaaaauguuuuggggggguggagggcggugauggcauuuuuuuguuuuugcuuuucaagaccggguuucucuguagccuugacuguccuggaauuuucuguaaaccaugcuggccucagacucacagagauccgcuuguuucugccuccacagugcugggauuaaaugugagccccaccaucugcaacuuaaaugguauuaaauggauuaacuugacucugccgugguucuguaagacauucuaccacauucaaaaccaguucagaacuacacuuggagcuuguagucaagguguuauagucuugaaaugcuguacuucauacuuaagaaaaaugaaaacuguguaaguuaucaguaagauuugggauaauauguaauagcuuacuuacuaaaaaauacucucuuuaggagcauucccugaaucucgugugauucccggacucaccuaggcagguguaguuuuuuaacaguacauguugacauaauaauauuguauaauugauguuuaucuucucugugugcacauugcauguaagcuuuucugaauuggaacauugcaccaggccagagaauaugugggguuggguuuucuucuuuacaguucuaggcuuugccucuccuuccuaguguguagacuggcuacuuucuaguuauaucuccuucauuauccugugucuuagucagcuuuucuuauuccuauaacauauguuucaguuaaauuaacuaaugaaaagaaagaguuguuagacuuggugguguguguuuuuaaucucagcacuuggcaaguggaggcagguggcucucugugagaucggggccagccuggucugcagagugaguuccaggacagccagggcuacguaaagauagccugucaaaaaaaauaauaguuucaauuacuauuuugaagguuuuagucuguugagcuauuguuggcucuaauauuguugucugcccaguaugaucccacuagccacauaaguuuauugagauuuuaaauuaaauaaauacuauuaaaauguugacucaucccaccuuacucgugucagcaacccuaguuaaaugcccauggucauuugcccuguugcuuuuaucccgacuuuuaaauuuuccaccaccauccagaauggauguucaagccuacuuuaaccauggacuuugagaauaauccacaucuaaauuucagcacuaucucauuuuuuuuaaaaaaaaauuuuuuaaagguccauuaauucaacaaacuugagccuuacuuuucuugaaagaaaauguccuccagcaccuaacaaauacuguaugagauagcuuucaucuugaugugcucacggacuauuacguacuuuaaauggcucguuauagaauaaauauacuauguggggacugaccaauucauagugcccaagaaguagugcugauggagaaaauaggugagucugugcauucccaaacgacuccauaccuuaaaaugauaugguaauggaguuccccaaagauaacuuuaaggucacugugaauagggacuaaucaaacuucccagaagagcucaaugagaguaaaaucucaaccuugcuuuaauccucgauauucuuucuucuacuugaucuagugugcugaccccugggcucauaggauaugccacccacugggcuaaauuuguuuuaacaaauuuguuuuaagcuuuacugagcuuuuucauuuccaaaguuuccauaagggagggguaguguugagugguuuuuagaaucucccuuggcugaauuucuuauacaaguuguugaaauuuucauccuagucuggaauuggcuuccuuaugccuuuugaaucuucuuuucauuuugaauauguuuaaaacuaaguguuuuaauuccuuaguuuuucaaccauuuugguauauuugacucaguuauugaggagugaacuacuaaagcauuuauauugccuuuauauuucuuguguuucuucacugcaaauuuguacaucuauugggaucugugucuuuuacauagggucuuaaucgucuuaaucaaagauuucucuugggguguuaauccucaaugcuacucaaaggagagaaagcagacauaguaacaacaauucagaagcagcccaaagaguuaauuaaaagcauagaaaaauaaaaacaaggccagguguggcaauaucuuuaaucccagcacucagaggcagagacaagucgaccucugugaguucaaggccagacuacucuacauaucaaauucgaggacaguccagggcuuuauagagagacccuaucucaagcaagaguaaggauggagggaagaaaagaaaaagaaggaaagauagauagauagacagacagacaucaacuaugguaaaugucuucucauaccagagguucucuucugugcuaaugugggcaugggcauggaaaaugccugcaaagcagcagagccaaggcagucuguguugacaugucagggcacagacacuuaaaguguucagucauacccagcauguuggucucagucccaguguaaagggcuucaguauucuugugugguagaacccacacacuuuccucacauagacucgugucuaugaauuaguauccuggacauaagcaguucucaggacacacucuugacucucagaguuguuacuugauggaaagaggagaccuuuggggcuuguggauauaaaaauucagaggcuauugcucuuauuggaggugaaauuugacuacaauaacucucauaagacagaccacagauaaccuaguuauuuccuugcccagcacugauggugugcaaauaucagaucucccuuuuuaagcuguguuguggguuuuccuuuaaauuuuucagucguguaugugugaguauuuugucugcauguauaucuaugcaccauguggccagagaggguguuggaaccccugaaacuggaguuaacaggcaacugucagucaccuugugggugcugggauccaaacccagugagacccuccucagaaaaagaaagcuuuagggcuggagaauuggcucuuaugugucugauauuuccuaguucuguccauuccccugcaaauuucaugaaguuguugguuuuuaauagcugaguaguacuccauuguguaaauguuccacauuuucuguauccacuccucuguugagggacaucuggcauguuucagcuucuggcuuuuauaaauagggcagcuagaaacauagugaagcaacuguccuuguuauguguuuggagcaucuuuuggguauaugcccaggagugguauagcugggucuauagaacuauuuccaguuuucucagaacagccagauugauuuccaaaauggcuuaccagcuugcaguuccaccagcaauggaggaguguucuucuuuuuccacauccugcugucaccugcauuuuugaucugagucauucugauugaugugagguggaaucucagggucauuuugauuuccauuugccugaugacuaaggauauugaacauuucuuuaagugcuuuucaggcacuggagauugcucaguugagaauucucugcuuaucucuguaccccauuuuuaauaggguuauuuuauucucuggagucuuaacuucuugaguucuuuguauauauugaauauuagcccucuauuggaugcaggcuuguuaaagaccuuuucuugaucuguagguuacucuuacacgcauucacgaccggccaggaagaacacagcaaaccguaaucuucuguggcaaagcuuuauugcuuacaucuucaggagccagagagcaagagagagcaagagugcaagagagagcaagagagaauggcgaaaccccgucccuuuuuaaggagaauuauccuccgccuaggacgugucacuuccugauuggcugcagcccaucggccgaguugucgucacggggaaggcagagcacauggaguggagaacuacccuuggcacgugcgcagauuauuuguuuaccacuuagaacacaggaugucagcgccaucuugcaacggcgaaugugagggcggcuccccacagguuaccauuuuguccaguugacagugucuuuugucuuacagaagauuugcaauuuuuuaauuagguauuuauuucauuuacauuuccaaugcuaucccaaaaguccccccacccacucccccaccaacccacucccacuucuuggcccuggcguuccccuguacugaggcagauaaaguuugcacgaccaaugggccucuuuccacugauugccgacuaggccauccucugauacauaugaagcuagagacacgagcucuggggggauacuggguaguucauauuguuguuccaccuauaggguugcagaucccuuuagcuccuuggguacuuucucuagcuccuccauugggggcccugugauccauccaauagcugacugugggcuuccacuucuguguuugcuaggccccggcauagucucacaagagacagcuauaucuggguccuuaugagguaccauuugucaauuguugaacuaagagcauaagccauugguguucuguucaggaaaauuuccccugugcacauguguucaaggcucuuccccacuuuuuccucuauuaaauucagcauaucugguuuuauguggagguccuugauccacuuagacuugagcuuuauacaaggagauaagaauggauugauuugcauucuucuacacacuaacugccaguugagccaguugaugaaaaugcugucuuguuuccacuggaugguuucuccuuugucaaagaucaagugaccauagguguguggguucauuucugguucuucaauucaauuccauugaucuaccugcuugucacuguaccaauaccaugcgguuuguaucacaauugcucuauaguacagcuugaggucagggauggugauuccaccagaaguucuuuuauuguugagaauaguucuugcuauccugcauuuuuuguuauuccaaauaaauuuguaaauugcucuuucuaacuaugaagaauugaguugggauuuugauggggauugcauugaauuuguagaucuugcuuuuaccaagauggccauuuuuacuauauuaauccugccaaucuacgagcaugggagaucuuuccaucucagucuucaauuucuuucuucagggacuugaaauucuuauacaaaccuuucacaugcuugguuagagucacaccaagauauuuuauauuauuagugacuauugugaagggugucguuucccugauuucuuuuucagcccauuuacccuuucaguagaggaaggcuacugauuuguuagaguuacuuuuauauccagccacuuugcugaaguuguuuaucggcuguaagagcuuucugguagaauuuugggggucaauuauguauacuauuaucucaucugcaaagagugauauauugaauuccuccuucccaauuuguaucccuuugaucuccuuuuguugucuaauugcucuggcuagaacuucaaguauuauauugaauagguagggagagagugggcagccuugucuugucccugauuuaaaugagauugcuuugaguuucucuccauuuagcuugauguuggcuacugauuugcuguauguugcuuuuauuguguuuauguaugggccuugaacacuuaacaugaaggauuguuguauuuugucaaaggcuuuuucagcaucuaaugagaugaucauguggguuuuuucuuuuaguuuguuuauaaaguggguuacauugcuagauuuccguauauugagccaucccugcaucccugggaugaaaccuacuugaucauagugagugaucguuuuugauguguucuuggauucgguuugcaagaauuuuauugaguguuuuugcauugauauucauaagggaaauugaacugaaguucucuuuuguugugucuuugguuuagauuaucagaguauuaucaguauaacuauguuuucauagaaagaauuggguaguguuccuucuguuucuauuuuguggaauacuuugaagaguauugguauuagguauuggaaggucugauagaauucugcuguaaaaccauuuggcccugggcauuuuugguugggagacuucuaaugacugcuucuguuuccuuaggggacuauaggacuguuuagaugacuuaucugauccugauuuaauuuugguaccugguaucugucuagaaaaucaucgauuucaucuagauuuuacaguuuuguggaucugauguuuuucuuaauuucuucguguuauguuucccuuuucauuccugauuuugguaauuugauuuugguaauuucucugugucuucuaguuaguuuggcuaaggauuuaucuaucuuguuuuuuuuuuucucaaagaaccagcuccuaguuuuauugauucuuucuauaguccucuuuguuucuacuugguugauuucauuccugaguuugauuuauuuccugcugucuacuccucuuguauuugcuucuuuuuguucuagagcuuucaggugugcuguuaagcugcuaguguaugaucucuccaaugucuuuaagggaggcacucagggcuaugaguuuuccucuuagcucugcuuucauugugucccauaaguugggauauguugugccuucauuuucauuaaauccuuaaaagucuuuaaugucuuuuuccuauuucuucccagaccaaguuaucauugaauagauaguuguuaagcuuccacauguauuggggcuuucuguuguuuuuguuauugaagacuagccuuagucuauggugguccuguacaauacaugggauuaauucaauguucuugugucuguugguguuuguuuauuuuguguccaauuauauggucgauuuuugagaagauacaugaggugcagagaagaagguauauuguuuuaggauuaaauauucuguagauaucuguuaaauccauuugguucauauaaguucuauuaguuucacugugucucugguuacuuucuguuuccaugaucugucaguuggugaaaguggaguguuaaagucuccuacuauuauugcugaggcucaauguguacuuugagcuuuaguaaaguuucuuuuacaaaugugggugcccuuacauuuggggcauagauguucagaauugagaguuuaucuugguggauuuuuccuuugaauauguacuguccuuccccaucuuuuuugauaacuuuuggcuaaaaauguauuuuauucgauguuagaauggcuacuccagcuuauuucuuuggaccauuugcuuggaaaauuguuuuccagcccuuuacucugagauaguaucugucuuugacacuaaugugugguuccuguaugcagcaaaaugcuggguccuguuuacauaugcagucuguuagccugugucuuuuuauuggggaauugaguccauugauguugaucuccaggguugucuuccuuuguguuuucuuuaauguuucuauuuccguuuuuagauccuggauaguuuuguugaauuccuucaccuguuugauuguguucuccuguauuuauuuaagagauuuauguguuuccucuuugagagcuucuacuuguuuaccuguguucucccauauuucuuucucuuuuuuaaaaaaagauuuuaaauuuuauguauaugagugcucaauuugcaugcaugccugcaugacagaagaggacaucuauauuccauuauaaaugguuguaugugaccauauaguugcugggaauugaacucaggacaaccagugcucuucaccacugagccaucucuccagcgcucuccuguauuucuuuaagggaguuuuuuuauguccuucuuaaaguucucuauuaucuucaugagaugagaauuuauaucugaaucuugcuuuucuguuguguugggguauccagggcuugcuguggugagagaacuugguucugauguugucaaguggaauugguuucuauugcuuauguucuugcucuugccucucgcuaucuguuaucucuaguguuaacugguuucucugucucugacuggagccugucccucccaugaaccugugagucugugauccuaugauuuuaugauccuggcugugucagagcuccugggggucaugcugccucuggguguggacugaaugggugaggauccagagcagagagagacucugcucccugcacaggugcaaacuggaaggaacacagguuaccucuuucucauuuuaaaaaguauaguugaagaaauguuuaaugauuaauucugcuauaugaccaucaaauucaacauguagaacuauuuuuggcaaagaaauucuacucuguccaccaucuuuagcccuaaggaaacaaugaccuaacccuacuguucaauuguucuagaauuucauacagauagaauaauacaauaaauguaauuguuauauuuuugcuucauauacaugguauaguauauauaugaacuuuuuauuguuuauuccauuguguagaugucuuaaugauguguuuauucaccaacuggauaauauuuaaauuguuucuaauuuuauuucuauuaugaauaaaggugcugugagcuuuugaaucuaauucuuuauauaaauguaugcuuuuaucucucuugaauaaguucuuccuguuggaauuauuaaccuguaucuuaacuuuuuagcaaauugaacuauuuuaagaguguaucauuuuucacucucagcaaaauguacacacuuggugugagaucuaguuguuccauaucuuugcccacacuugguguugugaaucuuuguaauuuuagcuauuccgggguaaaaccacauucuuacugugguuuuaacuuccuccuugauaaaugaugaacgucuuucauaugcaauucaucuuucaucuguguugguugcaauguucuuucaaacucgauauguguuuuauuggcuuuguuuuuggcauguuuuucuuuuucugagauagacuguccuguaacucacuguggagcacuuuggucuuggguuugugguaguuccucuuuagccucccaugugcuggaauuucaagcauguaccaccacaucugcuuaaaagucuuuuuugaaucacagucuuuuaauuaaauacauguuuuaaaaauaguuccuguuaucucuguuuugccuuggcaaagguaaacaucucuugccugugugcuuuacugccccacacacuuaugggcuuguaauagucacaguggaaguugaauggcagaggaaaacacugggauuggugacuccuggcaaaaauggaaagugacaucauuuuacuuuauagacucuuauccucugagcacuuccuuuugacaaguuuugguugguuugguuugguuugguuugguauugggguguggguguguuuuauggguuuuuguuuuuguuuuucugguuuuuuuuuuuuuugguugguuaguugguuugguuugguuugguuugggguuggagugugggguuugggggguguuuguguguggauggguuuuaugguuuuuuuugguugguugguuugaauuuuuuugcuucucgagacaguuucugccuguaacagcccuggugguuguccuaggacuagcuuugaagaccaggcugaccuugaaugugcagccugccucugccucacuaguguugagaucaaaggugugggccaccuccuccgacuuacggcuuguuugaguucuuacaauugacaucucuuauaacuuaaaggguuucaguuccuaguguugcacauuauuugcaugaagccuguaagaucaguauuuggauucagucacuguguuccacagucaguaaagccugaguacgaguuuuuuaucagguccagcuucuuuaacaugcaugcuguuucuucauacuguguggcugagcauggauagcagugugaagcucauuuggagucuaagugagucagaaaguggaagcuccucuagaauguccuucuacauauuuuaguauguauguguaucauuaaacauuuaaaaaauaauuuuaaccauuuucucccauaggaaucuccagaaguuuagucuuuuuggagacauaaguguuguacaccagcaaggaaguuuguccagcacguaccucagcaggguagacccugacggcaagaagauuaagcaguaagucauacaguaagcucuacagaggcuugugcuaauuaauuagucuagcucuuuucuagaaaucacaagacacaaucaagaaugguuuuuguuuucagaaaauauauggggcuuggcaguuaagcaccuaacccauaaccaugaagaacccauaugaaugcaguaugggcguggcagacuaccuguucuaaccuugaaagacagagaccaggaauccccagagcaagcugagcagcugacuaguccuuucagcaagcucuggucugauugagagaccuucaaaugcacgcgcgcacacacauuacagaaggagggagggagggaaggagugugcauguguugggguagacuauauguccuagaaacgucuuaaccauacguuuuaguaauaguuauaugacacauggccuaacucuuuuaggauaaaucauauagcuugcuggguaauuauugggguauaaauucuuaauauuucacuuguguuugaguguuuugccugaauauguauauaugcacuacauuuaugucugguucccacaaagguuggaagagggaguuagauccccuggaaauagaauugcagguguuacaagccacugugugagugcugggaaaugaaacuggauucccugcagaacaaaaucucuugcacacagucucuuacugcuacuuagagguguuaauucuucauuugccuuuguuauaaaauaagucauauauaucagucuuccauauuaguauaaaaaauauuauucuccuaagauaagaagcauuucuacauguucuuaucuuaauaaauaaaauaaaauaauguaucuuauuuauuauacuguaaugugaauuuuaauugcauuuguagguuuaguuaauagaaaucaauuauugagaagaaauguaucucaacagugaaugccauguaaagucaccauuaaaaaauugaugcugaguacuagugacaaaauugugacauuuuccuuguagaauucaacaacuguuugaagaaauacugagcaauaguaggcaacuaaaauggcuguccuguggguuuaugcuggaaauaguaaccccaacaucacugucgucucugucuaacccaauugccaacaccauggaacaccugaguuuacuggacaacaacauuccuggcaauagcacucugaucacugcaguggaacuagagcgguuuguaaaucuacgcucacuugcccuggauuucugugacuuuacagcugaaauggcgagagucuugaccgauagcaaccaugugccuuugcagcgacugucucuucugguccacaaugcuucagugaugcucaagucauuagacaacaugccaaaugaugagcacuggaaagcccugucacgaaagagcuccagccuucgggucuaucuaaugguuuuugauauuaaaagugaagacaugcuaaagauucugaaacccaguauaccacuugagaggguucacuuugacagcuacgucacuugugucucaggggcuauuguugaucuuauauccaggcaguaugacaaguuccuuacccauuuuauauugaugaaugauaugauugacacaucugguuuuccagaucuuagugacaaccgaaacgaagauccauugguuuuguuagcauggaggugcacaaagcucacccuuuuggcaauucaugguaugugcuuuuguucacucuaacuuauauuaacaucauuccugaaauagcuuaugcuaguaaauaucuuacaaguagaaagcuguaucccggcccugaguacucugagcacuccucagagugcuuuucuccugcuacugcuaaguaaauagauuguguccaccugcugucauggauauguuuguuccagucugaagauccuaaacuaagcgcagaaggagggaaaguauggcugguauauguacagucucauccuuuagauucuagugucgguauauuuacaauauuguugaaauaacuauuguuuagguacauguuuacuucuuaggcguucaucuuagugugugaacuguuuucauuugaauggaauugcuauucugauaagcuaagaauauuuuacuucgaagacaguuacaaaaauaaucuauaaaaaugacuuagucaaaaugguaucacacauugucaugaguuugaggggcuacguaaguucuagcccugccuaagcuacagagugaguccuuguuuaaaaauaacaaaacaagcaaggaauaucuuagguucucuaugcuaucucuuucauuguuuuagaaaccauuuuucuuagccugcaguugugauuuucacaucuucauaauugggccaugcauuacagauaguagcaagaaacagguccauauuaaaaguaguaagggguucuugggagaaaugguucagugaacuaaaugcuuauugugcgaauguaggaccagaguugagaucccacauaauagccaugcuugguggcaaccucaaaccccauacuugacccuggguccaacugacuagcuagaugagccaguugaguucuggcuccauuucaagauccuggcucaacgaauaaaguauggagaacaagcagggcaacacccaguaucaucuuggguccuccacaggcaggccuauucauguguacccacacacauguaaacacgcuuaaaugcauacacgcuuauacaguacacacacaaaaaaauguaugaagugaaacggggaucagcaaacaucaaguuauuuaaaaguuaauuuaaaccagccauuuuauuacauuuuuuuucuuuaaagauguuagauagguaaagcuugccuaucaucugucccccuuacccuuucccagacgggaccucuaucuggaguaguuccaugacuucugauaaugaacaguuaacuuuaaaguuucaagugucauaaacuugugacuaugacugugagacaccauagagaaugauuuuacagugaaaaacugcaggcuauuguauauuguugauacuuauguugaaaaugaaauuuauuccuugugauacgucauuauccaaaguuaaaguuuuauuuauauauuuuaaaugucuucuguuuugcugaguaaaauaccagaauaagauuauacaccacuuaacaggucacaguugugugguguucuuagagacaguacacacuccuagauacucguguuucuuuauucucguuguguucugagggagagcacaugguaagugcagaugggaagcuucgcagcaagcacuugcugaggagagacugacuaucagacaggacggaacaagagagugacagacuugccuuugcuugucuuuaagguuacaccgugugggcgcacaaccucauugccauugcucgucuucggggcucugaccuaaaagugcuucaagucaccgaagaaagcauugauuuugaccaaggugaacuagccgaccaggauguggauccaguacagaaccuuauugagcagguaucacugggccuuggucagucuuggcacgcagucuuggacauugaaucacucagugucuucacugaaccaaaucgucauuuuuacagagagaugcaaagcuucagcgaagacauuuagcuuuuuuaaaauauauaauuccuguggcuacauaugcaaguagggucccauuauguuuuuuuuuuucauuaguggaaacuaauccuuuugugcuguguuuaaucaguauuagcuuuauagaauuauaaauguauauucuacuucuugaucaaagaacguaguuggguauugguuuuagaaguucaaagugacacuguauagggcuuucacgguuaaugggauuguuagcagaccuuaaggacauacagccaaugauuaucugagguuacuggcuaacuguuuuucacugaguuacucugccuuuuugacauuuuuauucuuuguuugucagaauccagagcucaggagccaaauauuuuuauacauauauauauaaauauccauagccugguggauuuguaugcaaugcacugcaucuauguauucugauagcaucucauugauuuuuguuugaaauagaaggaaagauaguaucccaaaugaguuaucuuuaacagaaagcugaguuuaacuuuuauuaccuauauaauaauugauauugccaauuaccauucugaauuucauauaguauaaguuagacauugcuuaauccuuuuuuaaauguauuuacauagacacgaacacucaaauuguuggauuuuuaaaacuauaucugacauaauuuuuuucaucuguuacauuaaaguuagcuuguuuagcccagauuucaaaacaguagagaagaaaggagccauauuccagggaaaccucugaggcuaagucaaagcacagaacuguaaaugcacaggcuugcaaaccaacauuagucgugaaaucccuaacaagucacuggauucucucugucagcgcaagugucagcugccaaagaauagauuuacaugaagaagugcccacaugcuggcaggggcuggccagcuguggccagccagauacugcuagauuguaauauuuaaggucgaauuucgaccugugguacacagcugugcuguggcucagucagcaaccucagaacucugaaaaaauaaaaaauaaaaaaaacauaaaaaaaaaagaaaaaaaaugcaccuguuucacugugaauagugaauguaaaggagagaaaggaaaaccaaaagcuuguuccauccagguaugagcugcuaugauacaugaagaacauuccaugaaguauguuuuaaaaccuuguuauaucugagaggcuuuaaaagccaauuuaacuguuucagggcaaccgcgguacagacguggucucugugagacuuccaccugacccaaguuuuaagugguacgaauguugugcauuuaauguuaaggacagucugcaauaauaaagugaguagccaacgugggugcccagcagugcugagaccuggcugcucuauuguaagcuuuggaaacacaauuuaugcaacagauguccagauaugauucuauuuauggaaaaaguuuauauguuuuacaaaugguuuuaccaucuuauauuaaaugaccuuuugacaggugugcacuguuuugucuccagugagcacauaccaugcggauuuuauauguacaucaguagugugaauccacuggcacaguguguguaaaugccagauguggugagauuuuaucuuguauaugugaucagauaaaauaacuccugacagaaacuguaaggaaaccagcugaauguuugaccugaugacugauguuguaugguuuauguuaaauguauauucuuuuaaucaaugaauaaagcauuaaaaagugac

SEQ ID NO: 6666 - RNA, 39897 nt, Mus musculus
gggggcgggcucucgggauuugaaauccagcgcuauuuguccgugcuggggaaguggacgaggaaggcgagcggaguuucagucugcggacacgcguggagcccuugcccgggccuccgugggucugaggcgcugcgagcccuggguaaccacggccucgagcugcuguccucaccaagguagguccucugcucgcucagccucgcggaccgaucggccggguccccgccugacucuucucgggcgucuaacuucugcucuguucgcucguuaacauugcugcccuagcgcccgagauuuguucuaaaauccgaagucuccgugaggaguagcgugggaaugcccaacucuuugucuccggacccagcauuccuagaggcagccgcuuaugcguucuuaggauugaauaccaugcuuguugcaggcaucuguagauguuagagauuuuguuuggaaaacaggaaguuccauggaacacagggcccccaaugaaggagcuagagaaaguacccaaggagcugaaggggucugcaacccuauagguggaacaauaauaugaacuaaccaguaccccagagcucuugacucuagcugcauauguagcagaagauggccuuguacaaggccaccaaugggaggagaggcccuuggucuugcgaagauuauaugccucauuaugagggaaugccagggccaggaagcaggaguggguggguuugggggggguauuggggauagcauuugaaauguaaaugaagaaaauaucuaauaauaaaaaagaaaaacagaagguuccuucauccuauccuuaaaguauaacacuguacagucaggcgcauuuguuguuguuuauuuuagagauuauaauuuacuuagauucuccuccccccuuccucccuccaaacccucccuuacaaaccucccuacucucuuucaaauucagugguucauuuucaccaauaacaguugcaaauauguacacacacacauauauauuccuagcuauaaccugcugaauccguguaauguugccaguauguaugguuuguuguuguuguuuuauggguuucuuaacgugcuuaugcucauaagcaugugauguggguuuuuuaaaauguggcuaucaagucuguuuugccauuuaauccuucugcaguuuuuaauguucuuauuguuuuuguuguugaguacaucgaauugagauuuauaaaugaauugucacuaggagaagcaggagcugguaggugguaaggugcucuacuauuuaaaucuccugcaggauuugucuuuugaauaugccugguuuauccacacaagcauuccucaugauaucaugcuaguagaaaauuuacacauacauuucaccaagcguguaacagugcuuggguagaagugcugcagcaggguucuacuggggagucuucuggcaaugaugcuuuggaagcugagggcugaacccacauuugcugugaaaauccuucagcuguggcaggcuggguggaauauugcaucgcuggaggucccaggagacacuuaagagcaggacauugacuugguccugugugggcuuggcaacaguaccugaaguuccuuagucacugaggccaaugucucaagucuucuugucacuggcuagagacaccauucucaaaguuucagaauuuauuaggggggggggggagguagugguguuagcguuguacucuuagggcccacagcuugagauugguuuacuuccauaucaacaccaucuugggguuaguucauuagcacacuggcccugucugggcuaggcuccuaucugagcuucuggauggccucugguggcuugcuucugaaaccuaguucuuuaacuaucaugauuucaaguuacaccaaaugacuauuaagcuaugugacuauugacauauggaggugaggugcgcugcugcugcugcugcugcugcugcugcugcugcugcugcugcuccuccuccuccuucccccaccccuccuccuucucauuaugcauguuugaaccuagggucuuccagucuaggcaggcaacaaguauuggccacuggcuguaaccucauguuuaccuuuucuuuugaagcaggaucuguagugacuuugcucuguagccaucuuggaggccuugaacuuacgauucucuugcuuuccaaauaacugggucuaugggccuugugccucaguucagcuuuuaucuguccuuaacauuucuggucuguugauacagauugggcuuguuuucagcuuauuugcauuuuaaaaauauuuauuuauuguauguaugugaguacauugucgcugucugcagacaaacuagaagaagguauuggauaccagaugguugugagccaccaugugguugcugggaauugaacucaagaccucuggaagagcagugagugcucuuaacugcugagccuuucuccagucucuuauuugcaauuuuuauuugugaaguauuucaucagacugaaggacugaggguacgcaauccauacuuugccaguuuucccuggcauuguacagucuauucauuuuuauuuuugagauaguguagcuuuauuggcauuauuaguggcuuuauuggcauuauuaguggcuuuuacuaacucccaucacugcccaccugauaaauauacaucucuugagugcuaaggccaauauaggucauauaguuuggugguuuucugcauacuuaugcccuagcuucaaucucuugcagugcuaaauuuaaaaaaaaaaugaaugaaugaaugaaugaaugaaugaagcacaucaguuuauagcuguugagcuaaagauuaugaaaaaaaugcacggcuuuucugucacagggaguccuggcccucaggaagcagaggcaagccagccagggcuagacagagaaauccugaaaaauacaucucugcagucccccuuauaauaaaucauuagguaaaauaggacuuuauauaugaauuuucaaguugcuuauuuauuuuugaaaaaaaugauaucuuuugaucuaauugcuuuaauaaguucugggcacuuaggauuguaauauuaauuuuccacauuaauauaauauauuguuauauacuuggaauuuuauuucuaguuauggaaaguaaaauuuacgaguaagaaacaaaccagguguaguaauacaugcuuauaaucccagcaccaagagggguagagugggaacgguucaggguugaugccagccuggacaauaaagcaaaacugugucucaaaaaagaaagaaacaaacaaauuuaagaccguguauauuuaaauuaauaauuuuuuccaaaaauucuaaauagcaauauauguaaagaauuaugcuaaaaacaaguuccucuuuauuagaaguuuucaaauaacauaauuaaauauucuggagcacaauagaaccaggccauuuuaauaauuaaaugaguauuucaggcauuuacuucgaucauuauugcuucugacuuaaacuuuuuaagugcauaaagggaaguacacuuguuaaacuuaauauuuuauagccuaauauguagccuaauagccuaaugcagaugucauucucuuuaugcaaacacuagauuggaacuuuagagaguuaugcuuaaauaaauuucacugcugaaguagaaugcuuuuauagcaugcucaagacccuguguuaauccccagugucagaacuaaaaguggacaggaaacucauccucguuggcuguaaaaucccuuacaggaacgcauuccuguagcugucaaguauaucucaaaacagauauucacaauucagaacuuaaggauauuaaccguuauuuguuggauggugcuuuuuuuuuaaugggauauuuuauguauuuacaucucagauguuauucccuuuccugauauccccuauagaauccccuaucccauccccccugcuccugcuuguaugagaguacugcccuacccacccauccacccacaaccuacacuggggagucgagucuucacaggaccaagggcuucuccuccuauugaugccagacaaugcuauccuaugcuacauauaugaagcuggaucccugggucccuccauguguguucuuugguugguaguuuaguuccugggugcucugggggugggggucugguaaguugacauuguuguucuuccuauagguuggaaaccccuuuagcuccuuuaguacuuuccauccggguccccaugcucaguccaauaguuggcugcgagcaucugccucuguauuuuucaggcuuuggcagagacucuccuuagacaguuauaacagacuccugucagcaagcacuucuuggcuucuacaacagugucugguuugguaucuguauaugggauagauuccccagguggaacagucucuggauggccuuuccuuuagucucugcuucacacuuuguccccguauuuucuuagacaggagcccuucuggguuaaaaauuuggaaaugaguggguggucacaucccccaaccaggguccuugccuaaccucuggauauggucucuauagguucucccucccuuuuguugggccuuucagcuaaucacaucccuguuggauccugggagccucuugcuuuccuggcaucugggacuugcugguggccacccacaguuccccaucccucauugcuucacaccucugcucaaauuucugaucuucuguacaucauccucuucuccuccuauaccugauccugacccccuuuuuccccccacccucuuccuuucuuccucccgaguaccaccuucuaccucacuugaguauuuuguucccucuucuaagaaggacugaaacauccacauuuuggucuuccuucuucuugaacuucauauggucuaugaauuauaucuuggguauuccaagcuuuucggcuaauauccucuuaucagugagugcauacuauguguguuuuguaauuggguuuuuaucucacucaggaugauauuuucuaguuccauccauuucccuaagaauuucaugaagucauugcuuuuaauagcugaguaguacuucauuguguaaauacaccgcauuuuuuguauccauuccucuguugaaggacaucuggguucuuuccagcuucuggcuauuauaaauaaggcugcuaugaacauaguagaacguauauccuuguuauauguuggagcaucuuuugggcauauguguaggagugguauagcugggucuucagguaguacuauguccaauuuucugaggaaucgccaaauugauuuccagagugguuguaccagcuugaaaucccaccagcaauggaggaguguucuucuuucuccacauccucuccagcauuugcugucaccugaguuuuugaucuuagccauucugacuggugugagguggaaucucaggguuguuuugaugugcauuucccugaugaguaaggauguugaacauuucuuuagguucuuuuccgccauuugaaauuccucaguuguaggauuuauaaagaucuuuucccagucuguugguugcuguuuuguccuauugacaguguccuuuaccuuacagaagcuuugcaauuuuaugaggucccuuuuguugaugaucuuagagcacugguguuguguucaggaaauuuuccccugugcucauauguucaaggcucuuccccuauguacgguucaguguaucugguuuuauguagagguccuugauccacuuggacuugaauuuuauacaaggagauaagauuggaucgauuugcauucuucuacuugcuaaccaccaguugagccagcaccauuuguugaaaaugcugucuuuuuucuacuggaugguuuuagccccuuugucaaagauuaagugaacauaguuguguggguucauuucugggucuucaauucuauuccacugaucuaccugccuaucucuguaccaauaccaugcaguuuuuuguuuguuuguuuguuuuuuuguuuuguuuuguuuuguuuuguuuuuuuguuuuuucaagacaggguuucucuguauagcccuggcuguacuggaacucacuuuguagaccaggcuggccucgaacucagaaauccgccugccucugccucccgagugcugggauuaaaggaccaugcaguuuuuaccuuuaugaagaauagaguuggaauuuugauggagauuacauugaaucuguagauugcuuuugacaagauggccauguuuacaauacuaauccugccaauccaugagcaugggagauuuuuccaucuugugagaucuucugguuucuuucuucagggacuugaaauucuugacauacagauauuucacuugcuugguuagagucacaccaagguauuuuauauuauuugugacuauugugaaggguguuguuucucuaauuucuuucucagccuguuuauacuuugaguagaggaaagcuacugauuuguuugaguuaauuuuauauccagcuacuuugcugaaguuguuuaucagguguaggaguucucugguagaauuuuggggucacuuaaguauacuaucauaucauuugcaaauagcaauauuuugacuuauuccuuuccaauuuguaucccuuugaccaauguuuguugucuaauugcucuggcuaggacuuugaguacuauauugaauaaguagggagagagugggcagucuugccuagucccugauuuuagugggauugcuucaaguuucucuccauuuagauugauguuggcuauugauuugcuguauauugguuuuacuauguuuaggugugggcuaugaauuuaugaucuuugcuagacuuuuaccaugaagggguguugaauuuugucaaaugguuucucaguaucuagugagaugaucauguguuuuuuuuuucccuuugaguuuguuuauauaguggauuauguugaugcauuucaguauauugaaccaucccugcacaccugggauaaagccuacuugauuguggugaaugauccuuuugauguguucuugcauucgguuuucgagaauuuuauugaguauuuuuguaucgauauucauaaggaaaauuggucagaaaugcucccucuuuguugggucuuugugcgguuuagguauaagcguaauuguggcuucauagaaugaauuggguaguauuccuuuguuucuauuuuguggaauaguuugaagaguauugguacuagguuuucuuugaaggucugauagaauucugcacuaaacccaucugguccuggguuuuuucuugguugggagacuuuuaaugacugcugcuauuucuuuagggguuaugggauuguuuagaugauuuaucugauccugauuuagcguugguaccugguaucugcauaaaaauuguucauuucauccagacuuucuaguuuuguugacuauaagcuuuuauuguaggaucugaugauguuuuggauuuacucaguuucuguuguuaugucucccuuuucauuucugauuuuguuaauuuggauacuguugugcccucugguuagucuaaggguuuuucuaucuuguugauugcuucaaagaaccagcucuugguuuuguugauucuuuguauaguucuuuuuguuucuacuugguugauucagccccgaguuuauuuccugcugucuacuuugcuucauuuuguuauagagcugucacgcugcuaguguaugcuuucuccaguuucuuuuugaagguagucauagcuaugaguuuuccucuuagcagugcuuucuuugugucccaugaguuuggguauguuguggcuucauuuucauuaaauucuaaaacgucuuaaauuucuuucuuuauuucuuccucgaccaaguuaucauugaguagagcguuguucagcuuccauguguaugugggcuuucuguuguuuuuguuguuauugaagaccagcuuuaguccauggugaucugauaggaugcaugggauuauuucaaucuucuaguaucuguugaggccuguuuugugacugauuauaaggucaguuuugaagaagguaccaugaggugcugaaacuaagguaaauucuuuuguuuuaggauaaaauguucaauagauaucugugaaauccauuugguucauaaccuguuaguuucacuguguuucuguuuaguuucugauuccaugaucuuuccauugaugagaguggguuguugaagccucccacuauuauugugugaggugcaauaugugcuuugaacuucaguaaaguuuuuuaaugaauguggaugcccuugcauuaggaguauagauguucagaauugagaguucaucuugguagauuuuuccuuugauguguccuuccuuaucuuuuuugauaacuuugguuugaaaguugauuuuauuugauaucagaauggcuacuccagcuuguuucuugggaccauuugcuuugaaaauuguuuuccagauuuuuacuuugagguacugucugucuuugacacugagguguguuuccuguauguaacaaaaugcuggauccuauuuauguauccagucuguuagucuaugucuuuuuauuggggaauugaguucauugauguuaagagauauuaaggaaaagugauuuuuguuuccuguuauuuuuguuuuuaauauguuuguguggcuaucuucuuuuggguuuauugaaagauuacuuucuugauuuuucuaggguguauuuucccuccuuguguuggagguuuuuuauagggcuuuucuuuguaggacuggauuuguggaaagauauuuuguaaauuuguuuuugucauggaauauuuugguuuugccauuuaugguaauugggaguuuugcuggguauagugguagccugugcuggcauuuguguucucuuagagucuguaugacaucuaccuagaaucuucuggcuuuuauugucucuguugagaaguauaguguaauucugauaggucugccuuuauauguuacuugaccuuuuucccuuacugcuuuuaauauucuuuucuuuguuuugugcauuugguguuuugauuaguauguaacaggaggaauuucuuuucugguccagucuauuuggaguucuguaggcuucuuguauguucuuuaaguuagagaaguuuucuucuauaaauuuguugaagauauuuaguggcccuuuaaguugggaaucuuugcucucuucuauaccuguuauccuuagguuuggucuucucauuguguucuggauuuccuggauguuuuggguuaggagcuuuuugcauuuugcauuuucuuugccuguugugucaguguuuucuaugguaucuucugccccugagauucucucuucuaucucuuguauuuuguuggugaugcuugcauauaugacuucugaucucuuuccuagguuuuuuaucuccaggguuaucucccuuugugauuucuuuauuguuucuauuuccauuuuuagauccuggauguuuuuuguucaauuccuuuaccuguuugguuguguuuuccuguaauuuuuuaaaggauuuuuuguguuuccucuuuaagggcuucuaacuguuuacuuguguucuccuguauuucuuuaagggaguuauuuauguccuuccuaaaguucccuaucaucauuaugagaugugauuuuaaauccaaaccuuguuuuuccaguguguugggauauccaggacuugcuguggugggagaacuggguucuauagugccaaguagccuuacuuucuguuacuuauguucuuacacuugccucuagucaucugguuaucccugguguuagcugguuuugcugucucugacugugguuucucucuccugugggccuuugaaccugugcucauaauggugucaguaguccugaggagaccagcucucucugggugguaaugagguguagagaacugugugucaacauuucuggaagaccaguucucucagggugggauuugguuguggagagcugcgucacaggguuaguucccgggugcugaaggagaguggaaggauccuguccccagcugcucugcaguacccaugcccugugcauuccugguggguccuucuuuggccaguuaauggagcaaagugauggucucuccugugaacuuaggagugacagaacuucugggagacuagcucucuccaggugggauuuggguagggagggcugugggacagacagccuuaguuccagggcugcuuuuuuuuuuuuuuuuuuuuuuuuaaaugggcaguuuugaaugucaaacugcucgucuauugaaaaacaaugaaaauuguaauuuaauaaaacauuaaacauuaaucugguaugagagcuguauauucucuaguguugauaagaaucaauuaaaccuuuuaauaguauaauguuguuaauggaaaauuggcaaauuuuuaacuuuuuaaauuuuuuucucuuuuccuuuuugguuuuugagacagaguuucucuguauagcccuggcuguccuggaacucacucuguagaccaggauggccucgaacucagaaauccaccugccucuuccucccaagugcugggauuaaaggcgugcaccaccacugccuggcugauauauuuuuaaagggaccaaacugauaaaaguuaauuacauuacagguuucucuggacuccuucugaaguucugucugaaauuuuguguugaaugaauuuucuauaaaaagaauuuuguugccacucuccuaucaagaugauuguaacaccuuugaagcauucaggaauucauuugucuucuggaacauugcaaagaagaaauaugccucuagaugcagucuuuauugacagcaucccuucaggcacacucacuccuuugaaagauuugguaaaauaucagaaguccucucuaaaaguuaauggucauaaaaagaaucaguuauuagaaauaagaacuucuaacaauaaagaucuauuucaauccaccauguuaucagaggcuacccuuccaaacagcucucuugauaucaguguuauaaagcccagcauggauagauuaagaaaugaaaugauuuaugaaucaccagguaaaaucuuucaaagaaugaaagcaaaaguacagcgugacaaacaagaacaacugacaaggagcaguagcauguugggaucaccacagggugaacacaccaaagacuuuccuccuaacacggauaagaaagcucaguugcaacaaaccuauaucugugaggaaaaacaaacgucgguccaauccaaugacccuucauugggagguuaguuugauuacauaaggguuuaaaaugucuuuuuaacuguuuaaugugucaguuuuaagagcuuaguuaaaauaaugaacagacuaccaaaaugucuucucacauuccagugaaaguaauuuuuauugugggaccgaagagagagaacugcagacaugguaucaaaucccagcacuggggaaucauguagucuagguuggccucaaguuugaaagucucuugaaugcuggaauuacaggaauacauaucauauuacauuacuugauaugaauauaaguacauguauguguaugagugcaacacauuacuugauauguauacaaguauacacuguguguguaugggaaugugggagucaguaauaggauuuaagagcagauaaguuccugucuuugagauucugaugacucuuugucuaaugugcacacauaaaaaugauccuuuucuuuggcacaaauuuuaaguguucucuuuauauaucaaaaaaagcuuacuucuguauuuaaaaaugcauuaaauauaaaagacuuaaacuauaaaucagaguaaaauacaaauaguacugcuagucuuuauuuaucuaguugaaaaacuuucauuucucaacaaacuuuccuuucuuuaaaggccugaccauuauuucaaaagcugggcauggugauuuauuccuauaaucccaguauucaggaguauucuagaggccaaucuagacuacauaauaaggcccuacugaaaaaaugucaaagggauauaaauuuuuguugaaucugcaauuaggucuuaauauuucuaauuuuaaaagguagguucaaacucguuaauuguuuguucaugcccuuagucagaaccaccugaggucagccacuuaggaccuuggcauucucugguacacagugggguggaauguauuguuaauccaaaaugcgaguaaagcagauaacuuuugaggacuauauucuagucuuugaugcugcuuguacuaguaggaaucacggccccagacugcuuacaggggcuuaauagcaugcuuuugucuugaaaaggccaauuauaauuuggaaauuguuacugcucuaaccucagcauaauuuaaguauagaaggugaaguggaggcaagaagagaugguaaagggaaauguuuuuaaauuaacuuauuuccauuuuaugugcauugguguuuuggcuguaugcaugucugugugaaggugucagaucuuggaguuaaagacaguugugagcuaccaugugagugcugggauuugaaccuggguccuuuggaaaagcagucagugaccccaaccacugagccaucucuccagcuaacccaauucccuccuuguccccaaucucccucugcccccaggguuucucuguguagcccuaccuguccuggaacuccaggccggccuccagcucacagagaucugccugccuugccuccugagugcugugauuaaaagcccagcuaaagggaaauuuuuaugucacugguauuuauuauuaugaaagcauaugauacuggucagaagacuuuucccucucuguuucuaaagugccaaccaacagguuccucuagagucaucaagcauuucuagugucuuaguaacaguucuuuugcugugaaaugacaccaugaucauggcaacucuuauaaaagaaagcguguaauugggagcaugcuuuuauaguucagaggcauagucuauuaucaccaugguggggaagcaugguggcauucaggcaggcucugaagcaguggcuaagaucuauauccugauccacaggcagagagagacagacagacagagacagacagacagacagacagacagacagacacacacacacacauacacacauacacacacagagacagagaaacaagagacagagacuggccuuggccuaggcuuugaaaccuuaaagcccaccaccccuggggauacacuuccuccaacaaggccauaccuucuaaucaugucaaguagugcuacucccuggugacuaagcauuuaaauauaugagcuaaagggguaugggggggucauuuauauucaaaucaccacacccagcaaacaaaagauucaacaccaucaagaaaagaaaguggaaaauuacaauuuaaguuauguuauacucuuguguguuguugguuuguuauaaguuugcagucuuuuuuuuuuuuuuuuuuuugccaguuacuucaaaguguucuuaaauguucuagguauuuuccagugggcaauaagaacuaacuuugcaccuugaguuauaaaagugggugauacaugccuuuaaucucaucaggaggcagaggaagguuugacacuugcuagucuacauagugaguuccaggauaaaccaaggcgauauagaaagauugucuuaaaacagaaaacuagagacauuuaaauugaacuugaggauggacuauucuuaaugugcuaucuuuuuaauauaagcaguuuaaaacuuuuuauccccauagaaccuuucuauaauuuuuuguuguuguuauuguuguuuccuuuuggcagauccuccaauucugaaccaagaacaaaaaaauguuucagcuucgugcauuucaaagaaggcauuaacuagagcccaguuuggcggacaaguucuucauucaaaagagaguccuguuaggaucacuguguccaaaaagaacacauuuguuuugggaggcauugauuguacuuaugaaaaguuugaaaauacugauguuaacaccauuaguucucuuuguguuccuauuaagaaucauagccaaucuauuacuucugauaaugaugugacaacagaaaggacugcaaaagaggauauuacagaaccaaaugaagagaugauguccagaagaacuauucuucaagaucccauaaagaauacaucuaaaauuaaacguucaaguccaagaccuaauuuaacacuaucuggccggucucaaagaaaauguacaaagcuugaaacuguuguaaaagaaguaaaaaaauaucagguaggaagaccuuuaaggcaaguauuuauuuuguuccucagagguuuagacucuauuuuugcuuuauuccuuguuuuauuauugaugguagccacuuaagccuagugaaaaaacagucaggcugaaaguaaggugacucaguuguuaauucuuaccuugcucuauugcuaguuuuaaacuucacuuaugccuggaagaaaugaacacugacauugcuccuacuuuuauuucaacuuuuuaggaauuauuaacauuugaaauagaaaggaauuauaacagauaaagaguugagauuuuucuugauaaaagcuauauaagaugaacaguaaaauacuuuaaagcaucaaacuauguugaauugaggcacuuuuuuuugaagggaauguauuaucaguucaagaagaaauacaagcauauaugaaacuuaggcuugaucuuccaguacuaaacaaagaaaaaggacaauguaaaauuucuaacuguuaaaaguguguccauuaaguuuuaaguagguauuaguggguauccaauugagagauacuauguaauuuuaucuugguuuuagaaaugaugaagugguugcaauuuuauaaucaguuauuugcuacaaauuguuauuuacaaacauuuaauguuugacauaaugauaaaauguuuggauauugacauaaauguauaaaguuugaauaaaacuacucuaagauuuccuaguacuucuucaucucuaccaugccuguuuauaccaguuagcauaagaauuuuaagccugccuggugugguggcacaugccuuuagucccagcacuugggaggcagaggcagguggauuucugaguugcaggccagccuggucuacaaagugaguuccaaggcuuuuuugguuuuguuuugguuugguuugguuuuuugaaacaggguuucucuguguagcccuggcuguccuggaacucacuugggaauacauuuugcauuuucaucccccuaaguugcuguguuuucuguaagauucggugguucaguguauauguuaggagucuccucuuccuuuuggcuaagccauuuuguaugaguauuuaaaauguagauccuucuggauuacaggcaagccauauaguacagccucaguuaaguuucuguauuuuuuucuuucuuucaauauuguaguuuuaacaauuggugcuuuaaaugggcugauuccuauauagauggcuacuuagaaaccacgaggauuacauggggcuuuucuuguaauucacauuuucuaaugcuaaaugcugacuguaaugcuaugugcaaauaguacaagaaauauuuuuuuaugcuugauuaggcaguccaccuacaggaauggaugauuaaagucaucaauaauaauacugcuauauguguagaaggaaagcugguguaaguauaacauuuaaauguucuuucaauaugauuaaguuagcuguauuuaagugaugagugacgaauagcaucuuucuauaaaacauguucuaaugagguuauaaacugaaggcaaaaguaaaacaugacaucagugccuugcuaaagauguuugauguaaauuacugauccaugaaaggaucaaaauuauuuaaaguucccaguaguuacauguuaauugacacuuuugguucuccaaagugaacgcauugucagacaguaggcuuuaacucuggugcucuguucuauuucugagaaccagccucuccauaguaaacaacuugugcugacacaaugucaaugaucacuguuucaaggcuaaacauauaagucuacuaguagacuaucuuacagccuuauccccuuuuucaugucuaaaaugcagcauaaauugccuuugcagggauuucacuaauacugcuuacuaccaauguuacuugaacaaauuaaaauugcuucuacucuacgaggcucaacuucuucauuaguacagugauaacacuaauaugauuaauacugugggaaggcucuucuuguuuggagaguguaucauguagcccaggcuggccguggguacucuaaguacaguauguacuugaagaugacuuuugauucaugcuuagugcucagcuuugcuguagguagagaauuaagugaauuaauauuugcaguaucaaagaauaaagaaacaugccuuuuaaagacgcugugggcugugguggcauacaccuuuaagcccuaacaauucugguggcagaggcaggagaaucuuugugaguuuggaggcagcuugaucuacauaguucgaagauagcaggggcuauguagagagaccauaucuuaaacaacaccaggaccaaaauaacaacccaaaaaaacaaacaacaacaacaaaaaaaccucacaccuccccucaaaccacaauaaagcaaaaaaaaaguauuaugguauagugucaucaguuuaauccuaauuuauuuaauugagagaacuuuuuuauagcaugaguauguuuacuaucuguuauaugaaaaaugcuuugcacuuagcuacuaguuucauuuagugauguaugaagaguagauuucuaggucagugauuugcuacuuuguuuucucuuaaguagacccucuuuacaaaauagaagguaaaaauauuggccuauguauuuauauuuuuaaaaauaugaaaaaaaaaccuuuaaaaugagauagauguacuugacauuuuugaacaugaaguaggcgggagggaguugggugcacauguaaucuguaaucucagguaguuggaggauguagaagucuaaggcuaucuuggguagcaucguaagacccaggagccagcaagauggcucacagggcagagccugcugcaaggcuauacagccuuaguuugguccccagguuccauaaguugguaguaaaggacugauucccagaagcuauuucuggcucuauaugaauuccauggugugcacacaaauaugugggaaaaaaaucccagaaagacaguaucugaauaaacaaaaauagcauuucuacaaaaagccaacaaaaaugugaagggccaccaaaaucuuugaaggcuuaggaacuauuaagcugaaaugucagauguugccaucaggaaauguuuguugacaguuuuucuuuccuugcuaaugcuauaucuuauaucagguauauagauugauugaccacaguauaguuucuuggcauagacucugaggaucacauuagccaagcaguugaauucuguacugguuaguccucagauguuuuguaauuagauuaauaaugcuguuauuguugugauagcuaagaguacagaaugaauacuuccuuuuugaaguggagagugacaucaagauugcaucucacuaugaagcccucguuggcauggaacuuaguauguagaacaagcuggucucaaaccuagagcacuccuccugcuuuuauauacaagguguugagauuacacauaacuggcucacacccaguccuucauuauaaguuuguaugcuucuauguguauauacaguuccuaguaaaguauaaauacuuugaccuuauuaaacuuauucuuuucccccccuagagauaugacugauguuuauuggcauagcaauguaauuauagagcggauuaaacacaaugaacuuaggaccuuaucaggcaacauuuauaucuuaaaaggauugauagacucggucuccaugaaagaagcagguaagugggcaucauuauuaguuaaaucuuucuauagccucuccucuuuccuaaauaaaucccaggaucauaaauugacccgaccccuuguagugucccacacaaucacgacuuuuauuacucauuucaguauaugccuaguacugacucuucauuacaguucagcuuugcuugucuuauuucacaaacaaaccagcucucugucacaaggcuuuucauuuccuauuuuuaauauuuggauuccauuuucccauaugacucauucccucagguuccuaugcccuggcuuucuaugucaguagaauuucccugacuaccuccuuuugaaauugcugucuucuccuuuucuccuaugaauauguuuaacuacuuuuucugugauaucaaucuagcaaagaauuuuacuuucugcauuugcuucuucucuuauauaauagaaauucaguguguaaugauggggauuuuauuucccuaacuaauggguccucaguacucuagcaguacuuagcauauagugaaucagaaguacacauuuugccaggcaugguggcgcacgccuuuaaucccagcacucaggaggcagaggcaggcagauuucugaguucgaggccagccuggucuacagagugaguuccaggacagccaagggcuacacagagaaacccugucucgaaaaacaaacaacaacaacaagaaagaaguacauauuucuugacugacagugaauuagagagaccucuuuaaaagccuaggcuuuuggauaauuucauuuucuauuuuuuaaauuaaaauaauuuuguauuuguuuugcucauuguuaaauaggauaucccuguuaucucacaagaaaauuuauguuuggauuuccccacaacuggaaggaacacauugauaaauuucuagaacaauuaagguaaacugucuaaauuuuuaaaaaucagcuuuucaagguauaaguuauggucccuaaaauguacucauuuuagauaaaaaaauauacugugccuuuucaaauucauguuuauguaaccgauguaaugugguuuugcuggguuuuuguguuugugugauaguuuugaagauuuuugugauuuuagggguuuuagaaauaauaaaccuuuauuagacuuucugucauguugaguaaauugaaaaagaaaauaaaauuggagacacauuucuaaggagaauucaucaaucgccuacccuuuggauggcguguaguuguuaaauauuggacugaaauucuugauucguuuuucuccguuaauuuucauuaguuuuugaguaccuaccagguacuuagcagacacugagagaaaaauuuuauaaauucuuguucuucaggagauaguaggagauagagaguuuuaaacuucaucugaguacagguauuguauaauaagaacuggugacuauuucuuccucgaacgugucaggugguauuuuucuggacauguugcuucuuuucucgaccauuuaacucugucuuuucaacagaaaagcaacuguagguaguguaaauugagcauggcugugucucaguaaaacuugcuuauagaacuagacaacuucccaauagugcuuuuuaauccuggccucacauuuacuagguaaguacuuuauuucuggacacucauugucauguaguuuucuuaaauaagauuacauauuuuuguuuguuugucuuuuaaaaauauuugcuuugagaagggucucauguaacagguuaaccucaguauguagcccagucuggccuugagcucugugauuauccuguugguggggaugcgcucuucucuucucuucuucucuuuucuuucauccuuuuuuuaauuguuguuguugagaaccaauauuugagaaagcaauaacacaacuauuuuagggcugaaaaaaagaacaagaccagacaggaaacagcaagaguccaagaaaaacaaaaaucaaaaaaaaaagaugcagaagauaaagaaacuuauguccuccaaaaggccagcaucacguaugaccuuaaugauaauagcuuagguaggucuaaauuuuucuuuguugcugaagugguagagucuuauauaaacuuaacacuguuuguaguaugugaugugugguguggugcucuuugacugauuaggaccuuaaaauuccuucuuuuuuauacuuuuuuauacuaaggugacuguguugcagacugcugcuucaucguucuuuuuauuucacggaguaaaucuuuaucacaaucccaacccccugauaaauauauuaaugaaagauuauauuuagacuaucacuaucagcaaucuuguaguagagacaaguaucuauauuugcuuuuauggaggaacuugcauauaaacucaaguggcaagugcuuuaaagguugguagaauuguuaugucagcucuuuuuuaacauuauaaucuaccucucacacuacccuacuuucacaaauaauguaugaaauaauaguaagaugauaaaaguuaccgaaauccuuuauguacauuucuuggaauuuuaccuugacuuuguagcuaagaucuauacaaauuuuuaaaaucucugagaauugcacauuauuuuugcuaaagcuguggcaccauguuagauguaaauauacuacaucucucucuaauggcguugugucauuuaaacucuuucuccuugaaacuuauuuaucuuuucuagaccaaagaaaguaauaauuuagaaguguaaaugauggcagacauuucacuuaccaaagcuuuagcucuuucucaauccuuucuuuuuacaaaagucaucaaguuuucuuaacuuuggcugguugcuuauuaucauuucuagaacauuuugaaucuucuagaauccugggacuauuauuacuugcuauuaccucuacccuacugccuguuuuacuccaaaaugaaaaauaacacugggucacuuuuuuagagaaguaaucugacuuguaacuaugauuauugaaaauguuauagaaaaacacgugacauguaggauggaauacacauuuaaaagauuaaaguuugcuacacuauauacuaugcuaucuaugcacauaagaagaaccaaaugacuuuaaagcaucuucugugaaccuugcuucaugcuaaaaauuuagggaugaauacggcuuggcaucuccuuuuagcaagugcuguuuaaggguacauacuauauuauaauuguauccucuuucuaagaugaugcacuguaucuuguuuuaugauacuuuuagauauuaauuauguuuugaaguuuuagguguugcauuaucauacucugauuagugaugcuuuagugauuauuuuugucaucaucaguauauuauuauacuuucuuugagaaaauaacaaaaaucccugcuagaaagauggcucaguggcuaagagcaugaacugcucuugcugagcaccugcuuuuguucaguucccagcacccuuauagugcucacagaugccugagucucuagcuccagaaauccaacauccuuuucuggccucugcaggcauuacaugugcacaaauccauauauacauaucuaacauuaaucaauaagguuauaaaaauaaccuuaaaaaugccaaccauaacaugacuguauuuuaauuaucuaacauguaauuuuucauauuuagugcuguaaccauuauaucauaguaaugaaguuuaaaaacuaccucuaaaaaaaaacuaucucuguauuaucuaagcauauuauaaaggaucuauuagaauaucagcuuccuauacuauacaguaaucuccaggaugaggccauccauguugugucuuacaguuccuaaaagaguaauaaaauacguuuaaggccagguauucuggcacauacuuguaguccuagcacuuaggacaaugaagcaggaauuacaauuuggaauuuuaaggacagccuggucuauagaguaaaacccaaucuugaaaagcaauaguaagccagguggugguggcgcacgccuuuaaucucagcacuugggaggcagaggcaggcggauuucugaguucgaggccagccugguguacagaguugagacagacugguaauggugugaguuuuugaaaccucaaagccugcuccucagugucacacuuccuacaguacagucaaccuccuaauccuucccagacagcuccacagacuuggaaccaaggauucaaccaugugagccuauggcgaacauucucguucaaaucacuacaauaagcauacauaggaauuaccgcacuuagaauuccagguagauuugcuucugcauucuccauuuuuuuagaucagacugcugaucucauuugcuuucuucacauauguauaagaugcucgaauagauaucaaguucuguagcuuuaauuauuucccaugauaauucuuggagauuaggagagauuucaaagaugugcugcuuuggcuacauugaggaugagaguagagcuguauggguagaguuucacauuuuucuaauuauauccuuaacuagcacaacuuguuuuguauuuuacauggcugcuuaggauuaaugaccccaguggauuucuuaugucuucuaacuauuuuaugucuugagaacugauuuuuaaaacauuuguuuaguaucuacuaguucuugagagucuacacuaacuucagaaaaaaaaguuuaugaaaauuaagauuuuucucagucuaacuuaaagauuaagacugguauacaacuaaaauguaggauaccaaaaugacauuuuaaaaaguauuaugggaacuuaaugggagaaugggagaguuuggagaugcagugggcuaaagaauacguuccgagcaagccauugagguucuugcagauaaguaaaggaacauuuuaagggaagguaaacaauggaaguucaggcucaagcaauuugagaaauauuaggucuaauacccauggaguauggcucuaauuugaggcuggugggagacuggaacuauauugaaggccagguagaaaagcuacauguaugccagccaauuggaaagccacuggcagaauuguauacauaaggacauccuuacauuugaagugacugaucuaaauagaccagugcuuuguguaaccugucugaaaauuugucuuauuuuguaagaguauuuucuauacuuacaagauuuuguuucuaauuuccaauaaaauaagagagaacugaaguacccacugaucccuugaacucacuggaacagccuaccuccggcaaagaaagaagacacccgcuucucagucagaagagagcuuauguuuuaauaacaccacuuagaaacaaaaaguugauagagcaaagauguauagacuacagucucucuauugaaggaauaucggacuuuuucaaagcaaagcaucaagaagaaagugacucagauauacauggaacuccaaguucuaccaguaagucucaagagaccuuugaacauagagugggauuugaaggcaauaccaaggaggacugcaaugaaugugacauaaucacugccagacauauucagauaccuugcccgaaaaguaaacaaaugcucaccaaugauuuuaugaaaaagaacaaguugcccucaaaacugcagaaaacugaaaaucaaauagguguaucacaguauugccgguccucaucacauuugucaagugaagagaaugaaguagaaauuaaaaguagaaccagagcaagaaauacaaaagaaaggcugaaucgggagagagaaaacacaaaccacaucacaaaagauauccuccucauuucagaaacugaaggugagagagcuuguuauaucacaccaaagagaccucgaucuuguuauaucacaccaaagagaccucgaucuucugcuaaagagucacauuacaaaucugcuguuagcaaggacuuucucacugaaggaaaggcaucugauagaacuagcagacagcuguuagaccaucuaccugguuuaacugaugaugaagaauggagugagcaagaguuacagaagcuacauugguaaguaauuaugucucugcaauaucugcagaaugguuacaaaacagcagcaagagaacaccagugauguuagcgagcuuuucagaagauguaguggugauaaaucacauuguuuguuuguuuuguuuuguuuuuucgagacaggguuucucuguauagcccuggcuguccuggaacucacucuguagaccaggcuggccucaaacucaaaaauccgccugccucugccucccaagugcugggauuaaaggcgugugccaccacugcccagcucaaaucacauucuuuaagaacugaaguugaguuuggcuggagagauggcucagcaguuaagagcacucacuggcagcucuucccacaggaccugagguugauucccagcacucacaaaagugauuuacaaucuauaaguccaauuccaggggguuuuaugccuuucagaccucugcacaaauauacauggaggcaaaacagcauacacauaaacagauuuuauuaaaaagagaauugaauuugacaauagagacuaacacuacuaagaaugugguaguagggcuggugagauggcucagcagguaagagcauccgacugcucuuccaaagguccuuaguucaaaucccagcaaccacaugguggcucacaaccaucuguaacaagaucugauucccucuucuggugugucugaagacagcuacaguguacuuacauauaauaaauaaauaaaucuuuaaaaaaaaaaaaaaaagagcacugacugcucuuccgaagguccugaguucaaaucccagcaacuacaugguggcucacaaccaucuguaacaagaucugacgcccucuucuggagcgucugaagacaguguacuuuacacaugaugaauaaauaaauaaauaaauaaauaaauaaauaaauaaauaaaucuuaaaaaaaaagagugugguaguauggaaaacagaucauuauugacuuaugaagccuaaauaggaagauuaaagagauugacaacauauguagacaaaucaagaacauuggcaaagaugaggacgagaaguccauguguaauauaagggaagaucauuugguugcuguuuugucagaggguugaugcuaggguagacaggcugauggaagugauguagucaaaagaaaggaaaaugcaacugacaaaggaacaugcuacauuuagaguucuauuuacucuauguccuuaaaagugcauagcuuugggauacauuucaaaucuuuuuaaaaguucuuucugagacauuucugugacacuguacaaccuucacugauauuuccaauucccuacaugguccuuuuuuuguuuauuuuuuuuuuacuuccucaaauucuuauuuuugucuauuuucuugcuaugguauguuccuuagugaucuuuuauccucuacaauuuugacuuucuucuuuguuacagugauccucagauuuaucuguggcccugaauuguuacauuuagauuuguauuuacauuuaguggugaaugaaacuauauaaaucuugccuaaagaucugacuacuaaaaauguaaaagaauauuuuugauauucauuuuucaugcccuuaguaauuuuuuaaaucaaaaauuuuuuaacuuauucacuguacauccuacucacuguccucuuccaggucacugccucccacaauccuucccccucccucuuucucugagcuggugaggacaccaugggguccguccccccacccccuccccaucccccgcaaggcacaaggugcuuucuuuuccacugagaccagauaaggcagcccugcuaguagaacaaaucccacauacagacaacagcuuuggggauagccuccauuuuagaaccuauacaucuguuccaucugaguggggagaccuaggugguaauguuuuauuucugaagaugaaguucuuuccaucaaauauauuuaaacucugucauuauugguuaaaaaaaucuuauuaguugcuaaauagcuuuucugugggaccaucuaugugcagccuguuuucuuacuauuccuccauccaucucagaccucaccuauuuauuaccugaauuguaaaaguaacuuugugcuugucauuuguacuuuccaucuggguaaucuaccucaaauaucuucagguuaggcuugagacugucacugagaccugggcagugauggcgcacaccuuuaaucccagcacuugggaagcagaagcaggcggaucuuugaguuucaggccagccuggucuacagagugagucccaggauagcaaggugucuuacacagagaaacucugucuugagaggaggauagagagagggagagagggagaagaagaagaaagaggaauugaggugggggagagagagagagagaggaagaagaacaagaaggaggaggaggagggggagggagggagggagggaggaagguagagagaauauguaacagauuuugaauuaucaaaauuuuucauugcauuuaauauagcuucacauuuuauauucuccuuuaggucaaaggcagacaaugauaacauuuuuaccuuuauuagcuguaucucucagcauuuccuuauaauacaacuuuuuaaucuuauuuuauauuguuuuccaaaaucuauauauuuacuuauuugccugguugagacaggauuucucuguguagacuuggguguccuggaacaagauaaagcuggucuacuauucuucaacuauugaucugaguuucccaagugcuugaauuacagaccuguaauacaaaaccccucccucccucauucucccucccucucuccuuucuucuuucuucaauuuaaaaagucuggaauguuacacauaucaccaaaccuggggugaauguccauggguuuuuuuuuuuuuuccucccuuuuauagccucaccuaagcuacacuuaaagcuaaaagcaaucaggaaauggaccuucagacaaacagaagucuguccauucuaauucucaguucuugcuuuucuuuccuuguaaucuaguccacuugugaucucacaagggcuaucaucacagcacaccuuaggguguagacauaccuaaaacccauaugaagaccauuuuuaccuaucacuucacugcaacuauuucuuaucaccucuucugacuccauuagaugugauauuuuuuuuuugugaacaaaaaucuauccuagucauugccagugauacaaucaauggaugagcaucugaaaaaugcaaauuacuguccaucuuacuuagugaauugaaaucuugauuagcgauguauuuuuuauuguguucauuccugagaaugcaggugucuagcacauacaguaucacuguaacaaguuauaagaauauguguuuaugagacuauaagucugaucuacuguagauaauaugggaauuaagagaugaaagagaucaaacgugagccaaagauucaauguaaguguguuucauauagaaagggagaggccaauugagaaaucuugaaaggagucuggaaugaauugaauccccaagacugaaugaagaaauagcuccugaguggugggacuaaugaaugccaaucggaauaucaccauaagcuagagcaaguguucuaauggcugugauuauauguuaaauuugccucauuauuuaccuggaauaacuuggaagauagugauaauuacugacucuuauuaaaugcauuaaggauuauuuuuaaugaaaaauaguuauuuuagacagucguagauuuaccaauaguuuuauacaguacuaaggaacuugauaaaguugaacuaacauugucauauuaguuaauuaucccuaaucugaaaacccaaaaguuccaaaaucuaaaagucuuuguccuaacaaauaauaccaauggaaaaucgauacuuaaccuccuguuacaaugaaucacagagcguaaggguacauuaaaaagccuauaugaacucaucuucaagagguugguauggcauaauaguagcaugcuuccaagauaucaaagggaccucuguaauuaccuuuggucuguauguaugaagauauauaugaaacaugaguuaaucucauguucugacuagauucugaaacacuugugucuuaaguauuuggaauaaggaguauucacccugugccauuuuagaguaauugcugaauuaguuaucuagcugaaaugucaucuuaaccacaauauaacauguugaaguguggggagguggaaauaguaugguaggcuuuaaaacagugauuugcaggugaacuucuagaguuucauuuauagguugaauuagaaccaccucauauuuacaguuuuguuaguuuuugagaccuaguauuacuauccuuaaauucuaacuuuuaucuguugccucaacuuucucuagugcagggaucacagguguaugucaccaugcccagcuucuucuucuucuuuuccuuuuuuuuuugguuuuuuuugguuuuuuuuguuuuuucaagacaggguuucucuguguagcccuggcuguccuggaacucacucuguagaccaggcuggccuugaacucagagauccgucugcgucugccuccugagugcugggaucaaaggcgugcaccgccacgccccgcaaacuucauuuuuauuauaaguagccaaaaaauguuaauuguauguauuaaaggguuucccugugauauuuccauuuauacacgugucaugcauugaucaugcccauucacaccuaaucauaaaacuauggaagagcuagaaguuuaucuucuuguaaauuuacuaacuaguaauucuuuuuuuccuuuuucuuuuuuuuuaagauuuauuuauuauuauaucuaaguacacuguagcugucuuuagaugcaccagaagagggcaucagaucucauuacggaugguugugaacugccaugugguugcugggauuugaacucaggaccuucagaugagcagucggugcucucaaccacugagccaucucuccagcccuaguaacucuugauagacaauauauagaaguuaauauuuucuagaauucccucagagaucaaaucauugacuaguuguacuuggggaaaaaauguugaaaauuuuucauauuuaguagaaauaguuugaaggcauuuuacuagacauauacaauuauaucuucauaguuuauuauauuauaauaauaacauagaauagagugagauuaguaucuuuucucaauaguuaaccuagaaugauuuuuguuuuaaaaaacauccuccagcuuaguaaacaucacugacucaguauguucucagguuauuuuccuugauuugaauuucuuguucuuucugguuuuggucugcucuagugcuuuuacaucucuuccaaagcacaaaccuggcuuuuggucagauguggcuauggcaguagguucucgaacugcugaugagugccagaagaaauacacagaagaaccccaaggccaaggaucccgaaaacauggcucuaagaaaaagcaagccaacaagguccaaaaugguaaauuuuauuacuguuuucucagagugcuuagugcaguaguucccaaccuuccuaaugcugugacucuuuaaugaaguuccucacgcguggugacccccaacuauauaauuauucuuuguugauacuccauaacuauaauuuugauacuguuuugaauuguaaugcaaauaucugauaugcaggauagcugauaugugacccuuguguaaugguuguuugaccccacucccugugggcugugacccacagguugaaaaccacuggcuuaguuaauacucauaauugcuuaccaacuacauguuauauuuauuuaugaaucuguaucaguuguuucucuuaaauuuuaaaaucaggaacacaaaagaugauauuuuaagucuuaaccaauguagcuaauuccaucaauaauaguuuaguagguuguuucuuuuuaauuuguucuagaaagcuugauauuggauaaagauucauugucugaggauaucauuuaacaugaacauuugcuuucauuccugucauccuuuauggaaacaaucagauuuguguuuuguaaucugagauuuacuguuagcuauggcugcuaguaaaagauguuuuuugucagggaaguucuauaguaaguauagagaguaucuaaagaucauggcauaauaacaauuaauaaaucaaguggaucucacagaguaacuuguuuuuugucugucugucugucugucuguuuguuuguuuuaauugaacuuaagagacuuguacgugguagacaaguaaguacuauaugacuuggcuauauucuccagucucguuaacaaguuuuguugggggagggagagguuuuuuccuuuccuuuccuuuuuuauuaaguuauuuauuuaccucccacucacagcuuccucccccuccucuccuccuagucuuucccucucaccuuccugucuacccuuuccaccucuccuccccuucuccccugaaaagaggagguccccuguggauaucaaccagccuuggcagaucaaguugcauuaagacugggcacaucuuuuauuguggccagacaaggcaacccaguuaggggaaauggauccaaagguaggcaucuaaucucucucuggccccuucaaucuuuccuccuccucuuccacaggauuccccaagcuccacuuaauguuugguuguaggucuaagauggccuuacuauguuuucugucuaucuuggaacacucuauguaaaccucucuggcuccuucuagucuuuuaaccuuuuuguguaugcucuaggaguaucacaugagcuaauacagcauccauuccaauguaggaagaauuauuugugcuguguaugcuaccagcuaagaguaccuuuuggcauuuacuuauuuguucgagggguaaagguccacuuucuuguccagacugagcucaagagacaacaggccugugucaagguaccauguucauaaugucaccacauuuuuuugucugagcugugccuagugagcucuguuggacgguuugaccucaggaauaaaaguuuuagaugggagguugccucuuaccuuuggucuuuuuuuuuuuuuuuuuaauuuaaaauuuucguagcauuuauuuguguauguguaugcgugugugugggguguguguguguguguguguguguguguguguuugugugccaagacauaaaaauggaagucagcuauugaacucagguugucaggauuggagaagggugccucuacuugcugagucaucuugcuggccacccuuugucuguauaaggaaauacaugggaauuaagucauucuuaggacaaaacagguuuugagaaagugagaguggggcuggagugacgcuugagugcuugccgaagguccaggguugguucccagaaacucacaugguggcucacaccauccacaaugccaguuccaagagauccagugcucucucuugaucuccagcagcacuaaguaggcauggaggaaauucagaaguucauguuggcaacacacauacacauaaaaugaaguaaaucuuuaaaaguauauuaaaaaagaagcuggagagauggcucaguguuuaagagcacugacuccucuuccagagguguccugaguucaauucccagcaaccacaugguggcucacaaccaucuguaauggggauccgaugcacucuucuagugugucugaagacagcuacaguguauucauauaaauagaaaaauaaauaaaucuuaaaacuguauuuaaaaauuauuuguuuugcuuuuacuuuuauaaagcagguaacauaaaugaccaacucaucaaaauguuuuauugauucuuaggugagaaagacagugcugaugccaagacuauuaagauaacugccaaagugggaacucuuaaaaggaaacgacaaaugagggauugccuagaacauuuggcaaaagacaaccaugaugauuuuuucacugcaacacccuugcagaaacaaagaauucagguaagauugcugaaugcaugaaaucugcauuguuauauauuguuaguauauaucacuaaaaggaaaguccaugaucuguagucuuuacagacaugaacaaaaaauaugaagacaucugccauucuuaccaauuucuagucaucucuugaguguuucaaagagaauaaaaagugaagaagugggcccagggcaucucgaguuaccugacauuacuuuucucccacaaaacuaagcaaagcaacugguagccagguacacuuccaaagccuagacuuuuacaagagaccaaaguuggaaugcauacggcuguacgggacagaggccucuguaccuccaucccucaugcucacagauagcauccucacgaacccaaccaacuaggccagcagugccacuguugcugcagccauagacugugccguccagagacaggcgaggcgguucagcucugugagccuaagaguuucccauauaacacagugauuguguguguguguaaugugguauccaugggauaaguguuguuuuaacaaacucucaaauguucaauuuuacuaauaaagagucaguagcccugagagacagagaaagcacccagcuggcuuucuuccucugccuauguccccaaggaaaaagcagcucuccuccuucuugccuuuucaaaagccccucaaauugaaugugccucccuucuccuuccugugcaucuaucugcccuccugacuccucuugcucccuauguucacucacucccugucaacugguuguuugcucugccucuuuaucuaugguugacauuauuuaauccuguuuacaauaagcagaaagacuggauuaaaggugugugcuagggcugagccacgccauaacuagacacagacuuuucuaguaaccgacacaguaucaggguucacagugugaccacauauccugcaacaaauauaauuagucuacaugacucucauaaagaaguaacauaauacuagaugggaugagugcugauuuuauauguaguccccaaaacugaagaaacuaagcaaaauugcagaucuaaagccaacguguaaagcuaggaauguaucuaagucaggauuucuauuccugcacacaucaugaccaagaaacaaguuggagaggaaaggauuuauucagcuuauacuucuacauugcuauucaucaccaaaggaggucaggaagcaggagacgauacagaggccauggagggauguucuuuacuggcuugcuuccccuggcuugcucagcuugcuuucuaauacaauccaggacuaccagcccagagauggcaccacccacaaggggaccuccccacuugaucacuauuugagaaaaugccuuacagcuggaucucauggagguauucccucaagggaggcuccuuucucugugauaacuccaacuugugucagguugacacacaaaaccagcccguacaguaugcaucuuagugauuauaugugcuaaugcucuaggcucugucuccaccacuucucagugaguuuaaccuuuaccuuuaaacacacaaggauguuuacuggcugugcuguccugguggcccuuucaccuguuuuuauaaacaaaguuuuaguggaacauagugguuugcuuuuguauuguauauuacagccuucauacugcaguaacagacuugaauaauugggacuauauggaucauaaagacuaaaagcuuuuaacaugcuuagaaaacacuugacuaccucuguucuccacagccuuuagaaauagguauaauuguguuuauuuuguacaagagaaaaugguuuuuguagugucuguucuguguucuauuaguuuuaauuauaaaacuugaaaaaauuauagagaaaacaacuuaguccacaaaauuauuuugugaugagauaaauuugagaacuuagugaaaauauuuguuuucuaguugccaaguuuucaauacagucaagaugaugauuuucugcuagauauggacagggauccagcaucuccaucaucaauuauuacuucaccauugagaagcacuacuccacaaugucagcauuucagccccagcaugcuagccgcuauagaaagguaagugugaaugugagguucauuuuauauucaaguuaauuuaauauucaagaacauugaaacauuuuguaaauugauaaacuuaaaaacaucaaggggaaguuaucauuuaaaaaacugaagcauaaauaguuccuaaaaauuaagcauguuuaguuucagcaaguuauggguuaucucaauguauaauauuggaaguagaauaauuuuaauugaaauauauagugauccuuugugauauuauacuaugaauuaacaaucuuucuaacucaaaugcaaaacccauaaaucacuaaugaaaagauuuaauauuauguuuuaucugccaccaaucgcugucuauaauauuaagaugaucagagaaaaaacuguucugcugggucuggggaaauggcucaaugggaaaaagaguacuuagugcucuuacagggaacuugaguuaggagaucugacuuccucuucuggccuccaugggcagugcacucauguguauaaucuccaccccaacucccacaugcacacauaauuaaaacuaauacuaucaauuaaaaccuuuguaaaaggaauauaacauaauacaaaaaacguucccuggaauauauuuagcauuacugcaaauuaacagugaaacaguaacccuuuuuuacaacaugauagugaaaaacuauuaaucaguauuaucugugcagcugcaauuuguuggcauauauuacuauaaccauguacauugacgcaggaauccuacuuuuguagugcaguguucaaaacaacuagaaguuaauuugcuaagcaugccuuuaauuccaacacuuuggaaucaagacagagggagcauugaguuuggggacaggcaggacuacacaguaagagacuacacugucucuaaaagugaaaagggaugugcguguguacaggguuacuuuuuaugacaauuugagaacaauuguaaagugaaaaacuuuaacuucuguuauaccaaacaaucgcugggaaaguagacccauaggguguuaaucuggguagaccuaucauucacuaagcaaauauuagcagcuguggguuuauucauuuguacaacaauguuugugauuaaguuauguauguuaaucaaacaagaaacacaauuauauagaaagaaaagacuugcuaaguuagauugagacuugauauaauuggaagauguaaauggauaguuuuuauaccaggcaugucuaaaaggucaacugugacauuugguuuugauuaauggaagugaacaacaaaaguaguaaaaacaggaagugaacagucuuagggauaaaccuagaugguacccuagcucuuggucuuuugcugugaagagacacucugacuacaacucuuagaaaagaaagcaguuaauuggggcuugcuuaccgacucagauguuuauuaguuaauuauuauggcaggagcaugguggcuugcuagcagacauggugcuggagaaguagcuagaguucuacauccagaucagcaggaaauggcaaagacccagggcuugguuugggcuuuuaaaaccucaaagcccaccccagucacauacuuccuccaacccuucucauguaaugcuaccacugaugacuaagcuuucaaaccuuuaagaauaugggggccauucuucuucaaauagccacaguaggauagugaccaauuagcaaaacaaaguuuucuacuauagucuuuugaauauaguuaagaaaauuuuagacuuuuauugauugcuguuuaacaugauguugauuugacaucuugguauuauuuuauauuuauacaggaauaauugugauagauauguuuaccaaaugcaaaaaaaugcuaaaaaauauggcaagaguaaugguggccuugucuggggcaacauuaggaaaaaaacaguaaguguguuuuauuauuuauccuacacuauauguuauaaugcuugauaaacugugguaauuauaaguuguauaacugucucugcccuccaggaacuuacaaacuaaucuaauccuaauaugaagcuaguagugaagaaaguguauauagcacuguaggauuauagacgacagcuccuagacuggaggaacugaaccaagauauacaugggugaaaauucuccuuugaaaucugacuggaaaauaccaguccagaagggacauuuuaagcaauauaugaaaacacuguaccuacucaacaacugauuccagacugauuuauggcuuuuauagcuuugaaucaguuucagacucuuuauuuaucuauguauaugagaacacuguagcuguacucaugguugugcgccaucaugugguugcugggaaugaagguugcucgcucuggucagcccugcucacuccagucuacagauuugcacuguagcugacuucagaugcaccagaagagggagucagaucucaucacggaugguugugagccaccaugugauugcugggauuugaacucaggaccuucgaaagagcagucagugcucuuaaucacugagccaucucuccagcccuucagauucucuuagauuuagugaguauuuaaaauccaaacauaggggccgggcggugguggcacacgccuuuaaucccagcacucaggaggcauggcaggcggauuucugaguucuaggccagccuggucuacaaagugaguuccaggacaaccaggguuacacagagaaacccugucucgaaaaaccaaaaaaaaauccaaacauaggaaaacuuuaauugaagguuguuuuaauaaugaauagagccuggacaaaagacacaucuguuuggauuggugagaacaugacuuaguaguagagcauuucucugguaugcacauagacucugagucuaauccccaguacuaucucaaaaacaaauacuuuagagcugggacuccacuggaacagacuaguaauuccaacacuuagagggucaggagaugaaguccaauuagagcuacaggagucugcagugucaaaagacaaguuuuuaugaaaauucuuuuauuuucugagauuauaauuacauuauucccccuucucguucuucccuccaaaccuucucuacccacuugccccuuuucaaauucaugguuuauuuauuuucuuagcucuuaguccuuugaauuaucuuuuaaauuuuuaguuuucuacuuucaacuuuagguacucuuaaagaauaauuuauguagaugaauugugagaugacuuauggaaguaauucuucagaccagauauggccaucuccuccuuucuuugaaaucuuuauacuacaaauucacuuaagucaaauucuucuuagauuggaaguauauaaucauucguucucaugagcuuagccacaagaaauagugaauacuucauugcagaccuuggugugaaacgaaucuaguggcucuuaagagggcaucagaucucauuacagaugguuguaagccaacaugucgucguugcugggauuugaacgcaagaccucaggaccuugcucagaaagagcaagcagccagaguucuuaacugcugagccaucucuccagccccagcucauuucuuaagaagaaaccuguuucagaagugaaauagcagauugcuucucagugaucuucagaguuuugguguucuuuuucaguuucauaugccuuaaaugagaaucaaacuucuugcaaaagaccuaaaauuaacauugguaggaaagccuuggaacacaaauccaagauuagaugucuaguccauuuuuugguuuguuuuguuuggcuuuguuauuuaauuuugguugcuugcauucagaaauacucuaagucaauguuuccugaauuuaaauguucauagaaguuauuuaaaguucugauuuuaugaugcaauagacuugagaaauuuguacuucuaauaaucacuagaugauguccacacuguugaucugugcacggaccauggaucagcacagaaauuaauaaacuugauaguucucucuacuaaaugagaagagguaaauucuuauaaagcuuagggucuuuucuguuagaaacccccaucucucuuuccucccuuccuuccuguuuguuuuugagauagggugucuuuguguagucaugguuguccaggaacucccauugucagccacauugaacuugaacuuaagaucugcccggcucugucucccaaggacuggcauuaaaggcaugagccacuagacuuacuugguuauuuuucuuauuauguugaaauugagcaauguauaaaauugugauuuauuggauucuuuucacagucugguguauuaccaguguguuagcaugggaagaguaaagaauuuuguguaccauuucacugucuaauaagcaguaccagccuuauuacacuaagcaagugacuagacuuuucuaaucuaugccaguuuggauaauggcaacggcuugugacugagcaguuacgagaaguaaagcuacugugauuuccucaucacacagagguacuaauaaagcauucuaaacuaagaugcuaaguacugagcacauuucggcaacuuucauaggcuggagauaauccuggccuuauggaacauuaguuuauaauauuuucuuauauauaaaugucugccaacagugggaaacaacauuaaauuguagauuccguucuggauaaacucaagaauuuguuuucuuuagugacuaaaagugauguaacaggcccauguuuaagguuauaggaaaaagcauacuugauuucucaucugugagguaucacaggagauagaacuuugcuauuaacaugcacuuuuuuauagguuaaaacugaucucucaucuccaccaccaacacggaaagcccuguuuaacaaagguauuguauuucuuuauuuuauagcuuaguuccauuauaauaugaucucaauuugauggaauuaaaucuaacugaucucaacuagacaaacguaccauuuaguuucuuggaguuguuuucaguucuguuaaaauggcuggaaauugauuaauccuuuucauuaaauuuuucuuuacagauuuagguaaaaacacugauauuucaaaguauuucauugaugauacagaaucagaugaagaagagaaagauuauuacuuuuccaauucugacugauagacgacuugcaggaauuuuaccaucaagcagaauauacuuuuauccucauugaugacuauuuucuuuguaauaagggaaugcagauuuguuucccaaugucuuauguuuguaugcacccuauagagcauuccucagaacuacagcuuacaaauacuuugccuaugugugcauuuguaaauuuuauguuuguaauauuaaaguauauaaaguucagucucuugagaacauccaagccuguuuucuuuaguaaucaugucucaaguagaauuuuaauugaacuuuuaaaaggaggccuuaaaugaggagagguaaggggccagaguuaagauuguggacuggaagauacuagaaugaaaacuuuuagcaucaugcagccugaaauuacaagccaggguuccuucuguuuaaauuaugucauucaaacuguuuuaccugguuuuuauguuuuaccugcuuucucuucugauaguuuuucuuaaauuuuuuacuguauguuggucuguuugugaaaacuucaccucuaauucauuguucuuuauuauuuuauaaagaaagcuguggacagguucuguuguauucuucagcccugcuauaucuaucugauagauccacccuuacaaggacuuacaaugccauaaugagcaggguuucccuuucuuaccgcuucaaaagguaacuugccuucugccguuguuuuaacauuuccccuaaguuauuuguccucugcuauaguaguauucauccacccuuuaaaucuaguuagacugcgcaaauaaaaauguacauuugugaaauau

SEQ ID NO: 6667 - RNA, 788 nt, Mus musculus
cauggcuggacaagcuuuuaggaaguuucuuccgcuuuuuuuuuuuuuuuuuuuuuuuuuuuacagcaaaccaaggagcuagaaaguacccaaggagcuaaaggggucugcaacccuauagguggagcaacaauaugaacuaaccaguacccccuggagcuugugucucaagcugcauauguaucagaagauggcauagugggccaucacugggaagagaggccccuuggucuugcaaacuuuauaugccccaguacaggggaaugccagggccaagaaguaggaguggguggguaggggagugguggggggaggguaugggggacuuuugggauagcauuuggaauguaaaugaagaaaauaccuaauuaaaagaaaagaaauacuccaacguguugugaaagaguauugguugaaaggagugccgccgaaacuguaaccaaaggugacauuaugcuuccagaaaagucucaaagaaaaguguugcaagcaauggucguggcuguggggucagucgggaaaggauagaguggagaaauugagccugucagugugaaaguuggagauaaaguucuucacccagaauauggacgcaccaaaguaguucuagaccacaaggacuauuucuuauuuagagauagugacauucuuggaaaguaugucgacugaaaucacuuuugaaaugaugucaugugaagcugcucauuccacugaugucugaacuauuucaucauguaaauaauuuccaugccucccuuuuauaauaaacagaugaugccugaaagacu

SEQ ID NO: 6668 - RNA, 788 nt, Mus musculus
agucuuucaggcaucaucuguuuauuauaaaagggaggcauggaaauuauuuacaugaugaaauaguucagacaucaguggaaugagcagcuucacaugacaucauuucaaaagugauuucagucgacauacuuuccaagaaugucacuaucucuaaauaagaaauaguccuuguggucuagaacuacuuuggugcguccauauucugggugaagaacuuuaucuccaacuuucacacugacaggcucaauuucuccacucuauccuuucccgacugaccccacagccacgaccauugcuugcaacacuuuucuuugagacuuuucuggaagcauaaugucaccuuugguuacaguuucggcggcacuccuuucaaccaauacucuuucacaacacguuggaguauuucuuuucuuuuaauuagguauuuucuucauuuacauuccaaaugcuaucccaaaagucccccauacccuccccccaccacuccccuacccacccacuccuacuucuuggcccuggcauuccccuguacuggggcauauaaaguuugcaagaccaaggggccucucuucccagugauggcccacuaugccaucuucugauacauaugcagcuugagacacaagcuccaggggguacugguuaguucauauuguugcuccaccuauaggguugcagaccccuuuagcuccuuggguacuuucuagcuccuugguuugcuguaaaaaaaaaaaaaaaaaaaaaaaaaaagcggaagaaacuuccuaaaagcuuguccagccaug

SEQ ID NO: 6669 - RNA, 992 nt, Mus musculus
gacagccccuucucugcccuuaacaauugcugcgagguugaaaccugugugaacccgguggguauucuugaucugcggcuuccucucuccauaggccucaucaauaguccagcaccaagaccacuuagaacaauggaagguaauggauccgucgacauguucucagaaguccuggagaaucaguuccuccaggccgcuaagcuggugagaaucacuuggacucugaaauucagaaacuggaucagauuggugaagaugaacuggagcugcucaaagaaaagaggcuggcggcgcucaggcaggcucagcagcagaaagaagaguggcuuuccaaagggcacggggaguacagagaaaucggcagcgagagagacuucuuucaagaagucaaggagagugagaaagugguuugccauuucuacagagacaccacauucagguguaaaauacuagacagacauuuggcaauucuggccaaaaaacaucuugaaaccaaguuuuugaagcugaauguggaaaaggcaccauuccucugugagagacugcggaucaaggucauccccacgcuagcucucuuaagagauggcaagacacaagauuauguuguuggauucaccgaccuaggaaauacagacgacuucacuacagaaacuuuagaauggagacuugguuguucugauguuaucaauuacaguggaaauuuaauggagccaccauuucagagccaaaagaaauuugggacaaacuucacaaagcuggaaaagaaaacuauccgaggaaagaaauacgauuccgauucugaugaugacuagacugugcuguacuuuaaaaccuuccgucugucugucugucuacuucagaguuaaguguguuuucuaaauuccacugauuucggcccauugaccaucugacacucuuaucccagcguguacacugaccauuuugucugcagucauuguguauaacuugagagaaacauacuuuaaauuaca

SEQ ID NO: 6670 - RNA, 1357 nt, Mus musculus
caaggcuugguaucauuaacaguaacuuuauucucuagcaggucauuucucuacugcuucaguauuuuccucucagagaacacaaguuuuagaacuggaucacuuggcccuuccucuucuugucgccucccaguucaaaaugcuugcaucucuuaauggccagcauccucuuggaucugcaguugggcucaacacacucaagccugagcacaaucuucuuugugguuuuggccuucuuucgaaagauuggcuuugucugcccaccguagccacucugcuugcgaucguagcgccgcuuuccuugggcauacagggaauccuugcccuucuuauacugggucacuuugugaggcugaugcuugccacauuucuuacagaaaguccuucggguuuuugguacguugaccauguuugcaguagaagugucugcgaugagaacuguaagaaaguuucagacauuaaagaucuucaaacucgaaaguuuuaaacagguauaauuuguaggaacauauaaaaaaaaaacaguaauguucgaaaauuugugaacccaccaaguacucauuucccacgugaauaaaaggccaacacgcagcugaguggaugagcacuggcuuaaacaccgggguucaauccuuaccacuucaagccuauagaaaaacuguuuuuuguuuuuuuaaacuaaaacgaggcauuaacaguuaaaaacucagaccugauggaguguguccugggaggcugaggcagaggauugcuaguugaggucugccuuagcguccaaaggaacugacacuuggaguggccauuacaguucuccccaaaccagcguccaauuucuuaggucucacugcaaggacaacgcaguggcguccggguagagaaguuuugcucggacuaccccacagcaauucccuccguuuucuagcuacgaauggcuuacaacgaaauauagucguuucugcaacaaccgggcucguuccuuccccccagccacgucagucuguuuuggcuucacccccucuaaagcaccgucacucuccagcgggcccgaaggcugacgugucguuagcagccagcacgccucgccgcccgggagccgccaugcuggagcggucucuuccgagagagccgcgggcugaccucaagccgcggcgggcagcaccugccccuuuccgacgccucaaagagcuaggucggcuccggcuuccaggcgaccgcgguccccaaggaagcagcuaccgcucugcuccagacuuaccgagagaccggccgccgcgauccccgacucaaccgcacgcgccgaacaggaaagggacgaacagagcggaagucggaacugaaccugagcgacgggaaugcg

SEQ ID NO: 6671 - RNA, 2619 nt, Mus musculus
cucauucucaaaacuccuagaaugccuuuauugauacaaauagaagauucugcaaaaugauuagggaauuuuaugcaaaaaugaguauuuuauuuuggcagcacuaagaagaaaaaaaucaaaaccacuguauuucuacauugaggugaaaacauugcuuuaacuuccuuauuaaucaaauacauuccaaaggaaaucauguaauauguauguugaaagcacaggcaaaucuuaacacaauagcacaggaaucaguaauacugaaaaugacucuuccgacaggaugcuuaacaaacuuaaaacuucugaguuauugaaccaaaggauuccuuucuaauaacugugucaauagugaaacugggucugucccagaaauacucuagugauuucauuguaauacuuuuuacuguuguugacaguuuuaaauaaaucuugauauacuuaaaauaacuuuugaaaguggaaaaguauacaaaguuuuagauaaaaagauuaacagaugugauuuaaauaaaauuuccccuuucuuuuuuuaucaauaaucuaaucauuacuuuuaagcagauagacugaauuuuaaaacccagucccaaaaugaaaauuucaguuugaaauuuuaaucaguccuaacuggaaaggauugcuauguaucuggacaccuuuuacaagaaguuuauguauuaaagcagaggccgguuccuauaccuuuauucaauuguauaucccauugagacaaauauaaaaaauagaagacugucacuuuugcuuuugcaauugugauauuuuuuuuccucacugcagucuucuauaacuuuuacagaguucauggucccuaauaucuccccacccuccauuuuuccuagguggggaaauggcugccauaggaaacuucucaccgauaacuagaguuuccggaaacagguauuguuuguugcuauuuaauaaugacucaauuugggcacucuggguggauggccuacauguuuucuugugaugcauaccacagucuccagcaugaaaaauccuaggagccugaggaacuaagacuuuccagauuuuaggaagacaagcuagagucaaauacugaagaguccagucccaguuauaaucaucguaaguacagaaaguguccgugcauucgauaagcuucugauaugcaucucgggucaaggcuagccccauguugugcucugucgauuuccaaguuuucacaucuacuuugucagcaaugccauagaaacuccgaauggugguguaggucccuagagagaggacgucacacccaggacacuccugcugcuucaguuuccacaucuuuuugaagacaugguaaaagucuggggcuaaguagugguccucuuccaggaagaguauaaggccaguguaaucuugaagaacuuugacucuuucccauacaaaaugcagcuuccaccaccaaugguguuugguuugugagaacuuggccucucuguaauggccgaaggagucaggguauucggcauugaugcaccccaacuucagagcugcauucuucuuuaggucucuggggcaaucucuagggucacuacccggaaacucauucggguacagcugaaugcugaacggaaagaacacuugcagaaccgggcagaaauccacccuggagaucagacuguugaucucugcggaccagaagucauggcuaaagaugacuaggacuuccugaauacccugggcuuugcgaagcgagucuaucagcaaccugagguauuccggccuguuaugcaccuggaccaccagcaccagcuccccggggcuccaggugccgucauuaccgacguuccucagcaucugaucgaaguucaacugguacaccagggaccgguaccgcagcguuagguuguccaccuccggccgcgggaccgcgggaaccagaggagcggccgauucguuugagacccugcggaugccuacggacacagcaagguggcccgcaccccguacgggcuccgcguccagcagcggcgggccaagggcgucgcucuuccuuugucgcccauugcuacuccagaggacgaagccgcaggcggccaccacgagcgucaggauuagcaccuuccguuuguagaugcggaaccucauggucuccagggcccggagcgcgggcgcggaaaagaagcuggcggccucugcacggaaggggcgggcgggcggcgccgucgccuuggccugcagcccuaggaacuggcccccgcggcggcccucgcuaacucaucccgggcuccggcguccuggggcccgaaggcucucaacugccucgcgccgcccgggcuccgcgcauccucucuggcaguugcagcuccggcagccgccccgccgcuacgagccgcggcucaacgucgccucgguccucuccauucagcacccgggggucccggaagaagccccgccgcggucgccgacaccgugauuccuuuaccugcgcugcccguggcucugcguccucugcgcgcucauccuugcucgcacggcggaacggcgacaccgaacgccgcagccucgccccgcuccggcagcgaccgcucugacaagccgcgacuggccugcgagcgcccgggcccuccggcccacacccuccgc

SEQ ID NO: 6672 - RNA, 5664 nt, Mus musculus
uaguuuaaaaaguauuauuuaaaagcugucugaaguugggggagaugauagauggaaaaaacgaagaacccauuaugguauucuguacccagagugauggguauaagguagaaauaugagcgggguuucaugugcauucgucagcugaugggacccagagcaggaaagaaagggcaaacaugacaggaagugacauaggggcccccaaagaguugggacaggugccuguugcaccugaggggucgauccuuuuacacucauuucagggaugagauguaucagauaaagggcugaccaaggcuggguucugaggcuggguuacugagaauccucucuaacugguacaugccacagcgggcuggagagaaccauuagauagaugccugucagcgugugugcuguggauucacgugauguaugcgcaggcucuuccuucucggugccucacucugcugaugcuuuuccgucauagguuauggcacacagccugucugggaaaagaaaaugaaauaaugguauuuggugggagcaaagacaacuuacuuuucuuggauacaguaagcaaaucuuauauuucaacauuuucucuaaguaauugugauaugcaaagagcuacugagugguauuguugcuaugguaacugcagagcacagaaggaccagaaguguugucuggaaggaccgccccuccaagucagaggcuugggaugcuucagguuuacgaccacgauuaaucuauucauuucauuagcuaacucguuucaaaaagggcuuucucuuuccagugcuggggcuugaaccuagggccuuugcacucacacacauugggcuagcacucaaccuccaagccauguccccaucucccuuuucuuuuccucugggcauuaccacaauaugaguacuuguaguuuaacuguauuaaaaugucugcauauaagaagaauacuacauaaucauaguaauaaucacccagagaauuaauuuuuaaaauuauuuuuguuguuuugagucacacacauauacauuuuacucuuaagaacaauuuauuagcguuuaaaagaaaacucucagggcuggagagauggcucagcgguuaagagcacugacugcucuucugaaggucccaaguucaaaucccagcaaccacaugguggcucacaaccauccuuaaaaagauauaacacccuuuucuggagugucugaagacagcuacagugugcuguacauauaauaaauaaaucaaucuuguaaaaaaaaaaaaaaggaaacccucagagcaagcaaacuauaaaucccagagcagcaaagagguugcucacagcagggaguggagcuuuagaaaaaguuugggggagcccagagcagcuagagacuuuaagagcaaugcuuaggcucgggccagcgugcaggaaaggagggagagaauagcucucccuuuucugagucaggacucaaaaaccaggaguagacccaacagaaccucuuggcagcucagagagacugcccauguuaacaaagacuucauuuuuaaaaauguuuaaauauuuuuuuaaagauuuauuuauuuauuauauguaaguauacuguagcugucuucagacacaccagaagagggugucagaucucguuacggaugguugugagccaccaugugguugcugggacuugaacacuggaccuuuggaagagcagucggguacucuuacccacugagccaucacaccagcccuaaauauuuuuaagaaacaaauauuaacuacuucuguuacuguucucagagaacaaugucugauuuuuaaauuuauaauuauauaggguauugguuagguaaaaguuuguuuucugaaauuugauauucauauaccucauguuuucaaauagaaaagccauauaugugcaucuaugucuguguaugucugugggcaugcacacuuguaugcacauguuuauguauguuacuaguuaaauuuauucacuauuuuacauuuauacaauagcauuuauacaauguuuucuucaaaccuuugauaagaccuuuuuuuuuuuuuuuugacuagggucacuguaaugauuuauugaucuuucaaacacagcccuauucacugcucagguaaguaaauaaaguauuuuuacauauauacgaugucacguauaaauaugugguguggguguauuugggggcuguaaauucacuuaguugauguuaccuuguguucacaaggcccugggcacagucugcagcacuguauaaacagaacguggcagcugcugucuauaaucccagcacuauggagggaaguggaguucauagucacuguggagugagcuugguuuuauggggguuuauuguuguaucggacauuuguuucugagaaagaacuuauaguugguucgguagggagggggagaggaucuagaaggacuuuggggagaggaagacuacggucaagauacauuuaaauuuaaaaacuguuuuaaauaagaaaaauuuaaagaaggggaauucugacaugagcuacagaguggaaugaccuuuaaaaugugccgagugagaucugucguucucacagggacaaacacugugggguuccuuguaucugaaguaacuggaaugggcacccucgugugacaaagggcagaugagaggugagcagaggcucugcaugcucucauggauucaggauucaucugaggaggacgagaagacugugggauggggagggugaugguugcaaacaugcuuaggugcagagccgucagcagggcaguucuucaacuguacaaaauguccacuaagcaaagaaaaagcaaagccugugcuaugaauguaugaugaucuccuugcaccuccuuuguggggugugugugugugucguacacucuuuuacagguaguuuaugacuugaauucaagaaaauauuuccaucugccuaagaauaaaaacuagauaugaggccacaggucuuuaaucccacacucaggagguagagguaggcagacccuuugcgaguuuagaccagucuagucuacauagcagguacuaggccaugaggaucuauauagugagacugugucucaaaaaaagaguauaaucaaacuugucccaugacaacaggcuaguguugucaugacgacaggcuaguguuguguaaaucuccucccaaauaugccccggcaaugaaaacacaacucagucaauaugaauccaugcugugugccuagauugggcagaucuaccgcuacacuaccaucuuccacaucuaugagaccccuuagaacuugcaguuucuccaggccuugcgcuucugcuccguuuuucuucuuccuccuccuccuccaucguccucucucucucuuauuuucucccucuucucuccccaccuucugcuccaccuucccuuuaucuguccaaucaucagcucuccuuuauuuuacaaauuaaggcgggaagcagguuuacaggaacucaccugagugcagccccucgcaggagaacagagucagcgucaaguauaacuagccucagcuauaugcacaacacuucccccuuuucuguccaauuaaaagacuauuuuaucucagauauaguuaaacauaaccauuacuauuuuuuaauuuauaaagcacaagagaccuaacacuaguucaucauccuuguuaaauagaaccucugucaucuagccuuaccuaaaagacuauagcucugcaccuggcuaugccuuggcuuuagauuggaugccaucugaaaaccauccucucaaaucuguuucucucaaaguaaaaaguuggguuugccaggagacuauguaguuuuucaaccccaucagaaauccaagaaugacugauauuaacugaaaacauacaggaagccuaacacuguuucuaaaacuuagccaauuuauggaggucacugaucacuuggacagucccuuacuucaacacguuggggcaucaucggucuucagccuacuggccagggucaugugacagacuuagagaaacaggaaaguuaaggacuagccuacucuaucaugacagaauuaagcuguccuaaccuguuauuguguccuuucuuuggacaguauuaugucuguagaugaaaugaggcaauuugccuagugggugucucgccacaacuggaguaacucaaagacacucaguuucuucuuugaauccaagacagggaaagcugucaggagcagacuggucucaacaacaagugcguaaauaacauuaaaugucucauucuguggacuucugauguuuuugaaaaccaacuaucuaugugaaguaaucuggacuggucucuggaauggucucaaccauuucugauuaaaauaacugaaaacacccuaacaacaaauucagagccaugaauuuccuauuuggcccuuaacucauaggcuuaaauaucucagaucuguuuauaauaacagcaauugaaggacugggucuaagcccuguacuucaaaauuuuuagaaucaaagacaaccuauaauaaucauccccagucccaaagcuuaggggacugggacgaugacucuucauaacuucuucaagcugaauaugggcacugagauauuuuaaaggaagggggaaggguaaggaaaugggagaguuaguuggccuuaagaaggccacaccaaugauuguauuagucucugauguccauguccugacuggauccguaugaaaaaccaagacaucaggaguucaggcaggucaguucagcauggcugacgaugaaauucaccaaggauguauauucuguaguauauaaaucucaaaacaaaauuuuaguaucaucaagauaaccuuuuuguuugauucucuggaaucuaguucucagggggucucccucuaucaaaucugaucccuauaacucuggaagguguaaaaacuuuuuuuuuucuuuuuuguuuuuucgagacagguuaucucucuguagcccuggcuguccuggaacucacuuuguagacaaggcuggccucgaacucagaaauccgccugccucugccucccaagugcugggaucaaaggcgugcgucaccacgcccggcuagguguaaauaccuuaaucaccuuuuccaaaaacacaaagacaaaccuuucccccaagucagcaccuccuucagccgauaaccaggaaacccuguagcugcccucugucccagagggacaauagaaccagcauaauacucaaaaucacacccauuuuagacuacuuaggccuuucuaguuugucaugucaggauauuaauccaaaauucccguggagcccacguuagacagaauaugagucucuugcagacuuuauaaaauugauucacacuucuaccuauaccugcuuauaagaggcagcuugucaaaccaggauuuaaacccaaaauucccauggagcccacauuagacagaauaugaguauccuguaagacuuauuagagcaaucuaucuuuauaccaucuuuaaagcaauucaaacuuccacuaauaucugccuauaggaagcagauaguuuuuaauuguuaagcucucugccuagagcagccauccuguuauaccaucuaucuuuugugcucucuacccggaaccacacacuucuauuaacuaauaccuguucauagcaggcgauuaucguugcucucucuacuuggaaucagugacu

SEQ ID NO: 6673 - RNA, 1819 nt, Mus musculus
ggagccuggagccuuguguuuuauuacaaaucguucguauucucucaaaaacuggucgcgaaggggaaaggagagggccucaaacgguuccucugcaucgcguugcuuucuaggccugcagucuccgcuauaucucugcauuggaaaaauaugagcgaaccaucuguucuaaauacuguauaccauacaguguauagcaugaccccucguggcagagguuagggguccgaaaagguguugaagcuagcuggaaggaacgaaacuuagaauaucugucuguuccugguguuggucuccuauuguggaggaaagcuaguccguggguagguaggggugggcggggguuccuuacaguuguguugucuugcuuuuagaacaagcuuccgugaagaaggcauuuccaaccauaaucagcagaccuucuuugaguuuuccuauuucccccuccucuaaggguaaucccuagauuuccgagaaggaaaaccaguggccucuucuuagcuccgucaaaaacaguuguucccuugacgacucuuuccaacauaaaacaaaaacgggcaccugaaggggucgacggugauuuugauauagagcaacaaaagacucaguguaaacuaaagaacuuaucuuaaggaauaaaaacgaagauguggcagaaguuuaguuguacccaaagucuuuacccuuauuauuauacauuucuguuugauauuuugucccaauggaccacauuucaugcucucuuaucauuuugaguuuucaccaguggcaccugaaugaaaguggugugacuugcaguucuaguuuaaaaguaaaauaacuucuguccagggcggcacaccacuccuggaaucccaccaugcaacaggcgacuuggacaguuaagaguucaaaagccaucuucuaccagagagagagagagagagagagagagagagagagccaaugaauaggcugcagccuuccacacccccaccccuaccacucuccuagucuagccuagcaugcaaacuaggaggagacuuggugaucagauccagcccuaggaagaaagaaaccagagucuaaggaugagccauguuaagccgcucugucagcucaggguuccuaccucuggacagucaguaauacacuucugccucguuuaaaugacuauauuugggagccucugcauugucauaguacgcucuaacucugugguucucaaucuuccuaauggugccacucuuuaauacaguuccuugaguuauggucacccaccaaucauuaaauuauuuuguugcuacuucauaaauguaauuuugcuacuguuaugaauugugaauaucugauuggcagaacaucuaauaugcaacccacagguuucgaacuaccgcacugauuagagggacauucacaggagaaaaacacccagacaacuagaacucagaaaagugaagacccaaaggaacuccggcaucuacagggcacuugaugucgugucccuuaaaauguaagaagcggcuaggcaugguggcgcacgccuuuaaucccagcacucaggaggcagaggcaggcagauuucugaguucgaggccagccuggucuacaaagugaguuccaggacagccagggcuauacagagaaacccugucugucucaaaaaaaaaaaaaaaaaaaaaaaaaguaaguacgugauuuucuaguuuuuccuacaauuucuauuuauauacagucucuauauccauaccaacuuuuuuauucuugugaacgaaacuuauuuucugccuuucucauuugucacuauccuuuaguaucaguaaauauuuuauucaucaua

SEQ ID NO: 6674 - RNA, 3959 nt, Mus musculus
aagauaccaauacaucccacuuaucuacuccaaguaacauaaccaagaaacugcacuguguaauuccuuuauuuucugcauguuagugcuucagcaacacuacaaccauaaagaacaauuuccaaguacugcacuuuuuuuagcugggggaggggaucacagucuacagacucauuuacuuauauuagacaagauuuaccucauucaaaacuuacugcauguuuauaaauucacacaaauacagaaauugaugcaauuaaaacaaaaucuuuagauuuuuuuuaauccuuccauuauaacuuuuucugcaggcucuaauuuuugcuucauaaucaccaaugguuaugguuugacuuaacuacaucaauuauaaaucucuuaaagucuuaaagaaauguaagugaaaauuacaauuucuuuccaaaagguuuaggguuuucaaauuucaaauaugucucccccccucccaccucuucagauaucucaaauaagcuaaaaauaacccaucucaccugcaacauucaguaacagcaaucacuuguauaaaauuuuaacuaugcccccaauuauuuuaagacacaaaaaaauggcugucuaccaaucugucugucacaaguagaacacuacauuuaagaaucaacaugaggguuucaaguuuccuccaguuuaggcauuuauaccuuugugcuuauuuuguuucaggauguuacuauagcauugauauuuguauaaccauauuuauguaccuuagaauguaaucauuuaaaacacuaagaauuacauuuacgguggagcuuugggaacuguaaaagcaacuaaaauguucuuaagugaguccgccucauuccuagagaugcuucuauuaaugugaaacugaggccguuaggcuuuaguugcgucuugaaucaaaaaucccucugcaccaauaggagccuacaacauagcaccuuuucucaucugcuuuagguuaaauguuuuacuuacagcucauuuuuguauagccuccugcuucuccuacaucuuugguaaaagcuccauuauacaauauggccaaaacaugaaggaccaauacuguccaacuuuaccaugauauccggcuugauuuuaauuuucagacacccucauuaaaaaaaaaaaaaaauuccaccuuuuccaguacacugccugugcagucuacauuucccaaauucccuaaguuuaauuccuugaggaucgcuaaauuaauccuuaaggcuacagagaaaccagaagcugcuucacaauucggaaugacauuaacauuugguucaaaaaguuacuauaguggucuccaucuaguuacagguccuagccagaucaucuuaagauccggauacaaccagcacaaugcuuacccuuaaaguuaauuuacauucauugucaucuguagguucuucccguccagccuacuuccccuuugucauccacaucuaagccauucauucagcacauuuccuuccuuacaggagauagauauacuaccgaaccaacaggauaucugcaggaguaaacccuacaaucaagcaaaacuaaauaccuuuuuaaaauaaaacaucuuuuccagugucuuaauggagauguagaucacucaucuauuuaaaaaaugucauuaucuucggucuagucagcugcuguaacgugaaaacaggaauguguauuuucuuuccagcuacguuaaaggggcauauaauuugacuuuuuaaauguuuuauuagugagcaaauguuuaguaauuuuaaaacuacuggucuuaagacauuugaaacaagguaacauuccaguuuuguccaaaagucacuuuaaaauaucuacaaauauuucaucugugugaggcauacaccauuauugcuccauuuucuggaaagaguauuuuuaaagguaagaagagggaaacagcgaaguugcuaacuuugcaguggaagagaccuguaggcuuuacaggcugcgcugcuuguucuaggcggcaguuagcuagggugaagggagcucgagcuguacuccuccucaugcacguuaauggcugacacugccaggggcuccugacauuaccugucugacacacucaugugcaacuggaacauuacacugcuauuacucauuaucuugccacugugggcuuaguucaccauacuggucuuggcuauaaaaggucacauuugaaacugcuaaaguuagcgcuaaggaggaaggggggggaggccuuaaauauaaaagacaaacggcaguuugauuaagcaauaauuuucaguuuacuagaugaaacagacuuggaacauagucugcaugaaugcaaaauaagccaucuacagcaagugauaagaaccugggcaaaaaggaaaaaaagcauacaugggggggaagauucucucgaaauaaaaaaaucaaaccauuauuauaaaggacuuuaccaagaguugcuauuaccccaccccguuugcuggaagucacaaggcaucuagcacuguauucgugucaaaugucagaucagagcauccuaacgcaaagccaagagggaaaaaaaaaaaaaaaaggaaacaaagaaaacccccaaccccacuaaacuguagaacaguaacuccagaguucagauucaaaaagagaguggcaauucaaagaggugauggagguggcgauaauccuaggaauggguuuuggauuucucuccuuccgggggcuggguggaggacgcucauuaggauuuguaguuagagguuaaccaugugagccccucauagaguccguccccggagguggcacaggagggcugcacauaccaguuccugucccgaauccgggucaggcccaguuucuccuggaucucaugggguuucauggcaucgggcagguccugcuuguuggcgaagaugaggaugauggcgucccucaucucccggucauugauaaugcggugcagcuccuggcgggccucgucgaugcggucgcggucggcgcagucuaccacgaagaucagacccugggucccgguguaguaaugccgccagagcggccggaucuuguccuggccgcccacaucccacacguugaacuugacguuuuuguaagucaccgucuccacguugaagcccaccguggggaugguggucaccgauuggcccagcuucaacuuguacaggaucguugucuugccggcugcguccaggcccagcaugaggauccgcauuuccuuguucccgaagaucuuggauagcaccuuccccaucgcgucggaagagccggggccgggggcauucaggugucccggguccccucaagccuacaacgccgccgcgagcccgaaacgucgccgccccgcugcgaggacgcccugcggccugcgcgaagcugccggcuaggggagcaggggcccggccugcgcucacucgggcaucgcccgccgccggggcccugcgucugcgccgggagagccgccgcccugcucaagcgaggcgaggcgaggcgcggccggcccggaacugcccuucccccccgcaggcgccgcgcgaacgagcgagcgagcaagcgccgccgacagcuccuccgccgccucggcacgcgccggcuccaacugcggccggccugccggccugcgagcaccggacucggcaccgaccccggucaccaccccgacgacgagcgcggcucggcgcccggucaggucauggauccucgcgggaacucgcgggugcucgccugcagggacacagagagggagaagggaguuaccgccgggccuccgagggggcgcccagaccgacgcggcccgccuuucgggcucggcccuugagguuaccuccagccgccgccccgagcgcggguucccuccggccuccaccuccuccuccuagcucugcugccgccgccgccgcugccggaaaaggcgccgaggaaaccgccucacuuccccucccaacugcgcacgcgcgccucggcccgaccguucg

SEQ ID NO: 6675 - RNA, 5684 nt, Mus musculus
ccuuccuuccuuccuuccuucgagacaguccuauuaugcuuggaaccagcuugccccguagagcaggcuggucuggaacucaagagggccaccugcuucugucuccccugugcugguauuaaaggcgugcgccaccaugacaccaguccucagaacauuccuguacaguaauagaugccauuagaaauuggaucaacugauuuugagcuucuuagaaauguacugagccaaccaugcugcuucagacuugagggucucucaaaauuaauuuuuauuugagugauugucaacguuucuuuuaagcagaacuugaugccgaacuaaguaaaccuacguuagauuucagcccacaggugggcgggcgggugggcaggcagacauuucacauugugggcaguccaaaguaguugucauccauguaccagaucucuaaggacaugcuggagaaaucugugaggcagucuuccaugcgguaugcacaugcuccguucacaucuugaccuuacccaggauguugcggggcguggcuaagauggagaagcgcuucaugauggcgguuucuaugaggaacgggggaguuugaacauuaauguuauaacaccaaguagcgcacuucaagagagccaugugcaauguuuagagacaguucuuagcugacaucuaaagcaaucaagaagaaagcagauuaugaauauuaucaaaacuaaaagccuuuguguugguaaaggacucagaaugucuaagacagcacaaucuaaaaaugggcaaauauuucucuagugacauaagauacugaagaucauuaauuaagaaaaaaaccugcaauggaauccuauaccucaccugccccaacaacuaccacgagaaggacagacagcaacaaguguuggcgagcacucggcaagggagcccuugggaagguaaagacgaaacaggagcuuuggaaagcguuggugauuucaccauaccuacgaagucucugcacacauacguguucacggcaggauuauuacucacagacaagaagcaaacgagaaauguuaccagcggaugaaggaauguguggauuagcuagcagaacugugcucagggaugugacucagacucagagaggaggauaaggugaggaugcgacacggagggaccgggaaacgcugugcugaaugaagggauccggaugcagaagugugcaggacaacagacuuguaaagcacgcacagaauggacggugcggacugaacagcagcagcauuuccugucuggugauggaaacacuuacgauacagccgaguugacuaaaaaccgagacaugugcuuugcaaggauaaauuuauggaaugagaauuauaucaauuuaaaaaggaaacaggucuuugcaaaaacaaaauaauuguuuauauucagaaacauaaaagauauuuaugccucaaaaaaaaucccuuggaaacuguacagcagcuucagcaaacacugcaucuccuaagguacaaauguauugucuuugccuuuucagcacauuccacaccagucuaaauaacccucuuagccuuucuuccuuagacugaguuuuaacucccauuccuggucucuaaaacuguguugcuggcuauagaauccuuaccacuagaaagcagagugagccggguguucacuguucauugaauucaaucagaccaaaaucaucagaaaguaguggaacacacuagauuuuagugucauuagugaaacuaaugucucugccuuacgguccucacauccacaaucgagcauacaagauucccccuucuacaggcuugaaccguaggugcaauaaaggugagccacuaaaaaaccguuacggugggaagacaaccagacgggagcacacaucaaggucuauuuaauuggggugcuuuucuucuccaggucagaccgcccauuuuccuuuuaaagggaaaaugagaaugaccaaaguuuaaaaguugcaacuagucuuuuaaaaaguuagaaagaggaagcuacaaaaaucuuuugaagugcuguucaagaggcacugugagaagcauugggaacauugagauuacacacacacacacacacacacacacacacacauacaccuaagaagccuuacaguaacuucucagggacagucucaguuacucagccauuugacuuauaacugaaaaggacuuucuuuaaggggccuaccaggcuggggacuuaucuccauggcagacagcuugccuaucagguauaaggccaaagguccauuuuccagcauggcagaaacaaagccagccuuacauaaauuuugauauagugucccacuguggccagccuggccuccaacugcauagcccuccacuuccugaguucugagacugugaccaagaacccaaggcaacacaugaacgauggaaacgcugcgugucagucagcacagcucuucacacuagguggagaugacgaaccugaccacagcucagcacacagacaagagccagcugacacaaucagauaugaagaacugugaaagcacauacuggcuuuuucuuucugauguacacaauaugaaugucuucacuucgguauucuucaucauguuuguccaaagggauuucuucaaagucaaagucuagcugcaggagcuauaaauuuaaaggacauuugugauaaauucagacugacuggcaagggcaacucggaagccuucucaagucuggagugcucuguaucuuuacauuggcacaguuauuuagaugaaaccacaugagcugagaaccugauauaugugcacuguacauguuuuaaguaaauaugaauuacuuggauuuuuaaaauuauaauuucaaaaguugaguaacauuuucccauauuaaugaaaaacauggaauauauuauauuuacuuaauaauuaagccuauuuauauauuauaacauauagcacauauuaucugaaggagucacauaguuguuuuugucauuagacaaaaguaguccuuccagcagacagaauuucaggacuacagaugcagcuucaaaaggagccaguuuuucauagguugcaucugugcccauaaaaggguaugggugccacuugaggggagaauuaacaucguauaaaagacagacaagacaggcauucauuuccaacuuuaaaaacaaacaacaagggggcuggagagauggcucagcgguuacgagcaccgacugcucuuccagagguucugaguucaauucccagcaaccacgugguggcucacaaccauccguaauggugugucugaagagagcacugguguacucauauacauaaaauuuuuaaaaaucuuuaaaacaaacaaacacaaacaacaacaacgcucaggaaaucgcuacuuauguaaaauaaaaauauauaggaaaauacacaaguaagguccaccaccuccauucuaucaugcaagcuuuaaauacccugcugagaaacucccaaagggucucguguuuagcagccuugaaaacugucucagaagacaagcuugucaucacuggccccuggcaccucgcagugcaacaguaaggacugugagaacagccagcaaaccuggccuagcaaggucagagacagugggaggagggcuguggaaacgucucccuggguucuaaucaagagaauguuucccccacaucacauugccuaaaauaccgcagcgaccgcauccagcucccccagaggguaacugcuaccaagacagaccuauuacgauacucaccucaaaauacuucuucucaauuucuggauuuuuccccauuguacguuguucguaacaacauauaauacaaguuucagauccacugagaucuuuuaauguuuucagcagugguuccaaggacuauuuaaaaaaaaaauaccauuuucaguuuauuacgucaagaguuuccugugauaggaaagggucaggaggugagucaaaccauucuaaaccaacaaaacaaagcaagguuaucaaacaagacugguaaacaaccccugacuaccaauaauuauacugguuucuaguuaaguuguaccaucacaucuugcuagacuuaagucuuacaagucuaauuucacuucaucuaaguuaaugugguauuuaaacaaucaacuauuuauucuaccaaagcaagccugacccuaaugguuuaaauuuaauuuuuguuauuuuaauuauaugcacguauuugccugugucuaaguaugugcuagugccugcagggccagaagaauugaucuuccuggagcuggaguuacagguggcugugaacugccugauguggguacugggaacugaacuuggauccucuggaagaacugugugugcucuuaacugcugacccuuuugaucaucaguuggcucaaggcaucaacuuaaaacuaaauacuguccaauacugcauaaacugauaugggaagaaaaucauuccacaagucuaauaaaauguugucacugagaauaacuaauuuuggagcgucucacucugugcuggccuagcauucauggcaauugugagugcuaggauucuaggagugagccaaccugcauuuuaauuaauuuccaaagucacaguuagcagucaaugggaaaagaaaaacaaaugaacaaacagacaaacaaacagaagguaucuuaguuuucuagaauauaugcaaaucggaaaauccuuuuaaauuuuuccaaaaagucuccaguagaaugcacgcaaguuuucucaaccaccucgcacaggcaggccuguaugccuauccugaauugugcgaauguguugccuuugauaguuuaacuucucuuuacugccucaucaucuauagaacaaauaucccacaccuggagguguuaaaccacggagagcugugggcuuucggacacaccaguucgaccacuacucaccuccucauaguauauacagucugccaucaauauguagucuggugacaucaagucuucuaugucuucaccccuuaaaaaugucaaacguaugucuuuaacugaugcucugacgauuuaaaguguucauuuuagaaacgagaagcagaaggcuccccucauauuaagcaagcguuguguaaaaugcaauuuaaagcccauguaagcgaucgauuaucuuaaaaacaagcugaaaggccauacaaaccauuucaguaccuuggcuugaacagaaccagucacaagaugcuuguucauaucaauauucauuuucagcaaguccugcagcucuucaagaucagugacuauaacaucugcccuaaaaaaacaaccucguugagguacaggcgcaaggcugcacgccggugaccugaugcugggcgaccagcgccuucccgccagcucuuacccgagggucgcagccaugagccccacggcccccgugccggagcccagcuccagcaccgagcgccgacucagcgcgugggccccgucgccagaaaaccccggcgucuccagguauuuggaaaggacgauggcggcgucccacacaacgcaacccacgcccccggagccguacugcugcagccgaagcacugucccaucccgcuucuccagaacccgcacaaagcuccacagcggguccuccaccuccggcuccacggcggccgccaucccugccccggcccgccgcaggcugcggcacgcgguaacgucacgcccacgcagcacccguaccucccagcggcaggg

SEQ ID NO: 6676 - RNA, 5684 nt, Mus musculus
cccugccgcugggagguacgggugcugcgugggcgugacguuaccgcgugccgcagccugcggcgggccggggcagggauggcggccgccguggagccggagguggaggacccgcuguggagcuuugugcggguucuggagaagcgggaugggacagugcuucggcugcagcaguacggcuccgggggcguggguugcguugugugggacgccgccaucguccuuuccaaauaccuggagacgccgggguuuucuggcgacggggcccacgcgcugagucggcgcucggugcuggagcugggcuccggcacgggggccguggggcucauggcugcgacccucggguaagagcuggcgggaaggcgcuggucgcccagcaucaggucaccggcgugcagccuugcgccuguaccucaacgagguuguuuuuuuagggcagauguuauagucacugaucuugaagagcugcaggacuugcugaaaaugaauauugauaugaacaagcaucuugugacugguucuguucaagccaagguacugaaaugguuuguauggccuuucagcuuguuuuuaagauaaucgaucgcuuacaugggcuuuaaauugcauuuuacacaacgcuugcuuaauaugaggggagccuucugcuucucguuucuaaaaugaacacuuuaaaucgucagagcaucaguuaaagacauacguuugacauuuuuaaggggugaagacauagaagacuugaugucaccagacuacauauugauggcagacuguauauacuaugaggaggugaguaguggucgaacugguguguccgaaagcccacagcucuccgugguuuaacaccuccaggugugggauauuuguucuauagaugaugaggcaguaaagagaaguuaaacuaucaaaggcaacacauucgcacaauucaggauaggcauacaggccugccugugcgaggugguugagaaaacuugcgugcauucuacuggagacuuuuuggaaaaauuuaaaaggauuuuccgauuugcauauauucuagaaaacuaagauaccuucuguuuguuugucuguuuguucauuuguuuuucuuuucccauugacugcuaacugugacuuuggaaauuaauuaaaaugcagguuggcucacuccuagaauccuagcacucacaauugccaugaaugcuaggccagcacagagugagacgcuccaaaauuaguuauucucagugacaacauuuuauuagacuuguggaaugauuuucuucccauaucaguuuaugcaguauuggacaguauuuaguuuuaaguugaugccuugagccaacugaugaucaaaagggucagcaguuaagagcacacacaguucuuccagaggauccaaguucaguucccaguacccacaucaggcaguucacagccaccuguaacuccagcuccaggaagaucaauucuucuggcccugcaggcacuagcacauacuuagacacaggcaaauacgugcauauaauuaaaauaacaaaaauuaaauuuaaaccauuagggucaggcuugcuuugguagaauaaauaguugauuguuuaaauaccacauuaacuuagaugaagugaaauuagacuuguaagacuuaagucuagcaagaugugaugguacaacuuaacuagaaaccaguauaauuauugguagucagggguuguuuaccagucuuguuugauaaccuugcuuuguuuuguugguuuagaaugguuugacucaccuccugacccuuuccuaucacaggaaacucuugacguaauaaacugaaaaugguauuuuuuuuuuaaauaguccuuggaaccacugcugaaaacauuaaaagaucucaguggaucugaaacuuguauuauauguuguuacgaacaacguacaauggggaaaaauccagaaauugagaagaaguauuuugaggugaguaucguaauaggucugucuugguagcaguuacccucugggggagcuggaugcggucgcugcgguauuuuaggcaaugugaugugggggaaacauucucuugauuagaacccagggagacguuuccacagcccuccucccacugucucugaccuugcuaggccagguuugcuggcuguucucacaguccuuacuguugcacugcgaggugccaggggccagugaugacaagcuugucuucugagacaguuuucaaggcugcuaaacacgagacccuuugggaguuucucagcaggguauuuaaagcuugcaugauagaauggaggugguggaccuuacuuguguauuuuccuauauauuuuuauuuuacauaaguagcgauuuccugagcguuguuguuguuuguguuuguuuguuuuaaagauuuuuaaaaauuuuauguauaugaguacaccagugcucucuucagacacaccauuacggaugguugugagccaccacgugguugcugggaauugaacucagaaccucuggaagagcagucggugcucguaaccgcugagccaucucuccagcccccuuguuguuuguuuuuaaaguuggaaaugaaugccugucuugucugucuuuuauacgauguuaauucuccccucaaguggcacccauacccuuuuaugggcacagaugcaaccuaugaaaaacuggcuccuuuugaagcugcaucuguaguccugaaauucugucugcuggaaggacuacuuuugucuaaugacaaaaacaacuaugugacuccuucagauaauaugugcuauauguuauaauauauaaauaggcuuaauuauuaaguaaauauaauauauuccauguuuuucauuaauaugggaaaauguuacucaacuuuugaaauuauaauuuuaaaaauccaaguaauucauauuuacuuaaaacauguacagugcacauauaucagguucucagcucaugugguuucaucuaaauaacugugccaauguaaagauacagagcacuccagacuugagaaggcuuccgaguugcccuugccagucagucugaauuuaucacaaauguccuuuaaauuuauagcuccugcagcuagacuuugacuuugaagaaaucccuuuggacaaacaugaugaagaauaccgaagugaagacauucauauuguguacaucagaaagaaaaagccaguaugugcuuucacaguucuucauaucugauugugucagcuggcucuugucugugugcugagcuguggucagguucgucaucuccaccuagugugaagagcugugcugacugacacgcagcguuuccaucguucauguguugccuuggguucuuggucacagucucagaacucaggaaguggagggcuaugcaguuggaggccaggcuggccacagugggacacuauaucaaaauuuauguaaggcuggcuuuguuucugccaugcuggaaaauggaccuuuggccuuauaccugauaggcaagcugucugccauggagauaaguccccagccugguaggccccuuaaagaaaguccuuuucaguuauaagucaaauggcugaguaacugagacugucccugagaaguuacuguaaggcuucuuagguguauguguguguguguguguguguguguguguguguaaucucaauguucccaaugcuucucacagugccucuugaacagcacuucaaaagauuuuuguagcuuccucuuucuaacuuuuuaaaagacuaguugcaacuuuuaaacuuuggucauucucauuuucccuuuaaaaggaaaaugggcggucugaccuggagaagaaaagcaccccaauuaaauagaccuugaugugugcucccgucugguugucuucccaccguaacgguuuuuuaguggcucaccuuuauugcaccuacgguucaagccuguagaagggggaaucuuguaugcucgauuguggaugugaggaccguaaggcagagacauuaguuucacuaaugacacuaaaaucuaguguguuccacuacuuucugaugauuuuggucugauugaauucaaugaacagugaacacccggcucacucugcuuucuagugguaaggauucuauagccagcaacacaguuuuagagaccaggaaugggaguuaaaacucagucuaaggaagaaaggcuaagaggguuauuuagacugguguggaaugugcugaaaaggcaaagacaauacauuuguaccuuaggagaugcaguguuugcugaagcugcuguacaguuuccaagggauuuuuuuugaggcauaaauaucuuuuauguuucugaauauaaacaauuauuuuguuuuugcaaagaccuguuuccuuuuuaaauugauauaauucucauuccauaaauuuauccuugcaaagcacaugucucgguuuuuagucaacucggcuguaucguaaguguuuccaucaccagacaggaaaugcugcugcuguucaguccgcaccguccauucugugcgugcuuuacaagucuguuguccugcacacuucugcauccggaucccuucauucagcacagcguuucccggucccuccgugucgcauccucaccuuauccuccucucugagucugagucacaucccugagcacaguucugcuagcuaauccacacauuccuucauccgcugguaacauuucucguuugcuucuugucugugaguaauaauccugccgugaacacguaugugugcagagacuucguagguauggugaaaucaccaacgcuuuccaaagcuccuguuucgucuuuaccuucccaagggcucccuugccgagugcucgccaacacuuguugcugucuguccuucucgugguaguuguuggggcaggugagguauaggauuccauugcagguuuuuuucuuaauuaaugaucuucaguaucuuaugucacuagagaaauauuugcccauuuuuagauugugcugucuuagacauucugaguccuuuaccaacacaaaggcuuuuaguuuugauaauauucauaaucugcuuucuucuugauugcuuuagaugucagcuaagaacugucucuaaacauugcacauggcucucuugaagugcgcuacuugguguuauaacauuaauguucaaacucccccguuccucauagaaaccgccaucaugaagcgcuucuccaucuuagccacgccccgcaacauccuggguaaggucaagaugugaacggagcaugugcauaccgcauggaagacugccucacagauuucuccagcauguccuuagagaucugguacauggaugacaacuacuuuggacugcccacaaugugaaaugucugccugcccacccgcccgcccaccugugggcugaaaucuaacguagguuuacuuaguucggcaucaaguucugcuuaaaagaaacguugacaaucacucaaauaaaaauuaauuuugagagacccucaagucugaagcagcaugguuggcucaguacauuucuaagaagcucaaaaucaguugauccaauuucuaauggcaucuauuacuguacaggaauguucugaggacuggugucaugguggcgcacgccuuuaauaccagcacaggggagacagaagcagguggcccucuugaguuccagaccagccugcucuacggggcaagcugguuccaagcauaauaggacugucucgaaggaaggaaggaaggaagg

SEQ ID NO: 6677 - RNA, 3598 nt, Mus musculus
uacagauaaaggcagaaaggcuacuuaaguauccaauguugcuaccgucuccaaccagcagaaaagaagcgaugaaaccuacguccuucucaaggcaguguauucaggaacuuaacaaugugcaggaaaaggaaucccgacgucucucggccaucccccuuuauccccuccaguccacuccucaucaccccaguccacguaggcacaguucauuggcucaggacuauauucgucacgucauguggugcaucugcgcaaugcagcucaagguacauggcuaucuugagggauaugaagaagucaggugccagucauaagacuuggcagcagucccgggcaccaucuuggggcugcggccacacccgcuccucacaucuccccuuuauucuuuaaauuggcagagagaaugccugucuuagguugcccccugcaaaaaugcuccuuacccgucaucgggagacagacagcaguggucugaucccugucuuagguugguaacacguccagggagucuuacccgucauugacuacuucccuagcaugccaagccacacuuaaggagauugucccaucuccacagcugcaaaagcuuguaucaacagagcuugagcccugcaauggcgauauugcaugcggcagaugcaccaaaaggccaggacacugaugagcacgcagcacagugccaauccaccaauaccggcccauuccuuuaggugugacauagcaguggcaauccaauuugcaaguccuucagccauggauacccaaguggaauugauauggacuaucccaaaaucucuuuugggucuaaacaaggucauaaccgaaggggucugcacgggccaugguacaaaucuaggcauucuggucacaauagcuaaagaaaacauagaagcauucuaacacauacuauaaaaacagcuauccuccuuacauucuacaacaucaucaaaauaacaaccauuauaaacuaaaaauacaaaaggaggccaaacacauacagguguggcuuuaaagaauacauucuucccauaagcaaauugaauaacagaagacucaaaaaauauagauccauuccaauaaaagcuagcauuuccccacaccccacccaucaaaauacucaaagaagaaagaucuguacaacucccaauuuaucccacacaacagccaaacauuaaagggauugcuugccccucucugggcuggauuuugauacauccaauuaaacccugaaaacguuuaauuaugacugguacuaauauaaggggaaaagguaaaauauuuuuucacggcccacgcagcuuuccuggacuggcagcugguccaugggggcagcgaaucucgaauaccccuacaaaagggggcccaucguagaucuucagucaucacugcaggcagcauuaucacccccaggagcagcuucaucagggcaccucuguccaucuugaacuacccucgucaaucgcuccggaacccacagcggcuggugaugauccuguggaaacacacaaacagacccucucgcccagaacaacacaggaucaggcccuugccaucguccacucagaacauccuuccacaugacugugccucuguaggaugccucaggauuggcaaacuguuccgcagcagucaaaucauuuuuaucuuuauucaaaaaauucaagguaaagagagcaauggcuaaucgaguagugccagaggcuacucccccuuucuguuuuauuagacacucuuucagaguuugaugggcucuuucaaugaugcccuggcccugaggauuguaggguauaccgugcaccaagcggacaccgaucauuuuacaaaaggaaacaaaaagaagcugaaguauaagcagguccauuaucagucuuaagcucucugggcugaccccaugcaccccaugccucaaagcaaugggcaaugacauggugugccuuuucaccaguaugcagggaggcaaacaacaccccagaggcuguaucuacagaaacaugaacaaacugcaguuuaccaaauucugaaaaaugagucauguccauuugccaaauguggaggggaagcaggccgcaaggguuuacucccacacucgccugaggcaauaggggggcacaggcuuugcaagccguaacaauaucccuugccucugcucuaguaauaugaaauagagaagaaaguguuuuggaauucacaugaaacugugaaugaagaucacaagccaguucuacagguguuugaaucaaaaaggcagaagcagcucuagcagcuuuaucaaccaaaucauugcccucugcuaaagggccaggcaagccugugugagcuagaauguguuggacaaaaaauggagaacuccuauuuaaaauuaaggauugcaauuuauuuaacaaauccccuauaguggaucgaaaauucaccuucaccaccacuuccagcacugcuaacgaauuaaccacauacugacuaucaaauuaaauuaaaagauucagaauacaauuaaaaaacuuuuauaacaauguacaacucaauaacuuagggagaagcagggggaaaccacaaaguuacuggcguggagccauggaccaaauaugcuccgcagccugucuuagacccaucuguaaaaauuaaaggggcaucaggcaauggcacucgagaaguaauucguggaaaaacaacuggaugagcuuuaaucagcugcaaaaugggaucuuagggaaaugauuauccaucuuucccauaaagcuacaucucagaauugcccaaucaucaacaguagcugauaauacuucuauuugcuucauauuauauggaacaaucaauuccugagggggauugccaaaauauugaauacauuguuguaggccaaucaaggccaauugugcuacccaggcaggguaauaagacaagauuuuugcggguggaaucuugggauguauccauagcaaaggggcgcccugccagaggacuccaguaggcugggucuccgagggcaggaugcacaaaauaauaggacugaacagaucucuucucuuuaaugcugcuguuugaauacccuuuucgaccaaacaacacuacgugggcagaaucaguaaacugccggggagaauuuaauucuauaucucccgguaaaaugucauauaaugguuauaauuguuuguugguuaggcccaaauagggacguacccacuguauaucccccaauagcuuuuguaaaucauucaauguccucaaauuauccguccgaauuuucuggggagacacucgacuaucaaaaauuuuuguuccuaaauauucaccacuuuuccuuucugaaccuuuuccggggcuacaaccaauugcuuuucuuuuaauuuuuggaucacuacacuauaugcguguguaacuuuaauuuucucacuccaagaaccucaauaucccuaauccgggaaccuaauagucucuaaccaagaacuugaaucuucccacuucccugggagcuuuccagcuggcuacccugacuggguuccaccacuugucgauaucuucuccaaccaauagaaaagaagcgaugaaaccuacguccuucucaaggcaguuuauucaggaacuuaacaaugugcag

SEQ ID NO: 6678 - RNA, 89449 nt, Mus musculus
cugggaggcggggcgcggcggcguccaggguguugugcacucggcgggccucagggcggcagucugggcccgcggccugcguucucgggcgggccaggcucgauccgcgccggccgcgaacgugucucccggugacgcagccgcggguggggaacguggugcggcggcgacugugcgcacggccgucucggagaagacgcgggucuccgacgccggcgcucggccaagaacggacggccucucggguacggccggcgcggggccuggcgggaccgacgaggcccggaggcugccgggguugcgccccgugacgccccccgcgcucgcucucgccggugcaggcgcagcugcgagccgaggcuccauguugggaagcgccgcgcgcccucguuagcgggagacggcugcggcgggcagagccccggacugggcgcagcgaagauggaggccccgcugaggccugccgccgacauccugagacggaacccgcagcacgacuacgagcuggugcagagggucggcagcggcaccuacggggacguguacaaggugaggccccggcccggccugcgaacguggggcacccccgggaugcgccggaccacagcguccggccaggaagcggcccggagcccgccgcaccguuccgagcacccuggguuccccaucgguucuaaggcuagcgaccggcagacuuaaccgcaccuuccagaccacggcugagcuuuuuuugugguuuuaaggcguauuuaugguauugaaguuauuccggaggaugguuugguguugauguggggggaaaaugcuucgcggaaggcgguagauaggaaagaguauuguaaaucuagaccuuugcguccuguacugguuugggugaacuugccuugaaaaaaaucucuguggaaccggacucuaaauugucaacuguaaguaaucugguucuggaguaaaaggauuuguguguaaacaugacagccuguaggaagaugucuuuggggaccggugagguggcucaggguguuaaaggcccuuagagccaaaccuuacuuaggaccccagaacgguccccggauucucuugguggaagcacggaucccccacacauacacacucacacacucccaggaaauaaacaaaguguaaugaaauuuaaacauauuuagaggaagaccuuugucaccuggcagaaguuuaggcauuuuguaucugguugauaauaaugaauauaacuuaugggguuuuccuacuaaacuaauuccucucuaugggauuuauagcauuccauaaucaugaguggauaauuacugcuacccuuuuuacuggucucuuauauuaagacaaauaauaauaaauuuguaaucugccguuacacaacaacaaaaaacaugccauagcaaagcaaaccgauuucuuaagucugcuaaguuuuugaaggguucagaggaaaacacuguccaauauucccucauggcuuuuguucuuugucccaaaggggcagaguuagugcaguuccuuauggggauuaagaaaaagcuuauuuuugaccuggguguugguggugcacgccuuuaaucccagcacucaggaggcagaggcugguggauuucugaguucaaggccagccuggucuacagagugagugccaggacagccagagcugcacagagaaacccugucucuaacacccccccccccaaauaaaagcuuauuuuccuuuugcaacagcuugauauuuugaccuauguauguaucaguauguuccaaacagcaaucugcauagagcccugauggcuguguuucaugaguaauugcuugaccccacugagguauguugacuugcacagguauaaugcaaggaaaacaucucuuuucucugcuuguuuuugaguaauuuuuugcugagaguaguaccuuggggugauggauucugagguaagaacucuggguaggcuuuuuaccccugaaaacgaggcauuugggcccaagcagacacuguucuagcaaccgagcagugcagcagcagugagcaagguccugacucuggccucgguuaccuuugaugcaaagugcacaguuagaauggaauccccuuccuuauggaaaguuaaugguagcuagcacaaacgucucuauuugcucauuacccauuuuaggaaaugcuugcucuuuaaaaaacagaaacuccuguuugcuuucuuggucccauuuuaaaucaucuuugucuuaugauucacugaaaguuagaccaguucaguuccguucauaguaauuauacaauacucuaaauucuagcuuuugccccacccuacccccuuuuuccccugguacagaaaauuuaaagggaguauuucccccacacaaggaucuugcuaagaccuccacgguuuucuuuucagagcagcucucuggaaggacugcauccuuccuuaggaaagcaauguuuacauuaaaaggacagcugucugccugccugccugccugccugccugccugcuugccugcuucuucuuacccagcugcuuccugguccugcugcucacuuccacagcucaacagacaucagaggcugaaagcuucccaccccaccugggccucccaccuuucucaaucaagcucacguuaucacguguacuugagggcuaggccagccucugagucccacgcagccuuuagacacucgugugcccuucuguuugguguguucuaauuccugaggaucaccucccucccccauccuccaccuguugccaccauugcugucuaggaaaacaguucuugguucuaguaagccccagccccucacccugaccccuaaucucacccaccacucucccucucccuuuugcucuuaccacacuggccugcaggcuuuccuuaaacaacaauaagcaucuccuccuuuggagucuuuguucuugcuacuuccucuguucaguaucuucucccagacagugagcgucuugcuuccuccuucccuuuagacgaaccugaccgucuuuguacuugcugcuugcugugucuagcucaguguuuauuacuugcuuuuuuaggugucuguuucaaccaaaacuaucaauacuccacagagacgggcuuuccgccaucccacccgguuuugcugcaucuuaaccuagaauuaggcaggacauggaguauuccuaagagguugacagagugacaaagggcucuaggugguccugucaccuaguugucugagcacuuaauuuugacaucacaacagugcuuguauuuaauuccuuguguauuccugcacuguuuuguuuugcuuuaacaauagccacaugucucuuuuuauuacaaauuucaauaacuugaguucucugggaaaacauuucugaaaagcuguuuuauagcauauuuauuaucagugaucuaaguccuguggaauuuugugaauuuauacuuacuccuuaauaugucuagaacaugagacuuuggauuuuuuuucuuuuaaagcagauugauuguauuuuuaagaaacuguauuuuuaagaaacuguaaauccuggggcauuuuagaaguguuuuccaucugugaugcaaacuaguaaacuaauuagugagaaauaaugucaucucuuuaucucuuacccaucccaguuuguuuuuaugccugagcuauauuaugaaguaguaacuuuaaaaagacccucgccuugagauucuuuguaauuuuuacacucuguaaacacauagguccccuagggaucuccuuguuucccaagaggugcagacuccaucuuaaauaaggagaggaauguaaagaugcacccuauaauugagagcagagcaggaggugguggaggggagauggaggggagacagacauaaaagaaaagagugugguggauggaggaagaauuaagccccagcuaggcggauccugauugugacacuugcuaaaaggagggggagagcuggguaaugcccccccccccccaccgccuguccacagaguugcuuccagucaguaugaagguucacaagccgcagggugagcaccugccucugccauuuuguaccaaaacugcuuccaggcugguggccacagaagcucuaagaucgcuucacuuuucauaagauauaaaucuagaguaggggacccauguacuucuuuuagacucuuuucagcucuuugauuauccaugagugacauguuuaguucuaggacaacaaccuucaacuauauuacagcaagcagaccaaugccuaagaaauauuugcuuaaugauauuagugguaguaaauugcccagauguaauaaauacugcuacuaauauaguuuuuuucaggccuuuuccuagauguuuuuaaaggaaucuguuucugaaaugacuuacauuguuucagacgccagccagugcugcauguagcacaugcuacagugaccaacaguuucuuuaaaauuacuguuuuuaaaaggagccauugaaugaaucucuaaguuucacauuaguuauuuccaauuuuaaagauucuuuugccauuauaaaugacauaauuugcauagaaagcuuugucauauauauaagccuuaccauuucuaugaguucuucuggaagcuggaugagucagaucugcaguaaugaauuccucuuuuauucaaggcccccuuuucuccccaagccaacagucagaauucuggaauggcuucaggcauuuugaaacauuugcuaagaucgaaugguaaagaagcagcuuaguacauagugacagugagugcugccucugugcuggggucuaauacaggccucagaaagaaagcacacugucagaaaggaacauggagucuaggcaggaaaacaggcaugcagucauaauuagguaagugccauaaugaauauggaagaaauacucaacuccguccuuauuaggggauggggguuugagggucaacuagggaagauuaaccaaagacgaagcgguagcuagaccaaagagauggguuugaguucaguuuuauaagauguuuuuagaaauacccaugaucugcaacagaaagagaagguaauggauggcaacuuggguguguuuguuuuugucuuaggugacauuuuuuuugugugcuguuaacaggaaauacaaauuuugugggaugugaguuguguucaagucuguuugcccuucagacauuucguaagugacuguguggcuuagguaaaaggaaauucgacuccagccuccggagcucugaacuggggauucagguuuaggagucaucaccagugcaugggagagcacgugugacauggaaugaggucagcaggaagcuugcacccaggagagcugaggggacuauagucucagagaaggggcagaagaagacugugcacugguggcguccgaagaaagggcugaugagguucuuggcauaggagucuugaagccugcucucuccuaucucugcugucauuugcucugauaguaaugaggaaacauggacgcucuuccaauaauaauaaaacaauaacaauuucacuuauugaauuauuguauuaauaguuuucaugaaauuaguauuauguauuaauaaaacuacaugaaaacagugauguuagguguaccaauguaucagcuagucuaacauugcgccagcacacaguaucugcucaauaaauagaucuugaagaagaaagcaggguacugaaagucacagguuuguuaagcauggagcugugggacuguuaaaauggcucagcaaguaaaggcucuugcugccaagccugacgaccuaccugagugugauccccgcgauccauaugguggaaggcuagagccaacuccuccagugagugcaagcccauuuuccccauuaggaugguuagagugaggugcacugacugaugaggagcccugauggagaacugggagagugaggugaagggcugucugcuuaggaccucuuacaagguggacacugcccucagacacaucaagugaucacagugaguaaagacugcuaccuucgugggacaugguauucuagcacacaggagagggccagugcaugugcgcuaugcuggagagauuacagaugagcaagaaguaacugagcagguuaaggcucuagagugccauaugggccgcaggaggcaggucacagaguuaacagggauugcugggguaagcuucauugaagugaaguuugagcaaagccuuggaaaugagugaguuaaucagaggagugggagguaccucucuguuugaucaguuccucagcgccugcuuccacagcuaaacuacaagcucagaggcagccacugaaaccaagacaaaaauugccaucauacgacuuuuggaagaagaacuacaaguuauuguaauuaacauaaguauuuaauguaauuaaauaguucaccaguuacauaaccaaaucuugugugacucuuuaaagccugaguuugugcgcaaggauaugucauugucuucucugugcugcucugugaguauucucuagucauuaaaucguaacaaagccuaucaagaaucccaauggccucagaccugaaguuaagagagaaugguuuugacaggggugugacuaaaguguguuccuggugugucuggcuuuagagacacucuaauuucacauugcaguuugcagcaugaguaagauuaacaguaagagaugaaggaaggugcgucaaaaaugucaucaugaauuacauuuuuuaaagcagugauacgaugcugaaagcuuuuaaaauagguuauguuaaguaguauauuacuaugaaaaucaaauauguuuuguugagaugaaguguuacaacuguuuacuauuuauaagucaucugguuaagaucuuacuuaguauugauuuuucuuacaguucagaaauaagugugcucuaaggcugccugaaaaggaaccauggacccgaugaugggugugagucucugaaccguaguugggagcaaaugauuucaaagugucuuucuacuugcauagaaaugugaaaguuacggaagaaaucuuccgccguagacaagacagaugugaggugguaugguccucucuugggcacaagcuaugagccucgaugucauugcaaccuugcacagaccuaccacccuguucccuuucuuaggaagcaucuuuccuuugauuauuuccagugguuuuaaugaagauacagaggguagaauacagauuagugggguuuguuuuuuuuguuuuguuuuguuuuucaauuuugcuuucaaaaauuaaaaaguuagccgggcagugguggugcaugccuuuaauuccagcacuugggaggcagaggcaggcggauuucugaguucgaggccagccuggucuacauacagaguuccaggacagccagggcuacacagagaaacccugucuugaaaaaccaaaaaaaaaaaaaaaaaaaaaaaaaaaaauuaaaaaguuucacuucuaaacuuaaauugugguuuuuggaccaagaacacaggaaaagaaagaugaagccuauuaaaagugauacuuguguuuucggggcuuccuuagcaauaugagaacuuccccuagaccagguaaccagagagcacuuuucucauguguuuuggaccaguuucaguguuggcgaauguuagaguacuuuguguaggcuuuugcauccugauuuugcaagguacuaguuaaguuggagaagucugugaccuuugaaaagggcaagaaugucuagcuacuguagcuuagcucucuuucucuugaauaugguuuucucccugggagacucucagcuggugucugauggccaggucuauccucacaggucucugagcacaugaaucauaggagcccccaccuuccaacauuuuauaaaaauaaaaucggauuaaagugacuaagagugacuaauguuugcauaacccuacuguacauucuugcaguaauccuuuaaaggggguggaacagauagauguauuuucaucccuauuugacucagaaagaaacuaguuucugccuuguagauugcacacuaucagaacuugaaucuagaucuccuagucucccaauuucuguucguuuucuuuaucccaggccuucuauaagcuguaucuuucaguuuguuaguuaaccuuuaaguauacagcccuucacacacugccugcacaugguaaacuccuuacacauuguggcguggcuucccugaggagcugagggcuggaggguuuauggacuacugugugauugugcacauaagcaccagaaugagaggcucuuacuccuguuacucuguggucaucucucucucucucucucccucucucucucucucucucuuuuugguuuuucgagacaggguuucucuguguagcccuggcuguccuggaacucacuuuguagaccaggcuggccucgaacucagaaacccgccugccucugccucccaagugccgggauuaaaggugugcgccaucacugcccggccucucucauucuugugcuuuccagucucaggaucaguucuucaucacaagcgaggcugcugcucucccuccagcuggaagaccccuuccugcccugccgcccucugcccucauugcuuuggaacuuugaauuuaugguuacuguuacugaaguuagggaguccccuagacuagauugucagugggauuauaaauuaaacaaaacaugaagcauuuuagacaaaauccuuagucugcaucaaagaguacuugcuugucucuagugaaaacaggaccccccugaacagacuuccagugugagcuggugaaccaggggcuucuccucacccauacgugggucacuuugagacaggucuuacucuauagcuugguuggucucaaacucucagucccucugccuccacuuucugauuuguaggaacacaacugugugucacaugcccugcaugcaguaaugcacuguaaaacaagcaacuuguaaugauugacuaauaacugucuagcucauggcagagcacuugggccgcucugaguuauuuccgcaguggugcuagcucauggguaggacucauggucucacguagcccuucuuuuccuggccuguggauacgcugcuuucuccuuaccaucuuuuaaaaaacauuaaaguauuguagguucauuuuagaaaaccuugauacaggaagaaaugaaaauagccuuguguuuucucuaccaauauaggaagacguuguuacauauuaaaaacauucuuauuaaggacauaggucuucauugucgauuuugacacagccaaggagucacauaucagauauacugcauaucagauauuuacauuaugauucguaacgguagcaaagcaguaguuacaguuaugaaguaacaaggaaauaaucuuaugguugagggucaucacgacgugaacuguauuaaaggucccagcuucaggaaggcagagcaccacuggccuagaguugucugagugagucucaauugggggauuacuuagaucagcuuggccuguggacaugucugugggacauugucuuaauugcuaauuguuguagaaugguccagccuacugugagcaguccaccccuacucagauccugagauguguaagaaauguaacuguguggaggccaggccaggcaguaaucauugcuucuccaugguuucuccuucagcucuccucgagcuccugcuuagaccucuuccaaugauggauuguaaccugauuguaaaccgugauucuuuuucuccccaaauuguuugguuagaauauuuaauuacagucacaaaaagcaaacaagaacaaugauguauaaauggcagucuagacauuauaaucauuaaaauauagguuauauagacauauuugggauguuucuuaaauaguaugcccaacuuuuaguuucacuaaauacacauauuuacuuucuuauauuauuucuuuauuugauuguacauuuguguguguguguguguguguguguguguguguguguaaguguaagacagagcauccagguauagcccagguuaguccugaacucccaauucuccuaagucucucagguacugacguuaacggcaaaaccacuaugccaugcuaggguuuuccccauagaaaugugugugguuuuauuuuguacauuuauguguacauggccuggcaccagaagaagccagaagagggagucagauccccuaggccugggguuacagacagcgugagcugucauguaggugcugggaaccaaaccuggguucucugcuagauuagaaaaugaacuuaaacccugggucaccucucuggccucccugcuaguuuauaauccauuauguaguuccuuguuauaaacaaaguucugcucauuauccacaaauccuuuuuauggcuucucaauuauuuaaguacauuuuuagaaucagauuuuuuaaguuguuuuuaaaguuuuagugaauuuuggccagguaaucuccaaaaaaguuggacccaucagcagugacuuaaaaguccguaucauuccuauuuugaaaauuaagcccuuauggccagcaagauccucauuggguaaaaauacuugucgccagccugccugaguugaguccccagcacccauguguuugaaggagaaaaucaacuuaauagauugucacuggaccauacaugugcucuugugcacacuaagguauuuugaaguuauuagaugauccucugaagcaacuugcccuuuagcaaacuuggucuguguuagaaaggaguuaggagacacaaaggugucuuuggagacacagagguguccuagcagacugaguaguaggcuuuaguugacuggagauaaaaaucauguccuccggauccgcacuaguuggggucuaaaacugagagaggcagacacaacucccauccauaagagccaucuccaggugaggaccacuuacuugcuuucucuccagaggacucaccagcagugacacagcaggcauaacaaugguuccuggaggcuuuuuugucucagugcuuuugucaucccccucaccccauaauauacagucuuuccuuagaugcuaaacucccugguuuuguguuuuuaggagauuuccgugugugccaaugugugugucucugcaucugugugugucuguguguuucuugggcuuuuucuuuggcucuuuguuuuucugucccuuuggguuuuccuauucggguuuguccuuuuuaaucuuauuuuucuuucuuucuuucacacacuuguuuucucaugagaggaaacaagaaaggaugucaauuugggaagguggggagggccaaccauaaucagcauauuauaugaaaaaauauguuuucaguuaaaaaauuuuuggaaaaaaaaaaaaagcacgugcucagauuuuggcuagagagugugaguuugucugccuacuaaugggagaagcccugcaaguacagacuucucuccugaggauccuccaguccagauguguucaacuguguacaagucggcacaugucacaaacugaggacuugcuuggugcagugaaggaaucucuggaauuguuggauuagagcagggagggagggaaggcgagugugcgugagagacuggaugugacaguacuguccucagacucaggaggcagaggcagggggaaucacuacaagcccaagcccagcugagccuacacugaguuccaagcccgcuugagccaucaagugagaacucaucucuaaauaaauaagaaaguuuggcuuagaacacacaaagcccugagcucagcacuguauauacugagcgugggagcacaccccacaauaccaacguagggcuaagaggaucagaaauugaguuagagcccugacugagaggucgggaggguggagcuaaagguuggacucccgcaggagugguggcgaguggggauaaugagggaauugccugggcuaguuguuaagcugucagagaaaaagccuagaaguuaguggguaauggcuagaggaaaacagagagugcaacagucuguccugagcuucagacuguccuuaccucucaccauuauuaugaccaguuaguggcagacacugacuucuuggaacuguccauccugucacucaacugcccuugaguguugcacagaacucugccaugcauaaccggguaauggcaccuuuucccaccacccggaaaaucucuucuguuaucucauuuuggauuuauuucccccuuggaaaccuuuucuccagugcacugagccugggcugagaacacccccaggcuuuguaauguucgagaguucauacaacucuaguguauucucccucuacuuuuguagccccccuaccaggaaaaacucccugaagacuacaguacagguucuauuacaucacuaguaccaguaccagugccuggcacacaguaaguacucuguaguauugugguaugaaugaacucguuaaaaaauaauguccuuaaagaauuggacauaggacuuuaaagccugaggcacaauuaguuacuucuuuuguguauaagccagcuacuauuccuuucuuuaaaccuuguagaugcucuguuguuaauuuuuguaguguuauuccaguucuuccaucugaggucuggaaaccugaugacccuaccgaacacuuucuggacacagagaaccuuacugaauauugagacuccuguuuucuaguuauuuuuuuuuuaaaaaauggaggaagugaagucaaagccuucaguuggcuucauaaaguuuuguaacccuaaaaguaugcaagaagaaaguuacuguggaguaagaugacuuuauagauaaauuuaucuuuuuccauguaauaauuugaguagccaucugguaagaauuaacuaagauguauaacuauccuaauuccauuguauugaauuucugggugcuuaccaugccugucugcguauuauacaaauaacuugcuaauauaggaacuaauauauuaagauuucuuuguagagugcugugggaauuuauuucauuuuguaagcaguacaaaaucuucaaauucucuguguuaguuuaaagcacaguacacuggaggggaguguuggaguuuacaauucaguauuccaaaauccaguacugcuuuggguuauauugugaaauugcauaguuaagugucuggaagaucacuugauuugaauugaaucugaaaagucucugugugugugaacaugggcaucccccccccugaaagccucuuugccuuucauuauaaaagagccugguacugcuuucuguuuuaaaaauucagcuggaaaauuaccgaguacaaacauuugcccaucaguucuuuccuacagagacgacagaaagccgucucccagugcaagcugacauuugagugucucugucggugacgguuguaguuuguggcucuuugcuuuuacuuuuguaacuacauauacucuggcuucuacacaguacaacugauuuuaaaauaccauuuuucugaguuuccgugguuguuuucaaauuuuccaaagcucuguuucuuucugagccacucuggggagaaaaaaggaguccuugggcauaacuuuuuucacuuuaguuauuaaguugaaaugguguguuuauacugguuccugcccgguccaaaugaaacuccaccccucaagcccccaaggcaauccagguauccagaaaugagcacaucugggguauaggagcauuccugucgguagauagcagccagcauuccucagaaacuugugaaaccgguucucugccuccaggagugauuucccuuuucucugguagaagggauuuauggcuggcuaccuguggugucuaugaacauaucaaagcccacacaggccuccuggcucccucagccucuagagcacccauuacucauuucagucuuagcuggccagcauccuagcccuucucagcaucuccuccccuacccuaaacucccuccagcucugugcuuuccucuccacugcucuucauucuccucuaacccgcugccccucccauacucugcucugcuaaucugcccucucuugcagccucccucuggcccaccauggccauucuauuucuuuguugacuguuucucucucucucucucucucucucucucucuauuucuuuguugacuguuucucucucucucucucucucucucucucucucuguguguguguguauguauguguuucucucuuucucaucuguaauaaaaaccucccauuaaucauaucaaggagcagccgugucaucaguuuauacacuaagaauugaugugucugaacagauauauucuuuaaguaauaauucuggaaagugucuuaucagaugacuuaauccuugugcauuuuuauaguuacaaaguugaucagacaguuacauagaauguauuuaucuaucccuaaccuguauucaaguucaccuuguugccuugcguuuuuguggaaggccuguguguaccuccauuuaaauaaagguuugcuccuggcgcugcgcgugcuuuuugaaaagcacaugaugauguguuuccaguguugcagccucucagagaaaaccuuggcggcccccagaauccucuacacgcccccucuuuauuucucuugcuaaccacugauagauaauaucuuuaacuuuggccuuuguugugguugguuggguuugguauggagguugugguugugguuguaguuguuuucccauuuccgaagcucugccucuuccuauccugcucuauucugggugggguuauaccuuauuguguuuauacugauagcuucuucagguugacuucuucgguuuacauuauuuaaggcuccuccaucugugcucauggccuguuggcuccugccuuuauuaccaguagaugcaccacaguuacccauuuaucuauugagugacaucaugaaugucaccugucuuauuuuauuauggauuggcugcuauaaacaucagugugcagaaguaaguuuucgguucacuuggguacaugccuaggagcagagauugcuguaucaugugcuuagcucuguaaggaacagacaaaugugcacuguccgugucucugcguguagacucuuaaaacucugccuaauccgagccggcucagcacuuaagggcacuggcucuucuucaacagggcuugcaguugauucccagaacccgcauggcagcucgcagcuacaugucaguccagcuccaaggaucugaguccuucucauaucugugagcaccaggccugugggugguguaagccauaugugaggcgaaccccaugcacagaaaauaaaaguaaaucuuuaaaaaaaaaaaaaacaaaacagaaaaccacccaaccuaauccaaagccuggaggcacacacuggaaacugucagcaugguuaccguaggaaggugacagaggaguaccauguuggcugacauuauaauuuuuuuuuacagcaagaucuuacucuaugauaguuguauagcuuuuuugccaauuuuuuuuuuuaguuugugaaaauaaaaguaacaaugaaucaacaagagcaaaaccaaagugguucagucuacuuucaguguuauguuccagugacaggaaguuggaguacuguguucucuguauucacaggucgguagagcgccuuccaaaugucaggcuuucggacuacacacuuacccagccuugagauaccaacaagacuugggauaagggcuauccugaagcuaguuuguggcuggaauugugucaggcagugucuccuguguuaaccgugugugucuuacagccuugccuuaacuugaggcuuaccugccuucugugguuaugugcgacucucuaguguucuuguugcccuuauccuuccgcucuucuucccgguaaggaacuucacucuguccauagcugcuuuccuguugucuauagaauuccagugaaggguuugggaguuguccuagacaaagagugacagucaggaaaggugcuggcguacgaacacuugaguggccaguccuccauuagcuacaggcugaugaggaaagaauuuaaucuggauuuuaucccauccuucaaggugaauuuuacacaugcuggaagguuucuggccguguguguguguguguguuuuccguauauuuaaaauacuuuucuauggauuaaguuuaacuuuuaagauuuuuuuuaaaaagacuuuaauguauuauaagucaaauucuaugauauuaaaaaaucaccacagagaccuagaaauuuagcuugucuagcaugcauuuauccccaugcgucagugaacgaaugaauaaauaaaaucuucauagaaaccaucaauucagugggaaagaugauuauuauguuagugaauuuuuuuuucaauaaaaguugucaguguuaaauauuauacaauuaaguacuuuaccaaguuacaguugaaaaggaaaggaaaacacucuguuuccugacaggaaccucaucaccuguugaucaaucauuugaauuucugagccaaaucuuuuuauauuuaaauuaauugaauuaaauaacacuguauauguguguaggaucuuagauuccaaaacccauaaaguaauccagguguaauagccaucgucauuguggaaucauuguucuaaaacacauguuacaauucacugaguaagacucacaggaguugaguuaacucaaccuguugacauuuuuucuguacugucucacuggcgugcagacagcucaguaucuacaaaccaggcuuccuacaaccgggacagacuaagucacugaacuauagcaagaacuacagaccugaagguaauggguaguucuuuuagucaaggacaaaaaagagaguguaagacgguuguggagcuucucugcugcuguuuuuccugacuguucaugguuugaggagcaguggcuaccuggggaauuaaagacuguucuuaguccaccucaggaugacuaugugagcucaucguguguuugucguuagaacuuccgucguggacgguaauaguuguccccuuuccugcuugucugucuuuccugcuuucugcucugcuuucucagucucugggucuuucugaagaugucuccuccaguggccuccuccuccaucuuuguucuuugugccccuuucuuugucuuauuucucuggugugauuuaccaaagccauuccugccucuuugauggaguaguacuucuuuuuaugccaaaaguuaacauuuaaaucuaagaguaaagaaguuaucaguaauugaauuuaauuuucacauauggaauacaacuggucacagugaaaaugagaucugauauuaaggauaagaauauaauguuuuaugcagcuuuaacaguuugugugaacagcuuuaaguguucauaagcuuugacaugaaauucuauuauuguuagaaaccauuuggaaggaauaauuuaaauaaugauauguagagucaauaaggauguacaacaucugugauauuaguaggaacugcagauggacuauuauauagacuauuuuagaauagccacguagauuauguguagcagguagaaaguauauuacuauuuuuaaagcaauaaaauuuguaucugugcuagaucuuguuagaauggacacaccaagguaaugagaguacaaacucagguuuuccaaucaguguguacauuauauaccauagcacauuuaagagcaaagugugcuuuuaugugucaaacagcuuuuagaaucaucugggagcacagauauuuuaaguccacauaccauuuaagcaaagaauucuaugacuagguuauuuuauugauaagcugauacauacuaagauauuugcagggauauucauuguagcacuaauuauaguuugacugugaccguuauaaaauagugguuuuucuucugaggacuugucuggaggaugugaucaaagcuauggcuagauacaaagcuaugguguaguuacuucuuuguuaauaauuacagaauguuaaaauccuagauaugcaacaguaguaaguauauaaacuguauucuauacguggaagauugcagcauugcaaauguuguagaagacuguaaugaaugaucuuccauuuuauacacacacacacacacaugcacacaugcacucgcgcauacacagucacguguauagacagacgcaggaggagcaugcauggaaaagaagacuuucucugggaaugucgauaugaaucauucaggcuuaguuuuuguuaguggcuugugauuaugauuacaguauaaaauggacaugaaggugguuuuguuuuugugguuuuggcugaauggaaauugcauuuguuuauuccuuucuugaaaugcuugucuccaugcugccugccuugucucagauccugaguucaagagauccaugucugccucccauugucagggcuucaggcuggugccugguacccagcucauucguucauuauuuaaacugauacaugauaauguuauauauuuaugagauuaggacugacagguggauacacuguauacguauaggucaggguacugaccugucugucacuugaaacauugccauuugugguaacaaucuauuuacuguacagcacauaauugccuguagucacuguguuacacacuaggaugugagauuuauuuccccaaucuagcugugcuuguuuucuuucuuuuuacugagaaaaugaacuacauauaaagaaaaaaauuguaggaaauagacuuaaagaggugggacuaaaguaauuuuuaaagacuugggucuuuucuauauuuuuguuuaauagaaaaagaguauauaauuuuacuguaaauaaagauuuugauguuuuguuuuguuaaaagcaugguugauaggcaauuuauuagcauaguuacuacuaacauuuauacagcuaacaaacuugaauuuuucuauuuucauuuuuaggccagaaauguacauacaggagaauuagcugcaguaaagaucaucaaguuggagccugguauguacugauauaguguguguguguguguguguguguguguguguguguacuuauauaguguguguguauguauguguauaguguguguguguguguguguaguguaaaugaguauguacguguguaguguguauguguguaguguguguguauaguguguguauguguguaguguauaugaguguguacguguguauguguguaguguguauguguguauaugugugucguguguaugaguguguacguguguaguauguuguaguguauauguguguauguguguaguguguauguguguaguauguauguauguaguauguauguguauaguguguguauguguguaguguguaugaguguguacguguguauguguguaguguauaugaguguguauguguguaguguauaugaguguguauguguguaauguguauguauguauguguguaaguguauaguguguguguguguguguguguguguguguguguguauguugcuagggauuaaacccuaccugguguggauauguauuaaaauacuuuauucauuuuuuaucaguuuuuuuauauaguuauaagacaugaauauucuguauuuccuuuuuuucuucuucuucuuccuaaaauaagucuuuauauguucuuucaggucaauagcauauuuucaauauaaucauauuaaauuauaucaugcauuaaauuguaagauagucacaauugauaugacaguuuuguugcuaaagggaauucaauugaaauguacaugcucaaaaguuuuaaguuguaucaacucacagugauaaaguaauuuucaauugcaauuauagugaacacuuuagcuucaucuuuagcuguuaaaaaagugcaauuuggggcuggagagauggcucagcaguuaagagcacuggcugcucuuccagaggaccugaguucaauuuccagcaaccaugugguggcucacaacuaucuguaaugggauccuaugcccucuucuggugugcaccauguaugcacacagaacacucauaaauuaauaaauaauuuuaaaaaaucaauuagaacucacacagcccuaacuauacucuuggggacacuaaauaaaaccaaaacuagugaaugggagaaagacuauaggcaggagacagggcugcuaggaguggaaggggagagggaggggugggagaggggccagacugcacagcuuacauaaguguaugaaaugugaaaggacaagcuuacuaauaaauaugaauuuaaaacuuuaggcaagagccaguggcuuuguaagagaaaggucaguuaauauucaagauaaugguacucuguauauagacuauucccugauugguuuaguuucauaagucagaucucaguucagugcuuauuugagcagcacuucacauuucagaagauuauuuuaaaauauacugagauaauuguuuugaaaacaaagaccacauaaagccuggccaguuccugaaagugucuggugccaggaacaguaguuuuggagcagggaggugaguauuugguaaucugcucauuuccuggucuauaaauugaggcguguaugauagcgcaugguuauagucauaagggauucugaaucugaguggccuucauauuucacauacauuuuuggaucaucauuuguauuauuucaacagacagaugauacugggaaauaaccuauuuugggacaguuuaaaaucaaauuuucugcuauaacaccauacguuuucuugacacaauaacaaauugugauauuucagaauucuuuuacuauuccaugugauaaguauagacugaucuccaaaaugucaccaaccaaagagcugggacuguaaacaaacuucccuagaggaguuugaguaaacgucuccuguugugugcagggggcgggcggggcucaggaggaagcacugauauuuaucccuuugcugcgcacaggaagagcagaggucuguccugacagaccgacuuguacaugacuuacuuuggauuauaauucaccuuaguaaguacuuuuuaagaaucugcgguucucacuuaucagugaacugcauguuaugaauaguguagaaacugauucaguaaagaacaaggucaaagcuaaggaggugccucacuagguaaaugacuuaccuugcaaauauaaggacugcuguuuggcuccccagcacccucaaaugcucgguugguguggaggccuuucugugcuccaagcacuagcaagacagagagcggaucccagagcaagccggcuagcuagacuaaccacauagcuaaacucuaaguucaagugagagacccugccucaauguaugaaguaacagccaucaaaaaggauacccacugucaaucucuggccaugcacaugcauacguacacacauaugcacacccagaaaaggagaacuguaucauguauaaugugguuuagcuuaaugguuaaaugugauaauaaauuaagccucuuuggaagguuggcacucucacuuccuuguuuuguaaaagccaaugguuuccuauuagaggucacucacaaagaguaaacagauuucgguaaacacugaugacgugacacuaguguuuuuaccauuuuguucauaugugugaauguaugauguaugugugugugugugugugugugugugugugugugucuuugccugugucucugugugucugaguaggucagaggacaaccuuggaucccugacuucaccuuguuggugaugagguuggucuguucacuaccacauacacuaaagcucuccccagcuucuggggagucucugcucccacacacuuagccuuggaaggguucugggggucugaacugaggcccucgggcuuaugccgcaaacacuucacccagugagcuaucuccucaguaucugaccauuuguuuagacuuuuuauugauucuuugugaaugucacaucacgcacccccauccuuccauaucacccucugcccuugcaaccuuccccccaaaagaauacauuuaaaaaaaaaaaaucacuguggaagcuacggcgugucacauagcaugaccuuuugugcacacaucuuggaagucuucauugcagugagucacuggucuggaucuaggccccuggcuucugcuacacugucaauaccgaauccugaccgggacuccucucagauacguggcaguugacaggucucugaguguccucaggcauccggcuucucaacguuggccauuuuucuaaguaguugauuacgugucaccugcucuuccugcccucugucaggugguuguuguuguuauuauuacugacacuuaguuguucccugcacuuugagcuuagucagucuucacaucuguguccucaguguguccuuagguuugcacucagcuucugguaguuuucuugucugcauaaagacagucuuccuuucucucuucuuucccuuuuuauuauaugguuuuuguuguauuggcuguuguuguuguuguuuuagucuuuugagaugagauuucucuguauaguccaagcuguccuggaccaggcuggucuugaacucaagagaucugccugucucagccucccaagccuccugcuugguuuaaaagguuugugccaccacugccugguaguaauuauauguuuuaaaaaaaauuaacugaaacuucuuaugguugucuccuuccaaauuuaaaggucuucuccaucagaacacuuuuguucuaaacagcaagcaaggucuaggugggcguuguuguuguuguuguuguuguugucucacauugcugaacaguuuuuccaaccauagcuacaaauggcuucuuuauugacaaauuugaaguguauuaguuggguuuauauacugauacaguggguuuugcccucuauuccaaguucaguaacaaccugguuuugaguaauauaccuuuuuauuaucuaauaaaauucuuuuuuuuuuaauguuuguuuguuuauuuuguaauaacaugaaauccuuuuuguuuguuuuucuuuuggagacaggagucucagcauuggccaagguagccucaaacuugaaggcucaggcaguccucuuacuucccaaguaguugcaacugcaacagucugccacuuacuaugccugacuguagagaggaacuccuagaaucucauacacaguuuuguugucuccggcagucuuacagcacugaugucauuucugaugguuuuuacauggauacacauuacagauacugguggcuuuggguccaggcuuccacauuuuaagauggugcuuccaguauugcauauuaagcaucaagggcugacgaaguguugauuggccugugugucaugggggcucugcccacuucaccuugucuuugacguugucuguuaaugucuuucguugugucaguuagcucaugagagccaugagcacaucaucucuuaacuuaguugacgcuuaguacaugagagagccauucagagugaaaggauggagaugauaacagcagggccucggacuugaauuuguaucucacaggggaggcagagcaaaggaauuaauguaugaugcugugguugcucacucaugcucagauuggaaaguggcuuguuguuuuccuuaugacucgugcgcucugcccucaauacgccuagugcuccuagugcucccagaguucugcccucaguauuccuagugcucauggugcucccagcacuguccucagacauccacuccuggugcucccagugcucuguccuccuuacacugauuuuaacuuuacugaguuaugauagugccaacuccccuucuauguugccuauaccaagugagucagccuagaauuuuguacuuuuaauacuuaagucauugggguguuuguuuuguuuuguuuguuguuuauuuuaggcauuucacuuggaaaaauucuauuuugguuauuuuguaaccuaaucugaaccuuucccuuuguaauagaugagucuguuaauauauccaauauguuguuacuuauaggauguuugaaucucacuucaucugcuuauuuuauuuguuucuuagaacaguguuucucuguggagcccaggcuguccuggaacucacucuguauaccagacuggccucaaacuuuuugccugccucuucuuucugacguguuuuguucuuaaucuuuccuucccuguaaguuuuuuaauggccuggaauuucuuuuauuuuugcuguugauaauuuggaagaaacauaaucuaguuuuaucagagaguggucugugaagcuuuggaauaacagccuuaaauuuguacaacuuuauuaggagauaagcuuguguggcagugcacaccuuuaauccuagcacucuagaagcagagguaagcagaucucugaguucaaggccaaucuggucuacaaagugaguuucaggaaugcuaggacuacacagagaaauccugucucaaaaagaccaguuaaaaaacaaaacagacagaaaaggaauugaacagaggcauggagagaugguccuggguugaacagaggcguggggcucaguccccagcaccacaugguggcucccagcugucuagaucuucaguuccagggaaccaggcacccuauucuggcuucugagggagaaaggacaacacuggcuuccauacguguaucaugacacacuccuccagaguaauaaaaauacaauaauauuaaaaauuacaaaagaaccaaccccccccccaaaaaaaaaaaaaccaaccagucuuggacuucauagugcuaaugauauugaggcucacauacuuguauuuaucuaggcucuccacuucugccacuaagccauuguuuaguuuggaauuucagccauagaauuuucugauuuuagugagguauaaguauguaucggucuacuuuucagaaggaaugggagcuggagaccuggccagugguuaagagcauuugcuguucuuccagaggacccaggcucuguucuccaacgcacaugguggcucacagccaucucuaacuccagcuccgaagaauccaaugucuccuucuggcauucaagaacacagcauucauuugguucacauaauacauauauacacacacauacauauauacauauauacauacagucagaacacccauacauauugaauaaauuuaaagucuucuuuagaaauauuuaucaucuuuguaaccuauguauaaauguaaugaccaguuauccagagguaguuuucuacuuaucuugguucaguucccauuguugguauuuuugugucaguucuuugccauucuggcuuauuuuucgucauuaagugaugugcuaauuugaaugcgauguucacuauagucuugggcagugguucucacccuuccuaaugcugcagcccuuuaauacaguuccaaauguuguagugacccccaaccaugaaauuauuucauugcugcuucauaacuauuuugcuacuguugugaauuguaaauaucugauaugcagggcaucugauacgcagucccaaggguugugacccacagguuggaaaccccuggucuugggcaucugaauauuggggaggcuuaggagguauggcuuuguuggaggguguaugucacguugagaguuuaaagaugccuagcaguuugaguuggcucuuucugcuuccugcuugugguuuaggaugugagcccucagcuguuccucgugucauaaaagccaccugcagcccgaguccugcccuuagccugacucuuaucucucuuguaaagccaaauaaaccuuucuuucucuaaacaccuuggccauggcgcaugugcuaguuagguuuugucugcuugacaugagcuagagucgugugggaagcaggacccucaauugagaagaucuccuccccauucauuggccugugggcaagccuguggagcauuuucuuaguuaaggauuacugugggagggcccagaucacuggggcuggggcaguucuggauaguauaaaaagcagggugaccaagccaggagcaauaaaccaguagauagccuuccuccauggucucugcuuuagcgccugccuucagguuccuuccucauguuuugaccugacuucccucagugauggaguguggccugagagcuguaagaggaaauaaacccuuuccauuccaaguugcuuucgaucauaguguuuuaucacaguaauaaaaaauuagcuacauacaaguagacuuuccuuuaaacauuaggaacccuguaaucuguagccacacauugguugucuucccagcccucuucgucuuccuuauuuuggaaaucagccagcugagcuccaaacugggcuuucuuuucauucccuuuuuuaauacacuccagaaucagucuguuaguaaaugccuucaguucuaccuccaaaacaaauccugaacgucucucugucucuccauacgaccucuguguauaugcaugaaugucuccgucugcauucccuacagccauguuugucccagccgacuuagcucuagggacgcuugcagucguaaucagauguucagccuugcacacagaauccugcauggugugagcaggccccuuguguuuccccuccacuccucugccuccauuuucuuguauuuagacgguccgagacuaaaccagcuccugauuccgccaggggugcugguguuuuguuuagaagacuccuugccauuuagaacucagcuuagauguuaugucugcaguggcaacuuaacccacacccuugugggguugcagcuuugcacagcaugugacugcuugaugcuuuuccuauguggacauuugcuucucuccuacaagguacgaucuucggucuccacagccguauuucagcacacgggacagccucagcaugcaccacacgcacucucauauucuuccuacaaaagcacgggagcuccuguggccuuugaaucagcagacggucaugucacccauuccucugccagcaucuguagcguuucuccccugacuguugccggagccugccuggaggugcaucucuccccuuacuggguaccugcugcuucagcauuaagggagauuggcagucugcucuugucauugaagccagguucuccaugcacugacuacauuuugauuuugagaacucuuugcaagcuucccucucccacccgaaauucuguuuaaaacuuuuaucauuucuuagacuuuuaaaagaacuucauugcuuuucaugccgggcgugguggcgcacgccuuuaauccuagcacuaaggaggcagaggcaagcggauuucugaguucgaggccagccuggucugcaaagugagauccaggacagccagggcuauacagagaaaccugucucaagaaaaaaaaaagaaugucaguuucagaauucagcuaagaguucauacugcucuuucccagaaccuaacuaaguucaguuaccagcacacauauugugcagcucacacccaccuauuaacuccaguuccugcagagagagacagagacagagacugagggggagaagcaggcaggcaggcuggaggcaaggaaggaauaauucuuuaaaaauaaauagugccaguuacucacaguaccuccccuuaccugugcuuugccuguugucucuccaggccugucugucugucugucuuuugucaucuuuucuguaaguguauuuuuguccaccaugcaucaauggcuuacuugccuccuucgccauuccaucuugcuucugguugguucuacagcgggacuguucuccucagcgccaucauuauuuuuuuuuuucauuugcugccugguugucccuguauucauuuucuccuuucauuuccuuaaaaggaagcacugcugucuagaaguuucuuucauagggaaggcccguguguuuugcauccuguagcuauguguuuuucaugguaaguuuuugagcgggaccagggaagccaagguccaucggguucccaugcuuguguagccgacuuggggaaugugaacucaaaaacacaguaacaugguaaugaauuuuccugggagucaguucagauauuuuuaaaaaauuaucuagacagcauuauuucaaaauugaauucuuaacuguauuuagcaacuuaauaaauugcacugaugccagucuaauacaaaagcccuuccuuguauugacuuagcagaggagcugauauagaauuauguuagacaugaaaagguaauuacuugccaguaugaccagaaggagccuaugucugguagaccauaaaaaaaaagaggguuuuguuuuguuuuaucauuaaguagaugaaaugccaucuggaaacuuaauaacuuuuccuucauagauaaaaauaggauuuaggauaauuuagggcaguauuuaagugaauauuuuccugaaacaaauugcuuuuuugguucuucuuaauacuuacaaaaaggcuuaaaguaagccuuaaggacaaagaugaacacagaaagucguuuauuggccacaaaaguggaaucagcuguccuuccguggccauauguuuguuuuucuugucuuuuuuauagaaaaaaaugauucaggaaugauuugacuguuucugucucauucuuaauagcagaaucuguauuaaccaccuuacacauguggcaugggacaggguuuggcuuggcugugaucaccacugaaaugcuggugucacugcugggagcuuuaaacugcaguuuucuguccuuggucaggccucagaaaugcccuagaaaauuaggcugguagaugguagugugugccacccugauuuccugucugacguuugagugcuuagcuuagccuggugcuuccucaacaggucuucuguggcuaguaguggccagcagccaaagcaggagcagaaagcccagaaaaacguucucuuucucucuucucugcucguagcucuuuauuaguguggcuuguuguugagacaagguccaggaguccaggauaauuagugugauguacuuuuguuuguucacuugcuuggguuucguuguuguguuuugucuuguuuuuuaaagcaguuaggaauauucaugaaguaauccaauauuucacaauaaaaaguuaaguauauugccuuacuuuaaaguuuucuaaauaagugggagugcgcuaauaucuuucaauagauuuuuuuuuaaaugauacuaccgggaaauccuguuuccuggaaguguacgaggagaguguaagaggggaaaggucaggaugaguguaaagaugugcuuugaacaacaccaucagcugcucuagcuaagugggacauucuugcuuucuggaacucuauuuaaaaacugaaugaccuuuaagaaaaagagagaacuaaacagccuuaucuuuuucagugugugugugugugugugugugugugugugugugugugugucuacauauguguacguggggguaccuaccuuaauucuuuuccuuauucccgugagacagguucuuucagagaaucuggcaauaagcuggcagcuaaaaggcuccacccgcccugccuuugcccugcccugcacccggcacugugguuagaaacauuugcaugaccacaucugcuuuuugauguggguucugggaaugaaaacucaggugcuugugcuugugccccaaauacucucacugagcuagcuccccaggccugccuuucacugagcuagcuccccaggccugccuuucaauucucaaaagacuuucauauggauccucuguguguaaguguguguacaugugcccgugcccacagauuacagaauaaggcauuagaugcucuggaagagcagcauggccuccuaaugcugaguccaucucauccugugcuuuccaucuguaaaacucuacaauguaaacuauuuguaacccucuccucauuguuuggauacuuccauucggaacuggguggguguugugggaaaaccucccuaagaauggccuguaggagagcuuguggagcaguuuauauuuuuauauaccugaugauugauaaggaagggcccagcccaugacgggcagugccguccauuggcaaguagucuguagugcauaagaacaagccgggggagcaagcaguaagcagcaucccuccaugaccucugcucccauuccugccuuauguuccugcccugccuucccucggggauggaugagcucuaagaugaaauauacccucccuccccaggggugcuuuuggucaugguauuuaucacaucaguagaaauccuaacuuggggaucuaacagcuucuucuggucuuccaggguaccugcacacucacacauacacagaguaaauccuuucuaaaaaaauuguucguuuuuuuaaaguuucuagcuaaaaagucuaccugucaaacguguagccccagcucuguggagaugaauacagaaaguccaccugccugacuccagguucagugggaagccccacugcgaagaagugaggugaauaacgauagagugggacacugagccuccucccccgccuccaccucugccugggugcguguacucacacaugcgcacaugugcauaugucccauacacaaaaaguaauaaaacaugaaaaaagaugaaauagaauauuuugugccacuuaaagcauagguaauccuauguauuauuauauucuuaagguacuucuguuucccaguuuagcuuugaacacaaauaauuuguuguuucuuuauaauaaaaaucaugacuuuuaaugccagauucuaaguugauguucaugccagauuauagauuaguaacuuuaaaaguuaaguaauuuucuaagcgaaggaagcuaaagucaaggauugcagguuuacaaugugcagguuacagggaguucaagcuuggggugucuuaguuaggauuuccuugaugugaagagacacuauaaccaaggcaacgcucauaaaggcaagcauuuaauuagggcuggcuuacagguucagagggucaguccauuaucauggcaagaagcauggcagcauccagguagacaugguacuggaggagccaagagaucugcaucuuaaucugaaggcagccaggaggagggucuggaucacacaugccagacuugagcauucaugcaugcaugcaugcauaugcauauauagauagauauagggguguguguguguguguguguguguguguguguguaucuccauccucaaagcccugccuucccagugacacacuuccucuagcaaggcuacaccucuuucaauaaggccacaccucuuaauagugcuauuucucaugggucaaacacauucaaacuacuacaguguggucaacuuaggcauacccuauguuacaauaguuuuuaaggcagggagggacuggagguguagcucaauaaaagagcauaccuagaaucuaaaagguccuaguuucaaaccccagugcaguaguuuaaaaaaaaaagaaagaaagaagagagaaagaaaagaaagaaacuuuaaacguauuuuaucagaaaacacuucucacucauuuugcucaauggagaaaacguccuguuuguugacuaccacuuuaaccagccagaucugccugauccccagcgcugggucacugcugguuuucugaaacuuagcaaauguaguguuuaucauugcgcuuaauuggguuucugaaagcagcuuauuauuaaauuguguguguguguguguguaugcauguguguguaugcgugugugugugugagugaaugaguguguguguaugagugugugugugagugagugugugugugugugugugagugaaugaguguguguguacgagugugugugugugagugaguguguguguguguaugcauugugcauguguguacacauauguaagccagaggucagccucagcuguuguucuuugggaugcacuuaccuuguuuucugagacagggucucacuggaaccccgggcucuuuguuacuaacuuggucggccagccauccccagggguagccccagggacagccccaggacguguccaccucccugguagugggaucacaggccugcaccucaggcgcagccuuuuaccuagauacuggcgacugaacucagaaggugcuuaccaaacugagcugucugcccagcccuggaccuuucgggcugccgguuuuuuguguauagaaaccuuaacugcauuucccacuuugucacugugaugguugcuucccacucuuggcuccuaugagcagcauggcccugggcuugcguguaugucuuuuuagacuucagaugcacuuuuuggaugcauacuugagaguuggcuacuagauaacuaacuagaucauguaguaguucuguuuuuauuuuuaaauuuuaagaagcuaccauacuguaguagagcaucauuuuaugaucccagcagcaaugcacaaggauuuugucuucucuacaucccuacuguuacuuaaaaaaaaaucauaacagcccauccucguggacuugggugauccuucucugcaggugucaguugugguucucugauuaaugcugcuguguguugucugcugucuguuaguugacgagguuacuuuauuuguaauuguugaguuugaggagguuuacauauauauauaaauauauauauauauauauauauauauauauauauggcuguuaaccccuuacuggauguaucauuuucacauacauuuacccauucuacaggcugcuuagucuguugacagggcccuuugaggaacaugaauucuuaauguuugauguauucuugucuucuuucacuuugauucucugugcuuuguuaucauaucuagcaagucccaaacuccaucaucccaacucuuacuaggacuucuuggaguugugaguugugaucauuucagucuuucauucaugucugcgcacuugggucuguuuuaagucucauucuuuuacauguaugcaugcggcuuucccagcacugauguuuaaggaaguuauuguuggccacauacaugagggaguauuucuggguucuguuccuuuugucugugugccugucuuuaugaccguagugaacuguuuugauuuuuguaguguucaguacauuauggaauuggaaacacugagucuuccaguuuuauucuuuuuaaagguuguuuuggcuguugagggucccuugaaaucucaggaguuugguuuuucugagaaaauuccguugggauuuuuaugggguuaagugagugguguugaguguggaccgaucccuucuguuuuagucuucguccuguaauguuuucuguucucagugugcacaucuuucaugcgcguguuuauuuuuugggcgcuacuguaaauggaauuguuucccgguggucccuugcuccucaguagaaacacuagcuuacuggggugcaggugccuccccuaguucuggcagauuuuuaguagaaucuuaaggucacgucaucugugaacauacuguuaccuuguucauuuccaauuugggaauuuuuaaagugauuuuuaauuaugugaacaguacuuacuuucauuauugacugaaaguagucuguuaagcuauggaauaugggucccauucacagauacgguaggaggaaccacauaaucacauacuuauagaaaugggagcaaacaucaaaaugcuaaugauuaauguguaucuaguugguaaauuuguauuuuuauuucauucuuacuguuuuucuguauugacaaaauuuauaugaacguugauauaauaauauagacuaaaacaugaaacguuuuuauuauuaaaaagugguaguuccacuauugguuccucuagaggauggacauaguuuaguagcuuucuguguaauucagaagcaacagguaaugauuuuaaccuguaaucaacaauguagauauauacacaauagaccuuaaaagcauaaaccaguugacauuugaugaaauaauaaguggaaagacuugaauucaguaauaauuaucuaaugaaaauauugaaaugugcuaaguuauuaaaagugacucagcccaguuguagcuuuuagucauuuaguuauucaaguuaagucuggugccagugucugucacguaguguguagagcuuccaucccucacugauccccucuuggcugacaugaacacucuuuuccugggguuucaggcuaaauucuccaaccccaagacuuaaagaggccaguguugucagcgacucccagcuuucucuguuccacuuuggagcugccagcagcugcccuuaucagagugagggagagcacacggaaggcuuauccagggaguagagggaccugcucagcugcauggugcucagaguguaugagcugagaaagccgguaaugcacagcuuuugauucuagaucccaucuuuacugagacugcuaauaacugaaaacacucauuuuucauaguucaacuuuucaagagaccacaguggucucgugccaggccugugguccacacagguuccuucagcagccagaugacuaggcagagacaguagcucgugcugaagagaagagcugggggcaacuaguagauggcuaguggaguccuuaaagugaguaauaaauaaaauaaggugagaagcuggcuuuaggagagcuuggaaccauagcgcacauuuaaagucaaagcacuugcaagguauucagguggcaaugagaaggcugcuaaaaccagagccaaggaguucugucguucuuggcuaauuaguuucauccuuaauauggccugguuacgaugaaacucaacuugagagcacaucuuaaaagucacuucuacuggaccaggaaguagccugcauccugcaaaacccaacauacagcccagugccuuuccuaugcaccagcagugagcaugcugagaacgaaaucggggaagacuaaacuagaguaaggcugaccaacuaggugcgggaucuagacaguaaacauugaaccagggccaggcgaugguugagcacacaucggccugauggccagagcucagucccgggagcccacgugguggaaggagagaacugaccccacagaauugucuucucaucuucacauguguagaagugugaacacacacacacacacacacacacacacugaaauguaauuucuuuaaaaaugcaaacacugaagcaaaauaagccagaccuagaaaaauaaacagcacauguuaguacaugaaaucuagauuuaacuguguugugugcaugcaaauggaacaguccaacuaggaguuaugauuguaaauaguguauauugaguguugaaccuaauuuuauaaaacaaauaguguugugcguaaaggaacauugagguucacauagagugguagugggcgaaacuggggcugggaagauggcucaguggguaaauugucauucaagaguaagugccuggguuuaaaccccuagcauccacauaaaaaagcugcugcugguggugugccuguaacccagcccugggagacagagauaagaguaacccugggacucacaagaugaucuugcuuagucagcaagcuucaggaucauugagagacccuauucaaaacuaaagugggaagugauggaccucugagcuaacucaacaggcuugcacacaaauucucacuacccuuccccucucccuggucaaguaaaagaugugggugccuucacuaccccacuuucauuaauauguaggcuacucacaaagagaugggcuauagcucagugguggacuacuauccuagcaugcaugaggcuaugaacauauauuauguaaauauuaucaaaaacuuaagaguuaacuauaccauagaucaaauaggcacaacagaugacgcuguaguauucacuccaacagcugcaaaauacaguguuuguagcuggucuuuggccacuuugggguucuucuuucucccacccuucucuaccccuuuuccucucuuucaucccccuaacacuagguaggagagagaaaaggaugggggugaaagagguagacuaccuccugcugaugaggggugucaaguuccguggggcaaguuugaucuuuacugucaugauaucuaauuucuucucauuucuuugcacaugacuacuuaacaaaccaaaaccaaccaacagcuaccgcggccacuacccucagagcccuagcauuuauauuauauacccucugacagguccccaggaucccaaacgccacacaaucugcagcuggcaaaacacgccccugcuagagcauggggcaaaucauagucagcugcuguggacaaucugaagcagccucaaagcacaugccugggcuuaaaguaaaacauagucccauaauauuucuguguuuuucagagaaaccaaaauucucacuacaagucuucucauauuucuucauauuuggaguagcaugaugaccaacuuauuuuguuuuacaggugaugauuuuucuuugauucagcaagagauauuuaugguuaaagaauguaagcauugcaacaucguagccuacuuugggagcuaucucagguaaguauaaaagcgccaucguuugaccuguuuuucauauucucuuuccuaccaucuucuucuuguguaaaugucgucgugugugugcauuuuuaaaacauugcucaaaauucuaacucugguaggguuuucuugccaucuucccugcucuauaaauauuaccgccucuguguaugugaucgugccaugucugggagccuuacuggagcauugugagugaugauaauggagaacagaucacaucucaaacugagaaaucugaacugauaugugccuaggaacgauugcucugccaguuuccuguugcucucugcggaccaccccgaagcccagugcacuaugagagugagagccgugggccuauagaguaugcauuucaguagcuggaaguacacacucauuuaauucucuuucucucucauauuaguagggagaagcuguggauuugcauggaguacugcgguggcggaucacuucaagauaucuaucacgguacuguuacugcgacucuacaucauagagccuacuuuggccuuuuaugauuguuguuugacauuuugaguuaacaagggaagugaguuguguagacuuagucucuaacauuauucuuucuuguccccagagacggguuucaaaacuaggaauucuuacugucgcucuugcuuacucagcguuuuuuaagaguuacauaaauaccuguacaacauaaauuuuacuuuuaccugggcaugauguguguccuugcuaccccagaugcuucugagacacagucaggaacauccagagcuuaaggccagucaguacugaaaacugaaacucugccuaaaaauuacaucagugcuacuuagauguaguuccuaagaaagcagaagggcaugugcugagggaacaaagcuucaugauacagcugucacaaaaaggagucagccagacagaacucccaggagggaguucaguacuccaacaaauuuuauuaaaauaggaguuugaggccgggcggugguugcgcacgccuuuaaucccagcacuugggaggcagaggcaggcggauuucgaguucgaggccagccuggucuacagagugaguuccaggacagccagagaaaccuugucuuggaaaaaaaaaauauauauguauaugaguuugaaaagaaagaauauuuagaauauuuaguauucuuguaguuuagacaguuuccucaguugagcuuggcuuuuccucauaaccugguuuagaaaucgugucuguagggccgccacagucucagucuucauguggcuggcauuugcaaaaacauaaauaaacaauauuuaugaaauauuuuucuuuucuuuauuuaaaaagaccuguugcagauauguauaauucauccagaauuaugcagaguacuugaaaacauuucuaugcuaaaaucuuuacauugaaagucaucaaugucuguuaaugugguuucugaaauagccguaaagcuguaaaaacaaaagugcuguuccacugucguaacuucuaacgaucccagguuuuagacugucaggugcccagugacgagggaagccgaacuguacucaacuguauaugacauucuccuuaaauauggaucacaguugaccaugcuuaggcucuugaguuuuauuauuauaaaugugcaugaaugcaaaugcauagcaaaaugagaggauuauaugccaaaaucauaagucacugccucuacggaggaaaaguggagcucagaaguaaaguucugaauuaugauaaauacauauuauuguaucauucaauuauaaacuuuaaaguugccuaauuuugucacaacaaacaaccauaacaaauaacaaaaaaggcucuauuauuuuuaaguuugccacauaaauguuauaaguacaggaaauacugugguguagacugucucuuaggcgcuugaaugagagcccauguggugguacauaccuguaaucccagcauuuaggaggcaaaagcagaaggaucagaaauucaauaucauccuugauuauguaggggaugauucagggccaaccuggucuguauaggaccgucucaaaagauaaaaacuucucaguaaacaguaacccuaccuuuuuaaaaauuaauuaauuaauuuuauguaugugaguacacuguaguugucuucagacacaucagaagagggcaucaaaucccauuacagaugguugugagccaccaugugguuucugggauuugaauucaggaccucuggaagaacagucagugcucuuaacugcugaaccaucucuucaguccaacccuaauuuuaaaaaagaaagaaaacuacuauauauauguguguguguguguguguguguguguguguauauauauaguauauacauguaugaauauguauauauacauagagagagaaacuaccagaaugaaaugaauauuuucuuuucuccacuaauauuuuaaagaaauauuaguuaaauaauaacauuuauaucacugaguuuaaauuauuuucuaagauuuuauaaagaauuaugauuuuuauaaaaauuuuuauuuagauauaauuuuuaucuaucuguacuuuuacaaaugagaacuguugaaaauaugaauacagcuggcgaauuuuaccacuuccccuuuuaugcuuuuauuguuacugagacauuuuuaugaaauuucuguuugcaauauuaaagccuaauuguuagcagggcggugguagcccacucuguuaaucccagcacucagaaggcagaggcagggguuucucugugaguuugagaccagccugguuuacagagcuaguucuaagacacucaagacuauauacaaagaaacccuguccugaaaaaccaaaaauaaaaugaaaauaaagccugacuguuauuuguuuuuaguugaguauaagaguauuaguacuuuaaguacuauacuagaaacacagucauuuaauuuuuuaaaagucuguaccuaggcggaucucugugaguuugauccacagccugcucuaccuagagaguggcaaguuccaggccagcugggcuacguaauacuucagaaagaugugugugugcgcgggcguguaaaauaaagcagcuucacuuuguacgaugcucuuuuaucaguuuacuaaggaucagaaagugucaggaaguagguguggucagucagaaaugaaaggaagcaucaagggcuuucucuaugcggagauguugugucagcucuaguccgggucucagcaucagcaggcagcgcaccaguuuccucccguguacaaaaggugcuguuucgaagcucccgaugggauucuugcauaaggauuuucuauuucaugguagaggaagaucugcuuuccagagaucaucugguuccuuuugaucuuugguaagguucugaaccaggccugccuguucugagggacuugcucuagaaaguucaucucgacuccacaagcauaaacucaugggguuucagcccucguaacgcauagagaacauguuaaaggugucacuagacuaguuuccaagcggcuacuucuaacuaaccuuuaaggucuuuauauuguuuuguguuaugacuguuuugcgugugugcacaugcccugcgcaugcauauucucagaggucaggagcaggucuccuccagugcucuaugccucugcuaguaacucgcgaacagagucagccaugcuccuggcuuaguuccugagacuguuugaggacugagcugacaguccuggcucucuggggaccugugugugccacgugcacuaaguuuuacacauaaugggcacuuuccauguucacuguccagagcugccugggaauaaagcucuuauuuucagaauugacuuuaaaauucucaguguuuguuucauuuaaauuaugcaaaugcagucugcucuuagucagaaaagaaggcauccagugauacaugcagaaguuauacgcugcuuuauaacuuuauggcuagacuguuuuuaauguuggcuucaaaugacaauauguuguuguuguuucuuucuagugacugggccauuaucugaaaugcaaauagccuacgucugcagagagaccuuacagguaccguauuggcuuccguagcuaggaaggcaggcucacaguuaguaacuguaaaaugguggucuguccgaaagcugaagaguaaaggcagcgcucucccaguucagccucagcgcuuugugcaaagcucgugcuuuccuccugaaugacuugcaaggauuuauucaggcugagagcaguggucacaugucugcuuugaugcugaagugcagacagucaugcugcagggugcuuggguggcuugaguugccaccaacgcugaggaaagccauacuucagcauuguuuaaugugagucuguagacuuguccguuguaaugaggugucuaaccuuuucccucaagcuuuauggugugaacagaguguuccugcagaauugggagggcgcuugccagaucuuguucugcguggcauuaauacaggucaucgauagcagagcgcccuguucuaaguuccaucagcguaggaaagcaugcgcgcgcuucuuuauuccugagcccggggggaacuuuaauguacuaaguguuucuucacuggagagucagcaucucuacaugauuuuuuucccgguucucugaaagauaacucacugcaaaaauuaguguuaacaguauuguucaccugcuuaaaggcauagggagggauggcaacugguacuuaaaguuuuuucuuucacgugcuuccuagacuguguaguuuguuuagaagugagaucgauguucuguaugucuauguaguuguuguuuuaaaaugaaccuagauugaucagauccaagaaaaauucuagucaguuuauacagugcaugugcuccaagacaugcuguccccagccuacugugagacaagugcagguaaauucccucuguccaugugaacauccuccguguccacgagggauugcuuccaggaccuccaagagguccuguaucuauaccuacucgccuuuuacauaaaauggcauaguauuuacacauagccacauguuccuuugauuguugagaccaccuguagauuacguacaauaaauaaauuccuuacacgccauaaauguugcuuacaguguugcuuuacugcuguucaggaauaacaacaaaggcgucugucugcauaguagugguagcugcugcuucucaaacauuuucagucuuuuguuuguuuaaauccauguuuacaagugggagaaauaacuagaaauguauuuuuccacaacaugaaccuaauagaaauaaauauauugugcauagcaaagaauuauugacaaaugaguuguuuuuuuuuuaauauauuuuaguuucugaaguugauuguuucuuuaaguaacagauaggaugcuaaaccaaagagaaagaucagcaacuuggauuuauagucaggcccgguaacucugacuucagcuggcuauagauucuaguucccugcauaugaagcagcacuguuuaaacagugaccucccaaaucuguuccaacguuaaagucccgucaagcugauagacuucugcauuuggucaaaauggaguaacagagaauagcaaucgccauaccacccaaaacaguacaagaaacucagcaaacuauauaaaacagugguuuucaagaagggagacagaagaccacggcagacaggaagucuucuuauacaguaacucagguaaacauuugauagugccuuucuaauccauauucuuuuuuuaacuuuagggucuugccuacuugcauacuaaaggcaaaaugcauagagauaucaaaguaaguucacuuaauauauuuaaauugcuguauuuugaaagaaauuguauguuguuaauuaacagcaucugugcuuucauuuuagggugcaaauaucuuauuaacagaccauggugauguaaaauuagguaugcuuuuuugaguucuuaauuuuuuuuuuuuuuuuugguuuuucgagacaggguuucucuguauagcccuggcuguccuggaccucacuuuguagaccaggcuggccucgaacucagaaauccgccugccucugccucccgagugcugggauuaaaggcgugcgccaccacgcccggcgaguucuuaauuuuuuaaccaagaaaauuaaaugauauuuaaguuugaauagguuuauuuuuauauauaaucauaauaauaauuaccugagauaccuauuuuauuccuaaaagagaaaaaucuacugaacuugagaaaaucuuauaggugaagaaagucauauucauagcccuauuauuuauguagaaacauaaaaacccauugaauacuuuucagcaaaucaugaauauuuaaugaaaauauauaagucagguauuuuaaauggcagcaaugaacuaaauaguguguuuaauuuuuauuacugucuuaguuaggauuucauugcugugcagagaaccaugacaaggcaacucuuacaaaggacaacauuuaauuggggcuggcuuacagguucagagguccaguccauuaucaucaaggcaggaacauggcaaacaagggccuggaggagccaaaaguucuacaucuugauccaaaggcagacaggagaagacgggcuccugcagggcuagugugagggucucaaagcccacccccacagugacauaccuccuccaacaaggccacaccuacuaauagugucacuuccugggccaagcguauucaagccuccacaguuacuguguuuaaacacaaauacagaauuucaugugcauaggaaaauguucuaaaaaguagugacagagucugaaccuugugcuguucagaguuagaggagcucaggggcggguuuucugcauguucuuagcuuucccauuuuuccccaaauuaacuucauugugcuuguaauuaaaauaauuuaauuagccuaaugcaagacauuuuuccuucuaggagaauuuuaagaaauuuucuuuuaaugaauauguuaugaaccaaguaaggacagaucuuaguacuaacguuaugcacagcucuuguaaaauaucagggaugcuguguccagggugaagcuuaaaagugcuaguugugucaaaaagaacucuaccaacuuuuuacucuguucuguucuuuucccucgccagcugauuuugguguggcugcaaaaauuacagcuaccauugcaaagaggaaguccuucaucggcaccccuuacuggugaggccuuacugccaucguccuucuagcuucguuucuucacgcuuugcacugaacccuaguucuugucucugaacuuuuuauugauucucucugaguuucacagacugcacgcagcacuaauuaucuccccgucccgucagaucugccuugagcccaugcaagcaaacgaccaaacaaagcacagaaaacaugucaucguggaagcuguaguugucacagugugucccacaguacauaucucuguccacauggucaccugcaaaucugaucccuaauucuugauaaugcaaaugaccaucaaaggccaagaggcucgugagcugcuucauacuuuccucgguuugacugcacuagggagccuugcuuugucagcaucuagcaugaugagggcccggguagaauauggaguuuaaaaagaaagacuucuguuaccucuucuaauuuccuguuuuaaucaaggacuauacucccgguuguuuaaaaccuacacaucuuacacuaguguccugcagugugugguguagccuacuggugacuaccagaguaauuuuucuaaaacacugccauccuuauugaggguaaucuggucuaugagacccugacucaaaaaagaaaaggcaacagaaucgcuuaauauuuaaaauaguguaaugaauacuauagcaggcaacauucaaaguuuguguuaaauguuggguuuguuugauuaugguguuuggauaauuuauuauuuugaaaauaauuuaaaguaguucuauacuucauaaauaaugccaaaacaaauaagggucugggagagcuaguuccaugauuaauagcacuagaugcucuuccagaggacagaguuaaauauagacguaaaccagggcugagcagagcgccacacucugggaugcagggcagccucugcgagugugagaccagccgggcuacagauaagucccaagccagccagcauuacauaguaagacccugucucaaaaauaaaauaaaauaaaauaaagcuuaaaaaaccaaugagcuggguuguagauguagcucaguuuguagaguccuucgccagaaugcauggucucucucaccacagaaacucgggguggagacacgcacauuuuuccugcacuuggauguguaggagaauuuuaaguucauccuccacuccaagcaaguucaagaccagccugggguauacgagacucaggaaaaagaagacgacagaggacagcaaagaccacaagaggaggcucaaagccuuugcuggcaucaaaguuuaaagggaaagauuguucccaucacgugacaguguaaagcuuuaugccugccagcugggacaaaaaucaaaagccaagugaaauacaggaaggacgggcugaauuugacuaaaguguuuaaaucucaaauaugcugcuaaaaagggugucucgagcagcaguuauuauaguaacacaugcaagaaaucauaaaauauuagaaauguucucccauaaacauaagcacagauaaauuacuuucuuuucagucaaauuggaauacguggacucacugaguaacccccaucacuacauauauuacagggaaagucaguagagggccuuuucaguaaggcuuucaagagccucugacggucuccguguccuuuagucucagcauauuuacuaguggugauuuaucgcaggcuugugcauuuuuauaugcaaagugcuuuccagggauacuucaauauugagacucaagagaaaagaguggcucaaguaagcuaaggaaaauuuaccugucaguucagaggcguguaaugagguguaaaaaggauguugucuaagaugaguuguuagcagucaggcugagauggacaagauuuuuaaauuagcacaugccccuagagagcagccuuagagauaaucugccuguaaguaaagcauagauaggaauaugcgagacaguagcuguauuugauugaggucacugcuuguuuucuuucauauuuuuccuaaauucauaauuuucuccagcuaaccaccuuuaauaacagaagaauaccuaagagguaucauuuaaauaaaaguucaauggaaauauagauaaaucuuuccuggaucuuuccugugcucaccuuaaguucugcugcugcucagaggugcacacaccaccuccaugggguugaccaagcuaagcucaggacccuccagaguuagcaagcacagucagucaggugccacuccaguuagcuacacaacguccaguggguagaggaaucgaggguauuugcugaccacugggccccacucaguccccucugagucucuacuggccauuggucaucuggcucaagggaaauuguugucuucucuuuuucggaugcccaugacugucauauagcauugcauagguacagacauuuccguguuaguauuucuaacagucacauuuugaaggguugcaaguguagcucaacagcuggcaccuggcuaucaugcucagaucccuggguucaauccccagcacagcaagaaagaaguuuaguauaaauauuaugugcuuacuuuaaaacacauggacuguguuccaccuuuaaguugagauaccuuaaguauuucaacaaauguagguuauaauguuuugugcauguaaaagcaauaguaacugggguauccaguauaacuauauauuccccgaggccagugucgccuacaccuuuuaugcucaguguguuuugagggguuuuuguuugguuggguuugugugugugugugugugugugugugugugugugugugugugugugugcgcgcacgcagggauagagggugguaauuauugagacaugaucuucuauguggcucugguugcccuggaacucaagauaacucgugcuucagccucccaggggcugcaguuacaucucugccugccugguuucaccuccucucucugagcuucaccuugcugugaguuuuagauuaaguugccuccauaauuaagucuuucaguggguccacgccauuuucacgagaaguucugaauuuacuuguauaaaagucgacuguucauaucuagacucuaccuuggcagucugucugggauguacuuuccaggcccucuaagcccucaguugggaaguuuuguuuuuguuuuuaauuuuagaccauuuuuacauuuuuguaaaauaaaaugaauuacuaaaacauagcaauguguuuugccaagagaaaguucuucuguuucuguacucaucccaaacaauaacaggccguguauggcuccuucccagggccuaagucccccguccccaucuggagccuccuuacgguagcucagcuuccugcugacucccuccuaagguucaccuccucugggaacuuugccugcacggguguuuaguaguccuuuacaauuucaccaccgcagacuggagucaaaccguagugcucuuggagcacacgauucggaagaggaagugagggcuuuuaaauagggaauuuuacuuauuuuuuuauuucuuaagguuuuuuguuguucuucccccccuccccccccccccguguguguguguguagguaucuugccugcauguauguaugcccacagaggucagaagauccccuguaggagaaguguugaugagccccugugcacccagcgcucgugaccacugagcggguguggggcagggugauaagguuucuuuccuucuuucugucuaugagcauaacuaagaguagcauauuuucuaggauggcuccagaaguugcagcaguggaaaagaaugguggcuacaaccaacucugugauaucugggccgucggaauaacagcaaucgagcugggagaacugcagccgccuauguuugaccugcauccaaugagguguugucauuacucacaucacuuugggaagaugaaguacugauuacucgggguuauuagcucauuuucaccuguaucacacuagcaaaaguacuguaaggggcucagaaauaaugucauaaaccugcucgggggucugcggugaugccucacugugcacacaauuauagaccuaggcuuagcacccuuauaaaagcugggcgugacaccacguaccugaacucacgugcuggggugucagggauaggcagaucccccggaguuuuacugggcagccuuucuagacaaaacaaagcuccggguuccaugugagacccugucccccaaaagaagauggagaacaguaaaggaagacagcccucugcacacaugcacagggcaagcagacucucauacauuguacacaugugaaagguaaacacugcacacaugugcgggggugaacauucacacacauacacugcacauauauucaggggcaaguugaccuuucucucuuaaaggugaauucauagaguacucuuauagguuagcuuguaaaccggagacaucaggaaauggauaugauuugucagaaucauagaugccaggcuuugcuuaaaccuauaacuuaauuuuaaaggaacaugucagugcuguguaauaagcuaaggcacaauuauguaaauaugccugcaauauaguaugaguuauguagguacaugugguaaugaaacugacauuuuaugucuuuguuuuauaaauaagggccuguuugacauuuaaagaucuuuuuuaaagcuagcagaaguauuccagaaccuucccaaaacacaaaaaaagcuaaggacugaggcacaucccagcaguagaggugcuugucuggcuaguacaaaguccaggacuugaccccgugucaucagaaaacaaaacacaaauauuaaaaaauuccauauccuagcuggagagauggcucagugguuaagggcacugacuacucucccagagguccugaguucaauuccaagcaaccacaugguggcucacaacugucuauaaugggauccuaugcccccuucugaugugucugaagacagcuacaguguacucauauaaauaaaaauaaauaaaucuuuuuuuuuaaauuccauguccaaagcaaugucuucagugccuuuccaugagggagucuuacacaaauuuacaacugaauauucauccuggcugucgguugcaacgaugaaguaucuuaguauugccuuuaacugaaauuucuguuucagggcucucuucuuaaugucaaaaaguaauuuccagccuccaaagcuaaaggacaaaacuaaauggugaguuacagauuacacagugcugaagauccggcagucaguucaguacguucuagaugaccacuccagggcuugcaggcguugagccgcauaccccauuggugcaugacuguccgucccucugugagcauguggcaaggagccagguuuauauucuagacaucccugucauucccaagcagccacuuuccacugugcugcugucugggugaaagaaacgugcugaggaagggacuagaugugaauaugugaagguuuggaaagugcgcgugaugagacaguccauacugggagauuccagauucgaguagacucugaagggcauuauguguuauaaccugaggggaacagcuucgucuaugagcaaggucaucuuagggugguggcaagaaugacgggcaagccacgcaguaguaugccuuucugugcugacacuggccccaagcuccuagcguuuuagaacuagaggacuuugugacaagaaugccuuaauauccacucagaaacaguaaauacuguauaccaacagugaguucauggucagauuccagagacacugguaacaucagagacucccgaccagucuccugccguuucucgagugucacuuacaagucaccacaggcagaacagugaggcaucucuccgcugagaugugcuguguugucuuggccgguuacuauggcaaccuccuugguucuuaagcuauuuuccccugguggaaucuugacgcugucagaaagaagccuguuuguuauuaguaaugaaaauagaauucuuucucuuuucuuucuucuuuuuuuaaauuuauuuguauguauguauguauguauguauuuauuuauuuuuugcuucucccucucccugcuucaucaaugcagguagcagggacaucuuuuugguugcuaaaaucauucauuuuucuuugcccuuucauuaugaauuccagaaauucuuuuagaauuuaaauugucuuguauuagucucucuacucuccauguaaucuaacucaguauggaaaucaaaagcacucuguaaauuaaacaauaagaaaagggcauuuggcuuuuacagcaccuugaaagagaaccuuaaaccaugcauucgacauggccugccgccuucugucuguagagcgguguuugaaguuaccuguuccuguugcuguuuaauuacacaguacuuagacaaaacagcugcacaaauguacaagggcagacugugguccauguugagguuuuggccuaaguaagaggaacuaagaggccuaaggaaaaaggggacuuuguuucucacuuucuaacuauuccuaaguugauuuuauauacuaacggcagaaaacuaauacaagugaaauauuuuuauacugucucuuuuuauuugaaggucaucgacauuccauaauuuugucaaaauagcacuaacuaaaaaccccaagaaaagaccaacugcugaaaggcuucugacuguaagucacuggaucccaggguucugaggcucccggcagcuacgugugucacuaaaacaaaaguagacauuguaaaacuuggguuguuauuccucucagggaugaaugcaggcaucaaccaacguucuuucuguaagggacaagacucuacauauuucuaucugcauaaauauuuauggucuguacaguuucuaucacaacuauucaguuugacacaaaaguacccauagacaguauacauacauaggcauaguuuuaacccccaagaaaacuuuauuuacaaaaguagucaggacaccagauuuugcugaggcuacauuuugagaauacucuucaaaaucuuaucaucuaagauuaguugcuuucuuaauuuaugcaaauguauaauauauucuacauguauauguaauguacaguaaccuaagaaaacucuacgauuuaacugaauugaauggaugugacuauauaacaugcuuuuucuuacuguuuugaaacaucccacuguauuuauuuguauaccaggauaauauauaaaugagcaucauuguuuagcugguuauaauuuacagcauaauauagauuaacuguacauagagaagugauucacauuguccucucacaccacaaguguccgauguggucauagguggucauaggcuaucaaucauaggugcucacagugaucauaggcaauugaugccuccacuucugcacuccccaugucucaaugcagacuccccugcucaucucuucuuacaaguuacugacuuaaaaaucacaaguaacguuuuuuuuaacuauaggugugaaggcucauuugugaaauguuacuguguuugauuuuuacuuagcacacuuuuguugggcagccaggccugucucgggcgcucgcgguugagcuguuggacaaggugagcaauccggacaaccaugcucccuacagugagggcgaugaggacgacuuggagguaagagcaggagaccggcgaaggcuuggggagguuuugagauuuuuaacguguauucucuuuauuucagugauucauuuaauguugacuuuauagacaagguaucauaggauacagcuuggccuggaucaauauguugaucaggcuaacuccgaguucucggguauccuuucucagccucccaagcgcuaggguuacugguaugaaccacuacacccaauugaggguuuauuuucuaauuuacaccucaauuuaguuaaaaugggugaagccacaaaaauuaacaauguaaacucuguauacaugcucacuuaauuauagccuucgaaggcuuuccuacuccuguucuccucgcaguucugagguccuccuccuccccccacacacgcaggccuagaauuccagaggugccuucuuccagaccucagcuuguagugagaugugaucuuccaaagaacguauagaaaugacauuuguugccuaggaaauagagagaggcuuuaagaaucucacuuuggaacaagaaggaaagguuuaggugcaacauauaggcauauacguuuucauaagagagacuccuuauaaauggaguuggucauuuuuaauuuucccauuuaugcauauuaacacaauauagguaauucuaaaggaguaaguugaaauccucagugggguauucuuacauaauugcauguagcuauucuauuacuauacauaucuccucugaaaauaugaugggauuauuuugaguuuaccauauguaguagcucaacauguaaauuaggaauaagggacuuucccgcucauugccuguaccacuguucugugcaagugcuuaauaaauauaaucuuuauagaaucuuuaaaagacaaucuguguucccccccaaugcuucauauaauuuaauccuguuauauaauuuuugauauuaaauuaucuagaauugcaaacauuaaauaagccaaccacacauaaauuuccuacacacacuuaguucacuauucacagccuaagauuaauaaagcuuggguaggcaaggugucuggguuacuaaagguacuuacuacucagguuaacugagguuaggaaagguacuuacuacucagguuaacugagguuaggaaagguacuuacuacucagguuaacugagguuaggaaagguacuuacuacucagguuaaccgaguuuaggaaagguacuuacuacugagcuugauaaucugagaccugagacugauuccagauaaucacguagugaaaugagaaacugacucccacgaguccuuuagaucuccacauguguacaugaauacauacacauaauaaauauaauucuuuuuaaaaaauaagauucaugaaauuuuauggcgggcauauucacauucguaaguaaagauacaaaccccugggcuucccuccuucugccuacuuacugaguccuuuuuggguguuuguuuguuuguuuguuagcaauaugccguucuuuucaguccuugaaacacagaacuuuccaucauauccugggcauggugaugugagacugacccugucccugcguucagagauaggguuacucucaaagggaaugcagaaacaccaacacaaaacugauagaacugauaauuccuauggaguaggaaauauagggcacugugagggaauaccauagguauggcaggaaagagacaaaagccugaaggaagacuaagaaauuagaaagagcaagaauaagguuuggggguugauuaauuauuagguagguagguugguugguugguuuuguuuuuucagauuuauuuuaucauuuuaaggguacaaguguuuugcccagaugaggguggcagaucuaggagaguuacagacacucaugagcuaucacaugggugcugggaauugaacucagaugcucugcagccaguguccuuaacuacugagccaacucuccaguccaauaauaaauaauuccaguagaggaaaucauagcauguuuugaaagccugauaguaauagagaaaguauaacuacuuggggaacuaaagaaaacucagucuggcuggaguaggacauaaagcuacauacugucucuccaaucaugcaaggcuguggacuacggccugcuaaagagcuggcuaccaggggaguaggauagaguugauagccacuucagaauccccagaaucaccgccagggauuuccugacagaaacaugagcaaaaucaaguauggggagaaggaugcguuuccuuuaauacugaacaacuuccauauggagaggucuagucaggaguuagauguugguuguaggggaagaauuuggccuauauaaacgugagucacaggagauugcuuacaauuuuagacugucagauucacacuagauagagagaucagauaccaaugaugaguaagagcaucauggauccaugaagcugguauucaaguaggaacauugagccacugugauggaaguaagagaacaggcucaaaaaccagauggguugggaauauaguguggagaugcugagggcccaggagggaccuuuggggguggaauacaccagcuaugugacagugucuggaauauacuguggagcugcugagggcccaggagggaccuuuggggguggaauacaccagcuaucugacagugucuuacacccaguuuugugccucacuccagcugucgagaucuuuuggcacaggagugaaccuuggaauggagaaggaaaagcugagccaucaggaacugaugagcuucagaaauuugguagcuaagagcugaacuggaggcauagccucagacgagccugagcuuaugcuaagagggagaaguagauuacucauuuaguuuauaauauucauucuuuaagugcauaucagcuuuuggugguuguuguuguugcugccuacauguaugucuguguaucacaugugugccuggugccuauggagaccagaaggggcauuagguccuuuguaagagcagucacagaugguuaugagcuagcugccuugugggugcugcaaaaucagccggguccucuagaagagccccagguacucuacccauggcuuaaaauacucuuaaucugucuuuagccagcauuuccccuaauacugcacccuuauacaccugcaaaauuuccccuuaaagcugucccuggugcuggcacgcccuucaguaaagucuccaaacccuuccuucuguucaacaagugaaaacugaguugucgucugaauuucaaggccuuugggaucugacuuaccgucugucacacagcuuccucauccuaccuaauuucagugcugucaaguaauuaccaaccgcacuuccugcaagugccccugucgugcaucaugugaucacguucugugucuggugcaucuccaaauacugcacagccgacgccugcuguaucucaggccccaaguagagugcaagcagagucucugugcucuucaagcggguacacagggacggcucccugugcaggcuuuaguagugauucuuuucuuaauuacugacgggugucuaacucugaacauguuuguauccuuugucuuccuggacugaacucuggaggcaagguuugucugacuuugaaucccuucaaaguuuuccacagcuuugggaauauaaacugggauauucagugggauaacugaauacacguguacagcaucuacuguucauuguguugcugcuguuuuucuuagaaauguuuuaguagauauuuauaguugucaauaagcaauaguugucaguaagcaauuuuaaaagaaaguuuaaaccucuuauuuguuguugaaauuuuuaagaguguauguuaugcuuauauucacagccccacgcaaucauucgucauaccauuagaucaacaaacaggaauuccagagcggagcggacagcuucagaaauaaacuguacgugccugcuguacauuuuuuauuggugguauuggagguugaucuggguauucuuauguuuuggagaaugauaaaaucuuagacuaguugaggcuauauacuuuguuucagaauauauuaaaaauauagguugcuuuucuaguuuuccuggaauuauguugguuauuguuuuuaaauuguuuuuauuuuuaauuaugaagauaauugugcccguugcugguaguuuacaagaaauaagaaauagagaauuuacauggcccagugucacauaucccauagccaucccacuguuaauacuuucugacuuccugcuuucccauuaauauuucauguggcuaacaauauacuuuuacauuauagagagacauuuucuguuuucugguacuggcuuuauaacuccacacaguuauaaaccuguguugcaguuugagcuauguauguuucauacuguaaagauggucuucuauugguguuuagguggguuuuaaauauuuuagaucaaugugaagaugacucuuuacaaauauuuaaaguagaauuuuuauuuccuuuuaauuuaaugaguuauaaacauucaaaaauuuuacaaucaacugccuuugucuccucagcugcauuuaaaauaaauuagaaguucuaaaggccuuggugaugguaucacauaccuuugauuccaacacuuaggaggcugggacaggcagaucucuacuaugaguucgaggccagccugaucuacagagugaguucccagacagccagagcuacacagagaaacccugccuuuaaaaaaaaaaugcuuguauaugauuuccugacuuagacauguauuuguuucaagauuucuuuccuuauaaaaugaaaugcaugccuaacaauacaaauauauuuuuauccauaaugagauaagaugguucauuaaguauucgaaccaauuagaaaucuuacagauaaguauuaaaucaaucgcugugugcauuuuguuuuauuuuuauuuuuuggaagguggcugcguuacccaggccagguucaacucagugacuucucuuccuuggucccuggaguucugagucuguagaguuuaccaccuccccaccccacccccagcuuaaguucauccauuuucuuuaaaccaaguguuccuggcucuuuaaaagaaugccuucucuuacccguugcuaaagaggaugugacguaaauaagccaguaauaccucuagacucaaugucuucguuguugcuguugcccagcuugcugucuucuugccaaaauuaucaguuuguuaugugccugcugagccaucuugccagagccuugcugcuucuuaugcaaaguuuugugguuccggauaccaaagauguccuucuuugacauaacuguauuuaucuuguguagcuauauaaugugcuauuaauguugccugguuugucuuguauuuauagccuuuguacuucgugugauauucuuuguuuuaauuuacucauauuuuauugugugaaugagugcugugcuugcauuguagguacagcaugaguguaacuggugccuaagagaucagaagagaguauuggauccccugaaucuggaguuagggaugguugugagccaccguaugggugccaggagccaaaucuauguccuacgcaagaguagcaaaugaucuuaaucacugagccauuucgucagccccuuacgguauauucuugauuucaaaacugcaaaaagcauguugugugguguguuguaguuugcaauccgcuuucuagauacuuacccuguugacaugaagcugggaguaaaacguggaccagcuucaguggggucaacugcuucagcccuuuuuggcucaaugccauuuguuaaaacuugugaucucuuuguucauggauugaagauaccaucuuuauuguaguacuaaaucccccugcuuaugguaagugcagcacacuugugaguguuaccucugcuaaagucuugucggggcugucucuucuccuccugcuucucgucauccacuguccaggugcacacauuguuguucuucuuuuagcuguaucugaugguuauauaaauaaauguuagagucuuguuaucugauuuuaaaauauauuuucacugaugugugacugaauuauauauugauagaguuggcaacuuuaugaugcucaaucuuaacuacagagccuccuuuggggggaguuguucuguuuuuuggagauagccaaaagauuuagguuuuccaugagugcgcagggugcuuauauuuucauagaguaugccuuagaaguaggaaucgcuacugaugauuuucuucugucuucacguuuaaacacuuacaauuuuagagacacuggaauguuuuauggcucuguucuugcuugcucaauagauuucaguucuauucuggcuuuugcuucaguuuuuuaaguugagcugguaacuuacauauaguaaaugaucaaaucuuaaauguuacacaugguaaaauuuaaauauacauccacgcauguggacugcccacagcucacugugcagaaccuugcugcagucucgcccauguggacugcccauggcucacugcagaaccucgucacagucucagacuucaucaugcucugucacucaguacccuuccauugucuacccccacccugaauccagauuaaucaauauucugaucccugucacauagguuccuuuugagcugcucuugaauuuuagacaaauagcuuaacacaguggaccccuuacuucagccauaucugugagaggcguccacaccauuguguaggaauacagacaagugaaagcuuucugaguauacuacaacacacccaucuucuagugacuuuguauuguauuaugaucacucuguguauuccuucuauauauuuuuaguagacaugaaugacuuuugagccugguuguugauauagcagagucugaggcaaacaaaggaagaaagauuuguuuuggcucuugacgcuaauguuucugggccuguacugaggcaggacagucuaacugagguucaucauggaagaaagcuguuaaucacaugggaugagaaaucagagaaaguaagaugagcuggccugagacaaugcacaguccccaaagacccaccacugucaguuaggccccaccucuuaucucugucaucucccagaauccuuuccauuuauaacucaaccuugaauuaauccauucugagaacacggcccugugagcccaucagcuggcaaccagccuuagcacauggauuuucaugacauuucacauugaaaccuuaaccauccugugcuaaacugaccagggauaaagaaauaguccaacaaguuucuauucauuuauuccuuguagugguauaaaacguaccguaaaacgcacgcggcaucacagcuaaugaagcaguagaggaggaggaguagaauaggacugagugacucagagggaagcagcguguguggcagcggagcucugggucugccguggaaguagacugacgccuccugcagcuaggcgcugugcuugggagugccuucauuugaagcugggugucugcauugcauuugagucagugacuuagaucuuccagacaugauacagugauucacuguaaugagcaagacuuuacccaggaggcuccugaccgucugacuuaaagagcgguuucucagagggccguggagcucagagagagcacucauuacaugaaaugagacacaugcagaauauccuugggagaaaucauguuccuuccggccuuugcauuuggauuuguguuuguccucccagaugucaaauaccaggaaagguccccgcccccucucucugaccaagagauagucauauuaguagugugacacacaaccucagaauucacaaguuugaggcaaaaggaugacaaggauucagggccagccaggaugacuuggugaaacgcuugcccuuuuuuugguuugguuugguuugguuugguuugguuugguuugguuugguuugguuugguuugguuugguuuugaagacaaguugaguagacuuuacaagcucguuacauguccacagacuaaaguguuuucuuuuauuuccuuugccugaaugacagugaagccuauuaaacuuccaucaggaaaugcugccccuggcucaaguuucugcaucuaucacaggcacauagcuaagcugcauuuagcauauccaauuuuacaugaugggacucggguucucuugucugccuggaggucacuaagcuccuuagguguacggauggauccaugguuuucaucaaguuuggcugcuguuccuuugaaaugucugauggucucugcucugcacaaguguuagucuuguguuaagugugaacacacugauuucauagaugacugcagcuuuguccuuucgucaugccuucacauccacacaugacaggaacuuguuccuguguccacucugcuuuuaagccguucagugagcuuuaugucagguacaguaguuuucauacguaaauuuuagucaugcgcagauuacauguguacauauaaacacauacuuagacauauaauuucaguuucugugcugagauugucugcucacgcauugucucucucuuaaguccucuuaugauacgucuuuaaaguuccugucuguugaucaccuguauggccuuugucuguuucuuccuuucuucagcugucuuuaauuccuguuuucuaccuucaacuccauccagaacuuuuaauuuguguuuguuuguuuguuugcaucuugggcaaccuaacagcauacuaagcaucugagucuuggccucuuccuuugaagaaugaguuaccuggcggccagcugacucguuuaaggccccauccuguuucucugacuguuuauacgagguucuucugggcagaaucucagaugucugcccuaaugcugcaggcugucccuugcuuccagcgcuaucuucuagcuguacacagcugccuagaacuccaauuccaguggaucccuaaggucaccagacacucuugugagcaccauauauaccuggaggcaaaacacugauacacauaaaacaaauaucucuuuuucuaaaauauuucuagguuauguuaacuguuauuaaugaauaguggcuuuuauuuuagauuauuguuuuaaguagaugacauuuuaugaaauaucuuccucucuugggccaaaaauuuuaagcuagacaugguuguacacacuuguuaucccaccgaacacuaaagagucuaaggcggaaggaagacccagaguuggaagccagccgaagcuguacauagugaauaucaggccagccuggguuauguggcagccauuaaaaaaauaaaaugaagaaggggggcggggagggaagcuuaugauuuacuauuuggcuccauaaaacuaauuauguuagugguuuguauugaagauaaauacaacuagcucuuauuugaaagccuuucagcagugagcuaagauuguauuuauauauuauauguauauauguguaaauguugaaaaagcaacuuuggccuuuuaaucacaucaauuucuuaaauuucuucaaaauuauaauagcguaccccuagagcucgugugucuagcugcauauguagcagaagauggccuagucggccaucauugggaagagaggccccuuggucuugcaaacuuuauacgccccaguacaggagaaugccagggccaagaagugggaguggguggguaggggagcagggcagguggaggguauaggggacuuucgggauagcauuugaaauguaaaugaagaaaauaucuaauaaaaaauuuuuuuaaauuauaauagcuuuagguaggcaaugaaaacuuuucucuauucuagacuauuucaccuaaaagaaauugcucuuugaaucugugggauaaaucugaaaguagucuaacaugaucaaauaacauguaggaagaaugcggccauagaugaggagcgccauucugaccacuccuugguucuccuuagaugaucugcgcagaacguugcuagguuuucuccaccacagcgcuguucccuaaucuccaaacagcaucugugaucuuugaagcuuuuuuuuucuuuuuucuuuuuggucaccuacuuccaauaaaaaguacaaagguacuuuuuaaauuuccuacuuucagccaagaauuaagccuagaagauaggggaaaucucugauuguuccuuuaucugggugaguagaaagguguugugugggaggaauaagagaguuuuucuucucugccuccucaguggcagccguucucaucucauccccuaaguuaacugcauaagaugacaacuuuuaugaauauguauuuuuguacacuuauauaucuguucuauauuuugcaguugacaaauuacaauuugaaccuccucugagaaaagaaacagaagcccgggaugaaaugguaauugugacuuuaaaccguuuucauguuuaagauaacuuagaaugagauauaugucaagaaguaaagucguauacauauuaacuucacuaaucuagcucacacucugcagugugagaaaugaugacuaggcacuuugaugguacuacgggcugugucguuugacccacucaccuggguacucccaguuuuuugaaggacgcacauggauuacugaacuccgacugggacucagcccguaacucuuuuacuugcugguucucuugaguuuucaguaagcauauuuuugcauugcuuuacuguucaucugugggguugggcacauggcuguuaguggaacacuuguuguggguucuagcgucugucuguuacuauagcuucauuggcauugucugugguuugggaggggacucgugauguagcccaggcugcccaccgauugcugcaguccuccuccuucagcugccuagugcugcgguggcaggcauaugucaucacaccaaagugacaccacuuugagauuaacuauauauuuaauccuuuauauauaggaauagguaaauaugauauuguuaagauuggccuagaagguuccuuaaugucuaauuuuuguuguucuuguuuuguuuuuuagucaauacaaguacaguuucuggauuuuaauggcauucuuauugcuuguuucuguaugcaucagcauuuuccauauacauuuaaugaauuauuuaauugucuuggccgauggcauaguuaugcaaauaaucaaaauuuuuguggguuauuuuguuuugucuuuacuugucagauugaaagcuauauuuaguagaugcaaggaaguucuuaaguuuacaucagaugauaauuagucauugaucuaaauguaucaaaugacagaacaaauuguggaggcauaaaaccgauuagaugcugugguaacaagcggccacaacauccagguuuuucuugaagcagauuauuugucugauguguaauuagugaaucggaagggugauauuaaugugugaaaguaacacucuaaacugugaccugcacagggauuaucaucagagccaaacuuuauauuacauuggaauccuuuuguggauggagcaaauacaggcagguaaggugcuuucuaauucauaacuugauuaugugaacaguucugauggagauuugucuuaaaguuaccaguguagagcucugacuuacauuauugacaaaaaugucaugaaaaugucuuaaagggucucuguuguaugggggagggguuguuuucuucuauuuuuuuuuuguuuguuuuguuuuguuuuucaauuguuugcuuugcaacaggacauguuauauagcccuggcuugccuagcacuuccuaguuaggccacguuggccucgaacuugcaggcaucugccaccauuccuggcauggcuuuugguuuagucugaauauauuguguguaaugaugauguauuagcagaugucaugggaaaauaaugcuguagugguggucaggaacccacauucuguuucucuaauguaguuucuucguauucuagaccugucuuuauucaacagugagugauuugagggccuggccucaaugaaucacugaauuguuuacauguuugugcauuucaguuaccuggagaauucauugaaaauguagacuucuggguccccgcauuaggcaaauagagcugagguuggcaaacuguacccugugggucagagcuagcugcuguccauucauuaauaguauuugguagagagauggcucagcaguuaagagcacuugcucucugcccaccacaccccccaaugaccuggguucacuuccuagcaccacauuaggcagcuugcaacuuccuauagcuccauuuucagaaaagccaaugcccucuucuggcuucuguaagcaauugugcacauaugguguguguguauacauauguguuuguauguguauauauauacaugugcauacauacacauaaaauuaauaaauaaaguuuaaguuaaaaagggauauuggaauggauaaaaauaaaagaaugaaauuuuguuauggaaagauugcauuaaaucaaugucagugucagucaagauuuauuaggacacaaccauagcaaccacuuuauguaccguuuauaacugcuuucaccuuauauugguagagcugugacugcuguaugccaucucaagugcauaauaguucagaucuggccccuuacaaaaaguuugccacccccugccagcagucuuagugaacgggaucuaaagaccccggcagcuucccacuucacugaaagguucuggagaaguguacgugacauugagcagugucacugucucucaccuggagcucuuaagcugcagguucugacgcugugggucuuccaaguguucauuugucagcggucucaggggccucccuugacuaacaaaggguuaaucaugcaggcacaugcauccaugggcuccagaauucugaguuucauuguuggcuguuuuguucucgugugcuuuuauuuucauucggcuguuguugacauuugguuuuugguuuaaaggcaggaucucauauagcccaggcugcccuugaaccgcuagucuaccuugccucugccaucuugaugcuaggauuaaaggcauugugcuucauacuccaccuuuggugggagggaguuugauuuuaauuuuuuauaaaugcauaaccugacuuuguccacuuuucauuaguucagauccuuuagggauacagugugacauggauucuguauacauguuagcaaaaagguagcuuagaguguggcaugcaccauguuccugcccccacgcacgugagucaccucucccaggucacccagacucugucggguugccaccaggccucccugagcuguucuuugauuuaccaaucagugcaucucuugucaaaguaaaauuccacuucaucucaagcaccagccccucggguuauaagaggagucuacauguucccuuauuucugcaacccugcuuauugccagcaaagggccuuacagcaucaccuuccagacacauacuugccuuucagaagaucuguuccaagcaggucuccacaggcuccaggagaguggcggguuaguuuguuuguucuguugcugggaaacaaaaccagagcccugaccacacuaacccugugcuugccccugagcuacacccaaagcuuggauuuacaucucuaauaagcuuaaucuaauguaaauuacacauuuaguacagcagaauagaacugaaaaagacuuuguaccucuuuacugcugcuauucugauagaaacugagaaugugaggucagaggucgccaucacugucugucucucaggcuuagggauggaagccucucagugcauaugugauaaugcaugugugcguaugugauagguaugugucaucuguguuccagccauaugugaccaucuaaacugugcuuuuccuuugauuagaucaaccucuaagcgugcaauaccaccuccgcuaccuccuaagguaagcuguugagggguuuugaacaauaacuccuuuauauaauuacauuuuaaaaauaauuucauuggcucuguucagguuuugaaguuuauuaauuuucuuuagaaggaggagauagaaaguacauuacaaaggugauuuuaugugaaauaauauacuuuaauagaugcgagaaagaaauaggguuuuacucauuuggaauaguaucugacugcauagaaggagauacaaaguuuauuugucaucaccauuuauuacuauaauuugauauuucaauccaacuguucuucauuaagucaucaucuuugucaguuucuacuuguuaaauauauggcaacugcuuacauaauuuuauugguuauaaaaguuuuaugauuucggguugggacacauuuuaaaacccucauguuaaauucauaguugugcugggcagugacucacuuggguuccuugcugaaggucacugugaccuuuuaaagagcacuuuuuacccucucaucaucagccgagggucaacacuuacccugaagacagccucccagaugaagaaaaaucaucaaccaucaaacguugcccugaucuggaggcgagagcaccucagguccucagaagacagaguagcccaaguuguguuccuguggcggagacauccuccucuauagguaacgaccagcaucccagcauuccuggaguacaccgcaucccagauccugugaccuagagagucaggcagaugggauggaaagccauucucuuccuggaucuaagacuaucucuuuucuucagucaguccuuuugcaguucagaccuucauuucuauguuuuaauuaugcacaaguggacuguaaaagauucagaccauuuccaccucacucagccacuuaguacauauaggauucagaggaagaacccauguucuucccucugggagcuuagaagcuugacagaaguuaugcccauauacauauaacauuauaaaaggugacugugugugcuaaugcuugccugucacccaguacuccagggacagagaccagccuaaacaacauaguaaguaagacaggucucuguaauuaauuaaaaaaauuaauaugauguagggaagaaaggaacggcgggugugugguguuuccuaaaacaauaacuguacuuagcagagcccugacauuucugugagaggugaggauagagaauggguuauccggagagugcuaaagaguuugaggagcuuacaggagggagugcuguaaugucugcugugcuuaggcacaauccuggagaauaaggauugagcaaauacacuaucaucugaaccacguuugaagcaguccaacgugcugaaagacugguaucugagggaggacugagcguguagauugguuucuguugggaaagaugucaaguaccacugucaguaggauagauguucuuugugcucacaauguguuugucauaacugaagagccucacuaaggaugcagugaggacagcacuggggauaaauuaacucaucugacagaaaccaccgugcucccacacucaccccaaaggaagggaaauaauggggcaaagaaaaguuauuuuucacagaauguucuuugugugcucauucaacuuuaacggugguucccuuaggaaauggugaugguauuucaaaacugaucagugaaaauacagagggauccgcacaagcuccgcaguuaccucggaaaaaggacaagcgggacuuccccgugaguacagcggcugcucagacauuacuuacaacucguagcaaggauaagaacccaaguaacuaagguugagcaugguggugugagcuccaaaguuugcagucauggagaaaacacaaguacucuguuucuuuuauauguauaaagagauggcucagcugaugagagcacuaguugcuuuuccagaggaccuggguucgauucccauacccaccaugugacagcucucacccauuucagucccaggggaucugacaccuucuucaggccuccaugggcaccaggcacacacguggugcacauauagguacacacacacacacacacacacacacacacacacacaagcaaaacauccauauacauaaucuaaaaauaauuuuaaaucaaguauuauauauauaauaacugaaauaguaaguagcuuacauuuuauuuuaaaccuaagcuuucuuacaguauuaaaaauuaccaaaaaaaaaaauuacuuaauuuuuuuucccacagaaaccaaccaucaauggccuuccacccaccccaaaaguacugguaaggacuguuuucaugagaccuauuugcugaucuuuuuuuuuuuuuuuuaaucucuuuagaaacaguagaaguagauuuccugucaaguacauucagccacuaaaagaauuuuauaaauauaaaguuggaagauagauaugaguguacuguagucugaucacauaccccaauuugagugcagugguuaaaauuuagaggccaaguuggauguaauagcaggucuguauauaaucuuagcauucuguaaugcuaaggcagaaagaugauagauucaaagucagccuggcccacacagugaguuccagaugacaucugaguagucagauaucaaaggaggaggaggcagagcauaaggucaggggcggagagaggcaggagugaggaggggcagagagagaagaaaaagcaagaacaaaaagaaaaacaaacuugagaauuuauaaauucuggcuguggguucucagauuagcauccaaacaccagcuucauuuuaauuugacgguaaugcugggccuucuuccuuauguggcaaauaaaugucuuucugccugaagccguucucucaucgagcugugcacaauagaaaacaaaaggaagcuuggguucgcacuuacucugucaucuuauggcgcgaugugucugugagauguucuccuaaucaugucaacaggaugcuucaugagucaggcucugagucaguucauaccuaggauauaagcucggucuuuugucuguugccugcauuguagaauuacacugcaguucuuaccacugcagugaugcugaaggaaucaaauaugauuccacuuuaguaaaguuaguccugaaguaauaaccuaaaguucaugcagcucguuaaguauguagauguuugguaaacuugacacguugacucuaaaauggagagaaagggaagaccaugacuuuugggagaaaaaauuuaacuguguuaaaaaguuguauuuuguauugagguaaaaccacaaauuuucuucaaagaauuuggcauugcaugauuuucuagaaauaugaaaauuacauaaugaaauaagccaucuuucuuucuuuauaaagaugggagcauguuuuucaaaaguauuugauggcugcccuuugaaaauuaauugugcaacauccuggauacacccugauacaaaagguaugauuucugaauuauauauauguguauauaccuccuguaaaauauuuauuguagggaagaucuuuauaauuagugaauugaaguuguuaacuuuaaaauuaugguauaggaacccaugacaagcuaauuacuuagguaggcuucuguugaagaccauuaaaguugaacagugucuaggaacuguccugugaggaagcuaacaagcugucacagccauuguuuuuaaggacauugaaguccacaggcgggggacgguguugucucagucucagugcucugugcuguauaaaacuuguuagcaacaaaagaaacuaaaauauuuaggaguuaaagggauuuugugcucguagcuuggcuugggggcacaacugggcacgcauagggaagauguaauucuagccuagucugugguagacugggacaauaucacaaacaacaacaaaaaaaaaaucaggaaacuuauugauauuucuguuucaccgccuccaccauuuuaguuucuccaaucuaacauucaguuuaaaauuccacaucaguccuguuggauugauucauguguucguguucggaagauguaucugucacugugacucauucugacacuuugaucuucccaggauuuguagggaaugucgguggcuguguccuucagcauggggacagucccucacuucccuuucuguuucauacuuacuuuccucagaggacuccucucgcagaaacucugcuucuuucuagcaguaauauuuagaaaccaacaucugaacaagaaauauguucguuacuugugcuaugucauggauuauauuugcauuuuugaguauuugguauuuugacuugcagaaaugcaccacucuaacaacaguuuaaaauucaguugagagguagcaugacagugaagucuuacacagcauagauuuacauuuuaaaacaugggagagaaacaugggggcauaaauguuagaaaauuauugugaauguguagccaacucaugcuaaauaucacuacauauagcccuuaucugaguaaacaauuucaaaaaugauaauaaagucugguaacuugcuauuauagaucaguauauuauuuuuggaacugaagaugguauuuacacauugaaucucaaugagcuacaugaagcaacuauggaacagguaauaagaauuuuuuuuuaagaucaaagauuuauuuauuuaucauauaugaauacauugugguugucuucagacacaccagaagagggcaucagaucucauuacagauggcugugagccaccauguaguugcugggauuugaacucaggaccucuggaagagcagucagugcucuuaaccacugagccauuucuccagucccaagaauuuuaacuuaaagaauuaguuugagcaaauuggacaaaaguaucauaguuugaaaucuguuuguaugaucucuagucuuaauuuuuaugguuuaaauauuuaaagggguaagaugguacugucuucaugucgguguugauuuuguuuucacaaagaaaggauuuuauaccacuuguuuuguuuugcguggugcuggggaucaagcccagggcccugugcaugggaggaagcccgugcucuggcucugagucccguccccagugacaccuucacugucggggucugggggccaggguaagaggggagugcaugccuuacuguuacaguaaucugcuucuucuuccuuucaguuauuuccacggaaauguacguggcucuacgucaucaauaauacacugaugucauuaucagguaugcaugauggugaaaaccauaggcaagcaaagaaauguaauuuuaguguagacuguaugacuaugccguuuguuguuugaaaaaggauugggucuucugugagggcuacauuucccagcccccuuccugcaucuggacacagagggaggggaagaugaugaucugcugagcccauuuccuuccacaacuucuaacauugcuggcugcacuuuguuugccuuccuuugaguguuagcagugcagcuggaggaagcagagggucaagcuaccuccuuucuccaugaacucuagcaaauaacccauucuuagccucaauuuucuuaauuaucaaaacagaacagugacauuaaaaacaaaaaacaacaacaaaagucucaugagguuguugugaggauuaaguaaaauaacauugcagugcuaaauuauaaagucuuauacaagugucguucuggaucaauauaaaguaccuuagacuggaccuucucacccaggggucugaggugauagauagcucagucuguagagugcuuuacagcaagcaugagggccuguguucuguccccagcauccaugcaaagagccaggugugaugcacacuuauaauuccaguaguagggaggcagacgcaggaggcuccuugggcucacuaaccagcaaaccuagccugggaggugaguuccagaccaggaagagaaccuaucucauaaacaagagagacauugacuaaagaacagcauucaguauugaucucuagccuacucaacacaugggucauacacgccagcacucacacacacauacacacacacaagcacgcaaagcuuaucuaaacaaggugauucauuccagaacaaccuguucugauuuuagcauugucagguuuuuugguagcuggugguaaugaaaguaucagauauguuaccauaccuuuagacuuuugucuuguaguucuuauccagugucuuaguugcuguucuguugcugugaagagacaccaucaccaaaauaacucuuauaaaaagaaaacaaucaacuggggucuuccuuacaguuucagagguuuaguugauuaucaucacagcagggagcaaggcagcaugcaggaagguaccagaucaguagcugagggcuacaucuaggagacuagagcuggcauggguaauaaggccaaacugacuaauccuucuaauccuuucaaauacugucgcucccuaaugacuaagcuuucacauacaugagucuaugggacccauuuuuagucaaaccaccacacccaccaaacaauauuuucuuacccauuagucuuacaaagcuaccuggaggcuaacugauugauuugauuuguaguacaagaugucuaauuauuauuucuucaggaaucugcauuugagcuauaacaaugucuaugaaaaauacaaucuuguguauaaaugucuuauaagaaacagagauccuagccgggugugguggcacacgccuuuaaucccagcacuugggaggcagaagcaggcagauuucugaggcuagccuggucuacaaagugaauuccaggacagcuagggcuacacagagaaacccugccucagaaaaaaaaaaaagaaagaaaagaaacagagauccuauaaaguaaugguucucaaccuucccaaugcugugacccuuuuuauauaguaucuuaguuaggcuuuauuucugugaagagacaccauguccaaaguaacucuuauaaaggcuaacauuuaauuggggcuagauuacaguuucagagguucaguccauuaucaucauggagggaagcauggcagcauccaggcagacacggugcuagaggagccaugaggucugugucuugaucagaaggcagcuacaaggagacuggaugccagaaggaugcucacuuccacacuagguguagcuuaagcuucuauaugagaccucugagcccaccuccacagugacacacgucccccaacaagaccauaccuccuaauagugccacucccuaugggccaagcauucacacaagugaaucggugggggccauaccuauucuaacuaccacauacuguuccucguauugugaccuugaaccauaaauuauuuuuguugcuacauaauaacuaugauuuugcuuaguuauaauguaaauaccuguguuucccaaugguuuuagguggccccugugaaagggucauucuauccccuaaagggguugugacccacccguugagaacugcugcucuuaagaguacuuaaucucuuugguuuuaauuaugauuagccugucauuuuuuauuuuauuuuuauuuuauucauauauuacucuugugaaaagcaauaaacccaauucuacuugagugacuucuaaauguuuuugccagacuuaauucacuuuauuuuucuuacauaaaaacccacauagagccagggcaggagccuggguccucugaaccggaguguguauguguuuucacagauggucagggaaauccugaaagagaaacauggugagcacagucucuuuccagcucuggggccaaguagcuauagaucuuggagaagacaucagaggugaaguugcccaggguggagugcagcagucaccaauaccccggaacaacaucagcuucucaggcacugcagcagggauggggugcagcagcacagagccucaggagccucucacagugcacgagaugcuguggggcuugccugucuucccccaagugcucucuggacagggagagugugaaaaccaagauguuguccccucagacggcaguggccuccugccuggagcaaguaacaccaagaccagugugaccauuuagugcccaguagugacaaaagcguugaagcuggcccaaugcacugcccaagucacuucugcucuggcaggaucucuagaaccgcauccuuguauccuuuagggaugcucuaggaaaaaucagggaucacagauuuacugguggcaaggagaccaggcacaugccucccagcccuggaacuugaccuucauguccuugaccaggcgguccaguuuggugaaggauccacuccuugucuucuaccuuaccuccaugagugccauggcuccuaugaucacugaaagcuuccauggccucucaagccugagccucccuauuccccagccccucccgcuacagcugagcagcaauucugcauucugucaguagcacaauaucucuaacucuugccacuuuuaucauuagacauagcuuuaaaaccauacauaguacaccuuauauucucaugagauaacaugggauggcagggaauaguuuuuuaugaagucauuucuguaaugcaguuauaauuaauuacuccuaaaacagagccuaaguaucagagcaauucuguguggauagaaagaggggaaaaagggcuguguuggccagauguuucuuuucugagaaaacacagaaauuguugugaggauaaauaccugugugguguguuucugcugguaaggggcuguguugucaggaucgggugguguuuaugcguaucgccugccgagcguagcuacagugugacgugugggucguccaucacuauacuagggcucauagcacuggcuuguuucacuuugucuuuuauuacagucuaugcauuuaaauuuuauucacaguuuuaggggaagauaagucugugggucgcugauagauaaaccugucccagagagcuaagcgcagcauuguagaccuuucuguuugucuguacuccuguaacugcuuguaacacgcgugugcagugcuuaacaguuucuccuccuccacuaggaucaagcagacgacauuuauucucccgacugauucgucaaacaugucuaaacagaauuauccacuugcuuaaaaauaaguuuauccauuacuuucaaaauaacacuaaccaagucuguuuguuguguuuugcauguuuuucuguuuugcuugguccuugaaccuuacuggacucgccaccuuagaagguaauugcacuuuuuuuuucuuuuuggcagguuuuguuguuguuuuguuuuguguuuguuuguuuguguguuuguuuuugaaacaggacuuuacuauauagcccuggcuguccuggaacucaccauguagaguugggcuggccuugaacucacagagauccaccugccucugccuccgccuccaccuccugauuccugggucuacaggcgugcaccaccgugcccagcuaguugcauuuucuuuuacuugaaaauugucuuuuucuaaugaaauuuauuauaguaaaaguaacuucuuucuuuuccacaggaaaaaccuuucagcucuacucucacaaccuuauugcuuuguuugaacaagccaaaaaaccaggguuagccgcccacauccaaacucacagguuuccugaccgcauucugccaagguacagcauaccauuuagauccuacugggggugagaguauguguguguucuuuuuaagcugccaguguuccuugucuagugaaacagcuuccuuuucuuaauuuacaugucauccagacuacaaauaauucacauucauacaugaaaaucauauggaaguuuuauaacaaauucuuuauucuauaaggucagaguccagggugauuuauuuuuaagcccuuuccugauugauucugguguagugguucauaugucaccauaugcaaccacaauaggguccauucauaauguuuuauauuucagaaaauuugccuuaacaacuaagauucccgauacaaaaggcugccacaaaugcugcauaggugagugaaugcccucucaaacuugaugguuagaacugucaauaucuuucaaauuacuugaagaaucucauagugucaauaaaaggaaaauucagugugggagcuuagccggcuguggguagcgucguccacacaaaccccagacuaccccaaauucagcaacugcuggaaggacuccagaagucacugacaaguaugaugcaagugugaugcccacaguagugauuacaggauagagcacagcugagugaagaggagcaggaggcagagcgcaggaccgccaggcggggugcugcugcaguauggcauccuauugucccucgugguguggcuggguggcggcucacaaaacacugccagucagguguugguucaaguguucacacuuuacuggggcugcgucaugaaggugugagauuacccacauaggcaaucucauuuccaacccauccagugacugacugaugcuaaaggagcgaaagcccccacacuguuggucuuucuggcaggaccggcuucucauacuaaaauuaucuggugucgauggccccaccuaaguuacaguuagauguaaggcaggaugggagguucaagcauggcauuccgaagauuccaggcguuuagcggguguuucugagaggaguauuagaggaugggcuugaagcaguggugcauuccuuacuacagaacuguugcuccuaccccuuaaauagugcuugacacuaugucacaggaagcgacagaaccaagaaucagaucuaggcccaaucucuuaaaccuugaacuucuaacaacugggaguuguugguuugccuggucagugagcuuucauauuuauccucaugaaaagagacucuguagaacaaaguacucaucuacaaugugcucuggcuacagucacgugucacuucaugauguauguaucagugggugauuuaaccuuguacguacacaaaccaagugauuugucaccaaguagugucaucugcagaacuaccaugauuuauucaagccuuugcuaacugacaugcuacacggugugugacgauacaccccgauuucagcuuccuagggagaauuaaugagaaucaugugcugucaucuauggcucugaaaggucuggaagccugcagucugaagccuugaugcaauucugcagcacuuagagcaaguacccgcucacuuagagcaaguacccgcucacgcagccgcugggugaugugguugauggcagucacugggagaaagacagaccaauaugaauuuuuguagauuugagucaaaggaugguccagcaagauggauucauaaauguacugauucacaucacauguugcugggguuuccacaugccagcaacugucuucauuaaaaaauaagucacaaguugagugaaauagugcacaucuauaaucccagcacucaggaaacagagucaggggccucucuguguguuccaggggaguuccagaccagccagagcuacacagugagacccuguauaaaaagaaaagccaccuggcuuuuaggagaauagaguucaccuguuaccuaaccuaaugauacauucucaccaaaagaaauccagcgauguguguguggcuaggauuguuuuucuuucuuuucaguuagaaacccuuacacgggacauaaguaccucuguggagcuuugcagucuggcaucguucugcuucagugguaugagccgaugcagaaauucaugcugauaaagguacaugugacucucuuacaguuuuuccuugagaaagcacugugcauaacuccaguuggcuaaagcuggaauuacuacuaugaggaacagccccugagaguuaguaggaagugcguguguuauauuuuauguucuuaguaauaucuucucuguaacuucccguuacuuaauaagccucuggaaucaucauagccauguggccaguccucuuaaguuucucggaacaacagucuugcuccucaucacagagaaacgagcuuuuauagacaaggcagggugaggagcaaccuucuagcugaccucauacaaccugcugugaacgagggauugcuuauucuuccuguuugucuguugcagcauuucgauuuuccuuuaccaaguccacugaauguuuuugaaaugcuggugaucccagagcaggaguaccccaugguuuguguggcuaucagcaaaggcucggacuccagccaaguaguucaguuugagacaaucaacuugaauucugcaucuuccugguuuacagaaauuggugcaggugaguguuuuucacuugguuauguuccugcuuuuaccuguaucagaggcagagacuuaaggucaaccauugugggcuucuaauaaaacuguaagcauaggggcuggagacauggcucauugguuaagagcacugacugcucuuccagaggacauagguucaaugcccagcacccacauggcagcccguaagugucgguagcaccuguugcaggggcucgcacacccucauacaggcacacaugcaggcaaaacaccaaggaauauaaaauacaaauaaauuauuuaaaaaauaaaaauaauguuaucauaauuuucuaaguaaaaaauuaccuacauuucuaaauaauaagaaauuaucuacauauaguauaugaucucuguuugcccaagggccuuuuguuuguuuguuuguuuguuuguuuaugggugacccgcugccaccauagucaguuuuagacaacaagccugauauuguguaacucacaaauuuacugagaauuuaaccagcuuguaagcccugaacuuugaauaccugcuuuguggaccaagcuguaauucccaguaagggaaaagaagaaagccccuugcaccuguuccucgcccuucucuguggucuuaauggcaucugcaguugggugugugccuccuaugaagcuaacagaagggguaaaguuccugucaccagaguaagcagccgaaauacaaaugauucuugguuaggcaaggaccacaauaaguggcuauggaucuguuuauuaaaacugugauuaggccaggccugaugguggugcaugccuuuaacuugaacauucuggaggcaagagcaggcagcgcuucauagucaaagccugucuccaaaagaauugaaaauaagaacaacacaaacccaagugauauuuacaccguaguccagcauggcgauuguugcauaguuacccacagugauucccacccuccuccuucaggcuggugugugggagcuuacacuucuccaugcuagagguggauugaguccucuuuugaaucucagaauuugaguugguuuuugagauuuugaugugguccagugccucaagugccacauuauauccaccuuuaacguugucccagcugaaauacaaacaguccaguaaguacuuccugagcaagccaggccucugagguuaucaugcgcucgccugagcacacggacgaggccccuuucaguccagcuuugguccucauuaggcuuuguuugcacaagugaucguugauccaaccccagcugugucuguuguugagccaagagccuuuagcuggcaaagcuguggccuugaaaggagcucuguuguaggaguccuuccucugcagauucugacucauuccucaugaucccugacucccagggcagcccucagcauggucacuucuugguauuuguugagugagugaaugaacauagauuagcugagaaaaauuacaucugguguguugccugaaagaugcuucauugguugucuugacaaggcugccuacugugcugcucagugaugugucuguaagggaccaugugccugcuguagaaaugggugacaugacuacccccaugguaugguuaaggggaaacuuuuuauugcagaugugagagaggaaaucugggagaguccagagcagagagagaaagaaauaggcugaauguggcagcagacuagacagggccagggcuaucugcaagagauaggagauuagcagaggauagaaaauagagacugaccgccuagugagaaucacaucaagaauagcaggguuauaaagagaaugaauagcuagcugcagggagggaagcccaggagcuggagggcguguuggggaggugggaggggagcagagcugggaugccagcaugggcucugaaauguguaacaggaacuuggguacugaaggagccuggaggucagcacugguuuaauaugcucacacgcaccacagguagccauauguccccacagguagccauauguccccuuugccagagggaaaggaaauggcuccuuuuggcaggugagaacuaguuucacaaguuccugagaaaugcuggcuucuaucuaacugccagaaauccuccuauguguauacagguuaagcucauuucuggauauuuggacugccuuugggguuugggaaagugaaguuuccuuuggacuugacagauuccaucucuugugagugcagaacaaaaucuaagcacugugugcguguaucguccuuuccuuccacauaccugcccuuaucacaucaucacgauagcccaccuuucuaaagcaaaaguaguaauuagggcaguauugauuuuagcucagguauccauuuccgagcugagcugauguuuguucuucuaaacugagguacauacuucuucuuuguuguuguuuuguuuugcuuucugcgauagcaugacacgaugcagcuuucaccauauuucaaguaaaucucaggaagauucagacuuuguugguuucuaagccugcuucacugagucuguuguuaacgguaaccuuuccccacuuaggcagccaacagcuggauuccauucaugugacacaguuggagagagauacuguuuugguguguuuagacaguaaguauuauuuugaaguuuauuuugaauguacuacuugauaaagcaaccccuuuuagugaaauuaaacuguuauucaggcccuuucucuuuaagugaccugguuguauugauuaagcagcuaaaauucacugcagcaagaggcugagcugcugucccuaggugcuguccuuuguuuuacauuugacucauguggagacauuagcacugucccccucuuagggaaucucuguauaaacuuuccccucucucuguaauuaugagaguagaaggucacagagucacuuaacaugaacuucuggaggcuucucaggcuugaagcacucaggcuccugaucuguuaugcaggagacauguuacuaaugggagcagauugcagugugagcagggaaggcagaaaacaacagcuuagcagacguguuacuuugauuuuugcagaggaggcacuccaguucucaaaacccaucuucucuuugugcaguaaguguuauaggauggacuguacccagacuugggauuauauuuggaacauggcuguacagcuugcuuuuaguggccaaaccaccuguauguauaagaucaucuaauaacacaacugaguaacccaaaggcugcagggccucaccccuugccgucccuugguaagggacuugacucuaaacaccugucagguagaaguguuauaaaguuaucuauaaggaaacuacauccuuuuuuaauccuaauagauacaaagugucuuauuaguguaacauaagcaugacaagacucccagagagcuaaggccuuccugcuaagcucugcaggucugugaaucaucaaaggaaggccucagccucugcuuucaucuccuugucuuauauuguaacagucuuaagaacacauuggguaacaagacucccugcuuccugaagaaaccguuuucuguuuuuaaagacauacuuuugaaaaaauauguucccagcucugugauuuauaaguuggcuuugguagacagcaguggagacaggcuuggaaucucagacugugggaaugcacacugaaaauugaaguuguugggauuuuuuuuuaagucuccuugagcuaaugugagggaaugagaaaacagggggagcagagggaaggaggcugugugugcuuguccccaccccagaccucacugcccuggggugcacaggcccaugggccccgacucacugggcuccuauggccagucaggaauugcugcaaguguuacuugauaaauacagugagauuugugagggagaaaucagaacuuguggcuaaauauucaaacaucaaaguagccacuuuuuaaaacaugaagauauucaguauaugcucuguaauuuuaaaaauagcaaagucccacuuauuggggaaaaaaaggcacuguaaguguguccuuuaaaacauauuagugaugauuuguuacugggcauacccaaaccaagauaaaucuuuaaacuuuauuaagaauauuauuugaggggcuggugagauggcucaguggguaagagcacccgacugcucuuccgcagguccagaguucaaaucccagcaacuacaugguggcucacaaccauccguaacgagaucugacucccucuucuggagugucugaaggcagcuacaguguauuuacauaaaauaauaaauaaaaucuuuaaaaaaaaagaauuuuauuugauaccccuauaaaacccauuauauuuauuuuaagaaauuuucauuucuagucuugacuuuuuuuuuuaauuuccuuuaagaauuuguaaaaauuguaaaucuacaaggaaagcugaaguccaguaagaagcuggcaucugagcucaguuuugacuuccgcauugagucuguggguaaguccucuccugcggccggccguggauaacugguggcuuugaugaugcucucccugggacgcgucacugcaccagcuaggucgugcauguggcccgugcuuucuaaguuuucaacuaauuucauuuuuuuuauuuuauuaguuuuauacauguaauucacacuaaucaugguccugucccuggguauugguuuuuaaacaugcucaauauuuuuuuaaagcauuauauaggauuagguguggugguacaagcuuuuaaaccccagcacuugguuagcagagguaauugguucccugugaguucaagguuucaggccagccuggucuauagagcaagccccaagccagacuacuaguaggaccaaucucaaacaacaauggaauuucuacuuccaucuuuuuugcugauaugucagcauuuuuccccaggagaauagaaauugugaggaaaaaauaugauagagccaaauauuuauuguacuuaaaagaaauauauauguauauuauauaauuaccuguauauagcuuuuuaaaauguuucugacuaguuaaaaaacauucuggauuuuuaaaaauuaauuaauguauuuauuuguuuguuuguuuggggggguucugguuuuguuuuuuauucuaaccugagcuucucauauuaaacuagaauuuucuugugcacaguggguaaauauguuguguccuuguguaacagaugauagaaaaguaccuaacucgcuggggcagaaacccuaagcuaucugaagagucagaaagaagggacuucggaagcuugugucuuccgucccuguuaaacacugcauacggcaugucaggcucuaagacauaauauccuuaaggaguguggcguagauccucagccucuuagcugagauguacugaugucacgugugccccacugucuggagaauuuuuacuguuggacagaagucuccuccuagauggccgccaccccauuucaguaaagcuuaaaauggugacacauuuuaagcuuugucacaucuagggaagcaugcgaucugucaucgucaaaugcuucugucucuauuaggcugaguuguguugugucccagacacucaugcgcuaaccauggucuuauuaucccaaugagcagcauggauugcgugcuugucgggcgaguacaaagcccccuccauuugcucccuagcacaagggaagaguaaucuugacucuuuuccaccguuauguuuguuuaugguugugguuuuuaauucuaguugcaagaauagucaguaaauaauaagauacuuacuuagcaacugccugaggucacaauauucaacgugauuaaguuuuggauuaugaaguggguuuauuuuuuuaaauuaauuuuguaaugugaaaauaugaacauaaaaguuaccugcuuguagcuacuugaauaacuucuuuuaaauccaaaaccccacugcauguuuuuacuguuuuaaucacuuaaaacagaagcuacagcauaugaaagagaagucaacagccaauacucaguuuaucaagucagcccguguuggagaaaugccugcaacaugcaucuuugaagcuuuguaacugucucagucaauuacuugaguuuagacacuccuuagucacaaaaauguugagcaguaauggucuagacaguggaauuuugccccaagcacuugaaaagccuuacauuaucauuuguuaaaaaguuagggaggugccagaaagauggcucagggcugcagagcaaggccugcagcuggaguuucccagcgacccuuucuggccuguaccuccaguuccaggggaucccuuggcucuggucuccgcagacaccugcacacacgcacaucacacacacacacacacacacacacacaauuaaaaggaauaaaaguaaaucuuuucuuuaaaaaaaaaaaaaggcaaaaaccaagacagucuggggaacucuguugugcuuccauuacauguccccucaucuuucucagugugccuucaagacagcguguuggcuuucuggaaacacgggaugcaggguaaaagcuucaaaucagaugagguaaguuugcaccauuuaccucccugacuccuacgcuagauuuuaauggcgaaauguucauuguucuccuguccucucugagucacauggcuuugcuuagugccuuggaugccguagcuuggcaggaugcgcaucaguguucucucuuccuauauguucacuuugguacuuugguuuugaauccccaguagccaugaggaacuccuaaauguuugcacaaccucauuccuuucgcuucauuuuucaaaauuuagugacuauuuuucauagcuacuauuguuauaaauaauauauaagaccuauuauguuccaggcaguuugcaaauauuagcauauuuaaggcucaaaaugauucagugaaguaggcacgugccuaaugaaauggcagagccuagguuggaaggucuucaagcaucacuuuaagccaagaugaucagggugcuuuuaugcagaggagaguuuggcucccucccugagggacagcccucagggaagcauuucccgaugucagauucuucuacaccaaaggcucauaaauccacgggacugccugaaagugggaccuucuugcuuuugaauuuaguuuaucuauacccuuauuuauauuuuaauaaauauuuauacuucuaagaaaaagauguuauaaaccagcagucauuggugaguugguuuauuuacugaccugggucacuaaaugucaccaggucccuguauuuagugagaucuguaguccugcucacugccacagugcuaauuauucuguuguuguuuuguguucaagacaggcuuucccuagaguccaugagcacagccagcacacugagcgugcuagcuguucucacgcucugcgcugugucauuucuaucuuuggaaaacucaaacccagggucucaggcaugcaaggaaggggcuuucugcuaaccaacaugcccagccauguagcugccugcuuguaacgcaucucacuuuaacuacucucugcacgucugccuuucugugauauucucauccuuugacguacaccuaguugaaguuuaaccucugccauaaacuaacauuccacaguaauuagaguauuucaacuucauaccauaaaaauuagcccccuggaguauacagcgccuaaauuguuugcagauuaacauucauuaugucuuuccagacuacaaguuccgguuaacagacuuuuuacacuaaucauagcaaugguuaauuugaguuccccaagagccagaccaagauaacaacccaaguggagauacuuuaucuaggaaaagguucuagaaaacaagcgauguaauaagacacguaaaaauagcaagaggggaacaucaaaagcacaucauguccguaggcagcugucugugcagcaggggucggucaagagggagcacccgugagugaugcugaccgcacccuagcagcgacuccguuacagaagagggagguggagucuggcacacaguggcuguccauuuggauagaggcugcaccacaguccccacucuuugggaagugcuugugugugguggugcagcucugaagacugcagaaagcagaaaaugucaucuaacacuggaugaccccgggcacugggcaagagcaacagggugccccaaagcaccucacuggcacggaaggcuuacaugaccuucuuguaacuuuuaacuucucuggccugcgggagggggagggucccaacaagaaaagaauucaaaugcaugcacacagaguccuuacagaaauuacagaaagcagcugacccagacuagaugcucuguaaauacuggcccauuucuacugagagucaaaaaacaaacuuaauugaaauauauuugauuuggggaauuauagcuuugaaaaauuauucccuuucauugcuagauuuaagugauuguuaaguuacuguguaagcaguacuggggccauaguuuacugaugguuauuuucauccacagguuacccaggaaauuucagaugagaccaggguuuuccgccugcugggaucagacagguugguuguauuaauauaauuaugugaaaguagcaaugaucaaacucuugacuaaacugucagcccgugucggguuacaaucagaauucuuagagggcucaucaacuuagagagacgauuguauugagagagugagugagauuuaguuuguugaguucccagucuuuucagggugagaggugugcuuugagagacaguuacauucggccaaggcaacauguguagauagcagugcucacccccauuugacccgaacaagacuucgcaucccuuaguucccacucugucuuccugguguguuucuuucuaauaaguauuacagaaaccaucagguguuaguuuugugucauaaaaagcucaccuugucuggaaagcauucuuacuguaagauguuagcgggucccaucugacauugccuaagcguuagccgcgugaugaaggagugggagaauagagugaaugacucuuugaagggaggcuauaaggagaaaggaguuucuggaaaauggugguuaccucagugaaggagaauggcagccacgggcacgacaguaaguacugugaccacaaaccaggagucagcaggaacuggagggucaacucugcugcuggaggggcuggccauugagcuguggcucuguaacucugaggauucuggugguagaacauaacaccucguggcugaugcuuuucucuccucuuugcccggacucuucuccuugccugacuguccuuuguaacgucucguuauucugucacaguuugcucuaaaauuucauuuuugaacugcgacuccuugggcucaucuucuuguuuaggcauccccuugguucuuuauauaugcacagaaguuuuuguaacuuuuagugugucuguguguauacacauguggagaucagagaacaacuuauaagaacugguucucucuaccacgugggucccaagaauaaaacuuagguaguugggcuccucagaaauccccuugccugcuuauauauuuauuaauagugguuaacucugggcagacagguaauuuuauuuuuuccuucuacauuuccacaauguauaagguauguuuuuauugcguaaaauucacacaaaaaauauucagugugugugaacugucucuuccauuugcccucuaggcuuccuucuuuguguggauuauaucuuauucuauuaaaccucuccucauaauucaaaugcuguggaguagcucuuggucgcccccccccccccuucaguccgcugaugcucucccugucuucgcuccugggaaaagggagagguggggcaggcagcacgcuauucuuugucuuaaaccauuuguuuucaaagaacuugugugcaguucacagguccuccuaggguucuguugauucucuagcccuccuucucuugguauagaugccugagacauuugccacagcuguuguuggcauaacugaguaagcauauuuguguucagugggaauaaggugagaacuauccccaaccgugacaauacuuuauauaaaacaacuuuguucaccaaaaaaaaaaaaaaaaaaaaaaaagcugggcgugguggugcacgccuuuaaucccagcacucaggaggcagaggcagguagauuucugaguucgaggccagccugaucuacagagugaguuccaggacagccagggcuacacagagaaacccugucucgaaaacaaacaaacaaacaaacaaaacaacacaacuuuguucagcugugcuagaaguuguggagcacgcuaaugacuuuggcuguggaacaagcugguucuccuggcuaugggggacgccaugugaauacuuaagcuuuuccuugguuucuuuuaggguggugguuuuggaaagccggccaacagaaaacccugcagcacacagcaaucucuacauccuggcuggacaugaaaacaguuacuaagcagcagaggcgaauuccaagugacaagaggaugaaugaacauguuccauugaaaacaagaguguguuaagggaauucagugccgacugcaguguaacuugcuuuaauuauuguggguuuuauaucaaaugaacuguacauuaggauagaauucaguauuuucuguagcuggaaacagcuagucaaucucuugccacuguguggugguuauaucaaguuugcuuaauaaaagcuaugagacaaauaguccucuaguuccaagaaacacaguccuuuuuaaaaaacaauguuuguaacaaggugccaugguguuuuuaaauaacucaugauucucuggagagggaguuuacugagcauuauaucauuuuauaccaugucuuacuccuucuuagugaacauaauuugauaagacguuaucgaacaagccuuucacuuugacauuggccguucuguauguuuuuguaagauagaauauuuaauccuuauuuauuaaucucuugcuggagugguguaauguuucuaacuuuuagcaaaggaagguugcagagcagcugaaauuuuuuauaaugugugaaaauguuguuuaccuucucagaguagugcuuuggggguuccuggcggcguguuggaggucuagcacauacagcuucccuuaacagaauauuuuacgacaguuucauacaggguugccuuaacgggaauugguuuccaacuccagaugguuguaagggcucgugcagaaauacugaugguggacacaaagccucagcagggacguguaguguccaggugugacuaccggaguuuugacaagcaguauaauauaccugugauuuuguuuuuuacauuagggauaaugcauaagaaauuaaucuuuauauauaucaugaccccuaauguuugggaaaaaaguauuuaacugcccauauuauguauuuuacuuauguuaugccaagggagaaaguaauuacacguguaaucuugggguuuucacauacauagauauucauugugaguaggcuuaaggaaaaaaaaaacuuuaagugaaauuggaauuucugaugggauaguauagauaaaugauguuguuuuauauuuuuuaaaaaaccaguauacuaaaauuaaaaaaggauaggguugucuuuuaguuuguuuuuauuuuacaauucuuaguauucagaauugauguguuuuauugguaccagcugucuuaaugcauuuauuaagaacaguuagcauugagguaaugaacacaggggcuaagaguagcaaacgauagacguagucugaccggauacuugaggaaaacaauguaccuaucucaucuuuacaguuuuauaaaguccauguuaucaucuccaccuuccaaaugaggagguaagaguuuaaccaaguuaaacaacuuacacguuacauacugguuaguucuuugagccagaccaagaguccuccgacucugcucuuuucacuaugcaauauacaaguaauaaaauguuacgcaaaugaacuau

SEQ ID NO: 6679 - RNA, 1257 nt, Mus musculus
uggugcagcggacuuuauugaugguauucaagagaguagggagggcucccuaggccccuccuguuauuaugggggucugggauggaaauuuugagggagaugcucaguguugggggccgaguugggauagggacuccucagcaaccgagggccucucucuugcucucagugucuuugcuggggugggugguccaggguuucuuacuccuuggaggccauguaggccaugagguccaccauccuguugcuguagccguauucauugucauaccaggaaaugagcuugacaaaguugucauugagagcaaugccagccccggcaucgaagguggaagagugggaguuguuguugaagucgcaggagacaaccugguccucaguguagcccaagaugcccuucagugggcccucagaugccugcuucaccaccuucuugaugucaucauacuuggcguguuucuccaggcggcacgucagauccacaacagacacauuucggguaggaacacggaaggccaugccagugagcuucccguucagcucugggaugaccuugcccacagccuuggcagcaccaguggaugcagggaugauguucugggcagccccacgaccaucacgccacagcuuuccagaggggccauccacagucuucuggguggcagugauggcauggaccguggucaugagcccuuccaugaugccaaaguugucauggaugacuuuggccaggggggcuaagcaguugguggugcaggaugcauugcugacaaucuugagugaguugucauauuucucgugguucacacccaucacaaacaugggggcaucggcagaaggggcggagaugaugacccuuuuggcuccacccuucaagugggccccggccuucuccaugguggugaagacaccaguagacuccacgacauagucagcaccggcaucaccccauuugauguuagcgaggggggggggugugucucgcuccuggaagauggugaugggcuucccguugaugacaagcuucccauucucggccuggacuguucuguugaauuugccauggguggagucagacuggaacaaguagaccauguaguugaggucaaugaaggggucguugauggcaacaaucuccacggagauuuugccacugcagacggcagcccuggugaccaggcgcccaauacggccaaauccguucacaccgaccuucaccauuuugucuacgggacgaggcuggcaccgcacaagaag

SEQ ID NO: 6680 - RNA, 22296 nt, Mus musculus
aagcugaacagaaguuuacacuucuuuacagacagcuggccguaugcgcacuaauucucuuccccugauaaugucccaguagccauauuuuagcuucagcuucucuuuucauuauaggcuugugggccuucugaacagaaugauaaagcauaacaaguauaaagcaucaaacauuagacuaaauauaccaaaacaugcauucaaggaccagacaguuuccacaaaaauauauuuaauaacuuguuauauaaaaucaaaugcgaaauuuuaucaauaauucaaagucacuucuaacauggagugcuuauacuuaggaaaagaacuaauauauauacauauucacaacauuuguaagcacaacugaagagcuaugaagcucaagaauucuagauuuacagcuggaaguuccauaaguuuaucuguaaucaaguguucagcacuaauuaugaacaacuauuaaacccaaagcaagaaaaauaggaaggaaugacagccuguuucuacaccuuuaugacaaauacuucucaaagauaaaaaaggcaauauaaaauuuacuuaagugaccaagauugcuuauuggaucccugauugucguuuuuggcaacuuagcccacccugauggaaggcaguauucuauguggucaggaagccugugcugugucucagagccaugcuaacuguacuuaugugcucugccucaaaggaaggaagccguauuagcaacaguugcgcacuaagaggcauguauuuauuauaguccuguauuucugaauguauuccucaaagacuucaucuuucuccuucaaagguguuccuuacauugggggucgggggacugagggggcgggggggagaugaccacacacguacaagcuuguuacaauaaagguuccaaguccuguuuuguauuuugaacuauaccuaugguaauagucaaaccaucucauuccagaaaacacuugacaccacacguagcaacugaucacagauguacucucauccucuucuguuuccuaaacaagaaggguguguccauaaaaagucagagagugacgguuuccuauuuaaugccuguuuaugcugauaaucucuuccuguacuacuuuuuguccagagucuccagcaguuuccuaauacagcauuugguagcauaugccauauuggcuuuuuaaaugauaaaacuuucuugguucaauaaaagaaaaaaaauugauaacaaaauauauguaaaacuagaauuuuauacuuccaaauaguaaguuaccuuuauuaaccaaagaacuuguuugcagucauuuaucugaaaauauuuuaaagcucuuauaaacuuggcuugugauaaguuaacuuaagaacgucuugccaugcugcugggcauaccacugcugccucugcuugcgguuuuccaacucagugagaagagccugucuguaggccucguacaacuucacaaucugcuccaguuccuucaugaagagcaacuucagcauucccugguacguguccaggucagccagcuggaagagcucccacuucagaauguggucauaucuguaggaaaacauguuaauaagauaagacagaaaugugcauuuacaacaauaaacuggucuauuuuuuauagauauuuuuauuauacauaaaacucagcuucauguuaaaguauuugcguuaguaaaacuugcuacuuagauauauuuuucuugagcuggggcccuaagcugaccuugaacuucugugugcaggauguccuccugccucacacuucucaguggcuacgaauacaggcgcaugcgaacacacauagcucugaauacacuaucuccccccuucccucucucuaaaauucauuuccauuuuuuauguguaugaaugcuugaccugcaugcaugccagugcacuguguacacgccuggugccugagaacgccagagaagacaucagauacccuggaacuggaguuacaguuuuaagacacucuauggcuccuaggaucugaaccagggcccccugcaagagcagcagcacucucuccagcccuauuuauuuuuuaauugggggauuuuuuuuuagauuaacuuuuauguauauuggguguuuugcccacauuauaugucuguguaccacaugcaaagacagaagaggguacuggaucccuuaaaacuggaaucucagacagugaugaguggccauaaagacucugggaacugaacuugcucucuacaacugagccaucucucuagccacaaaugugcugcuuguuaaggaagggaaaaaacuguuaaauauuacuucgggcuuauuuuaaaaaucaaauguaauauuagucuugaguaauaccguuaauacugcuuucagacuauagugguucuguaauuuccaaaaagcgcauccuaugcuccuuaaaguucauacaaaguuaauguugagaacuuagaauccucgagagcaugccgugcucacaaguggucacacagaaaagcaugcagucacuagugaguggcgucagugcuggcagacugacaggugacagaggaacacuauucaacuacaacaacugagacagaagaugaaucauuugggagccaaguauuccugaggaugaguaacaagaaauaaauacuaagaagacagguuuggaggcauggcucggaaguucuugcaaaggacuggaguucaguucccaaccccucauuaaguagcucccaucccccuagaccuccagcugcaggaaaucaauacuuucauuuggacucaagcuacaccacacauguguguacacaaacacacacacauaguuaacaauaaaauaaauucaagaaucaaagaaagaauaaacuuucaaaaugagagaaacugaagaaaacuucacaaugugacaucauguugcuuauucucaugugggccuuggaaggacucuaguccuccuucagugcuuaaaguaaguuggaaguauaaaaccaagguaguaacuuacacuuugaaaggggagagaucaagagacagcagucuaacuuaguuuucuuguuuauagaugaaaacccuaauuaucuccuguaaaaauguuuagugacuaacaguucaggaaggcagagguguauggaccaaggagcuuuagagugacaguuuuuuagggucacuguccauuaccaugggaauguaaauacaguaaguuauguaccuaugugauguugaggucauuucucaaaucacugcaggguagagauaaaaggaagcuuuaaguugcaaugucuagugaauuuguuuauaauaacacuucuguccuaucuaauggcuacuuugguaacucauuugccauuuuauuccaaagucuauauaaaaacauauacggcucaaaaaaauacaaaaauaaaacaaaguauacugagcaguuccugcaagcugcccaggcugcacagugccacacacaguuccaucaucuugggugugugucccaggaacaccagcaccguggcaaagcugcaagcaagcagcucaccccacccccgcuuuuauucuguuacuugaggacugaggacuaaucuugcagaaaccugauaggcucuuuucuuggcagcaccacuccucauggacaagagcuggagcugcaucaaggagugacaaugugaccgccuccagugucuccagcacagcugucauuaggucgguucauuuacucaccauuucucugaaauucacuaguaauuccuaucgaagaacuuaaucucagaguguucugcugugugucaccacaguaccaagcucuuaacuggguaccuugguuguaaguacuauaucauguuacauguuaaugucauauaaaaaagaaaacaaaaauuaaaugucauauuugguauucuuauguauccauuaccagagguuuguacacaaaguaauuaggauucaaacaucuuugaagaauuuuuacuucuaaucaaagaaucaaaauuuauaaccucugauauccuuucuuaaaugucacauagaagcccaauaguguaagaaaaccacaauacuuuuuggggguggggaguggggggugggggguggggugggguucucucuguagcccuggcuggccucuagcucacagggcugccugccucugguguauguugucauccccaucuggguccuauccccacccccauccccuccacccugccagagcugggauuaaagaugugcugccaccaccuaauccauacugacuaugcaugguacuuaagcugguuagagaccccaaagauacucgugccgugugcucacuuacuucacaggggcucgggcauaaaccugaagccagucaggaauuucugcaguaugguagggauuugcagggaccaggagagacugauuucuuucaguuuguuguggcugauacgugauggguggaggcugaucauaccgagguacacugagaacaaagaauugacauuuauuaaaaaacagaagcccuuuaccuaggccaguaauuaugaugaccauacagcuuagcuggaccgggugaugaucaucaggaccaugcuguauacaccacaggagaugaagcagaucacugagauccaagcccagacagaaggcaucaacaucagugaggaggcacugagccaccuuggggagauuggcaccaagaccacuccgacauauucagugcagcugcugaccccagccaaccuguuggcaaagaucaacuggagggacaagcacugagaaggagcauguggaagagaccaucgagcucuucuaugacaccaaguccucugccaagauucuggcugaccagcaggacaaguucaugaaguaauguuggguuuggaggugcacagggucucgucucaagcaugcuuugcaguguuacgguuuucuuuauuaaaccuccacgguuguuuggaaggaacccuucccuacuuagcuugauuucuaauaaaaaaaaaaaagaaucuucuaucuaugugcuuucuggccaaacugaccaucuuucacuuuaacagaacuuuccaugcuacaggucuagauuuuuuuguuugaaacuagacuguguggaaguauacaucaucuucuuuuggaagcugauaugcuacuagugguaaacacccaaguaacgguggaguagguaagauggacugggugucccccacucuggccugccucaagcccugggccugagucccacuuuggaacccccucucccuugcuuauuccucaguccugugguguccaguccuuuggcucaaagguccccccaaaccccaccucugccuuuguugcucucuguguuccccugaucucagcacuucucccucaguaugcaguccugucugacccacuuaagugggauguguugauaacaagguuacaauugagugagugggguaggccgagggcugggugccaaucccaggguuaccugagccaggaguaaacuuuuauggaauuggagacaagggacugaagugccaagauaugggggauacuuccugucccauccccauccugcaugcuucaagcuaagauaugaaggaaauaaaucacuacuacaagucaugacacuuagguuuccagcaacaccugagcuagcaaauacaguggcuacuaaggugauacaguuaaaagaagagcaaccaauggacacuucaguguuaaucacacagaacaauacaagacgauagaggcaaacuuaccacagaacacagcagaaaagaccugaugacauguuuuagacagcauuuggcagcguaugcugaucuugauaaaagagcaguugauguucuaggaauuuaauaaagaaggagcugucuguacuacagcacucaaggaaacacaagguagcucaugaacuaucucguauucagggggaaaagaucaucggugguguaaguacaaagcaaaaggcuuccuccaccacuuuauacaaacacaguggagggcuggagagacggcugagguuaagagcaccaacugcucuuucagagauccugaguucaguucccagcaaccacaugguggcucacaaccaucuaaugggaucugaagcucucuucugaugugucugaagugugcucacauacauaaaauaaauuaaaaaagaaaaacaaaauuaagagugaugaagaucuacaagcagagagcaggaaaaggugcaagagucuacaaaggggccugaugagacaaagaccaagcaaagucuugcuugagaggacaggccauauucuggauauaaccauggggcagaggaaguaugaucuuccaccagacaguguguauucagcugugggaccuggaacugaaacagaggucuucuuggguaaaaaucccaugagacuuguaugaggaugcauuggugccccuuugugagaaggcugguccuaucugggaucuaugucucaugguggagccagucuccgggcagaaccaaggcuaugcaucuaucaucgucugugggaaggaagcugccuaggaagcagguaaauaagcuguguaaggucugugaaaucuguccuggcaaacaccuggcauguguauuucuguggcaaacaacagacuuuacuugauccauuacagcacucuggacucagguuuaccagggguuugguggacgcuauucucuaccauuaaucagaugacaacaagaggagugggggcacuaguucugcuuccuugaaaaggaaaaaucacaagucagcaguacaugccaggugcuggcugaugguggaaaagucaaguguggggagauguacuuacagugguggugcucugaacagggauggcucccugugacucacagaccugaauguuuggucaccagggagugacacuauuaggaggugugggcuuggagaaaguauaucacugggggugggcuuuaaaguuucagaugcucaagccaggccacugucucuuuuccaacugcuugccuauccagauguagaacucccagcuaccucuccagcaccaugccugccuguacaacaccaagcuucucgccaugacaguaacagacuaaaugucugaacuguacgccagcccccauuaaauguuuucuuuuuuuauaugaguuguuauggucauggugucucuucacagcaacugaaacccuaauuaagacacaguugaaugggcugaaucuguggaagagccaaauccagaagucauggcuaugauaaaaguuuuauuuuuaagaaacuuggcuacuacagugacaggggaaauauuggaaaagucauguuuugaguuuagaaaacuggagagaguaaagaagucgaaagauuaugcuuuuguucauuuuggagacagaaaagcugcuauuaaggcuauggaugagaugaauggaaaagaaacagauggggaagaaacugaaauugucuuagcuaagccacuagacaggaaaagagugccaagcugcucaacaggcuuccagaagcacugcauauaaagauuacuaucacccuccuccccaaaugagaggccaugguggagggagagguggauauggcuacccuccagauuacucagauuauaauuacgagguauuauaaugacugccaugguugugauuaucacaacuaucguggagucuaugcugauggcuaugcaguaagaggaaaagaagggagaggaugagguauuccaccaccaccaagagagcagagacuacuaccucuaagaggcagagcuggcuacucacagauggagcauaucugggaccaccgagaggcucaaggaguggcagagggggucuugcagaauaguagggaggcccaugguccuuuggaacucaaggcaauugggaugggggugauguaggagacaagaaaagagcagauggguagaaccugccuaauuccaagugucaugaggccaacaaccuacagaaagggguuccuaacccauagaccagcagcugucucaaccaagugguaacuauucugguaacuaugguuacaauaaugacauucaagaauuuuaucaggauaugaagaagcaacagcggaaauagacaagggcuugaaaaugauucuagcaagguaugauuggcucuagaucuacauuuuucaaaacaaaauugguguaacuguuucaucuguaaguaguuuguugccauuuggauucagaaaucaaaucauuaaagaagucacuauugucuauacacucaggcuuucuauuguucuucuuuucauaaauacucuuggacaucauggguguacagaguuucuuuguccuggagucacugguuuuucuguauugaaaauaagcuauggcuguauguuuuacauuccuagaagcaggcuuacuacgauuuuagguuguuguaacuuucacaaccuucuuugaaaucuucccuucaaaaucaguuuggcuuacaugucaaagucucaacaauuuguucugugaugugacuguuuuuccaauuucuuuuucauguaaaaauuucaacaaaauucaaaaucuauuuaaaaaaauaaagagcuggguguagugacacacgccuuuaaucccagcagaggcagaggcaggcggauuucugaguuggaggccagccuagucuacaaaguaaguuccagggcuauacagagaaacccugucucgaaaaacaaaacaaaacuaaacaaaacuaaacgaacaaacgaaagaaagaaaaacaagcaacuaacaacaaacccaaguuaaucacuucuguauuuuaagacaugcuuuuuuggcugguauauauucuuuuuaaagaaaguuucaauggugauagaaaguugggccuuaguuguaacuuuaacuauccaaagcuuaaauuagaagcaccgauuucugcaaauaccuuguaauuugcuaauauauauauuggaaagggcuauagcuuuucuuaaaaaaaaaacucaaaaugauguuuuucuuccuccuguugacuggaaggugagguugggauauguagcagcaggacucuguacuacaccagguuagggaaacaacugggaguugacuagagccuauuuuaaaucagagagaauuaaaaaggaucaagugucacuuagcucuagcagccuguguaagcugagcagggaggaguacuugcuuauacugugagaugcuuguagaggguguuaugcaaagugcucagcaccugcaggcucaagugaauucugggaaaccaaacucagcuauuucagaccuaaagacaaaauuaaacugagccugcccuuaacauaaaagacauauaaauauuaaaaacaaaaacaggucacugcuuucuuaaucagcauuaaaauaaggucuagauuauaccaugguuaacaaacaguucaguuuaagauuaucuguguguacaucucugucucugucugccucguugucuuucucucuguguaugugugcaugugcauggauacacccaugaggccuggagaggguaucugacccccuggagguggaguuacaggccacuguaagacacugauggaggugcuagguuauguagugaaggaagacuccuaugccaaauuaggaaaaggucuaaacucgguccucugaaaaagcagcaaauguucuugaugacugagcaaugcaucucucccaccccagcaauuuaaagauaacauaaaaauugcacuaaauuuucaacaguuuuuaauaaguggguucaaaaaggacauaguaauugauaucauaugcucuggggucaaauaagccuguguuuuugcuuuuguuuuguuguaguugagacaaguucuaucuaagauucuauguagaccaggcuggccuugaacucacagaguuccucuaccugucucaguuucccaaguacuaugauuaaaaguaugcuugaccaugccagccuauguuuuaaauucaguuuagcugccuccaauuuguaugaaauguggguagaauugucuuuacuucuccaaaccuccucauuuaaggaacaaauaaacucuuagcaaucccaaaauuuaaugaacaaauauaagucguacguucuguguaaagacuauaccauauaaccaaacagcuacuuauauuacuaagugaacuagaggugcugagucucuccugccuaacauguacagagccgcugagagaaacaaucauuuggaaaaaugccuuguaaaucaucaaaacucuacaauaauacaagggugagugagauaaaguuaccucucagaucuguuuguaaagaccacgacuauaagacagcaaaccauaaccauggccuuagaucuccaugaagccauucaauaaaagcuaagugccauuaaguguaaucacuggaaaaagaguuucaagguugaaucacuaaauauaaaaauguaaaauguuuauagcaauacaccaauaaugccaucuuuguaggugguaacuccaaaauguauucucaugauuuuaaugauucuaaaaaauauaucacuaccugccaaaaccaacaaacuguauuagaccagaugaccccaggcaguaucuaucagugacaucugaccccuuguccucaguucuugcaccuuaaacauuauaaguaaaugcuuuuccacuauuaagcuaauaaaguuuuauauuuacuugaaguacagugucuauucauacuuccagcaaucgcaauugguuaaucaaguuucaagugcucaacagccacauaugacaacugacuacauuauuaaauagauagcaugagacuuaaauaucauucaaaacaaaacagcccaaagaauuacugguuuauuuauuaaaaagcuagaaugcuuuguugcauuccaacuuuuaccucaguaagaaacaacaaaaaaaaaaucaugccugaaguugaauaaaaacaguaagauaaugucaaaauuucaaaguauacuuugacuuaauaggaaaugggccugacaugggaauuuaaaaugaagagacagguguuauauuagcuucaacuucugacuagcuacaaaaacauucugacaucuccucuaauuggaaucugaucacaaagauacauuuguuucaaguugcucaaagagaagauacuuuaaaaaacauuaaaauuauuaauuguuaaaacagauuuaggauaaauauaaauuuugagaaaucacuuuaaaaucucaagcuucaagaugcuuaucccuucaaaaaaugugagauccaaaucuaacacaggauacucucaaaacagauagcuggaaacaaagccacuccuuuaccucggagcacaggggugccuguacugagcccuuuuauuggugugauccacguaauagguuccaaauucugaugacucuacucguucccagccaggaggaaguccuucucguucaaggggaugacuccagugagugguauuuguguuaugaucuauguaguauuuucucccucucauuguccaguccacagaccagccaggaggaagggguaaaucuucagauccaugguuaguuaaauucccuagagauguagccgugacucucccaauaccuucagagaaaagaaaauggagcaaguacucgaaugccuguuagaucuuauuacugugucaguguaaaauggccacaaaaauaacacuacuauuaaagcagaaaggaagagcuaaaauuugaaacaaauaugaguuuuagcuuguuugaaucuucuaucacugaggcacagaaacacuuaaauauuuauacugcuaaaggaaaagugaagaaagaaaaaaaaucuccgucaagauuuaagauuugacauuucaucuaaaacaaaacaaaacaaaaaguaaacuuguaaaaccauucccaauuuauaauuuuuuuuuuaaaaaucuagcugugcccuagaauuaaguauuaucaaggcagguuauauagucaacgugcaaaaauauacaccaaauagucacaugcugaccacaagcagaaauaaaguuaaugaaauaacaccacuuauaauggcucuaaagaucagucacguuuccagcuaucugaaguauacauuuuaaaauauacacuauauauuuaauauauucggcuaagcaacauguuuaacuuuaagaaauaacuuucauuuucaacucgcuugaaaugacacugacaauccuaaacugacugaaaugucagaauccccugcuucuaugagaagagcaguguuuccugucggccauuucaguaucuaugcaaacagcaaugacaaaacauaauucagaagagacauuacgaucaaggcaaacgcuucuacucaaacuaugaaauucuaaaggaggaaaggguaaguuuauaaacaaauacagguuauuggcaggugguuuaaaaacaguauucacuuaauauacaacauacaaaugguaaaugcaaaaagccaguuacuacagcauagucuuauagaaaggcuagcaagaaaccaauauugacauuguaggugauuaugcuauuggaugcagagcaggucagagcagaauucuggacuauggagcuauacacauaaagaugcucucuccuuucuacccugaguaagaguaagagagaaagccaggcagggcaacucuugccuguaaccccagcacuugggagacugugguagaaagaaugccacaaauuagaagcuauccuaggcuagcuagugaguccuaagccagccugagcuagagagagacccugucucaaaccuucccacuccaccccaccccaccccaaacaaggagcgaaaaaagugcaaguaacgugcuuccugaauauaauuauacuuaaaauagucccgugcuccaccaucccagacuuccugguauucaccugucugugagcaauaauuuaugacagaaaggauggugugugauuucugacaguaagauacaaaaggccaugcagcucuguccuuagcaagcucacgugcuuccccugaauuacucgggggggggagggggggagccagcuguucuaaugacauaaauagugcauuugaugaggaacugaggccuccagcuaaaauuaaagucucuugcuaacagcuuugggagugcucucuaaacuaugugcaucuaaagaaguggcucugacugcccuggagaacacugguauaacugaaacaugagcgggagaccuccaguuagacaaagccagcuggguacaaccacucugggaaucagucuggcggucccucagaaaauuggacauaguucuaccggaagauccggcaauaccucuccugggcauauauccagaagaugcuccaacugguaagaaggacacaugcuccacuauguucauagcagccuuauuuauaauagcuagaagcuggaaagaacccagaugucccacaagagaggaauggauacagaaaaugugguauauuuacacaauagaguacuacucagcuauuaaaaacaaugaauucaugaaauucuuagucaaauggauggaucuggaggauaccguccugagugagguaaccaaaucacaaaggaacucacaugauauacacuuacuaauaaguggguauuagcccagaagcucagaauacccaagauacaauuugcaaaacacaugaagaccaaaguguggauacuucaauccuucuuagaagggggaacaaaauacccauggaaggaguuacagagacaaaguugggagcagagacugaaggaaugaccauccagaaacuaccccaccuggugauccaccccauaaaccaccaaacccagacacuacugcagaugccaacaugagcuugcugacaggagccugauguagcugucuccugagaggcucugccagugccugacuaauacagaaguggaugcucacagucauccauuagacggaguacaggcuccccaaugaaggagcuagagaaaguacccaaggagcugaagggguuaacagcccuuuaggaggaggaacaauaugaacuaaccaguaaccccagagcucccugggacuaaaccaucaaucaaggaaaacacacggagggaauugaggcuccagcugcauauguagcagaggauggccuaguugaucaucauugggaggagaggcccuugguccugugaagguucuauguuccaguauaggggaaugccagggacaggaagcagauguggguggguuggggagcagggggagaggggagaggauaggggauuuuuggaggggaaacuagggaaggggauaacauuuaaaauguaaaauguaaauaaagaaaaugucuaauaaaacaaacaaacaaaaaaaggaaacaaccaggugaauugcuucugacauccuauucacaaaaacucgaaugucuguuauaucacugaguuuagaguagcauacaaaagaaaaucaacagagaugaggaaaaaaccauacguacacauacauguauuuauucuuauuuucauaagaugaugaaauauaagaauacaacaaaaaucaaugaaacugaugauuuacagaaggaaggacauaaugauagaaaugauuuuguuucccuaaaugggccagaacuauguagaccaggcuuaucucauaucucaaacucacagaaaucugccugccucugccucugccuccagaguucugggaguaaagacacaggcaccacagcagaccagcgaacagcaucuucacacacaugccuguggggcuccacagaggccuauggcuuagaccaggcgccuuuucucauuugcucucugaacacuuuucgggacaaugucucucaaugaaucgaaagcucaucaauugagugaggcuggcuggccaaggagcuucagaaauccauccaucuaucucugccucacaccagaagcacgucaccauuccuggcaagguucuagggauccgaacucaggcccucaggcuugcucagcugauaucuacugacugagguaucuccccagaccuugugcgcgcuuucuaaaugugacugggauguuguucuaaagucugccuuuauuauaaaaacuuuguccuacugcucuacauagaagacacuaguagaaacuuacauuauuuccucaauuuuauuuuacaaaucggaacucuaaagcaaaauuucagccuuguauuucauuccuucauauuuaaaaaugggaaguuaaggacgaaaagaauuacagguugaguaucccuuaugcagaugcuuaugaccauggugcuuuggauuuugaaauugauguguguguaauauacuggaaaacacaccaaaucugaacaucaaauucaugaauguuuuacauuucucuuauaaaaacagccugaagauaauuucauauaguauuuucagugcagcugccauucugacaaugaauuaugaacuacuacaauaaucccaagcacuaggaagacagaggcaggagaaucauugcaaaucugaaacuagucugggccacacagugaauugcagacuacccuuaacuauacacugagacuguaucuuaaaacacauacacauacacauaugcauauacaaaacaagguuugaaaaacugccucgaugugaugucauggauaugcucaaaaaauugggauuuuggaguguuucacagaucagauuucuggaguugggauauucaaucuauuugagcuaucagugacaugugaaagugcaaagaacugaauaaauuagcuacacccgcaguucuuaaccuguggguuaugacuuucggggucgaauaaccuuuucacagggguugccuaagaccauccgaaaacacagauauuuauauuaucauccuuaacaguagcaaaauuauaguuaggaaguaguaaugaaaauaauguuauggccggggucagcacaugagguacuauaugaaaggcucagcacuagaagguugaggaccacguaucuauauaaacaauaaacacagcuauuguuucugcucuccuucagcuaacggacugugucaucagucuccagaugaacugacucacucagucauuuacuuuauuaagcaugcccuuuguccuaaggugcuauguucaucacaucugacacuuucucccuucucucuccaucccuauuaggaaccuaguucuaugaauuuggauguuccacuuuccucugucccuuguaaauccugaaacacaucuucauuaacuugcuuuaaaauguuaaccacugggggcuggagagauggcucagagguuaagaacacuugcuggggcuaccugccuccauccgcgcccuugauccccccccauccccaggugugggggcugagccccggucggggagaccccccccccccccacgagcccagcaggguaaccauuugcagcgagacauggcaggagcuggaggagggaaugauauucagaggugagagguguuuuucucaggugaaaggagcaguagaugaugacguagcagaagcagauauaauuucuacaguagaguuuaaucauucuggagaauuacuagccacaggagauaaaggugggagagcugucaucuuucaacaagagcaggagccacaggagauaaaggugggagagcugucaucuuucaacaagagcaggagcgccuuugaccugaggaucucaaagugcuuuagaaacacuaaugaaugaauccucacaacaccccagugagaacaaaauccagucucauagcagaggagaauacaauguuuacagcaccuuccagagccaugagccagaauuugacuacuugaaaagcuuagaaauagaagggaagaucaacaaaauuaggugguuaccccagaaaaaugcugcccaguuuuuauugucuaccaaugauaaaacaauaaaauuauggaaaaucagugaaagagacaaaagaccagaaggcuauaacuugaaagaggaagauggaagauauagagauccuacuacagucacuacgcuacgggugccaguauuuaggcccauggaucuaaugguggaagccaguccacagagaauauuugccaacacccacacuuaucacaucaacucaauuucuaucaauagugauuaugaaaccuacuuaucagcagaugauuugugaauuaucucuggcaucuggaaauuacagacuggaguuuuaauauuguggcuaucaagccuggcaauauggaaaagcucacagaggugcucacagcugccgaauuucaccccaacagcuguaacacauuuguguacagcagcaguaaaggaaccauucgguuaugugacaugagggcaucugcgcucugugacaggcauucuaaacuguuugaagaacgugaagaucccagcaacaggucauuuuuuuucugaaaucaucuccucuauuucugauguaaaauucagccauagugaaugaugaugacuagagaguauuugucagccaaaauuugggacuugaauauggaaaacaggcccgugaagacauacaaggcaccugaauaccucagaaguaaacuuugcucacuguauggaaacgacugcauauuugacagauuugaauguuauuggaaugggucugacaguguugucaugacuggacccuacaauaauuucuucagaauguucgacaggaacacaaagcgggauauaacucuagaaacaucacgagagaacaauaagccucgaacaguuuugaagccacacaaagucugugcaagcggcaagagaaagaaagaugaaauaaguguugacagccuagacuugaacaagaaaauccuucauacagccuggcaucccaaggaaaacgucauugcuguagugacuacaaacaaucuguauauauuucaagacaaagugaauuaggcuggcauucucugcaguggagccauuuccugcuuagggagauaguugaaucuagcauucauaccuauaaaagagugguccauuguggcgccccuuuccaguguuugacagugugccauucaacaacacauuugauagccucauggagaaagcuguguggcugcaucccaggcuguuuuccgugucugcuagccauucagggaagggagggaagggcacuuuugauuuaaugauuucuugcaccaucuggccugguggacuggaguggacugugucagcaucaauguacuccacuuuuuaugccuuccauugugacgacaucaaacacagugaacacuucagucaugcuauggaauuuguguauccucauuacuguaucauuugugggguacaauccuccccucuuuuuuaaauuaaauacagcucauucuuaaaaaaaaaaaaaaagaacacuugcuggacuugcagaggacauggguucuguucccauauggcagcucacgagugcuuacaacuccacuucagaggauccgaugcuuuuaguacuugaacacagugcacacacacugcaugccuagugccuacagaagccagaagagggcgucgaauccccuugaacuggaguuauagguugugagucuccacauaaaugcuaggaaaugaacccaguccucugaaacaacagccagugcucuuaagcacagagccaacucuccaggcauugaucuugagcuauacaauggcugauuucaagucuaaacuuucuguuggaccaugaaucuccauuucaccuuacuaccguauuucuuaaaauacguaggaauauaaucucuuaaauuuaagccacugcacuucauuuugcaguggguauucccaauuuucaaccuaaaaugucuuucuucugccuuguuaauguccaguccaagcucaaagccuacuucaaacuuucucugcuccuuggagugugcauuccuuuaaguaguccaauuacacuggucuuucucugcucccucaacagugaggacuacaaaguauaaccauucguuguuccacgacuauuaaguguaugcugguuuugucucacuaaauaagauaucccaagaggaucaagaaaaugcuaaacauauaauuaauauuaaauaaaagcaaacuucauggcugauacaguuauguuccaaacuguuaagucaguuuauuagaagcuguggccacuaaaaagcaaaccaaccucacacaaucuuuacccugccaaauuuaaagccuaacaguuacuaaacaggaugaaaguucucuuuuuagcuucuaccaguuuaucuacaguaauggccauuuuagaaauuaaguggagcugcaacauuccuuaauccccaccucggagaagcccuuccaggucaagggaaaaggaagugccaggguuuccugccuguuacaaaaaaaggcauguuucacacaaagugagccaucugcucagucuuuuuaaccaaccuggggaauaguaauugccuacaaaaagccaaaaauaugacauagaggacagacacaagaauucuguccuucauuauaaguuaaaaacuaccagcaagcaggaggaagcaagaagggcaaaauggaaauuuuuuccccucuaagaguaugguuuguuuugcuuuuuuugcuuuccaagaaaauccucaggucaccuuuuaauuuaaauaucaguaugaauaagccagugugcuguuuauuauaucgaguuaccugaagugugccuccccugacucuguggcauccucuggaagagaucaugguuguauucauaauaucuguaaucuucuugugcacgaucuccaaguggccgccuucucuguccaucaaaaaaguuaucugagaagaaguaucgggagccagagucuccauucucaacagcaaaguuaacuucugucaaaaaugacugugaugagccacacucucgagggacaucugcuaggcuccugacaagguaagaaggggcagacagucuguggcuuucucuucucauuacuucaugagguguccuuugaauugcaguucucaggaaacucugguuucuugaaacuacaccaucuccagaagcugagaaagcaguagcacuugaaucuggaagacagaggucaguccgucugggaauuguuggaccgugccgaaugaaugaaggcaugagaucuauaauaaaacaaauauaaucaccauugcauuaagucaguacacucgucuaaaguuauuuaugucuacuauccugagaucaaaauaucaaacaaaagggcauaagaaaacagauuuuaaauuuuaagacaauacuagaacuuuaaaugaagauuauuuucccaagcaaauacauuuauaaucugcauuaauaugcagguguaaacucagcuacaaacgaauggaugcugcauauugccauacaugauacaaugucacuaagcugaaaguaaccuaacaaaccaauuccuuuaccagcaucauguaugacuacaguuugguguuuucacuugauuuaaguaucaccaagaaucuuucuucacaaacacaucucauuaaaauaaaauuuaaagaaaaaaccgcaaagucagauuuccuguaaaagacuuuuuuauugguaauuuuuuuuuuuuugucuuucuaucaggaauuacccgguucuaagcacaauuaucaaaacuagaaagcaagaccuuucaguguggaaacugaaaaauaaagucaucuacuuccaaagaugcacacaaacccuggaucuacugaaaaagccuggaaagaauuauggcuccuuuaaaagcagauaacccaaaccaaggucauggcugcugauuugaaugugcaaacagcuuucauguucuuagaaagcaacuaccuuuaaaauaugaaaccuggauauagaacacauuuucugaauucauuaaaucaaugucacuaagggugucagaagcuaacacuacaguaacuuaauauuggaauaauuaacugucgaugacacaaauucuguauggagucacucacuaaaagacucaacaaguggcaugacuucaaaugaugcuuaauaaacuuuauuugcagcaaaaagcaagcuaucaccuaaaaaaaacagaaaaacaagcucuuaaaaaugguuucaguuacugacacauccaccccaccaacuguguugucuagcacuccaacuacuaacagaaccuguaaggcuggacacauggucacaauggaaaaauaugcucuccaccccuuucugcgggaucuugggcaaauacuaggaaccccugugagcagcuuucccaauuacaauaugagguaaugcuuaauuuaagucacacgguuacuuccaguuuccaagaaggaaacuuacacaagggguccagcuccuagaaugagaaccaaaggauuagcucucugacuacccaagaauuuuaaaaaaggagaaucaaggcguucaaguuaaaaacucaaauauuuuaaacggagaagaaaagcuacguacgggaggggacggaacauaugucggaaagaggaauaaaguuaggaacuugccugguauggcugaaauuauucugaauacuuugcuuuuuuuaauuuuaggagcaaagccuaauccaaauacguuaauggcuugucuacucugggaaaugaaaagacucuggguaguggcuacaaguaucagguucuuugccucacaagucugugucccgcugaaggacuaaggaauccagucucucucucguguguguguguguguguguguguguguguguguguguguguguguguguguguguguguguguguguguguuacuuagggcgcugguaguggcuacaaguaucaagucucucguguguguguguguguguguguguguguguguguguguguguguguguuacuuaggacgcugguaguggcuacaaguaucaaguaucagguucuuugccucacaaguuugugucccgcugcaggacuaaggaaggaauccacucucgcgugugugugugcgugugcgagugcgugagccgacgaguggcgcugcgauggucgcaaacgcggggcccggacguacccagcagagaggugcccgggucgaagcacuuuuuccccaacaccacggacagccaugcauuucccagagucggucuuccagcaccacccgaggcugcgccggguccccacccgccaccgcccacgacacucacuccgcagcaggggcgacgucuccuucuucacguacuugcccugcaccucggccggcuuagacaccucguuuuugguuuucuugcgggacagcauccucgcggacgacucccgccgccgccccagcagccucgcuagggccgcgagccugccgcccgccgccgccucccgggccgccgccgccgccuucgccucgggucuccgccgcccgcgcccgcccgcaggcuccgccgcauguuggccgcgcuaagcgcgcccgccgccgcucagucgcagggcagcuccucccgggaagucagccggcucaacgacgccgcccgaggccgccuugggacagggccgcggccgcccaccagggccaugguccgccgcccggagccgcuaccgcugcggccaccgccuacguccgguaaacuuuccc

SEQ ID NO: 6681 - RNA, 1046 nt, Mus musculus
gacguagcagaagcagauauaauuucuacaguagaguuuaaucauucuggagaauuacuagccacaggagauaaaggugggagagcugucaucuuucaacaagagcaggagccacaggagauaaaggugggagagcugucaucuuucaacaagagcaggagcgccuuugaccugaggaucucaaagugcuuuagaaacacuaaugaaugaauccucacaacaccccagugagaacaaaauccagucucauagcagaggagaauacaauguuuacagcaccuuccagagccaugagccagaauuugacuacuugaaaagcuuagaaauagaagggaagaucaacaaaauuaggugguuaccccagaaaaaugcugcccaguuuuuauugucuaccaaugauaaaacaauaaaauuauggaaaaucagugaaagagacaaaagaccagaaggcuauaacuugaaagaggaagauggaagauauagagauccuacuacagucacuacgcuacgggugccaguauuuaggcccauggaucuaaugguggaagccaguccacagagaauauuugccaacacccacacuuaucacaucaacucaauuucuaucaauagugauuaugaaaccuacuuaucagcagaugauuugugaauuaucucuggcaucuggaaauuacagacuggaguuuuaauauuguggcuaucaagccuggcaauauggaaaagcucacagaggugcucacagcugccgaauuucaccccaacagcuguaacacauuuguguacagcagcaguaaaggaaccauucgguuaugugacaugagggcaucugcgcucugugacaggcauucuaaacuguuugaagaacgugaagaucccagcaacaggucauuuuuuuucugaaaucaucuccucuauuucugauguaaaauucagccauagugaaugaugaugacuagagaguauuugucagccaaaauuugggacuugaauauggaaaacaggcccgugaagacauacaaggcaccugaauaccucagaaguaaacu

SEQ ID NO: 6682 - RNA, 14965 nt, Mus musculus
cggccgccagagcggaaguggagcugcggcggggagguggagcgggaacgcgcugaggcugggugagcggcugacauggcgcacuuggggcgucuuaugguuccccuggcagcucugguccugcugcucugggcggucccuggggcccacggacggcggaauaacgugcgcguccucaccgaugagaacuggacgucguugcuggaaggagaguggaugauagaauugugagugcggggcgcuugucuggguggcgguggccuccgccgccccgucccucaagcuggacaccugaccagcccaucuuccucggccaggucuugaggucccagccuuugccgcccccagcuccagggucauuuccuaaccgggaauauuacuuuucuaucuaagcgugcacugagccucgucguugcuaagcacuguggugcgauuaaaggauuacgagcuacaucgaauucucuggaacagacuagcggauuugagggugggauuggguugcgauggaggucuuggcuguuucuauagacuuuuagugaucuuuuguagacauccagacuuuaagucuccaaauuuuuacaaaaguugauauugaacaaaaucuugcuuuuaaccugucauucggaaauugcuauguuuauucggaaauugguauuuguaaugccugaauuuugagcucuuuauuuauuuuuauuuugugaguuaguuuuuuuaaauuguaaaugccaaauaaaugggaauauauuaaaaucuuuauuuucuuuuuuuuucuucuugccuacauucauuucuuuugauaugaaccucauuuuuccuugaccggugcguuugcaauuuagagaauggcuugaauugugauuuacaggccugcgaaugguauugcacaugcauuaguaugauuauugauaggcccuuuaaauacuccaguucaucauuuacuauucaaacaaaaucacuuaucuugugugauaauucuacuucaacaguguccgccguccugcugcuguaggaaauaaacuaccuuuggccuuugucuuagaugauaaauuaguggaaugguuaauugacaguguuccugauacggcauuauugauguggcgaaagcaccaccauugaauggucauuguuuacugacacuacccaguaucuuuacauauguuuugggguggguaauuauucuacauaauuccuuauaguagauaaccacucccauccccugcuuuaccgauuggccuguucagaugcugucauaguagcuuuguugggcuucaagaguaaauauaugcaagcguuguuagcaacccuuaagcaagauucugguguuugccuauguugugauuguguuuagggcuguacacuaaggaagagguggaagugaacauccucaagagagaaccugggugagguccaugauaccugaguugugaaacaagaaaaaggagauugcaguagggaagacguuuaguguacugacaguuggccguucacugaagucaguuuucaggagaggaacgcuaaccagugcuguuaguuuucagucacugucaugaauaggcaggagugacaugauauguaaaauauagucaaauauuacagaaagauaccuauaagcuuucuuuugucacacuguaaauauccacaaaggguauaaaggggaccuacaguagcauaaugcugagauaaaaacauccaucugaaaugacagggucccaugcuucccuuuaucuuuggcuaaaauuugggaguuuaaagaagcucuuaagggcauggagggguggugcuggaaggggucaucuaucaggauguaaaguaaauaaauaaauaaauaaggggaggaagcucuuaaaaagcauuaggaaacaauacacuugauagucauaauauuccuuagcuacaaaugaguucucugcagauucacuucugaugagcuuuguuauagagcugcuucuguaguuuuacuguuaaagaguuuggcuuugguauggaacacugguuuugcuuucucuacaugccugcuuuagaagcuuaauuuuucuaaaacaguucagaaguguuugaauaugcguaggcuucauucuucccgguugcaaauuacaacgggcaaugaaauggaaaacaaaauucuaaggaaaaacuuggaccugcaaagauagugaguuucagagauguguuucgaguacuggcgcccuuggcuguugguaucauggugcuagccaauagaguugcgucuccucugcucgguaucugugugaggguuagguuuagaguaauauuuauacauaagaauguaggccuccagcuucgguuacugugaagaaccugccuugcugaggcaaucccugauggcgagcgauucuucccagcagugauuguauaccgguugcagcauguagagcccagguacucccuguuuuuccaauacuuugcucaugacccugcuuguaaaauuacuuaacauggugagcuuaaacaaacaaaacuuucugguugccauguuuuaauuggaaaaucuaaagguuuuggaagagcuguuugacaucuuagaaaguucacguguauuuaagaauguauucucaggccugcuuuuuuuuuuuuuuuuuuuuuuuuuuuuuuuaaaugugguucuguugagcauuucuucacguccacauugccaggcucaugcuuucaauuuuuuucaucugcguaaaauuacccaguuuguuuccuuguucaacccaagaucacacucuguaacccaugcugggcaugcacucaguaauccugccucagcucccuaaauugggauuccaggugugaggcacccaaaugggucauuuucuguguuauaaacauucuucaaaacuuaugccucaacuguucuucacgguuaggucacugaaguacuuaacuuuuaaaacuguaaccgucuuuuguaguuaugcucccugguguccugcuugucagaaucuucagccagaaugggaaaguuuugccgaguggggagaagaucuugaggugaaaguugcaaaaguggaugucacagagcagacagguauuacaggcuggcugguucuguuuccuugcuaaugcuguuuaucauauuuugacauuuguuaaugaugugucaaggcucauaguuugauaacauuuuccaauuuugagcaacaauaagacuaccuagguucuugaauggcaaaugcacugugauuugagauguccuucagauuuguuuuuacuugucuaaucaccacuagucaauuacugugguaguacuaauucugcagguacuuaauuauucacagauaaugucagcauuuaggcuucauaagcuuuagcucauuuauguacauuaaugugucuuuaaaguucuuuaacaacuaauucauguuuucauuguugacuauguuuagguguuuucuuguucuuauuagcauuuaaguaauuuaaaguuaacuuuuaaguaagcaauugucccuaauuguuguuuauuccuugucauuuguaggacuaaguggacgguuuaucauaacugcucuuccuucuauuuaucaguaaguauuuggagguucuugguuggggagaggauuagaucacaguguaaugagagcaguaggccucugacucgcauuauauuugaagagcuuagguaaucucauauuuagcaaggacuugagagcuuuauuugauuuuaguuaguggcacauuaagucauagaaauaauagucgaugaaugauacauaaaacacuccuuguuuuggagauuuguagugucuguagacgguccucagaauugguaugguucucuaaaauaucaucaguaacuauuagcucagaguccuaacgaguccuguaggaagccgggcgaugggagaagccacaguuggucagagcaguuccuggagaacaugaguuuuaaacgaaacccugggacuagauagaauucucacgaaugcaagguaaacaaacauucuuuucugaguaaucuuaagcaggaggaacacggucugagaaaguauggguuaugcaggacacugagugaccgugaguucaagugaacacgucuuggcucugccucuuugacuguuucccaaacuacacuaacccagagggagacaaucucuguacuugaccuggacaucaguguaauuagcuggugacuaaauaccaggaaggacuuauuuccucauuuaaaguuacagcaggaauuuaaaucuuccccuuuuuuugucuuuuuuauuuuuuuuuuaaacauuaaaccuuauuucugcauuguauaugagaaucaacaagauugacaaacucuuagccaaguaaaacuagaggugaaaagagaguacaacagacaccaaagaaguucagagacuauagggacauacuuacacaucuguacuccaucagacuguaaaagaaggagaugaauuucuugauauguccaguguagaaauuaaaucucccaaugaacaaaaguucagggccagauagauucagugcagaauucuaccuaaccuaaaaaagaauuaacaccaauacuucuuaaaucauuucacaauauugagaguaaagggaugugucccaguucuuuuuacaaagcuacauuacccuaauaccaaaaccacacaacccaggaaagagagaaaaguauagaccaauaguguccuuuauggguaagaugcaaaaauuaucaguaaaauacuugcaaacugaauucaagaacauaucaaaaagauuauacaucaugauuaaguuacuucuucccagggauccaggaaugguucaacauuguaaaucagggaauauaaucuguuauauaaacaaaacaaaacaccaagcaucacaucauuucauuagaugaaaaaaaaggucuuuaacaaaauccuaagccccuucauaauagaagcucuggagaaacuagggaugcaagggacagaccucagcauggugacugcaaauuauagcaagcccacugccagcaucaaccugaacagaaagaaccucaagcauuuccucuaaaauaauuaggaacaagcaaaggugcucacucuccccauaccuguccaauaugcuuagaggagucuuagcaagaggaguaagacaacugaaggagaucaaggggcuaucuacaggaaaggaagaggucaacuuggagcugauaugacuuauacagaaaagacuccagaaauucuaccagaaaacaucgauagcugaugauuauuuuagcaaaguaagcaaaauacaacauuaacacacaaaaauuaguagccuuccuguuaacaaauggcagacugagaaagucagggaaagucuuucacaguagccucuugggauaagugucuuauacaauaaaaacgaggacaagucugcagccuuugcuccaccaacccucacacucucaacagagggcauucuguacuagacgugaauucucagcccccagagugugcgcagugcccuccucacaucaggguaagaguccuuuacccacagcaaggcugugacugagaugcuucgugaguuuauuauuugaaagaauaaagucuuaaagccugugguguucuauguuuggggcucugacgccucaguacauagcaguguguucuggugcuuugcuagguuucuuugaagauuagaauugacuguaaacugaagaaaugguugaacacaauuauuucuugcugccaguuaauauuuaguucugaucuuuaguuguaaagauggugaauuuaggcgcuaugugggcccaaggacuaagaaggacuucauaaacuucguaagugauaaagaauggaagaauauugaaccuauaucaucaugguuugguccaaguucuguucuguaaguaugaggacuaucuuccuucaaaauuaacuacagauaauuacguuucuuguaaaugaagcaggcaugcuguuucuuggauuuuuaugcuauguauauucagauauauguuuacugugaccaguaaaagauacuuucauucgugugaggcaggaguaggcauuugugggaccacauugaaugugcuucucagacuauuuuagcuuugauuuggcuaaauggacuugagaacuugauccuuuagaaacugagcagcaucaucgguaaggaaggccauugcuugauccuaauuguaauggaguaagaguauuuggucauguacuuuuauuguuaaugugaaguaacuguguuuggguggcuacaccugauaccuuguaugaauaguaugucugacagugaauaaugauaugagcuuauagcuagaagguagacauauuugccauagcaguuaggcuugugaauggcaaguguguuuccaugaacccagugcuccaucugagaaaccuggcagguagacugugcuaagacuaucauggucccauuuuggugggacuaaauuacuccugaccuuccccauccuugccaucagaagauggagaguugggauaccaacuguaagaacacagagcugcuguggauucugggaauggggaaagaagucagcccuuguuguauuuggaaguaguucauccuuccccuucugucucuggaugcaaaacuuguaauuauccucagcugucagaacagugagguuguaccuuccaguuccacuuuugguuuuggcacggcuucccuggauaacccagauugaccugcagcuuugauucuuugcccuggccuccaggugcuaggaucacauuugggaacuaccacaccuacuugaccuuuaaacagcacaagcaaugugauuuugcuuuucagugaguuguuguacucuaguagagggcugugccugcuuuagugucucuugaauccagugcagcagcuuguccuauuuuauuaguagacugaagaggggggcugcuccaaguugagcaaggcuacucuacuuaucuaagcaguuugguaguuggguuggaaggagcuacugugggcuuuuguaugaagaagccuuaggcagcuccaguuguacuugcuauaggaaacucauuguaaacccaacaaauacuuuuuauuauuuaacuuuaaaacaaacaaacaaacaaaacauccaaaccacuugcauuuaacaaugugaaaguaguuauuuuuauuuauguauuggcuuaguguuuauuuccuguauguuauuuacaucucauuaaaggcucucaauugauuaaucugaacaagaaagucuugucauguuggagaaccuaagaguggaaagugcaguguguagacauaggcaaagcuguaugucuuuguucaguuuuucauuccucuguuuuuuaggaugacuaugaugucagcacuuuuucaacucucuguguacaucaggguauggaccagcuuuuuccaucuuaaccauuucuaacacuuguuuuuaauuaaagagcauggucuuacuuuguuuaucucuauugcagacuagccacagcuauuuuguucaugaccuuggaauaccagcgugggguucauacuugguuuuugcuuuugccacaguacucucaggacugcugcugggacuuguaaguacuucuucuucucuuuuuuuuaaaauuaaacuaauagaauuuauuuuaaaauauacaacuuagaauugacauuuuuuaagucaucaaaauaauuuauaaucuuaaaugccuccuaaauauacaugauaucuugugaagcuaaaaguaauaugcacucaaccaguuuuuaaaaucuguuuggaacauuaaacaugauagaaguacaaaaacaucucuuaggaaauccucuaugaaaggaaauugugacaaguuccugauuagauagaaaccauuccauuuccaaggagaauauacagcguaauuguggcuucauagaaugaauuggguagugucccuucuguuucuauuuuguggaauaguuugaagaguauugguauuaggucuuuuuugaaggucugauagaauucuacacuaaacucgucugguccugggcuuuuuuugguugauagccuuuuaauaucugcuucuauuucuuuagggguuaugggacuguuuagauuauuuaucugauccugucuuaacuuugguauuugguaucugucuagaaaauuguccauuucauccagauuuuccaguuuuguugaauauaggcuuuuguaguaagaucugaugauuuuuuuaauuuccucaguuucuguuguuauaucuucccuuuucauuucugauuuuguuaauuuggauacugucucugugcccucugguuagucuggcuaaggguucuucuauccuguugauuuuuuuuuuuuuucaaagaaccagguccugguuugguugauuguauaguucuuuuuguuucugcuugguugauuuuagcccagaguuugauuauuuccugccaucuacuccucuuagguguauuugcuucuuuuuguucuagagcuuucaggugugcugucaagcugcuaguguauacuuucuccaguuucucuuuggaggcacucagagcuaugaguuuuccucuuugcacugcuuucauugcaucccauaagauuggguaugcuguaccuucauuuucauuaaauucuaaagucuuuaacuucuuccuugaacaaguuaucauugaguguggcuuuguucagcuucaauguguaugugggcuuucuuuugguuuuguugcuauugaagaccagccuuagucuguggugaucugauaggauguaugggauuauuucaguuuucuuguaucuguugauuccuguuuugugacugauuauauggucaauuuuggagaagguagcaugaggugcugagaagaagguauauucuuuugcuuuaggaugaaauacucuauagaugucuguuaaauccauuugguccauaacuucuguuaguuucacugugucucuguuuaguuuguguuuccaugaucuguccauugaugagagugagguguugaaguccccuacuauuauugugugaggugcaaugugugcuuugagcuuuaguaaaguuucuuuuaugaaugugggugcccuugcauuuggagcguagauguucagaauugacaguucuucuugguagauuuuuuuccuuugaguaugaagugcccuuaucucuuuugaugauuuuugguugaaagucaguguuauuugauauuagaauggcuacuccagcuuuuuucuugaaaccaucugcuuggacaauugauuuccagcccuuuacucugagguagugucugucugugucacugaggugcauuuccuguaugccaugcuggguccugauuacauaaccagucuguuagucuuucuuuuuauuggggaauugaguccauugauguuaagcgauauuaaggaauagugacuguugcuuccuguuauuuuugauauuauuuuuauguuugugucuaucuucuuuuggguuuguugaaagauuacuuucuugcuuuuucuaggguguaguuucccuccuuguguugguguuuuccuucuauuauccuuuguagggcuggauuuuuggaaagauacuuuguaaauuuguuuuugucagggaauaucuuguuuucuccaucuaugguaauuaagaguuuugcuggguguaguagccugggcuggcauuuguguucucuuggggucuguauaacaucugccuaggaucuucuaguuuucauagucucuggugagaagucugguguaauucugcuaggucugcuuuuauauauuacuugaccuuuuucccuuacugcuuuuaauauucuuucuuccuuucuuccuuucuuccuuccuuucuuccuuucuuccuuccuuucuuucuuucuuucuuucuuucuuucuuucuuucuuucuuucuuccuuccuuccuuccuuccuuccuuccuuccuuccuuccauucauucauucauucauucauucauguaaguacacuguaguugucuucagacacaccagaagagggagucagaucucguuauggaugguugugagccaccaugugguugcugggauuugaacucgggaccuuuggaagagcagucggcuuucuuaaccacugagccaucucaccagccccuuaauauucuuucuuuguuuuauguauuugguguuuugacuauuaugugaugggaagaguuuauuuucugguccaaucuauuuggaguucuguaggcuucuuguauguuuauggauaucuuuuucuuuggguuagagaaguuuuuuuucuauaauuuuguugaagauauuuacuggcccuuuaaguugggaaucuuugcucucuucuagaucuauuacccuuagguuuggucuucucauuguguccuggauuuccuggauguuuuagguuaggagcuuuuugcauuuuuuuuuuuugacuguuguggcaauguuuucuaugguaucuucugcaccugagauucucucuucuaucucuuguauucuguuugugaugcuugcaucuaugacuccugaucucuuuccuagguuuucuaucuucaggguugucuuccuuugugauuucuuuauuguuucuauuuccauuuuuagauccuggauaguuuuguccaguuccuuuaccuguuugguuauguuuucuuauaauucuuuaagagauuuuuguguuuccucuuuaagggcugcuagcuguuuaacuguguucuccuguauuucuuuaagggaguuauuuauguccuucuuaaaguucucuaucaucaucaugagaugugauuuaaaucagaaucuugcuuuucugguguguuaugguauccagggcuugcuguggugggagaacugguuucugaugccaaguagccuugguuucuguugcuuauguucuugcccuugccucuagccauucgguuaucucugguguuagcuggucuugcugucucucacuguggcuuauuacuccugcaagucuguguuuuaguacuccugggagaccaguucucuccaggaggaauuuggguauggaaaguuguggcacagggucagcuccaggguacagauggaaacuggagggauccugccuuggcuccugugucccguuggcucugggugggucauagaaaccagaaggauccuguccccagcugauccuugguccugugcccugacgguucuggucaggucccccuugggcuaggaauuugagcagacgugguggucuuaucugugcucacaggcauguccggacuccugggagaccagcucucuccuggaaauauuugggcauggagugcuguggcacaggaucagcuccaggcacagacccaaguacuucauuuuuagaguucuaagaaaaauacuugaggccaugauaacauuguuaguacuaguuguauugcaugucauauauuuagauuucugcuuauuuugcaguguaugauauuuguagcagauugccuuugcccuucaaaaagacgcaaaccacagcaacaguaugcaaguaaguugauguguucauuauguguggaaguggggcuugaguuuugagaugcaugcaugcuaggcaagcaccaccauugagcuacaucuacuccacgggcgacacugagugguuuucauuucuauaaauauugucaccggcugcucugagccuaggauauuaaaugugaaggauuuaaaggcauaaagggaagugagagaugaguguuucauguaaaaugguagcaccagaucuuggaacguggucauaauucagagaauguuauaguucauguagcuguagauacugaaaauuucuuuguccucaacugauuuuccuuuuuuccccugauaguauaguaggaaaaucugauuaaggauuaguguuaauggugaacuaugcuauaaaauuagucuacauuauuagaaauaguuauucauuacuaauaauauaauuuccucacuguucaguucacugcaccuuuaacuuggugugcacugaacuauucucuguuaaugugaggugaacacagaaggccauggcucgucauccuagagucaggaaagucugguguaguccacuauguaugaagcuugcuucuugacacuugcuccauuuacacucaucagguuuguuugcgauggagugucuuuguguauauccaguuguauaaugcugaauggucagcaguauuccacuagugcccagaguucugucccuaucagguaugacacccaaaagugucuccagacauuacuugguguucuuugaggggucagaguccuucuggguaagguacugcuguuguagacuguacuacucacugaaaucccauagggaugacguaggauaagaauaagucccagucugaagaggcaugccaggcuguccgcauugagcuucuucccauagcuugcuauguuugcuaacccucccugcagugguggguugcuaggaucggagcaguguaggauauauacaguaaauaucuuugguccaguucucacuucuguaucugucucuuuaacacauugugcuuugaacuuaauuagcuucaagcccucuaaaaaguagaaaggcuguacuuggguguguguuugaggcuucuccauuuuauuucucacaguuauaccuuaguaaauuacauagaugaggguggggaaagagaaaauaucugggcaagaaugcagcuuuuguaaguaugugauuuuuuuuuuccucucagggaccugagacaggauagggcugaaguuuuaguauacuuauagaccgaaaauuaacuucaaguuguaacaagaugggucuguuuaaugcaguauauuuuaucucagcuucuacguucacugcauugauauugauucauuaauguuggguuaggugauuugaaugugauaaaugaaucuuuguauaauaccugcuuuauucucuuugaaaaucuaaacauaacugucagggcuuucgaguccuucugucguaauuuuacucuaaagcaaauucaguacauuaacuaaagugcauuucugaucuuuaagaaaaaacaucaccagaauuuucucaaccucugaaaaaaguggaggaagagcaggaggcugaugaagaagauguuucagaagaggaggcagaagauagagagggagcaagcaaagccacuucucagagcagcauaagacaacgcugugugggccucccaucugccacggacacauccuaaguuuuacauauaucuuaauacuaugacuuuggcaaaacugaagcugggugaucauuucuauugcgagcugaacuaugacuugcuguguauacaguguagguccuuuagguuggacaguuuccauucaggaaauaaaaacagacauaagaguuugaaaauaugacuuaagaauauuaugaugguuuaaaguuauuuaauuucagaagauccuggugccaagcaguaagauuuguguuuauauuuaauaaucuauuuugugugagauucgaaacugccuuucccaagauuugcauuacuggaguauuuaagaaaauuaccuuagagagaaggauuucucauuucacaucauuuuucucaguuucacugugugaaaaaggaucauauuucccauaagugggaacauugcccauuauuucaagacauauacuucauugauaguacugcacuuagguagaguccaaaauuuccucauagauuuuggauuaugcagcuaacaaaacuaccuuacuuuauagcuuucauuucuacacauuacauuuaggcuauguugcugacuuaagaaguuuuuauaagucuauauggcauuggauuaauucuuaaggcugacgccuauuuuggugucuuguucacuguaugauuuuuguuauuugccauguguuacauuucuaaguuggaaaaaauuaccaguaucacuguuguguuugcuauggguaaacagaacuuuucuauccuuuuaggaugaaguuuacugagagaaccaucaaaucgaacuguuuacuugaaaauguacaaauuuggcuauacauuccagauuuuaaauuauuauucugaaguuuucucuuuuuuaaugugaagaugaaauuuucugauuuuuaaaauuugauguggaaaagcuuugguauuuuauauuuuggaaauucagaauuuaauugauguagaaugaagucugcauucuacucaagaaacaucuacuacuauguguuuuuaguguaauucuguccuccacggggucuugaugaauuuuauaaucaggauauugcuuuguguuugaauauuguaacacuauuguguuuuaaagacaaauuauauauuguauuguuguugacugcuaguacuguguaucucacaaauggaaacaagaucggcaaaaggacuacauggauuucaucuuacaaagugggaaggguaucaugggggcagggacugucuugaugucuggagggggaaagcagacugaauucuugaugagucagucaccagccuuuauggaauagauggugucugugacacucccuccccuuauguucucugugugacuuccuuagacuugcaguacugugaugggcaacagcuucuuuuaggccucuccuuuauaguuuaaauguucugcugucagaguuuggauauguaguuugugguggcuuagaaaaacauucuaagcacaaaauaaauguuucuaagcacuucagugauguugaagagaaguuugauuucuguuaguuucuuuucagagucucguguaucccaggcugaccuccacuacugucucgccaagcgugacggaagcaaugggagcacgccaucaccaggggcccuccugcaugcccagcaagccgagcucagucuccggcccaggagugaucgcuggguuccuguugaaauugugcuuaaucauuugccacucgguggugcucgggggcgugaauggaugugucacugcaugugugcuuccuguagacccagacacuagucuucucgaucaugucaggagaauaaugcucuguaggcaacauuuuuuuuaguguuuccguuguaucucuaacauugucgggucuuucauuagaaaaugcuuuauuacagaaaauuaaaaguauccugaauuaagguguugguguucucaua

SEQ ID NO: 6683 - RNA, 2717 nt, Mus musculus
guaccgugaagaaaaauacaauuuacuaucugcucuucuuccccugaggaccucaggaccucgcuuccacccugggguucacaggaauccugugggggcggggaaaaguaaugccuccugcucccugcaggugugcgggagcccgagccaggcacagcgaagagcaggaagacugagcauaaacacacugaugggugaaggagagggaagcgugcacacccauuuucguaugggggggggggcacacuggacccucacaggcccuaaggaaggaccugugcaucaggccgauuagcaagugugaaauucucuuucaacucccccaagccuuaagagagucaucuuccuguacccccggaacuugacaaagccuuuuuuuuuuuaaaucaggagucucccuuugaaaugauagcugcaagcauuuacauccaaaacugcauuaaacuugaucccuguucaguaagaagucagaggagaagagcauccauacagagcgucagccuugugggugucauagacuugcuggucccacucaguccugggguccaagcacaggggaacagcaggcagccgggccaguggugaagcauaguucuggaugagaccagugugcugcgaaucugacugugucacuuucuagacaucguugggacagcucucuuccugcucaggcuucgguuuccucuuaucuauagcugagaaaaugauagaaacuccaucaggggucauuauaagaauuaauuaggacucuauguucccuccuaaguaauuuuauauaugugauuguaugcuguuccucacaauaagccuuugaagaaaguccuacugccacucacauuuuaaugaggaaacggaguuacagaguggcuacuugccugaggucaccauucaaccaggcuucaaacgcagagcgucugacuccagggcaaacccgaacacucugacuccccuccccaaaccccucuauuucugguucauuauugauauucugguugcuuuauugauagcugcuaaagccaaauggaugguggguguuggugaacucuuguuuuuuaucaugaagguauacugggcacucggccaaguuacacucacucuccuggugcuagggcgugaagaggggaggguagucaugcagccugugucuaaggaacauuugcuaucaagagggagggagagggaaggagggagaaagagagagagagagggagggagaaagagagagaguaggagggagggaaggagacuugcaggauagaaaagaaccagguaugaagggaggacagaaggcagaauugguggggaccggagagaacugagaaguaauggugugcuuugaacacacugaaacaguccgaugucugcucaguuuuugugauaaacugaacaaggccuggggaccuucaauagcaagccuaguuccucagcaagaugucugggaaggcuuagguuugugacccagcccugcagccugcacugccugcucugcaccaccgucugccugagauguagguuguugcugcuagcucuucaagagcccaaacgcugcacuuaggagccugaguuuuauucccugaugaauggaaauacccacaaugcccaucgguucugaguggacaggagguaaauccugcugguaucucucuaucugcacacccccuagcuguggacagggcaccagugaacuagguuuuucguuuuccuuuaugcaaucagagcaucuggaggggcucuccugcagccccugcuaugucccacacacgaaaggaucaaagcccugagcuagucuucagacuauaauuuaagauaauuaagguuuuuuuuaacuaaauuacauuuuaacauuucauaacagagcugucaagauccuaucuaucaaaaaacucuaucaagcaaacaaaaggggggcuaauuauauuuucagacacaugcagccaucacucugugcaguucucauuaaagacuucugucuuccuucacacucucguuuucaaauguccuucaucuaccccucccaccccuggagucagagacuccacacucuuaaauaaaauaaugggaaguaugucagggcaguguaaugaaugcuauggcaggauuacucagaaacagguauucuaguuacaaugguaucaauaggaaagcucuccuacuugguucgggcauugugccucacagauacauucugacuagggcugcagaaaaggugagcaugcugcacuccucagaugggaaaaaugaagccaaaagcuuccuacuugaagcugaauuuaccuucaucucauuuccgugagauuguuuggucuaagauuuccuaugagauacccagggaauacuaaauaccugaauaguucauucuuuucaccucgcccccuaagcauuagaaaauaguuauacugauaaaacugacucuuaccucaagaccuccaugguggguuaugaauggccgaaguuacuaagcauaguuguacccacuuuaagacucugaauaagccagacauggguaaggaacagaugcuguggccaauccgcguaugguaucucucagucgcaguaacuggacaugcuggucacaugaucuuaguugguccagucagaauugagcccccaaguuucguuggcuggaggagaaagacaugcacucccuuuggacauaugguaagaggacacugauguuacacagaagucccgguuugcuggaguguuugagcggaagg

SEQ ID NO: 6684 - RNA, 2229 nt, Mus musculus
cagucucccuucuggcuuccaccagcagcaucucuggucccuucccaggucugcucccagacugcccuccgugacuuccaucucuugacuucaaccacuucaugguuugaacugcaccuauccagugccgucucccaguacagagggagccuagccauaccaccccccagcccccagccuuggauaccugcuagucaccucuaccucccuguauuuagagcaccucagaucauuaucacaacauucacuucuaaacuaacuccgccugggagucucccuaucagcuugugaggccacggucuggccccgucccucacccccuuaagccagaaauuuggagauaauuuggaaauaaccuuuuuuuuucaguguugagaacuaaagacagagccacugggcaacugcucucugucuaagcuuugucuccugcccagaagucauccuugauacuugacagucggccauuuaguagacccucuuaugugggucucccagauguuuccagguauuuauuucaccagcauccugcuucuagccaccauugucuuguucuuaaacuacugcacugucauccuaaccugucuccacauguacagggagaugcauggaaaucugccuccccaucucagagggaucuguguacauuuuugaacugccuuuccugaaaucuccagggccucuccacugcuuccagcgggagcuccagcccuuugguggccuaugcaaaguacccugagaucucgaaacuguuucugguacgagcgucuccuucacccucuguggccaagcucuccagcagcaaagaaguacuguggucccugcaggugacuuacaguuccuccacucucaucagcaugccucucuaaggacaauuuuuuccucacccuagccacacuccucuacccauucacacuuaucaggaucagcacagaccugcaagcagccuggugaacagaaagugccucaguggagaggcccgugucucacugggggcuaaaauggucauugacggcacugagguaggguccaaaggaguuuuccuugguuucuuaacuacuacgguuucaucuggagguauggguucugacuaccccauuuccagauguauauuuccaaccauuuauucuugcaucuauaccacauuuugcaguuucuugggaaagauaucaucaccuaauguaagcacugggccugugauucccucaugcaauccuaauagucuccuguuugcaaaaugagauuuaccagccacccacugcagauacucuagguuuccuaacgugccuuaugcaaguagggaggacuugaaaagaaaaugaacacccccgccagcagagggcagcagggagccugggcgcugaggacuggcagagucaggcuugggugugucugagaaaggaugcagauuaaauuccacuccuaucuugccaggacugguacagccacaggagauagaugguguauguguauagacaugcugaagcaggggacagggagagaaguguaaaugcaugccuuugauggugggagaggaagaaggaauauauuccaaucuguuugacagacagagaaaggguuuggcuuuuuuguuguuuuguuuuguugagauagagucuuacucuguagcccgugguaaccucaaauccauggugacccucccgagcgcuggaauuacagaugugagcaaucacaucuggcaaggaauucaugaauuuuaaaaccucaccagugcucagauguucccugaucgauggaagagagcccccccacacacacacacacacacacacacagcucauguuggaguugggagaccugauuguguggaaacaaagacaagacagcaagguagacgccaugcaggaaggcucugccucuuucaagacacucuaccgggccugcacgcuccggcuuccuccacccuucaggucucgucccaagcagaauucccuuggugcucucuggcauagccuuacuauuucaggaacgaaggaggcagcuuuugaaaaauaaguacauuaucaucucacuugaaaccuguucuaggggcugaagagauggcucagcgguuaagagcauugacugcucuuccagagguccuggguucaauucucagcaaccacaugauggcucacaacuaucuauagggggaucugacgcccucuucagacaggcggauguauaugcagcaaagcacucauacauuaaauaaacaaaauuuuuaaaaga

SEQ ID NO: 6685 - RNA, 21729 nt, Mus musculus
cgcaagaggaaaggcuauugguggagagcgcagccaaugggcgagccuguuacuagccugcgccgugugcggcguaggagcggcgcuugaggccuggaagcguuccgcggccugccgggucagcaccaugagcuccaucggcacuggggugagucucuccgcgccgucucuuccaguucgggguugaaggcagugaggaagcccggcugcggcucggagggccgcuggauccccggcgcugcccgaguccuggggacccgcggccucugucucggugaccccggcucccgcggcgguucgggccgguccuguccgcccccgugcagcgacagccccgggugcugagucacuuuagucucaugcuuaaggaaacugaaaguggagacucgcgggccugccgcagugcgagcuccccggcucgacccucgaacggccccuugcaagccccugcuggucgcaaugccucggccggaucgccgagugcgucgugcggccgccgccggcccaugcaggugcugcggagcugugugcugcggugcugcugacucacaggccugcccgggcuucccggacggaaccuaguuaguggacguucccuggaaacgggacaccaccuagaagaaaggcuggaucucaugaguccuugccuuuccuuugcguucugcuuuucgcgaacaagcuauuuuaagcgagucuguaagcauuuaaaggguuaucuaugggccuaagcgccuccgauuuguaaggaguauugaggauuugcgagcuggacuuuaauuuguuggggcuaaauacacccagugugugcagcgauuuaccccaccuuuccuuugucuccauauagaacuacuuaacagucucgauuauuugcaguagagguaaugaaugaauaaugcguuucuugguuauccuuguuucccccauuauuuugaugcucaccaaguguggugcaccccuuuaauccuagcacuugggagguagagguaggaggaucucugaguucgaggccagccuggucuacuuaaugaguuccaggacagccaggacuauguaaagagacccugucuuuaaaacaaaacacgcgcgcgcgcacacacacacacacacacacacacacaaacaaaauaagauuugcugcucagaauuaaacucgcauacuguguucuuaugcuuagaauuaagugguuacaagauauuaauacuauguaauacuuuugggauaagugcucaauaauaugucucagcaaauuggcuuugcaguuguaguaauguuauccucugucaguggucaauccauguggaauauuuuaauaugaaaguaacccugaguuuuaggaaguuucacgguugaaggcuuguuuucuggcugucuucuaagaauuguaaauaccaguauuugucagucauuuugggccauuugguuuucuuuuuuuuaaccccuacugcugggcaguugggaaggccagccgagggccucaagagcuaguaggcaagcacugagccccaaauccuauauucaauuaaagaaaauagugaguguguguguguguguguguguguuuguagggggugggguugagauagagccauacuggccuagaacucugcaucuuucugugucagccucaugagugcugggacccauccguauugcuuagauaugcagcaagaaaggauuauuauuuaauuuugaauucuguauggacaaucuuccguugucuucagcuuaaugaacauuucaauucugguuguucaaaugaaaguccauuaguugucuuuuuuuuuauuuuauuuuacaccaagagcuguccauuaacaaaucuguguguuuuuuacacagcaucauuuaugccuagggauuaaacuacaguguuugugcugccagacaagcuccacuccuagauccaugguucugucugacauuuaauggugcuccuaaaagcuuguuuccuuuccuuuuguguggucagagccaccauuguuuggaauaucugagcuccacacccacacuugucuacauuuguuuuagcccaaagccagagugaauuuuuuaaaaaauuucuauguguauguauguugcaccacauaugugucuguugucuauccaaagccagaagagggugucagauccccuggaauugaagcuaucgaagugguugugaaccacuaugugugugggugcugagaauugaacccaagugcuuuggaagagcagcaaauguucuuaacugcugagugucuuuccagccagagggauuuuuuuuuuaaaagauguauuuauuuauuucauuuuuguguguacacuguugcugucuucagacacaccagaagagggcguaagauaccauuacagaugguugugagccaccaugugguugcugggaauugaacucaggaccucuggaagagcagucagugcuuuuaacugcugagccaucucuccagccccagagugauauuuuuaaauacuugaauuugggccugugcaaugccaccaagacuuaauuuuaauaccuagguucagucucugagaugcugaguuccauucuuuuuuuuuuuuuuuuuuuuuuuaagauuuauuuauuuauuauauguaaguacacuguagcugucuucagacacuccagaagagggagucagaucucguuauggaugguugugagccaccaugugguugcugggauuugaacucuggaccuucggaagagcagucgggugcucuuacccacugagccgucucaccagccccugaguuccauucuuaagucccaaaaaguaggaagagaaaaugaacucuggaaaguugucccaugaccucuugaaaugcaccaugguacacacacacacacaauaaauaaauguuaaacagacaaaacacaugaauuagaucguacaacugcuccgguucaacaccucauuucaucaagaguaaaauguagggggcuggauggcucagagguuaagagcacugauuguucccagcaaccacaugguggcucauaaccguccaugaaaucagguauacacgcaggcagaacacuguauacauaauaaauaaauaaauacaaaggaauaaaauguaaacaacucccccaaccuaguuugacucuuuagcaccuuuggaguuuuuucacccuugucuuuuuuccuccacuuagaguguugaagacaccuuugguccuuggcuugggcugggcuaggcuaacaaugcuuuuuuuuuuuuuuuuucuuaaguuuuaugugagccgggcagugguggugcacuccuuuaaucccagcauuugggaggcagaggcaggcagauuucugaguucuaggccagccuggucuacagagugaguuccaggacagcuggggcuacacagagaaacccuuucucgaaaaaaaaaaaaguuuuaugugaaaaaaguucuagucuuucuuaagauuuacauccauugcuuaauuuuuuuagauuuauuuuauguguauaaguuuuugucugcaugauacaugcacuuuuuaaaaaaauauuuauaaauuuuauguauaugaguacacuguagcuguacaggugguugugagccaucaaguaguugcugggaauugaacucaggaccuuugcuugcuccagccccacucauucuggcccaaagauuuauuuauuguuuuaugugaguauauuguagcugucuucagacacaccagaagagggugucagaucucauuacagaugguugugagccaccaugugguuguugggaauugaacucaggacuuucugaagagcagugagucuucuuaaccgcugagccaucucaccagccugauauauguaccuuauacaugcccauggaggucagaagaggccguuggauccccuggaauuggaguuacagaugguuguaaagcacccgugaguucugggaagccaguaauccaggucuugugcaauagcagcaggugcucuuaaccacggagccaucucaggcugcgcuucucucucucggagcagcuucuguuaggauagaacucacgccuagugugugagcuguuuagagagaaaaguugucuaaguguuguugccagggacuuugguguaaacuuacuguuuguuguucucuuuguuauuaguaugacuugucagccucuacguucucuccugauggaagaguuuuccaaguugaauaugccaugaaggcuguggaaaacaguagguaagaagcccuguuugauuugaagugaguguuuuaaucucuuccuuuguauguuugguaauuaggcuuuguuguguugcuuuagcauaaacaagugucauaccuugaguaaucucaaccuccucccucguggcccuccucagagcucuugaguagaucucccaucuacauuuguguuccagggcucaaacagguaaucagacuugcaguauauacuuucacccagugagccauccugguagauuauuuuauuuaaaaaaaaaaaaaaaacaguuuugguggugauagcucacaccuuuaaucccagcaauugguaggcagaggcagguggauuucugacuuucaagucagcuuggucuacugaaagggcuacacaaagaaacccugucucaaaacaaaacaaacaaaacaaaacaaaaaacagccauggguggucuggaacuugacguguaggacagaguggccuaaggagauucuucugucuagggcugggauuaaagaugcauuuuuccccuguguaaaucaauccuggaacuggagagauggcucagagguuaagagugcuugcugcacagucaugaggacuaauguguagagauccuaguaccacuaucaaacugagcucccagcgguugccuauaauucuaaaugugagaguuccaguuuccucuucugcucucugugcauuacccacccacacauaugcacauacacuaacacagguccacacacuuaaauacaaaccuuuugccaggugguggugcacaccuuugguccagcacuugggaggcagaguugguggauuucugaguucauggccagccuggucuacagaguggguuccauguuagccaggguuacacaaagaaauccugucucaaaaaaaaaaaaaaaaacaaaaaucuuuuaaauaaguggggaaaagaaauguugagacuguaagcucaguugguguaguacacacagaguucuggguuugaccuccagugccccaugagcuggauauggugguuaaacagcuaggaaauacuucagcuauaauuuuaagauuguguucauaucgaaaggugauucauuuuuuuucuuguggugggugcacgucaggaaagcgcuuugcugcgacaaguaccuguuaaguuuaagaaauaccaaaauaaguaauuaguaauauucagguaggugccuaaaagcacuauacuugaacuacacauugcugcgauucuguuuucugaaaggauucucuuagggguggagagauggcucagcaguuaagacuguaagacuguauuguuuuugcagagagccugagauugguucccagaccgauguggcagcucaggggagucugacaugcagucuuacacauccccuuagguuguuaggccuaagauugauuuacuuucugugugugugcaugugugagcagagaucagaggacaauuugugaauugcuuuuuuucuguuacgggaucaaagaucgguuuucauggcuauccacucaaucaucuuaccagccccacagacuuucauaccuuuauuuuauuuugcauacucaguauauuucucagacugacauaggacuuccuguguagccuaggcuuuaaaacuuguaguccgcccggcuucaaccuucugaauucugggauuuaaaauuuauuggggaaucucaaaaaacauuuauuagugcaggauauagguuuuaccauuacuuaacauauuagaaauaaaagcugaaaauuaaauauuaguugauuauagagagguuuacauugcuucuguuaagauaauaguccugccuucccugaaauauuuuuuucuuaaaaauuuuuuaaaagguuuauuuuuauguauaugaguacacugucgcugucuucagacacaugccagaagagggcaucugaucccauuacagaugguugugaaccaccauguggguguugugaauugaacucuggaccucaggaagagcagucagugcucuuacccgcugagccaucuccccagccccccuguguguuuuugagggauguccuaaccagacacugaggcagacacccgagcuugacucuggcuggacuaccugcaaaugaugggcauguaauuguuuugcuucagguucuucauuuguaaaauagaugugagaauauuguuuuccaaaguuauuauauaaauuagcaguguaauguaguucacuuguacaguacuggguagcaguacugccuggcgugugugggucuuauguuccguccucagcaccacacaaagaaaaaggaaaguuuuccucaaaaaagaacaagcugauaggagaauuuauuggucuuaagaacaaauaccuaaugauaaaacugcucaccuacuuacuauuuaauauuauuccuaauaaacauuacuaaugauauuuauuaaaguggcuuauaguuguaaauaguuaccucccuuuguauauaaguuuuacauauucggguucagccagcuagaguuaaaaaauacucagaaaagccagccaugguggcugaaucuuuaauuccagcagucaggaggcagaggcagcagaaucucuaugaguucuagcccagcccaguucacaaagucaguuuuaguagcacagucagggcuacacagagaaaccaugccucgaaaaaaccaacaaaagaaagccaagaaguuagaaagggaucagaguguagcugauuggugaugugcuugcccagcaugcacaaggcccuggguuugaucccagcaccacacagagacacaacaaagacaagcagggcaagucccuguagggcuggagauguaccuuagugcugcgugcugacuaggcaggaggcagagugcaguuccagcaugcaaagaaaaaugguaaguuuuguaaaauugaaaauaguugcauauuaacguuaauaaacaaguuaaugaaaugaaaaucagaaagaagaccagggauguagcugaguuuagagcagcugccuagcauaugcaaagccugguuugauuucuagugccccucuacaccagcaaaaaauuggaaaauaaaguaagaaacauauuuuaaucugaaaauaacauuauuuuccauuauuccauauuauuauccauauuuuacuugagauuaggagcagaguuguaacagaacauagauuuuauugauuuguauauuuacuaguaguauauauuuauugcagaagaaauagaugaacaaaauaaagaaaaauacuuagauuaguuuuauuguauguagcuguaucuuuucuuauguauguuauguacccuuuuguucguuuguuuuugguuucugagacaagguuucucuauguaacagcccuggcuguccuggaacucaaaguuccagguuggccuuaaauccauccuccugcuucugccuucagaguacuggcgagcaccacagcugggacagggucugcugggccuggaguggcaggcaccuuugaucccagcacuugagagaggcagagacagguuguugugaguucuaggccagccaagggcuacauagcaagacugucucuuuguugcuauuguuugagacagggugccacuacaccuggccucuaguuuuucucuauuuuuuuguuuuuguuuuuguuuuuuucuuucaagacaggguuucucuguaucgcccuggcuguccuggaacucacucuguagaccaggcuggccuugaacucagaaauccaccugccucugccucccaaguucugggguuaaaggcgugcgccaccacugccuggcuuggccucuauuuuuaaguauuuuaaagugggccaauaagcugacuccuucuuuggggcaccugccacauccugguggccugaauuugauccgagacccacauggugaaaggaggggcguaaguccuucugucuguccucuguucucugcacacaugacucugagagcacacauaugcagguacacgcagaauauagguaaguccaauaaagugcugcugaguuuaacaauaaaaacacauguuuaaauauauuuuacaugguuuaaauacuguauuuuauuuauuguuaagguccccuguaucuuagguuguccuucaacucacuauguugcagaggaucaccuugaacuucuaaucccuuugccucuagugcugggauuguagguguguaccacuaugccuagucuuuguguagugcugggcaaacgcuaccaauuaagcugucaucuccaguuauaaauuagccuugggauaaagucuccuucauauagcccagguugccuucagcuucccaggcacuccuuaggacuuugggcgguugaugcucuuaccuccaucucccaggcgcuaggauuaaaagugugcucacagcuuuuuguauuuguuauagugcuggggaaugaaucuaacacuuuuuuaaccugggccaucacucuauuaucugaacuguagucaacccuuugaauuuuuuuuuuaaucuuacuaaguuucuucuauuucagcuaaaaaaaaauuucuucuuguuucaguacagcuauugggaucagauguaaagaugguguuguguuugggguagaaaaacuaguccuuucuaaacuuuaugaagaaggcuccaauaaacgucuuuuuaauguugaucgacauguuggaauggugagaucacacuuuaaaauguucaucuuuguuuucuugacuuucuuuugauauaacaaaaauacaguaaagucucuuuuaagaguucauucauuucuuaaguauuagggcaguaauauaugauugagcagcuacaguaauaaguuuauuauugcauuuugaucaacucaaugucuagaacaauuucauaaucuuacugguagcaagaaaacacaaguuguuuuuaagaugagagggugagggaugugggagauacagacaugaggucuuaacagcucagaucccaggggaugauaaguacucagggggcagaggauguuuagccuuuuccagcccucgagggauacuuuaucccagcagaacacuuuauaguaaggaacagggagaggagaugacauaaagugaaagaaaggccgauugaaggaacgugaguagcuucuaggcaucucggcuaaguccugaggcugcuguguaagcucaggugcaagccagaccacagacaaacccuggcaugcacugacggcaccguguggagaggacgcuguauuccgcaggaacugccguaauaagaacauacugaacugucuucacccugcugucaagacaacugguagaaggcaguugugucguccuuuaaaaggggcacuugagggcggaagaaguuuuaauccgauucuaggcgcucaaguguguccuuuucuuauagaaagccuucgagcuguuggcauucuucauacuuagaaauugguugggccggguagcuuaggccugucaugacaguuacucagaagguugaggcaggaggauuccagguucaaggcucacuuaaguuacauagaauuuggcaaaaugucagacccuaaaagggauagagaaaguuuuaaggccuaauuucuucuuucuauaccugucaucaaaaugccuuuuaaaaacuuuuaaucaaagauaguauuugauacuuauuuuuaaaaacuauucaauacgcuaauaauaagcuguuugccugugguuuguuauaggcgugucuguucaauugguccuuuuuuccaggcaguugcagguuugcuggcagaugcucguucauuagcagacauagcgagagaagaagcauccaacuuuagguccaacuucggcuauaacauuccucuaaaaguaaguugacaaauaugcugauaaaguuuugaacaguaauggaaauguacuaguaaagucucuucucuuccucccagcaucuugcagacagaguggccauguauguacacgccuauacacucuacagcgcuguuagaccuuuuggcugcagguaugaaauuuugugaaaccuuugagccauauuuauacagcaguuauuuuucuccaugaauuagccuuuuacuaaaaaugucugucccgcuauuuuacugggauacacucagcuuuuauguggaugcuggcgguccaaauucaggucaucaugcuuggacaacaagcacucuccugagacaucccuccaguucccagaucagcuucucaccaggaagugguaggcaggcauuaaaaguacacauaaaagcuggcugugagguuagugcuuaugaucccaguccucaggaggcugcggcaagaggaugggcacaaguucaaggucagcgugggcuacauaguuaaacgcugggcagucuagagaccuugccucgaaauaaauaaagugaaaggaauuauaguagucuugaagucaggagagaacuuauaauuaugauuuuaaucugauuauaauaaauucucuguaguuaagucccugauucuuggccggagguacagcuauuuaaacaccuaaguaaacuucuguuguuaaaaugaaguguuagcuagagaaagaggggauugagacauagcaagaaguguaauggguguuacaacaucguuauaaggguucuugggagaacucuuaugacuauauuugaaaugagguauuauugguuggagcuguaacucaguagagugcuuccuaacagcucauaagcuaggcaugcugugucugcagucuggguauucaggagcuaucagugggaagaucagaaguuauucuuagcuacauaguuuaaggccaaccugggauacaagagucugacaccaaguaaagucaagaaaacagaacuuggcuggcugugcucuaucauagccaagugucuuuacauagcuguaguucugccuuuuaaguugcuuaucagccauauuuaaauacagaagugacagaucgauuuaaacccugacuugucaaucauuagcaauguuagaacuagcggggcauuuguuaaauuaguuaaagguuugacuuuaauuacucuuggaaucuaccucuuuuggcuucguauauugccuuucauuguaacugaguuccacauucaucugcuccuuucuaugaauaguggguuuuugagcauauauugugauuauugguucuuaauggugggacacagaugucgcacugaugaaaccaacuuuagaaaugaaaugauaggaucccggcauugguccugaauauggugggacagcaauuaaggaguggucuguuuccaaaaaggugacaaggaaagaugcaugaaauauugggggagugggugaagacuguguucugugcuggugugaaacaugggcaccuagggagugcagaggcaguaguaagguauguggagaugacacuacagaugugcaaagagcagaguaugacagcuacuaaaggacauguggugggaggguuuuuaauuuauauauauacacauauuuauacacacacauacauauauauauauacacacaugcauguauauguguagguauguauguauguauauguguauuuucugaacgaagaauuacaucaguuuggaaggggaaaagcuagguacugauugggauuguuggcuccuaagaugauccacaugaugugauaagcuaaaauaaggcucaguuuucuaaaguaaaagaaauaguuugagaaaauuggucaugaucauuuaacaaccuaauuuuaauuuuaauuuauugagcauauaaagauauugagccauuucuaaccauugcagaaaaaugacaagaggaauaccagggaauccgauguaggcugcuucucggcagacauuauucccuaggccauuuacugugcagcgacgcugcucaucggacccuguuguaaugguuuuucuguauuucugacauugcagaauaaaguuucauaagaaaggccgacuaagcaaacaagucaaauggauuuugaauccuguaguuuagcaguuuuuauuguagcugucuuaucaaaaagaacuuacuguaaguuauguuagcaauuuaucugagaaaaucuaacugcaguuucaucacagccagcuucuaugcaaaugcuguggagaacuguguucuaaacuauuuguuuuuaugcaguuucauguuggggucuuacagugcgaaugauggugcacagcucuauaugaucgacccaucagguguuucauaugugaguacauuuuuuaaguuauuuaauuuauaaaaaguuaaaugguauugucaguuaucucacuuggauuauauacacuuuuauuuaaacuuuuuuaaaguuaggcauagugauagaccaguagucccagcuucuggguugaggagaggaggcaagaggauuacaaauucaaggccagccuuggcugucacaaaaagaucuugacaacuuacugaagaccuggucucagaguaaaagaaacaccuagggagagucuaaugguuagauuuuugucuaccauaugugaggccuuggcuucaauccacagcauuuuaaggauaaauaaaacccuaacuuauuuaaggaaaguaauuuuuuuuuuuaagauuuuauuuauuuauuauagguaaguacacuguagcugacuucagacacuccagaaaagggcgucagaucucguuacggaugguugugagccaccauaugguugcugggauuugaacucaugaccuucggaagagcagucagugcucuuaccugcugagccaucucaccagcccggaaaguaauuuuuuauauuaauaaacauauguuaugaagcagagaaaacuuaugacugacuuuuaguaugcucuuuauaagaacaaccuaggacgccaggcagugguggcgcaugccuucaaucccagcacuugggaggcagaggcagguggauuucugaguucgaggccagccuggccuacagagugaguuccaggacagccagggcuacacagagaaacccugucccaaaaaaaagaaaaaggaaaaaaagaaagaauagaacuaccuaguaaacaguauuuugauugugugugauugucucaugguuguauuguaucuuacuaugaaugugugguaagauaggacgcucagugguagagucguugccugggauuugcaaggccuucaggugaaaaucuagcaugggaaugggggcaaagccuaaauuuuuuuaaaguuagauuuauucauuuuuuuuguguguuuauauguauauguucugucugcguguaugugugccuugugugugccuggugccugcaaagguuagaagauggcauuggguccccuggaacuagaacuacagguguucauaagcuuguaggugcuaggauuuaaaugcggguccucugcaagagcagcaagugcuccuaaccauugagccaccucuccagccgcagccuagagucucauagaaguagguuugcuguuucaagguccuuaaguucaugugaauguaucuggcuguuuuuuaacuugcuggggguuuguuuguuuguuuguuuguuuuuugagacaagguucucaccguguagucuuggcuggccuccaaaucacagagaucuaccucccucugugucuuaagaacaccacaaccagaaaaucaaaaacuaaauaguaagucuuguaaugucagaaaauauauacuaauuaacugcuuucuuucuuccuuuccuuuuucaauaggguuacuggggcugugcgauuggcaaagccaggcaggcugcaaagacagagauagaaaagcuucagguaacgucucugcagugcggagguuugcucugagcgggguuaccgauccuaggccagugggaugaugcagccuggcgucgagaggagugugugccucuagccgauuagauagaaaagugugaaguugaaaacuaccuauugccgggcgugguagugcacgccuuuaaucccagcacucgggaggcagaggcagguggauugcugcaaauuuagaagccagucuggacuauacagugagaucuuauuucagauuaaaacuacucacuuucuacuauccaugagccagauguucagcuauuaguuuuucccaaauacuuuggcuauugucugcuuuuguuaugugaacuuucaaagguuuuauuuguaauuauaugcaugggaauguacacuugugaaugcaguugcccacuguuacuuccccgccuagagcugagauuacgggcaguggcaguuagcugcccgacguggaugcuugucaaagagaaaacaaacgaaacauuaaugaauaucuuugaaagacaacauaauuaaaucucuuuucauaacucaaacuacuaugaguauuauaaucuuuccucacuuuagcaucugaaaauaaaaaaacagauuuccucaaacuguuuuaaaccugucauuaaagcuccaacugcacccucccacgucccuccgccuccccagugcuaucacacaagccagcuucuucuaauggcugcagcauucaaacaacucggcuggacacuuagguuuaucucauuucuaagugucccuugaugggauaauugauuucuauuguaacaacuuuuuguuuguuuugguuuuguuuuugagacaggccucacuaugugacccuggcugguaaauaagcuauuguuuucuguauuuuuuuuuaauuucacuaacggugugcguacauaugcauaagcacauuuuccauggugugcuugcuccuggcaaucccagggauggugguauaugcacuauccauugagcugucucaccugcuuuuggcaucucauuuucuuuucuucuuucuuuuucuuacuuuugcuuuguacuuuuaucuuccaugaaauaaaaggaaacauaauuccuuuaauauauauaauauauaaaauauuccuuuaauaacuuguuuaauuuaauuaaaaauauguuuuaucugggcauguguuuaaucccagcacauuggaggcagaaguaagcagcuuucuauuaaguuugaggucagcuaggggaugcauagugagacucccaaaucuugcuacuuauuuugcacaagcgcgugugugagaucucaucuuguggauacaugcauacaguggcuucugagucggggucagaagauagcuccccauaaggguccuggacucaggcucagguuaucagacuuuguggcauuugccauuuaccugcucagacaucccggcagccuuuguuaauuuaaaaggugucccuagaucgcucagugguaaagggcgcucacuauucuuacagagggucugguuuuaguucauuaccuccuauauaauuaagugaaguuagcuauugucaauugcaaaagaaaaagaacccuggugauuaaugcuaacuuacgagacuagcuaagcaaauagggacugaacacauuucuuccuuuccuuuccuuuuuccuuuuuccuuuccuucccuuucccuuuuccccccuuuuucccuuuccuuuuuuucguuuuuuccuuuucuuccuuuuccuuuucccuuucccuuuuccuuuucccccuuacccccuuucucccucuuucccauucccuuuccuuuccuuuucuuuucuuuuuuuuuuuuuuuuuuugagacagugucuauaugcaccuuuggcuguccuggaacuugcuguguugaccaggcuggucucaaauucuugagaccugucugucucccaggugcugcaauuaaagcugcgcaucaccacucccggucuucauacaugacauagaauuaauuacuuuguuuuucuuauagaugaaggaaaugacuugccgugauguaguuaaagaaguugcaaaaauguaaguuguuugagauuuuaucugccauccacaagaaaaaccuuacaugaucuguguaaacucuuaggaggcuauuauaugugaaauuuuucuuuuuauguguccugggaacucagggcuuugaaaaugucagcaugugcaugcucuuccacugagauacaccuuuagccugaauauauucaaguuacaucuuuauuuuuauuuagaaacagaaguuuuacaauauagcccuagaaaccaaaagaagauccaucuucuaccucuacuggggcuaaauuaugugcucccaugaugggaaacuuagcgucuuuucaaagauaggaagagaacauacuagauacuuagaaacuacuuuugaaugcuuacagggcuggagaaauggcuccgugguuaagagcacuugcucugcaggagaccugggauuauuccucuucugaccuccaagggcaacaagcacacacacacacacagaaguaaauaaauccaaaaaaaguuucuuacccggcugcuuaaacacuguguguguguguguguguguguuuguuagacuugaaccugggccucacacucucuugugacgucaagccacacacuuaccuucauuagcuuuaucuuuaggguuagagcuguuucuauagugauuaugaagcuggcuguucuuuagucuuuccugguuuaucaucacauuuaucgugaaguucuuuuaacaaaaccuuuuacacagccugagacuuuccguuacagguagauggugaguccuguguaccacguuguguaguaguaagcagugaagucagggugauaauucagagagaauuauaauuugucaagagcaguaauguaggccagucacagcauccaggaggcagaggcaggaggaucucugugaguuggagaccagucuggucuacagagcaaucccagggcaaccaggacuaaacagggaaacccuuccuugucucaaaaacccaacaaaaaccaaaaaauuaauuuuaaagaaugcagacacuugcuguuaaaauauuguguagaguacucgcuuucuagcugccuuuucagguaaacuacacaaacuacaguauugcugaauaugguucuuuauguaauaguaucuuucagguuuugcauuugauaauacaaacaaggaaaaaaaucuggguucuaucauaauaaaagauggugccuauaaucucucacaaagggauuuuguuucuuacuauucccauucuuaccaagacucaucucucuucauuuaccuucuguuaugaagcagucuuccuuuuuuaagucaguuaagaaccauauuacauuggaaagugaaaguaauuccuuuaaauaguuugaguaugguacaauccagggucuguugcugaaauagucuuugaaguuccuguuggaagucaacccuuuggcaccuuucauaguuugugauugguaguacuuguuccucuucagaaagccaucuuuucauccuuguaacuaaggugcucucuuguacuauacagcaaggcuuuagcagagccucuaaaaguaagaaaagaaacagaaagcuuuguuuuucuaucauagggagguuuuugucauuuugaggacagccucagauucaggaguguccugccuuaaccuccugggauuacagucaugagccauugcugccagcugaagcucaguuguuuacuguuacuguaacugcuugugugccuucuuguuuguaauguauuacaccauaagaaccaguuugaguggcauugacacuaucuggacagaugguuuaaauuacugguuuguuucugaaauauguuuacaaauagaaaaaauggguaucaugaaaaggcauauggucuuucuaauuugaaucuguuuucuuucugagaugucuuuuauuugaagccuuaaaccauuaucaaaauaaacaacuuuuuuuuuauuuggggggggggggguucgagacaggguuucucuguguaguccuggcuguccuggaacucuguagaccaggcuggccucgaacucagaaauccgccugccucugccucccgagugcugugauuaaaggcgugcgccaccacgcccggcuucaaaauaaacaacuugagaaauagaaguauaucaguauuuguaaagagugucucaauuccaguguaauuucccauuuuaaggaaaauaaaacuuuuauuuucuguguauaaguaguuugcuugcauguacugugucugacuguaagagacuggagaggguuuuggauugggggagaggaguggugggguuagauguggguucuaagucagcauuguguaugcugagaaccaaagccaagugaccuuacaacugagcaucucuccagcuccuaaucugucuuucuaagguugaacuaggcuggagaguaugucauuuuauaaauaccaggcacacaacgucuacuuuguacucacuguuuauagaacuuguguuuauuuuguguuaauuucuuuucuguuguagaauuuacauaguacacgaugaaguuaaggauaaagcuuuugaacuggagcucagcuggguuggugaauguaaguuacauuuguacauuuauuguucuagaauuuauuugcacuuuacgacaaguuaaugaaagaauucuugccgggcaugguggcacacaccuuuaauccagcaccugggaggcagaggcagaggcagaggcaggcggauuucugaguucgaggccagccuggucuacagagugaguuccaggacagccagggcuauacagagaaacccugucucaaaaaaacaaaaaagaaaaaaaaaaacaaaaaaaaaaaccgauuuauaagucaagcuuacuguuauuuuuaagugaguucaccugugaauaaugauuauuugggggaggaggcaacaggaaaugaucucuaugcacuugaagauuagggcgaguucacaguauuacaaauuauaauccucauauuuaauauaugguuugauuuuauaguaacuaaaggaagacaugaaauuguucccaaagacauaagagaggaagcagagaaauaugccaagguaagcagcaacuuguucugaacaggaucgugguaaugaaguaauuugguugauguuugcuugaaauuaggguaaacugucuuuuagauuacugguuuuuuuguuuguuuguuuuuuuaaagauuuauuuauuauaucuuaaguacacuguagcugacuucagacacaccagaugaggguaucagauuucauuaccggcgguugugagccaccaugugguugcugggauuugaacugggauuggaccucuggaagagcagucagugcucuuaaccgcugagccaucucuccagccccuagguuacucucuuuaagguuaucucugguggggauagauuugcccuagcucuaaacuuuuauuuuuuauuuuuuguuguugguguuugccucuuuaaaaaaaggaguugucuccuugaacauuucaggguugcugggcaugguguaucaccuguauucacagcaaagggaacagaggcaggaacaucucucaguucaaggccagccuggucuacaaagcaaguucuaggucagagggggaaaacacagaaacccugucucuaaaagccaaaaagagcgggaacaaaaaaagcaaagaaaauuccagguuuuuccuuccaggacauuuaaugcuuuuauccauaggacaauauagacuuauuggguuaucuuuaaaugugguauuuuucaggaauaaauaauuuuuaauuacagauguuaaaagugcagauucuauaggauguaccagaaugaaaaacuuaaaacacuuuuuucuuuuaacaggaaucuuugaaggaagaagaugaaucagaugaugacaauauguaauauuuucuuccccauccgcugguuuacauuucuguaacaguugcauauggcuagcaccauggacuauauauacccacugaccgauuuucauuaaauuuugucuuauaaacauuguuggguaauugaagcuaucuguguaauauuaaaauauagauugauguuugauuaaaaauucuuagaacugggccuggagagauggcucagcaguuaagagcugcucuuccaggggacauagguucaauucccagcaccuacaauggcagcucacaccugucuguaacuccaguuccaggcuucugacaccuacaaacugagguacaugcaggcaaaacaccaaugaauauaaaauaaaaauaaaugauaucuacuuacacauauaauaaaugcaaaaauacaaauauguauauauacagacacacauguguauauacauuuaaauucuuggugcuauucucgugugguaguacaugccuuuaauccuaguacucagaggcagguggaccucuugaguucaaggcuaguauucaaaaaaaaaaaaaaaaaaaaaaaaagcagugcccagaguuaaggccgaaagauugagcccacaaguuaauuuauccauuuuguuuuaacuagaauuaaaauaauaauuuuuagauuuauuuuuguggguuuuuuuuuuuuuuuuuuugcauguuuauauuacaauguccaugccugguauccacgaaggucagaagagcuuuaaucuagaacuaaaguuauggauggcugugaaucaugggugcucggaacugaacccaggucuugugcaagagcaacauguccucuuaaccacugagccgucucuccagccuucuuuaacuagaaugaucauauuauucugugguucuuguaauaauguuguguuuaauguagggacauucuguaaccacuacugagaacagcgagcuuuuuguggaaaaugugacagcauuuauuuuucagauugcauagauaucuuaugacuggaaauuaucaccugucuuagucaggguuucuauuccugcacaaucaucaugaccaagaagcaagcuggggaggaaaggguuuauucagcuuacacuuuccauucugcuguucaucaccaaaggaagucaggacuggaacucaaacaggucagaaagcaggaacugaugcagaggccauggagggauguucuuuacuggcucgcuuccccuggcuugcucagcuuacuuucuuacagaacccaggacuacuaguccagggguggcaccgcccacaagggacccuccccacuugaucacuaauugagaaaaugcuuuacaguugggucucaauggaggcccuucccuaacuaagcuccuccucugugauaacuccagcugugucaaguuaauacacaaaccauccaguacagcacuugaaacaaaaacuuuaagguaucaaauugagcuuaaauauucauguaauaaaauguuuauaguacuucucugauaagaaagaguuccuuuccuuuguuucugguacuuuugguuuauuugaggcaggguaggucuuccuacauaagccccgccuguccugggacuuacuauauagaacaggcuggcuuuuaauucuuagagauccccuugccucugccuccaccauaccugguccucguuucuguuguuguuaaaaugaccuuggaaaaaagaaaguuggauuuagauuauuaguaucucugaaacaauuuccuuuguagacagguggcaaauuuguguguguguguguguguguguguguguguauacaccaagugaaaaugucuugaauguguaguuuucuaauguuuguauucgucuguugaaauguaaucuagagcugaccuacauuuuacauucuggcacaucuccacuguauccauauaaucaaagggugaaucugggaaguaugcauuaaaaacauuccuguauuuugccauacuacaau

SEQ ID NO: 6686 - RNA, 83387 nt, Mus musculus
caauaggaguucguguagaagcgagucugcucaacagcuuguuauuugguggauuguggcaguaaaucggggcgagugggggaacccggcgcaggaacugccgcugcggccgggagcggugcugcccggacggggacccacggcgaucaguggggcggcagacuggagagcugacagcgcucugcacccgcaguagguagguagucagcgggggccgcugaaugggcaaagcggcgggagcagcugcugccgcgauggggucccggugcaguugggagcuccgcaggcugagagggggaugcagggcgggcugugcccggggcgccgggcagcgaucggguccuggagucgcggcggcaacugcgggcacgaccgccuccgccgccuccccgggaaaauggcuguggggcuggccgcgccgcuaaguuugcuuuggaggagcgggcugccgggagaaccggcccccaacucugcugugcuucuuuggcgaggacccgcugcuggaccgcggagaucggggugcccgcgccucuccgggcuguacaaaaaguugaggcgggcgcgggaggagacggccgcugcggcggugcggcucgcuccccucccacacccuguccugccgccuccccgccccgcgccucccccgccggguccccccgcgccggccgccgccgcaggccgccgccccugccccccgggugaaggagcgcuucuccuuccugacauggugcagagcggaggcaggagagcaauggcgccgugacacuccguugccgccgccgcgggccgggccggggcgggccaagggggccgagcggcggaggcggggcgcgcgcuagagucggggcccggcggggcgcggacccgggaggccggggcgcagggggcugcgaguggccgacgaggcgggggcgcggugggccggccggccgggcaggggcgggacgcgcugcccuuuggcgcgcguggggcucacugcccgccaggcuuuggcugcccgacgggggucugucccgggggccgcggagcucggccccuccccgccugcauuuguuuacuuucuuuccgggucucaccccgccuuggacugauccucugccucucuuuucccugcuuuggcucuagcgcccgggaagagaacucgaggaagcuggaaccccacaggucaccagucaagaugaagguaaguggagccaacucuucuucuuagccuugugccccggacgcugccaguccggaggcugcaguuguggaauggcagcuuuuuguuacuuagaauugauuucuuuacuaagaagcacuuuaaggaaaaugacaugugaaugggugaggggugugugugugugugugugcguguucgaauguguguguguguguguguguauaaaugcaggcgguccaacacucucuagcaguuagcacuuugagaagaucggugcagucuuucgauuuucaaacacuucagugucaaaaacaccuuucaagaagaaaagcuuuuguccugcuuugguuuuugcaagguuuuuuuguuuugcuuugcuuuugcuuucuuuaaaaccuauacuucccccuuuccacuaccaaugccauuuucuaaaagacauguuauguagcuugaguaagagagauaguucuguauauuuuuggggaaagaaaguaaacuaaggugaugacaauauuuagauugauuaguucagucuucauaauauauaucuuaaaacguggauucuauguguagcuuuugaagcuuccuaaucuuacaaacaucaguggcagccugcuugaagggaaagaaagcuuucauaacauuccucagaauucgguaggauacuguggcucuuguuuguuucuggucagauacuuaccaaaaaguauuccucuucauuuuuuauucuuuuuaaguagacugacauuuaaacgugcaugauuaacguuguacuuaguguucggugugugugugcguguguguaaauagaaaauauauaguuguuuuuguuucgguuauuuugaaacaguauacuuuacccgggcuagccuggaacucacgauguagacucucaaggcugaccuugaacucccuugacguccuccugcgucugcccaagugcuggcaggaugagcaugcuauaccauugccugacucgguuuaaguauauuacuuucugaaauucucaaacuuccucuuauauauuuuuuuuuauuuuggagugacacaacuuccuuuaauauaacuugggaaaaugaaaauuuguuuccuacuuaaaauauuuaaaguuaacauugauaucuuuguacauauaauguugaauugguugcaugauacauacagcuuuugaauuagguaacaucacagacugaaauagcaguugucuguuacucucaagauuaaaaugauguauaaauggaaguuucuuacauauuucaauguauaauucugaucaugacuauuuccuguaaauggguguuuucuuucuuuucuuucuuucuuucuuucuuucuuucuuucuuuuuuuaauuguuuuguuuuccaugauaucucuauguaacagagaacaugcuggcauagaauuuaaagagaucuuguugccucugccuccaccuccuaccaugcccagcuacuaaugucuaaauaaaaauuauuuuaaguauacugagaucaaagcuguaaacuagaaaaggcugcagccuuuagcuaucaguuuucaucuguugaacuuagauuuaaaccuuucauuugcaaccuucagccaaagcaauuuuggaaagagguuucuuaguuucuugugucuagagauacauuguaucaaaagauaauggcuuagccaggcuugcuggcccuggccuguaaucccaguauuuaggaggcagagacagccugcaccuugucccaaaaccccaaagcaaacaaaagaagauguuacuuuccuaagcugucucacuaagcauuuaauuauguauuguuaauauuaacuuuguagcaguauuucucuuuaaccuagaaaauagaaucaccugggggccccaaacuaauaaaauuuaugagacauucauuauaaauacauuucuucuguuuauuucuuucuaucucuuauauauuaaacuguagaauuuuuuaaaacauguacuucaaaaaaaacaaaaaacaaaaaacaaaaaacaaaaacaaaacccuuuuuuuccuacugguaguucccaguuacaacuuuuccgucaucaggaaaugaguacguaaaaugaaauaguguuaauaaguuguuugcuuuaggaggauuuugcaaauuauuauuuguuguuaagcaaauaauuucaauguucuagugacuuuagauguaguuccuuuuggugcuguuagaggucggguaaaggcgaccaguagugauguuuggcaucucuguucuuucuucacaggcggcagaugagccugccuaccugacagugggaacugaugucagugccaaguaccgaggggccuucugugaggcaaagaucaagacugugaaaaggcuggugaaagucaagguaaaugcgcgaaggcuuuguaagacagcccaggcuugucuggcuguuugucucugaggacacaaagcggguuauuugguguacuucgagugacagaaggcagaguagggacaagagucacuccuguugugcagcaggcucaguacauugaaaagauuacaguucaugguagcccagagggaaagguugaacauugucagcuuucuguugaaucagugcuggggcaaguaucauugcauacuaaacugaaagaguguauuaagaacugaaaaauaaagaacucgagcugagaaaugauuccagauggcuucauuucaggauaccaaggugugaugcuuguguuauuuggaucauuccuguuuguaggaguguacuugggcuauaauuuggugucucccuuuccuaaucagauaaugacaguuucagugauuaggaagaacaaagaaguaaaauuauguuuucaagauaacauuaaaaaugauucauggaguugacgcgcgugugugcacgugugugugugugugugugugugugugugugucugacuuuuuuuagacaauuucuggugaccauccugccuuugccuccugaguguugggauuacaggcgucagccucuaugguuggccaaggcgcugauuuuuaagaccagggaaagcuaaaguuaauaaauacauuuccaguagaauuaggaaauacagaaaaggauggguggauaaagaccugcaacuuuugagaaaucuguuuacacauuguuuuccuauaaaucuuuuuuuuuuuuucuuuuugagauaggggucucauguagcccagcacagucucagccucacuaagcaucugagaaugaguuugaacuugauccucuugcuuccauucccaagugcuaggaucauaggcugaggcagcacgcugguuuuuacagcauugaugguaggauucagcuucguucaugucagacacccuuuaccacgugagccacaucgcuagccccugucugcuguucugcauacucugcuaauguagguacaagagcaucuucauguauauaacuauucuuaacauuguaaagccauaaaagaugauucgugaaaguccuugauaacucugcacacacugucuacagucuuccacacuguguugugcucgucauuguaugauuguuaguauuauuauaaucauguuucuacaguuugugauaugcucuacucagguacauauuugauuucauuuauuuauuuaagauuuguuuauuauauuuguagcagucuccugcauguauacaccuacagaccagaagagggcaagagaucuuauuacagaugguugugagccaccaugugguugcugggaauugaacucaggaccucuugaagaacagccaguguucuuaaccucugagccaucucuccagccccauaucuguuuucuuaccagaguuaaguacugugaaaaggagaggacagcucagaguuucuguuucuauuccugauucauacaggagggcuucaugucuaguggucacacagagucucuggaauguggaugaauaaaugacagacgagugagcuagugagugagcuagugagugagcuaguguacuggcgcucaggaugugccuuccagaccaggagcauucgcccagcugaagaacuuacucaaagugaacauuuucaggacucuaucgcaaagauucugagugaaaaccucuaggacuaauuuaacaagccuaaaguuucaaauacaaucaagauuuagaaggccuuggucucagagacugugacucaaguagucaguagacccaaguaugaaucugcuagugacacuugcuuguuaggaugccauuugacauuuuuaucuucuucauuucauauagccuuuuaacuuuguaaaguagaaauguagaccgcugaauauuugagagucauugacaguuuuaaccuuuaaaauauacauauauauauugugacucuuaguuguuuauuuaaaauaauaugauaauuauuuuaggacuucucaugcacucccauuauccagcauuucuuacucugcugugcuuuuucccuguaugugugguggaacugaagggacaagagcguccagggggauacuuugguaugacugaauugcuucuaguuguaucauaagacuuuuuucuugagacaaaguuucuuuauguagcuuuggcuguccuggaacucuguguagaccaggcugaccuuaaacucauagauauccaccuggcugucugccuccugagugcugggauuaaaguuauaugccccagggccagccucagggggcuuaaggaccacaagagcucuguuuuuaaguaggcaauaaaaugugaagguuuuaaaaaauauuuugugacagucaaaaccuuuuucugacuugauaaaauacacuagaagcaguuuuccauuuuuauaguuaucacuggauuauaaaucuauacuuuguccacugggcaagcaguuauuaaguggcuguaauaugcucugacacuugcuaacuauaaggggaagaguaaugaaagagggcuccagcccucaaggagcucacaguuaaugagaaagaggauaaacauaaauacaagacaguguaauaacuguuacugcagagguaaccacgggguauuaaggaggcaccugcuggguuauuauagauacauuguuucaaaaguaacuuccagauccuuuuguuuuccagguacuucugaagcaggauaacacaacacaguuggugcaagaugaccaaguaaagggcccuuuaagaguacguaugugggaaaagagagagagaguacuuuugccuaguucagaaucaaaaauaugaaucauagguaaaugccaucaguuuucaaacuucauucuuacauacacuugaauuuuuuauaggcaugugagucagaaaacaaaauaaagauauauaauaguguaaauucaugauauuacaaugauugcauccuuuaagaacaccaaucauagcuggauuaguuauuuauuuaauuuuuuucuuguuuuguuugaguugguguuuuagauggucucuuagccuaggcuguccuaacacuauagaacagaccucugccucccaagugcugggauugcagguuaccacugugcuuggcugacaggagugucaugcuuucucuugucuuuuguuuugaguuuagggacugaauaugugcauacauauacauauauauuaagcaugcuuacuuguuuguuuugagacagagucuuaccauguagcccuguuuagccuggugcuuacuauauagggcaggcuagacuugaauucacaaaaaucuaucuguggggcaaugcccaguuugacuauauuacuguuuuguuuuuuuuuuuuacauuguugcaauauuuaagaugaugccugugacaugccaacuaccauaacuuuucuguucuucugauuuaucaaacuauauuuguuucauuauucaauuugacgaauagcaauauuguauuuucuauucauuucuauuuaugugguaagucuuuguuuugucgcaauaccacuuugguuaauaucugauauacaaaggcuuggaagcugaaagaagguucacuggccuguuccucucuccagcugaacguuuaucugaaaggucccuuaaauccaaguguugaguccuguacucaguguuuugaugaaagcaaaccaagacuuuucguuguauuaugguuucauuuuagcuuauuggagguagugcaauguggcgagcaaacucugaaguaagauauuuagucagacuugaauccuagacuaugcaaauucucuuuaauuuguaaaauacaaguaacaguucccuuaauuaugccagagaacuuugggcuccaauuacacagugaggacugaagcauccuaacugauaauucugccucauuccagcuuguguauuuauuaaaaauuuccuacuuggaucacauaguugguggaagggguuuggucuguauuuuuaaaucuuguaagaaaagcuggcuuuuauguuuuagguuggagcuauuguagaaacaaggacaucugauggaucuauccaggaagcuauuaucagcaaauugacagaugcuaguugguauacuguggguaaguaguaacuuuacauauggcuuuggccggaggcgugauaccuuuaacuuauaaauacagugugugugcauuggcagggacaugcauucuaugcugugaacuuacuggcuauagcuagcuaaagcuguaguggcauucagcugggagccaaagcagguaucaguuagacgacuugcaaguuuuuaucuuuaucuaagaguacuucuguuguacuguacuuggacauuuugucuucaggaaaguaacuuuuuuuuuccauaagacaguauccuauuauuucuguaacugcaguaaggaucauaccggcauuaucguuguugcacuaaggauaauguaguuguuacagcagaauguaaagaugggacauguucugccaaguagauucaagccgauguacuuguagcuucauggugaucuguguaguggauucucuugucaggaccuuucaagaaugaugcauauacuguuaauaugaauucauucugauucuauguauaaauuuacgcuggucaaaagugguggcaaauaccuuuauucccaguauucagaggcaaaggcaaguggaucuuucugaguugaaagccagccuggucuacauaaugaguuucaggccaagcgugaguauaaugguccauuccugugauccuagaacacagaggcaagaagcaaggaaucuguacuuggagaccguccuugacucuauacugaauuugaagcuaacccgggguacaugagacccccaucucaaagcagaacuaaaaucagagcgacggagcaagugucacagucuaugcaaauuaacccuucagagcugcacagaggugcugagguucuauauacugagagaggagagagggggguuguggguuuucugagacaggguuucucuguguagcccuggcuguccuggagcucacgcuguagaccaggcuggccucgaacucagaaauccaccugccucugccuccugagugcugggauuacaggcgugcgccaccaacccgccuacucucaguacuuugagacugugcacuucuguaaacuauccacgauguuuacacugcacaccguaaccccacucgcccuugcacaucugucugucugucugucucgcccuugcacagcugucugucugucugucugucugucuguagguaauauaguugccgugcugugcuuuccuugguuucuuagcuugacuuucaguuugauuuuuuuguuuguuuguuuauuuguuucucucuguuuuucugagacaggguuucucuguguaucccugacugucccuggaacucacucuguacaccaguggccuucaaccgugcaccaccacugcccgcuacucuaucuaacucacucuuuccaagggcuguuuucagaaguuuuacuucuuuggcuuccuggaagcaguggaucauguggcucuguuagucucagcuguauguauuucauugagcuaaauuguuauuauugauaguuuuuaaggccuuaaaaacugcaauuaaagccggaugugguggcgcaugccuuuaaucccagcacgugggaggcagaggcaggcggauuucugaguucgaggccagccuggucuacagagugaguuccagaacagccagggcuacacagaggaacccugucucaaaaaacaaacaaacaaacaaacaaaaaaauaaaacaacacaaaaaaaaacccugcaauuaauaauaacugagguuaauuugauagaaguaugcuauauuaaaggcuugguagcuacagaguuaugugagauuaugugaauauucaaauacuggugguauguccucugcaccacucacugucgaggcuacauucacaaccuguaugaugcuuucuuuaccugugcucugcagaagcauaccugugcaucuucauauuuucuguuuuuguguucuagaauaauugaauuccaagucuguccucuacacagauagcauuuugucaauucuagaaaguaguugcuagugagcauuauuuacagugcucuucugugauggauaaguucaguaggucuuagggaugccaaugcaagcuuucuuuguauaaacauccugaaugauucugacgcacacaguucauguagagaaaacaacccugugggccagugacauggcucaguggacaaaaaugguggguacaagccuggcaacugaauuagggugaacaccagaacuaauggagugggagaagagaacuaacccuucaaaaugcucucacuucuccauaugugcggcaugugugcacacacacuaaacaucacagagccagagggcugacguacugcucuugcagaggaccugaggucgguucucaguagucugcuuggggagcucacaacugccuguauguaacucuagcugcaggggguuucagugccuguggucuccaugguaaccugcacauaugccuuguaauuaaaaguaauaaaaauauaccuuuaaggaauaaauauuaccaaaaaagagagaggggugguggggggaagaaggaagggaggaaggcagaccacacaaaaagaaacacuuauuugggagaaaaacuaaaaaucauuggagcacaguuacaguucaaugauagagugcuugucuguaggcugugguuuugaucucuauaccauaaaaacgcaaccaaaagaaaaucauuggguuuugcacuuaaaugcauaaaugagguuucucuguaaguguuuaagguuuuaaagucacuauucacuuaaguacacucaagauaccaccuuacuguaaguaaaggcuuacaaggauguggaccauucagggcugaucagaggguagggaauauaaucaccaguggaaaggacagcguuggagaaaaugaaaugugugaucucucacaggucauaaaguuacucuuugugcgcacauguguguguguguguguguguguguguguaucugagaacauuugagagaacacuuaauuguuuugucuucugaaguuuucuucaugaaaauuucuaaaaaguauuuaguagauaagaaaauucugccaggcgugguggcgcacagcuuuaaucccagcucuugggaggcagaggccagcggauuucugaguucaaggucagccuggucuacaaagugaguuccaggacagccagggcuacacagagaaacccugucucgaaaccccccccccccccaaaaaaaaaaagaagaaaaggaaauucuagaaagugcuagugaucuuugaacuggauguggcucggugguagagcguuugcuucucaaggccuugggauugaucgccaguauuaccucucugcuaggguauuaaagggaagaguuccccucucuacucacgcacaacuugcuaauauugaacugucccuguccagcucaccagguauuuuaaguccagagucucuuuuucugggccaagcuagcucccgacucagugauccuugugccucaguaucccugguagcagcaaucuugggguuucauuuguuuguuuguuccuuggaggggucguuagcaauacuucucaccugacgugauggcuccucuuuauaauccuaguaccugggaaguugaagugugagacuuacuuccuucccucagauaauuuucugcuuuugugucaugcaugucugccuuccccuaggcuccugcuucccuucucacgaguuucuuuauaguuuuguuucaaacaugugugcguacucgugcacacaugcgcgcgcgcgcacacacacacacacacacacacacacauuuggagucuaggucucauaaauacauagcacuugucuuucugagugugguuuauuucccuuuacuuaaugacuuugagcuccaccuauuuaccgugugugucaggauuucaguuuucuucaugacuguaugaaauucuggcaucugugcgccacaguuuuguacaucuaggcugucugaucuccucacuguaaugaauacuccgcagugaagauggacgugccaagcgugugucugguauguuggcuuaagguccaagaaugauccagcaggucacggaguaguucucuuugaguuggaaccugcgcacuaacuucccuagcagcugagcuggugugcucucuccuccuucaugccccaugucuaaagguucuucuuccucuguaugcuuaccagaauuugugacaauuugcuuuuggugacagccucucacuaggggaaauggaaucccaaagcacuguuaauucacauucccugauggcugaggacagugaauccuuucccagggauuucauggcaguuugcagguuucuucagaacauuccauucaguucauuagcucaguuauugagcggaugcuuucguuuguuuugauuuuguuugaguuuugcaguucuuuaucuauuguagauauuauuaauacccggucuggcauauaguuggcaaagacuuucuuucaugucuaggcuuucuuccuguucuaagcuuuccuuguagagcuccuccagcucuucgcuuagguuuaugccuugguguugcugcuuuaaucagauuguucaaguucuuuuucucagcaaguucauaucacuagaccgaaaagcuaaugaguucuguguugauuuuugugucuggcugcuaugcugaacauuuuuaucaggccugagaguucacaguucugaagaacaagcuccacagccaugugggcaugucacagugcacauguggaagucaagggacaucucagccaugugggcaugucagagugcacgugcggaagucaagggacaucucagccaugugggcaugucacagugcacauguggaagucaagggacaucucagccaugugggcaugucacagugcacauguggaagucaagggacaucucagccaugugggcaugucacagugcucgugcggaagucaagggacaucucagccaugugggcaugucacagugcacgugcggaagucaaggggcacuuuuaggguucgguucuuuccuccuaugcugaucccagcauucccacucauguuaaguuggcccacaguuccuuuaaaccccuaagcauccucgccugcccuucaucaccuaccuguucuacugaauuacaguaaucgagauacugugucugaugagaaugcuguagaaccaauggcacagagcagucagcucagaaauaugucaugagcaugaguaacgacuucaguaacuguucugagaacacuagacauugugugaagaauggaaccagaccuuuaucucacacagcacgugagaacaacagaaaaaggaucagcuguaaacugaagaucgaucagccugcucuuucuccaucagaugucaggucucugucagaagcugaaguggacuuguuacuguaauggaaagcugaagccagcaccucaguacacauucucaaagggaaaaacacagccaaugcaagcuugcuuuaaaucaacaguucucauccuguggguugugaccccaaagaccacuguaaaacagauacuuauauuacaacucauaacaguagcaaaauuacaguuaugaaauagcaacaaaaauaguuuuauucuuggggucaccauaacgcgagugucuuagucaggguuucuauuccugcacaaacaucaugaccaagaagcaaguuggggaggaaaggguuuauucggcuuacacuuccauacugcuguucaucaccaaggaagccaggacuggaacucaagcaggucaggaagcaggagcugaugcagaggccauggagggauguucuuuacuggcuugccucaccuggcuugcucagccugcuuucuuauagaaccaagacuaccagcccagagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacagcgaggaacuguguuaaagggucccagcauuagaaaggcugagaaccacugcucuaaguaaugguguuuugauuaaugacugaaagcacuuuuuaaauuauuuuuaauuucuaugugacuguguguuugugaauuuaugugcaucauaugcauacaggugcccauagagaccaggaaagaguauuagauccccuggaaauuggaguuauagcugauugugagccaccccguggauguugggaccuuaaccucugggccugcuacaagaguagccagugcucuuaccugcugagccaucacuccagcuccuggucugugacuuguuuauuguucaucugagaucccagcccuuccuuagucacucuucucugccugacccagcuaaagcagcuuuaguucuguauguuucuccuacaguaaguagccuguauagaucacuguuuaaauauuauauguaugguuauuuuaccugcauguguguguaccacauguggcugaugugagggguucaggaaaggauaucagacccccugggauuggaguuaaagacuucauggaguuaugagcucauguggguacugggacucaaacccagauccuuuggaagagcagccagugcucuuaaccacuaagccaucucuccagccucccauuucauccuuuguacuguguguuugcuguuccugcucugugcuuaaauguuggauacuuaauaaucauguuauugagaccuccccuuucaggacuguaggaugcuuggcaaauaagccuaagggcggugacauaugcaguaucaccuagguguguccugagcuguaccaucuaggauugugaugaucucacagugauaaaaucaccuagccacgccucucuccaggcaggcgccguugcugauugaugugugacugcauauugaucauuacggaaguuaaagcugucaagagguaucaucucaugcuuguuagauuagcuguuaccacaaacacaagacgucugcauaagaauguagggcggagggagccuuugcuugcuguggguaagaguacaaagcagggaaaccaauacggagagcaguguggaggcuccucaugaaacuagacagggucucuaugguaacccaggcgugcucaaacucacaauccuccugccucagccuucugagugcuugggauuauaggcaugggcuaccauggacacuugauacaaaauagacagaccguauacacauccagcaauggcacuucuggauuuaugucuagagaaauaugagagcaggccucagagaacuuuguguauuucuguguucacugugacuuuauuuguaugcguggugguauggaauuccccuaagccuccaucaggggugacgagguagacuguggucugcugccacggggcacgcuugggcucagggagacuggaaauucuuccacaugcagcuguauagaugaauguuguguucaaagaaacaagaaugacauagaaaaucaaauacuuuacccugucauuuguacuuagaguucacaaagguccaacucacagagggugggaugaaggaaacugggaaaggcagggcugaggacugagggagauuucagucaggaggaguaagugaaugggaugugguaagggccuguagccuagcacuuccggcacuagcaccgggaaagcaucuuggccaguuacuaauagugcacugagauagacuuuaaauauuuucaccacaaaaaaaugugaggcaauacauguaugaggauguuagcuuauacacauguauugcaaacaucauguaaaaugccauaaacgucuauauuuuguuuugucagcuaaguaaguaaaaguaaaugauuuauuuguuugagucaagguuucuuuguguagcccugguuguccuggaauuuauucuguagaccaggcuggccuuggacucagagauccacuugccucugccucccaugugcugggauuaaaggcgugcgccaccaccgccuggcaaaauaaaugaugcuuaaaggacaauucguuauaccuaaaauaugcauauuuaaaguuuuuacuucauuauaugaaauauuuuguuccaucauaacugcuguguguguauguauauauauguauauauauagauauagacguauauauguauauacugauaauuuuauuuuuuugaauuuuugacuuccuccuccuuguagcaagccugggaacaauagccuaguguacaauaggcguguuaccuagggaggugcacacucauuuuauacuuacuccucagaccuacuaacugucauugauccuuuuaauuaucuuggaggucauuaaccugcuucuauauuuaucuauaagaagaaaauugugauuucuaccaugcagaugcuguuuugugggacuaacaugugguugaaguuuaguaagugacagucgaguaaaauaucuuuggaugguugccugacuuuaggcauuuauuaucccauggugucaaucaguuuuaagauaacagguagacagaucgucuauacuuaguagcauauuauauuauauuacauuacauuacauuccccuggauugucuguuuccuugcauucuagaggagugggguuaggguguauauauuuguuuacauuugucuaauuagaaugauuacuguugccuugggucuuagcuuugcuguuuuucuguaaauacgcuuuuguuucuguauaauaucagauguaaucauuuugggcugugcugaaauguucaaugaauuaucuauacaaacaucuauacagcuugcgauguuuacccccacccgauuaaaucuuuguagucucacacgauaugcuggaagucugagaaguuccugagagaggucugcugacuccacuuguuuugagacauucuuccuguguagcccaugcuggccuggaagucagggcagucuccugccucggcuucccacaugcuggaauucccccacaccugacuuucacaucacugauggcuagagcuaucuuugaugacagagaugucaggguuaguaaguccguuaugaucuugugcucucuguggcuuugggaaaaugguaacauuuacuaacaagcguguaaaguacccaaauguaugcaucuguaugguguguggguuaaaaucucuuuuaagauuuccucauuauauagcccuggcuggccuagaacuuacuguguagaccagaccggucuuauacucacgaagcucagcugccucugccucgugagggcugaguuagauucuuagccuguuucucuuuguucauagaagauuccuguguaagaugccaagguagcuguuugcaccacaguuccuuuuaagaaauccuucuggggcuggagagaugccucaguggauaaagcacuggcuacucuuccugaagacagggcuuugagugccagcacccauacgguagcuuacaacuguuuauaagcccagucccaggaucugaugcccuccucuggcuuccaugggcaccaugcauaacuauggugccuagacauacaugcagacaaaacaucaaacaaacaaacauaaaagauuuuuaaaaaaaaaaaucccuuuguuguuuuuuuuacaguauuuucaauccauaauaauggauguugaaacaaaaugaguuuuucucaucaaaaguacaacuuuauauuaaagugauuauuuaucuaucaagaauuaaggauaauguuauuggaguuucuucaucagaacauucuagggcuuccacugauaaaugauaaaacacuauggagaauauuuucuuacauaaauuugauagugccaauuggucuuaguuuuuuuagauugauuuauguguauaagugucuuguccacauguauuuaugugcaccauacacaugccuggugcucacaguagucagaagguggugaguguccuggaccugaggcuacagaugguugggagccggcacguggguuuuuggaacugaaccugggcccacuguaaaagcagccgaugagcuuaacugcgcuuaacugcggaguuuucuccccagcucccauauugguauuagauuuuuuuuaccuuuucuccucauacuugcauucaaguguccauuguaacucucucucucucucucucucucucucucucucucucucucucucuguguguguguguguguguguguguguguguguguguguguuuuaaggcagggcuucacuguauaacucugguuauccugaaacgucuuaaguagaccaagcuggcuuuaacugcauggaagugggcuuggcucugccuccugagugcugggauggugugcauggcgguccgcaccaucauggcuggcuugauuuuauucuuugagguaucuuguauagugacacagauacaugaagaauuguguuaggcuugguuugugaggucagggauugggauuuuuuaaagaauaguuauucauuugcugugcuugauaaugaaugcagcauacaucaccuucauucauacccccucacaccacacacacuggggaucgaacucagggacuuguaccaccaccgaagccuucuaccacugagcuaggggcaauaggggcaagcucuauauuguaauuuugucauacauaguguggacuauaauacucagauuggugauagaauccuagggaugucauagggggguuguuauccugccucccuuaucucugcccuccucacaucaccaccugggauggcucagaacucaugauuucccugcuucagccuccugaucacugggaucacagcuccaggccaccuagcuguuugcaggcauuguuuaucuuacugaauuugcaggcagccauucaugucugugucacagacaggacccagcauggcugcuuuccuuugaacguaugucaggagcuuuuuauuuucuuaaguuguccucugcauguaaaauguuuucacuaaagaauauauuucaucucagaggaagaagugauuaaaauaggcagaugcugagcauguaagauugcuuuuugcagaaacuucuuaagucuuguuuguuaagagcaagugugugauucgaaggcaaaauacucccuagcaacacccaucaaaaaacaaugcugggggccgggugcuguggcucaugcuuuucaaucgaggacucugcuuucaggaagcagaggcagguggaucuuuaugaggcugagcaccccgcccccugguccacaaagcaaguuccaggacagccagggcuauauagaaagacggugucucaaaaauccaaaagaggguaaaaaagucaggcuuuaauuuuuuuacuuauuuugggcuuuucaauacaagguuuuucuauguagccuuggcuguccuggaacucacuauauagaucaggcuggccccugacucagaucuaccugucugugccucccaaguacuaggaucaaaggcaugcgcuaucacaccugaauaaaagucaggauuuuaauucucagauguuauaccaauucuuucugcuuaguaggaaaggguggggguggguagggugugcaugcauauguguguaugcguguuuauuugauauguugagaauuucacuauguagcucaggcugcccugaaucuucuggugagccuugugucucugcauccugaguauuuauauauuuugcaaagcaguuauaggacuaggaucacagguugagaccacacacauuguguacuccuuagaaaaaggauuagguggccauuuaugugacauaguaaguaccucacaguaauacauggggucugggugucacugcuagguugucaagcuucucggcaagugucuuuuaccaccuuagacauuuucaagacccaugcuuuuuauuuuguucuggcauuuuauucauuuuuacuuuauauguaauauuuauucauauuuaaauugauuuauuuugagacugcaucauguuguucagccuccugccucaguguccccuuugcuaggaugauggguuggauccaccaucacuagugguaaccguuguaguguauguauccuuuccugugaauaugguuguugguaaaaugcauauauacuuuugaaugaauaugcauucacucuuugaaguaaggauuuuaucuuuguauuuuauuguugcauaauucuggacaacuaagugucaucugagaauauuuacuuuuuaauaaacuauaagugacaggugguagaaccgauacauucugaaaauuuuaauauuaaaaucaucaaauacuguagcuaggguuuugaaaauuagggauaaauuauuacuuacuuggauuuuuugacucuuacacauuaccaaguuaggcugccaucaaaagguacaaccuuggcugccuggcacaguggucuuucuggcuguccauucagggacaucccucacauucauggccucagucggugccuuuccucagucucaaagggaaauuccguccuugaucuaaagguagaaugaaguggccgaaguuggcaaguucuguugcuugcuggggcuggucaugguccucuuguucaauuacaucuucaccagcuuucuguuuuccuugguuuucuugacugccuaagcuuggcuguucugaaccuugcucuguagacaaggcuaacuuugaacuuggagagcugcgugucuguuuccugagugcugggauaaaagguguuuaccaccacaagcuuuucuuuaauuccuauucacaagauacaauucugucugggugggaucuuguccugaggucaccacucucuuaauugcauuuaauaucuuuaaucuguuuaucuccuugaucacaggauuagcuccauucuucuuccugcugccccuuuagcccuugaagcauacuuuuuuauaguuuuccuuucucagcuuucuaccuucaaccaaaaugcucuucacaagagggaaccacaggacagagacuguguuaggcuguuuugagacuuccuuugccaauguaauuaagcuaaaucccaccuucgccucaggcagacuguuuggacaagaguaaaaagcagccacacucuucaccaaaauagcacaagaacgaucucuaggcaacaugcuaaaauuccuuuccucugaaaaauuuugagcuagcaccccaaaguucaaaucacccugagcacuguugucuucugcuuccuccugggaugacccacuaagccccacuuaaagcauuccgccgcuuuccaaauccaaaguuccaaaauccacguuacuccagacuaaagcaugguugggccuaucacaauaauauuucauuccugguaccaggaagcaggauguguuuuauacuggguguagcuugagcauuuaagacccuaaagccccgccuccauagagacacacuuccucuaacaaggccacaccuacuccagccaaaccaaaccuccuaauagugccacgcccugugggccaagcuuucaaacacaugagucagcagggaucauccccacucaaacugccacaaguucugaaauaguaguaacacuguuuacauuguugguuuguugguuuuuuaaauugaugugcguagagucucagacaucuuuugcauuuugcaguguuugaugacggugaugagagaacucugaggcggaccucacuuugccugaaaggggagagacauuuugccgagagugagguaggguggccgggacugauauggagggcagcacgugaugggaaaguggagugugaauucaguucuuugucucuucugcagacucuggaucagcuuccucuaacaaacccagagcauuuugggacgccagucauugcaaagaagaccaacagagggaggagguccucacugccuaugugagugcucacacuugguuacucucucgaugguguuaaagccuuccucugcugacuuuccuaggauggcuauguccugaguccugagggguaauguuuccauggcauacuguaagcugcacauucggcccucagcagacuucguuuuuaacuccuccauuacagacaucaugaaaauuccacuucccaaaauacuauuuuaauuugcuuugacagaaaucuuuaauuggcaagguuuuccuuuauuaaguaauuacuuguaguuuuuuuuuuaucuuuuuauuuaaaaacaaauuuuguuguuguuguugcuguuguuguuuuuucugagacagaguuucucgcuguagcccuaguagaacucucucuguagaccaggcuagccuugagcucagagauuugcccaccucugccuccugagugcugggauuaaaggugugugucaccacugacugauuuacaaauaauuuugaauuuaaaaauaacaauacaaacagucuccauaugucuuuugccuagauucaacaguguuacuauuucugcccuauuugccuuaucuuuccaucuuuuuguauauacauaauuaguuuucaguuucauaauuuuacugagcccuguggaagaaaacagcaucacaauucuugggucuuauauaaaauacugauaucauaauuagaacauugaguuucacauauguaaacuauggaacccacaggcaaaccccugaccauuugccuagugguccacaguccugggccaggccugaucuaccugccucacaguuuacuuuguggcaucuuguuacuucacacucucagcauuucaggcccagcuguuguccuaggcgccuucagagcauccuuucaggauccuaaccaaggucaugugcauguggcugcauuucccugauugugguucaugaguuccaaaaacaguuguuagcuuuugguguuacggacauuuaagaguacaaguggaugcagauguuuuucagggguuuuucauuuauagauuaagguuauucaguguagacagcaaguggugugugcucuucucaguguaaggacaccaguagauacucaccaucuguuugccccaucauugcuggcaucccuguggugaguggcuagugcucuaccugccuaguuccugggcauagaguucuccaagucaccuucccuucuccccucuggggugcggcuccccucaagcuguccuuccuccuuguuuaauuacucacuggggcuccucuuauauaucagcacuguuacagcaaaacaaugacuuuguaacuuuucccuccagccucauuucuuacuuacauuugguugucauagcuauaauaaagucuuccuaggccagcaaggcaguuugcagguaacagcacuuguuaccaagccugucuauuugaauuugauuccugaaucucccaugguagaagaagagaaccaagucaugcaaguuguccuuugaccuguauguaugugcuuuggcgcuuguacguacagaaacagacacacacacacacacacacucuacaggauccuauuacuaguuuauaacugaggacaaugggauugauagugucuuggcaguuuggacuaguguuguguguguuuuccaguguguagcaagugcuuagcacauuuauuuaauaagucauuaaugguauuuguacucauaacauaguauuauagucuuuaauaauuguaacuuucaaaaaguugaguaggcugauauuucagugcaggacacucacauaagcaauuguagguguuagagcuaaagauacggaaaugucgucaguguggaaaguaaagaguccugugguagcuccuaggcaacgggucugugagaggaaaaggaccaagugccucagaucauuaguaguuaacagcccugcauagugcagugaauggcagauaucagcauauucaggaugcuucaagagcaugucagauuacuauuuaccaugauuuuaaaagcguacauucucauuuuuauuuaaaaagcauagacucauaauuaaugcuuguuauggacacuuagaaguaaaugauuaccccagagaagauaccugaauaaacccacauauacuuuuugggagcuauuuucauacccuacuagaaaauuaaacuugcauuauuugcccccuggcauuaaaaaccagacagguaauguguuucuaaaagugaaugaggugauacagagaaguuaggcuucucuguccuggcagaggaaccgaagcccagguauucacugaccagugaagcaaacucaaguguugcuuacuuaggugguucaguuacuugugugaggcaggagacuguccaucuccucagccccaguaagaauggagaggcagccauaggggccaguggaccaugcagaagucacagcacucugacaugccuaggucugggacacuaggauauggacauuuggauaaugaccagguucuccugacucuuagcacugaagacgaaaaggaagaagaaagcagcgaagaggaagaugaagauaagaggcgucucaaugacgaauuauuaggaaaaguuguaaguguggccuccacagcagagagcacuggaugguacccugcuuugguaaguuucauugcaaaauuagucagcuguauuaguugucgagaauggauuuuuuaaaauguauguaaaauauuuuggaaguauuauaaaucuaacgaagauguaauuguaauuuaauauuaagacaggcccacucacauggccauugucuuucuuuggcuuuccuucuguuaucuguuuguugaccuuucagguuuuccccucagauguguucuucauucugcccuguuuaucgccucaccgcuucaguuccuguaggucaaguccucaauauucuuuauggcuguuuuguuuguuuuacuggauaguccaggcuggcccggaacuuacuguguggcccaggcuggccucagauucauaacaauccuccugcuucagucucuucagguguaggaucacggugugagccaccacaucuggcuucuuaauucuuucuuuauuacauucagcuaauuaucuagaacuaaguuuuuagguagaaccauuuaaaaauaaucgauuuaucucacaguaaucccaacaacuuggucagauguggugcuucagggcuguagucucagcuucucuagaguccaaaacaggaagugugcuucagcccaggagguggagacuaacuuggucucaauaacaaaacaagacacuggggguggggcagggaacaagcacacugguaagagcacuugcccugcaagcaggagagcuuggggacuccggugccuauguaaggagccaggcauagccugggguugagugcccagacaacagagucaaaaccacgcuguccagccagccuagccaaagaagcaagcuucaguuaagcgagagaccuugucucagcgcagugcagugucggagagugacagaagacaucuguucccguguuuugcaucccuaugugcaugagcacaugcaucaauguguucauaugcacccacacaucugugugcaugcaccacacacacaugcgauauacaaaaccuugaucuuucaguuaauuaaucuaguuuuacugagucugcuucaucaacuaauuucacuuuuuuuuuuuuuuuuuuuuuuuugguuuuuugagacaggguuuuucuguguagcccuggcuguccuggaacucacucaguagaccaggcuggccucgaacucggaaaucuuucugccucugccucccaagugcugggauuacaggcgugcgccaccacugccccccuucaaauucuuuuaaugaauaucuaagacuccuucaccauaagcucccuuccacuuucuuauuuuauuuuuuuauuuuuaaagcaucugagugcucuaucugcaugaaugucugugugccagaagagggcaucggaucccauuacagaugguugugagccaccaugugguugcuguggauugaacucaggaucucuggaugagcagucagugcucuuaaccacugagccauuuuuucagccccagcuuuuuuuauuuuuaaguuuuauuuauuauuuauauguagcugucuucagacacaccagaagagggcaucagaucccauuacagaugguuguaagccaucuugugguugcuggaauuugaacucgggaccucuggaagagcugcugucagugcucuuaaccgcugagccauguauccagcccaagccccagcuuuuuuauuuugaggcaggguuuuacauauuucaggcuggccuccaauuugccaguccgccuaggaugaccuugaacuucaccucccagacaccauuggcccaggcaugcuaggcaggcacucuuccacccagcuacuuuccuuacuacgccuaagcuaacuucuucaauuugugcgccuuuacuccacccugaguuaaugaguguuaccugaggacaggagugagcuugcuuugccuugacuguaaauuccucagaagacaggcaagugugggcuuuucauugugacucccaagaacaugcgcucuacacauaaagcagacuauguugggaguuauagacucauucuuuaaacccaguguagcagcgcacgccuuugaucccagugcucaggaggcagaggcagauuucugaguuugaggccagccuggacuacagaauaaguccuaggauagccagggcuacacagagaaacucugacuugaaacccccugucuccccaaaaaagugguaguaauuuuuuaguacugguacauaaaguaaacuaaggaaguaauagaaaggaaggaucuccacccuuagauguuuaacgcuguagaaauggcgguuucauggcacagaagaagggacagauggucacagagggucuuuuaugagaggucggagacugcuuagguguaguugucucacaaaaauccucuuugaccgauggugagagagaggagggggagaauaggaugcaacugcaaauaucauugacccuugaagcagaagggccuuccaagggucaccuaaaacucagggauaauucugcagauaguucugaaaaggaaugguauuugugcugcauguuugggaauauucauaagacuguuuacagaaaucaauauggaggccauuagaguagcucccaggugaugugaugagacuuggacuucuauuuauuuacaucucaggacuugacuaccacaccucuucuagcugaguagggcuaauuuuccugccuuuggcacuguccugugccugguguaccaaugggucaucccccuguuguguucuuucuuguaugucuuagauuugccccucugugugaagcacagcgacucuuacuagucugacaguuauuaguaccuaguacucacaagaccuguauuugucucugaagccaaaguguggccauccaugucugugaucuuaacaauuaggagaguaguguaaguucagagucauccuccauuaccuacaagguucugggcagaugagaccugccaaaaaccaaacaguaaucaauaagaguaucuaaaaacccagugcaguguggugucgcacaacuugaaucuuuggaaacagaggccagcagaccucugaguuugaggccagccagguuuacauagugaaaccuugucucaaaaaauaaguaaguaaguaaguaaguaaguaaguaaguaaauaaauaaauaaauaaauaaauaaauaaaaaucuggcucugugguauugaacaugauaguuauaaaguguauauuguuauaauaauaaacugaaugaaugaaacuuaguuacaaagaauggaguugggagccagagugugagugagugucugagacacacuuuugccuacaacguccaggacucuggguuuguuaaggauuaagaguaucaugaguaagucugucucagcaacuuuagaagugugcuacccagcuugaguuuuuaaaauacaaaccacgacuacaguacucaaaaauuacucacuaagcacacugcuaaggcauuuuuuacuuucaaaggcuagauuaaaaguuuucuuuucaaugacaaacugaaaauuguucaugcccuguuaaaaaagaucuuaggugguuucuaaccgccagauuuuaaagcagaugcguacugaggugucuuagaugaaggucuggagugcugcuucagugaccucagagcacagugaccugcagaggaccagaguguagggcacccacaggacugacgccucuggucucucugugagugcaugcaugugcacacacaauggaaaaauaacaaaaaccaaaucaguggcuugucccuucaaucccagcacucaggggacagagggagacaaacaucugugggcuugaggccagccuggucuacauagucauuuccaagcuaguuaaugauacauaguaagauccuguuucaaaagaaagaaacaaaaauacucaccaccaauuaaacaaacugcacugugccagagggaggagaguacagaguucagucauccuuggcuauguaguaaaguugacgcgaacuugggcuauuaggagucccuaucugaaaaaaaugaaaagaacagaccauacauccauaaauguuacuguuuuggauaaaaaaucaagucuugagccaggaagauaguugcaccuguagagaugcuuaugccaagcacaagccuguggccugaguuugaucccagggccacaugaggaaagagaaaaugguagcaaguugccaucugaccuucauaggaugcuaggauacauguguacccuuccucacaaaugaauaaaugugauaaaauaucuuauuuagguuugaauaagcucuaauuuuuaaagugauacuauuuuaacuuauauuucauuauuaauuuuuauuaccuagugagcauguuaauaucuagaaagccaauaugcuaaaaaauaaugaaauaaauuuuguaauuuauuaguaaugggagcuauuagaaauugagcuauuucuuguaaaacauaauccauaugaaacauuagcagauccagaaaaauuuuuaaauuuauuugauuugauuucuuuauguaugggguguuuagcuuccguguaugucuguguaccaacaggguggcuggcccuugugaagccaaaagaaggggucagauucccuggaauagaaguuacagacaauugugagccaucauguaguugccagggacagagccugugucaucugcacccucucagcugcuaagcugucucuccagucucccugcccccaaguuauuucuaacauuacauucuugggccuggcaagauggucaguaggucaaggugcuugccacugcugcugacaaaccugaaccggagcccuaggaaacccacaugguggccggagagaaccaaggcuuaccaaguuguacuuugaccucuacaugaggguaacagcaaacuugaacucucccuaccccauacacaaguagaugaauagacauaauuaaaaaaacuaaagcauucuuguugagggaugugacugaguagaugaguccuuuccuaacagaugaaaguuaggacgggaguaggggaggggggguggggaggggggguaguaaauaacaaaauaaacguucauuuucugagcaaggggagucagucgauucugauuuuguauuccagguugucucucccagcugcaaugaugacgucacagugaaaaaagaucaguguuuaguucgaucauuuauugauucuaaauugugaguaaugaaacaccauccaguaaugauucauagggcugggacacagugauuggccaccuaccauaaagggacucauucaaguugaaacugagagguuguuauuacugugcuuauguaggguaccuuuagcugauaaauuuuauguaaaaauaacaauaaguggcagcaguauuaaagaccuguauuuguaauuaaaaauauauauaguuuauugaaaaauuucauauuuuuaucaugugcuauuucauauuaugaauuaugaagcuucuuaauaaacuauugguaaaauaaguauuuucacuuuuaauuuuaaagaagacuuugagaaacuuuccuuuaauuuuguauuuuuauuaaaacaguaaaauucauauuuuuaaguuguucucuaugaaagauauaccauaguauauauaaucauaaaaauauuuuagcaaauuaacaaaaauuaggaaauauuaaacaaaauggguguuaucuauaaguauugaaaugacuuuguugauugaaacuauugucuauaggaagguuguauauuuggaaacauuguaaauuccaggcucucaaauaagaguacuugaguacaugaaacuuaaaagauacaacuuugccuccaagguuuuuuuuuuuuguuuuuguuuuuuguuuuuuguuuuuuuaagauuuauuuauuuauuauauguaaguacacuguaguugucuucagauacaccagaagagggcaucagaucucauuacgggugguugugagccaccaugugguugcugggauuugaacuucggaccuucggaagagcagucgggugcccuuacccacugagccaucucaccagccccgccuccaagguuuuacuaaggaucagggcauuauggccuuuggcuuuuauaaaacacuauuugaggaaauaauuuucauuucuugaggucuuauguauguguggauauggauugcuuaaaugauguuuuucauuuaauaaguaguucuguguuuuguucuuuuuucauaguuauucuauagcaagaaaggacauuaaggaacuggacauucucacucuaccagaaucugagcucugugcuaggccagguacgugaaagcagagucaguuuauuucaugaugugaccguguuuagaaaauaacaaguacugacuauuaccauauucaccguuuggaauccuguaucugcccugucauccgugggcugcguguggcccaauacagugucaguaaccuuacagagugagcguuucugcugcuccuugccuugugccugcgcucgguuucugagugugagccucacagauaauguguuggacacaccugaaugauacucucacuuaauggcauuuuuuucaugucucgauaaaauauuugguuuguaaauuguacagauuuaacucugcauguuugaucguuaguauuucuucuuucagaggggugcagaaggguugucucuuuacauaggccugguuguucuggaacucacugcguggccuugaacucacagggauccaccugccuuugucucccaacugcugagauuaaagucaugcacuaccacaccugggcugaccuaguucuaguaguggggcuagagauggcucacagguuaagagcacuuguuacuguuacucuugcagaggacccagguuugguucccagcacccacauggcggcucacaaccaucuguaaucaguucucgggaauuuaaugcuacugguggacuggagucugcccauaaauaaacacaggacagucauacauaaaauaaaaguaaauucuuuucuuuaaaaggcgauuucuaaucuuugccaggcuuggugucacuuaagagguguccauguuaaggucgcaaguuccaggcuagauugggcugcauagugacacccugucucauagcaguaagcaaacauaaacgccuacagauuguaauaaaaucuacauggucuucugacucaugagacccccugauuuccucuaucauuuugagaauaauggguggacuuggcuugagccuucagacugagcggcuggcaucucccuccccucauuccggagcaacugccaaaguccauguuuccuuucagggcugcgaagagcaagugucuuccuaaaagguaggauuguuccugauaauuggaaaauggauauaagugaaauccuugaguccuccagcagugaugacgaagaaugcccagcugaggaacaugaagaggagaaggaaaaagaggccaaaaaggaggaagaagagcugguaggucaacgcugugguuuguuuguuuguuuguuuguuuguuuucuagugaaaauaauaccucuaugcuuuugcucuggggcguuuguuuuugucugaaacauuucuuagcuuaauuugguuaaggaguuguggcuaguuggcuuagaguguaguguauaaaucaggacugguuuucagcauaaaguuaccaaaaaguacuuuucgagguuaaucaacaagguuuuggggagggggggaucagguauuuuccguguuuaccaguugucagugugugaugucauuguuaccauccugcuuucagggugcucugagacucagaaguuaacuguccugagcuggcacagcuaaaaugugcaguguagggauuugaaccccggucuuguuucuccuaacuuagaaaccuuuuagggguuaaauauccuaauuacauccaaagaaaaacacaccuggcagcuugacaaaucauagaaaaaacuguagauugugauuuuaucaugaguggguuucuuuguacugcagccguguugugcaugcucugauuguagguuacagaagccauccauaggguuaccguggcugcucagaugcugccaggcuguggagucgccaggguuuuguuaaacgggaugaauuuucuaguguaauuucaguuguugagaggcaaaacaaagcaugaguuuauugaaaacgaccaccuauuugagcaugaaaaauucugccuugaaaaugugcgaugcuuuuguuuguuuuacaugcacacgugugagcuuuuggaacgccacggcuagauuuauauguggggaagaauguaugcugguucuugccuuugacuuccccugcagcauuuggcuuuuuacacucugaaaucagaauggcgguucauacuuacaggcugccgacagaguugccauaguaacaugcuguugguuuuaagugagcaugcucagaaagacaggaaggguuagcagaggcuuggcagguugccaguggagguuugccagcugcuuugaaaugggcugucuuucucuuccuuucauguaaugucugauuuuuauguggaagagaauguaaguagugcuguaucgcccugcggaugcugugaccucagaggggacagcagauauuugccaaucagacugacaugcccagagccugcacuaguagaaggggaaucuaaccguuuugcauuugaaaggaaaugcagcacauagguaagacuuuuuuuuuuaauauuuaguuauuguuuugguugacaaaaaaugagauuaaauacaauuuuuagguguugauuauauggcugguacgguagagcucauaaccaagcauaauuguuucuuguaaaagacaguaggaaucuauuuuuagaagauuagaggguaaaggggauuuuucuccaacauaagauagcuuuuggaaugacugugcugagacaauuuggcaaaaaaaaaauugucuuaggauuuaaauuuugaauauuagaugugaugucugaauuuuauguguauuuagucuuagguuguguguuucaggguaaauaggccacauuuucagggugugaacucuuagcaggcugugguuagcuguuggauuucuauugaacauuaauuaggaucuuauaucgccaaaugcugaaagaaggguuagucucuuuauuucugcuaauacuuuuaauuagugucccuuccagaauguauuuucccuaucccucaaaaaauagccugaaauuuuaaacaaagaggcuaaaaagagcuuugaaagaaguugcagaggugccucuaagacaguaaauggugucuguguuauagugauuaauucuguaauaguguaauguuucauccaaguggcuagugagaaaugcuaggaaaaaugcacagagcagaggcuaaaauuugcaggaauaacagcaaagaaaaauucaaagauaaggacacuuagaaaaauaaugucuccuuacagugugucucuuaugaacuugcuaaaauuuaguggguacgguugcuuuauuccugacagaaaaauagcaaaaaucacaaacuguaggcaugcuuuaugcaguuuauucuacauuauuucucagcugcucauuuucccacuguuuggucaauugccacaggcuuguuguaaaguaguucucuggccaccuuagugggcuuccuuuagugagaucguguuuguuucaggggaaggaucagcugcauuuccugcucuuggauuugagauuuaguugcugaaucauucuaacucaucuugaagaauaauucuuaaaacaauuuaacaugcugaucaaucgagagcugcuucaaagcacacauagcaagaggagaaaccggagugugaugugcacuggcugaucugaggagccagggccuaccuggcuuagucauuaugggccuuccccacaccagugaggcuaacugcuguauuacaguacagagcauaguucucccucagaugaagggaugcugggcugcuuaugaggaugggaugcugcucuacaaggaucuaaagauccuuuggaacauucuguaaaccauuaaacaacacuguagaucgucagccaggguaggcuagcaagcauaugcugcagaaucauacaaguguugguguuugugcagugcgaaugagcaguagccucuguucguuaaccgugcugcggggauucaagcauuaguuggagcaguaagauuggacauugugcagcuuuccaggggcaggagcuuuuuuauuuaguauuuuauuuccuacucagaggccacgucaggcuuugaguguaagcagcgugucucaggcugugcuuggaagagacuugcggauggggcaggaauacuuccugucuguauugguaauugcaacacauagauaacuaggccaaaaagagcugcuuagagaugauuuuuguggucuuauuuaaaugucuuuguuaagaaaguuuuauauuagaaaagacauuacuaauuuuuuuuagcuuggaaauuuauuggaaaguccagaugaauagaaaugauaggaauuauuuauuucucuugacuuagguuuauauuggauaaauguaggggaguuuucuaaggguaagauguuaaaagguuaauuaucaagaggaaauuaaccaguuuuagguuaaaucaucaugacuuuaucaguagaccuuguguaucagauuucauguguaacaaugaaaauuaaaauuagugaguuuuuuuauaagaucuacucuuuuuggucuaauguauugacauacucauuuuuccaaucuugaagcuuuuguagggauuaccauauuuagugcccaagauaauuuuccauuguuguaaaagucauaagugcuuaaguuuuuaaauuccuggaaauaugacuauucuuuuuuuugguauuugaaucaaaugucaucugugucaaucucugcccauguagguuauaggcauuugcuggugacuauucaagaccacucuguguauagacccacaguaaaugccugauaacucaggaaaacuguaaugucaguaaagcuuaagguuuuaaauuuuaauauagauaucaaagcugauuuuaauaacuucaguuaccaauaauaauaggcuuuaaguagauuugacacaaccuccuuuaaugaauaccuuagauauuagcuuacauucaaauacaacaauuugcuuaaauuuagacuauuaaacaaggaaaugaaaaauaacagugggcuggacagagaugguuaaggggccaagagcauggcagauugugcaaaagaccucagucuggccaguuugcuacuuagcacccacauggcaguuuacagacaucucuaccuccagcuccaggcgauccagugcccucuucuggcuuacucaggcacugaaugcauauggagcacuuguguaugcaggcagaaacauacauacacauuaaaaaagagaagucucuuuauucuuuuaauuuuuuuuucuuuuaugagcacacuguggcugucuucagacacaccagaaaaggaaaucauaucccuuuacagaugguuaugagucaccaugugguugcugggaguugaccuuaggaccucuggaagagcauucaguacucuugaccauugagccaucgcuucagccccgaaaucucuauuuaagaagucuuaaugaguuuuuaaaagucguuacuacuucagccuaaaacauaaacaacacuaaauucacauaaugagacuaauaagauuuauacauuuguucacauaaauuuagcuacauuuuaaaaauaguuauuguguagagguguucuaucuguaugaaugucuuugcacuacuugcaugccugguaucuguggaggccagaaggcgggagucagaauccccuggaacugggaaucaaauccagguccucuggaagagcagccagugcucuuaaccauggcgccaucucuccaugguuaaaaaaaaaaaaaaaguuuuacguaaucauacuuuauauuagaggucauauaagagguuugggugacguuaaaaacuugaugauaaccagcuggugauggugcaugccuuuaaucuuagcaccugggaggcaaaggcaggaggauuucugugaauuugaggucagccuggucuacaaacaggguuacauagagagcccuugucuugaaacacacacacacacacacacacacacacaugcaguauuugcaaacaaauaauaaauaaauaagauaaauaaauggucuugaugagagcacgacuaucacaucuugauuauaguguauguaucauuucaaguggaaaaguaauuuauuggguuuacuuuaacuuuugaaaugcaagagucauaaaauuauuuuaagugggaugguuaaauuguaaaacagcaucuugcaguaaauauaucacuuccuuuguguuccuggaaguguuuggcauguguguaacagugaggaaugguauuucagugaggaaugguauuucuguaaauuuuaggaucugaguuaacugguucuccaacuauuacuggguaauucaguguuugcaaucaagucaucuucuuugaaugucaccuugucuccacuccggcuuuggaaagaaacccccuaaguuucgggugggagcagauuaugaaccgcaugaggcaugagaggagacuuagacccaacagccuguucuuuuucccaggcacacuugacagcgugucgcccucugagagccaggucccugggguucugcucuggaucagaagucugagucuaucagcucccucuccuccuccucuagcccauuccauucuguucccgccucuucugcccucaaguuuccuccacuugucugucugucugucugucugucugucugcgcuuacccuuuuguccagguugcucaguugcaucugucacuguggugucuuguccucucaucacaaccagaacaacugcugacagucaccagagaccuuuaaccaaacaacaguguuucuuaucucaucugacaccuuaguagcacucagauggcaugacauuacauugguuuucugguuuacuucccaacuaaaugauagaaugaccccaaaucucugugcacaccucagaugucucuuggcuacagacauuuauauaaaacugucuggaauuuuuuucauguuuauaaguacucaaacucaguaugcccacagcuucgauuaccucccuuccuggccauuccuaaucuauuuuaauaaaagcaccacacccaguugccuaagccagauacacagaaggcaccuugauuguuuucuuggucuuuccaucugaauccauucagacacaaacccuuugucuucuaccuccuugaauagcuccuuacuuugcccaccucuuuacauuuuuacucugccgcacuugguccaggcaaucucuggcuuuuccuagacuagugcauuagcacauaacugcuggccugccccucccccucccccaggcuggucucugcacuagaucugaagcuaguuuuuucaaaccagaaacuacaugugaucccuuugggaauaaauaauuuuaggacacaaaagagguguuuuuuuuuuuuaacuuuuuacuuaaaauauuucuaaagcauguuauguaauaucucuuuuucaaagcaguguacuuggcauuacuuaaugucacauuauuccagauuuauuuauucaggaaauucacugcugucaggaccuuuggaccuuacacaaauacugccuacuuaauuuuuaaaacuuauuucucuuuugcuuuauaguuaguuauuuauguacauuuuauuuggguagaggaggcucaccagccaugcuagucaggggcuugaacucuggcugugaggcuugguagcaacccgccaccauuauccacugagccaucuccccaccccuguguauuuaaggcaggagcucuagaagccuaagcagaagaugaccuugaauucccccuaccuuuaccucccaagcucugggauggcaacuguauccuauuuccugcucuacuaucugguuuuguauuugaaacuuuguacauaguuggguuuuuguuuguuuuuuguuuuguuuuguuuuuacuuuguagauuguucauuagcgucuauguuaaguucucccucccucgcccucccucaccuuuucugggauguaguguugcucugcugcccaggcugaccuugaauuccugcgcucuugaauucucuuggcucugccuccugaguagcugcgacuacaggugcaggucauuguaccaagccuuuucuuuuucauuuuuuuagauuuauuucauuuuauauguaugaguguguugccugaauguauguuugugcacugugugcaugcuuggcgucuagggaaguccgaauaaggcaucagaucugcuggaacaggacuuagggacaccugggagacacuguguggacucugagagucaaauacuucugcaggagcagcaagaguucuuaacuguugaacugucucuccagccacuuaaaaaguauucuuagggcuaaagagauggcucagugguuaagagcacugacuacucuuccagagguccugaguucaauucccagcaaccacaugguggcucacaaccaucuguaauggaauccaacauucucuucagcugugucugaagacagcaacaguguacucauacacaaaaaagaaauaaauauuuaaaaaaaucuuuuugggugcuagagaagagauagcugagcaguuaagagcacugacugcucuucccgagggccaaggaucaaucccagcacccauguggggcucacagcucuguaacuccgguuccagggaucaacacccuugcagacauacaugcaggcgaaacaccagugcacauuuaacaaguacuaaauacauuuuaaaacauauucuuaaaauauuuuucuuuuuaaauugaagucguuauuaacuauuccaccgaggcacuguaaugugucuguuguauuggaacagaacaucugccagcaguaaaguaaaccuuuucucaucacuguuggaaucacccucuguuagggugugagcaggggaagccgacuaauccaaaucacuuuuugcuuguuuuuacagacuuguugguuuucuuuuuuuuuucuuuuuuuuuuuaaauuagguauuuuccucauuuacauuuucaaugcuaucccaaaagucccccauacccacccccccaauccccuacccacccacucccccuuuuuggcccugguguuccccuguacuggggcauauaaaguuuucguguccaaugggccucucuuuccagugauggccaacuaggccaucuuuugauacauaugcagcuagagacaagagcuccgggguacugguuaguucauauuguuguucuaccuauaggguugcagaucccuuuagcuccuuggguacuuucucuagcuccuccauugggggccgugugacccauccaauagcugacugugagcauccacuucuguguuugcuaggccccagcauagucucacaagagagagcuauaucuggguccuuucagcaaaaucuugcuaguguaugcaauggugucagcauuuggaagcugauuaugggauggaucccugcauauggcaaucacuagaugguccauccuuucgucacagcuccaaauuuugucgacuuguugguuuucaaaugcaaacugccuacccucuuaucaguaugaauguguauaucuaagagauuguguguguguguguguguguguguguguaugugacuguggacggaaguacuuagauacacuacuccaucgugucuucaaagcagacuugcuagcucaguaggcuauccaauaccuucucuauuuucucauuuuuuuucuuaugagaaacucucugcuuucacaagcacuucaguuucuguuuccccuuuucuguguuguaaauggacacaaggugugccagggauuuuguucuuccuccuuucuccccaggguacccuggcagcgagcacuauggugcauggcccauauuaaacccucaucaccuaguuugugaagaaugaauaaauguggauuauguaaaaucuugggaaauugcugugugaaacaaguuguuggacuguuguuugaaguuaauuggaacagucuuugacacaacuucucuuuucuucaaaauaccucauuucuuacacaauguagucuagguuucucucucucucucucucucucucucucucucccucucucucuuucucucucucucuguuuuuaaauauuuuccucccaccaacuugggauaguuuucuguaccuugccaaagauucaaagauuucuuguuuaaacccuuuaaucgcuuuccacccguaucggaugaacacugauuucgguacuggguuuuguuguuauuuuauauauuucuuuucauccuggccuuugaagucugggcuuucaugaauugaccccuguucaccuucuucucacguccacgugucuccgagcucccagccuccacucagacgcggcuggaggcuccuucguguuggguguagucagcuuugucuucucaguguuaaguagcacuggaugggcacagugaaagcuaagcuagcuguggugcucaucugaaauugcagcacuagggaugcagaggcaggaggguagcuacaaguuucagaccagccuccaguuuugacaguuuggauaccuucuggauuugcagucuguaaagucaauuuccuggcuaggaaacuuaacagcagaaaugagguguguauugcuucaucuguggcaugugccugcaaucucagcacuuggacaggaggauggacacuaacuggagccuaccuagauuacaggagacccccgucugaaaaggguagcauacuguauuauauccagaugaagugugaagccugcuugucgccggaguggaugcuguuucugaaugagcauuugcuuccagauguguggagaugguggcccauguuguggacaacuugaaacauccuguccuucccggcuuuccuggcuuuacugcagagcauucgguuuuuccgguggccagugugaaacgugcaagaacaucuucucaacugaguugcaagaugucuuuucaucacacaaugauuaucuaaaugcuugacagucaucagagauuaaagcugugcauaaaguagccgugucucaaacuggcagaccuacagaguacugccagcauagagaggcauggaagaaaaauccaaccagcagaaacucccuggaacuucucucuccugcucucauccacucccucuccuucagggcagggcugaucucuccuccuccuccuccuccuccuccuccuccuccuccuccuccuccuccugcuccuccucuuccugcuccuccuccuccuccucccuacuccuccccccuccucccugcccuuguggaccgagugauggcaugcucuucccuauuccuucguuucauucaugauucaugacugagaacuucaaaaacacgacucuaauucuuuacaaaauguccugucuauaugauaccaaguaguggcucuuuaguacguugugacaaagcccuuuccugaucacggcuuuucucugucggaccuaucugcuccugcuugcuguucgggaacugccagucacauggaaaggcuuucuuuacuauuacaguggcagccgcuccggagcagaacuggucgugccacccugcauucccgcacuaugcacacuacauuauguggucuggccccuugugucuguccacaccacucggcagaaucaaagcagcaaaaugagaaggggucacguagucucauuuccauccaccgugcucuugcaccgcuccugagugaugauaaacuauugauaaauacuugaacuuaauuugaagacauaaugccucaugucagaaggaucugagccugguaguguaaaccacuacucguaauccuccguagacuauggguagcgguacccauucacauccaggaguguucuggaaccuugagauccucuugcuugcucuaccagguuugccaagaauauaguuacucuugauuaccugaagggaagaagucucacaguucagagaaucucuaccuuucuuccaucugcccuuucccacaccuaaguccuucagaggugcuagagugugagaaggcccagggagggacagcaaacagcagcagcucaggaucccaugcagaaggcacuuccuagugcauggaacacagcuaguaaacucauggugaggaauucucuauccaacucagcaguuuugcaaaagccaucagguaaauuuaaaacuuuguuuauagcuuacuuauuuuuggugggaauuuccucucaagaaaguagguauauguaaauugaauuuuuuacuaauuuuguuuuuauaucuuggaacuguaccugaacuuaaaauuuuguggcauaguuccucacagagccuagaauacucuuuauuauucacuaacuuaaugcccauaaacuaucaguuuuuaaccuguaaaaguauacacucaaccuugaagaauuuagcauagcuugauacaaccuuauuugugccauguuugcauuuaguggguugauuuuucuuugcuuacauuagggaacaacuuuuauuuuuauuuuauuuuauuuauuucugguuuuauugagauagagugucauguagcucuagcuguuguaacacuugcuguguaguacagguuggccuugaacucacagagaucugccugccuccuagauuuuauuauauauuuuaauucacuacauguucaucgauucuggcuauacuauuagcuauuaaacuucuuaaaggauaacaugaucuuaaagugccuguugccuucuaagcccugaauaaucaauauuuauugccugaacauugcuuuucaucugaauaugggucuuaaaaggcaaaaauuucaauuauucuuuuagaaccauaggaaagguaucuucgaaagacaugauccuguauauggaaggaacauucguguuuuacuaauuuuucuauaguacugcugaauuuuaaauaauuucuauaacucagugugauguuuaucuucagucuuagcacagagcccgugacaacaggauggucaguaguucaagggcauccucaccuacagagcgagguuagccugucuugcuugugacccugucucaaaacaaaaacagaaaaauuauaaauauuuauagguaauauaccagcagauauuauauuuuuauaccauguauguguauguacaugcuuggauuggcaccugugugaugguaugaggaaaacuugugggaaucaauucucuuuuuccaucaugugggacccagcgauugaacucaggccauuaaacauauugguggugcccuacccacuuagccauccugccagcccaaggauuguuuauuuuaauacauaauacuauuauaugaaaacacuacuacauuuauguaauuaguacauaggaacacuuaaauugguggguuuuggaaauuuauuuuuuacagaggugggggcgcgcagggugcacaaacacucacaacuaaguaauuaugugucagccuuuuuuuuuuuuuuuuuuugcuaguaaacaauacucuuuguuuuauuuugaagcaggguaagaaguauccauucuuuugacacaaucuugucuuuaaaugcuuuaaaggguuauaguagccaauacagaaggaggcaagcacuagagaaaaguggggggggggggggggggggcaccaaguaugacuuauaugauuuacuuaaaggacuuaaaauuaaguuuaaaaaagucucaucuaaacaaaacacucuugccacugaccuuacagccuuugcuuauauucauucaaugauacuguuuucuauaaaaauauuuuucucauuagugugcuugucucccaauauauuuguaugggccauaugacauuuguugguuuuccccaaaugaagucaaaacaguccucuugcuccauucuggaaucuguuucucuugacucuugugagucucuggugggacuccaggcagagucacagcggaaggugggcugaaggguagagacuggcggacagugcagugggucugcguuaucagaugugaauuaagggcugggaugguggagcacuguccuagcauuugggaggccuagcguuugagucccagaccagcaacaaagccacagcauuacagugugaguaccagggguucacaccaacagcggucacacugaucucuugcuguucccugugcuugccguuacagccugaggaagagcuugauccugaggagagggacaauuuccuccaacagcuuuauaaguuuauggaagacagagguacgcuguucuuaguggcuuugugugugagucugugcacuguuucugccauauuaggagugagugccuuauaguccagcgaaagccgaugaaccagcuauuccugauggcacuuagaugaauaaaaauaagcuauucaaguagaauacauuggaagucauuauuuauaauuacacuuguaaaaagauuaaaauagucagaaauaaaaagugaccaauugggcuggagagauagcucagagguuaagaccacuggcugcucuuccagagguccugaguucacuucucagcaaccacaugguggaucaaaaccaucuauaacaugaaaccuguugaccucuucuggugugcaggcauauauacacguagaacacuauauacugaauaaauaaguaaaaaaaaaaaaaguuuuaaaaagugaccaaucaucacauuacuuacccugcauaguacuuuauuuauuucauguacaugaguacacugucgcugucuucagacacagcagaagaggacaucagaucccauuacagaugguugugagccaccaugugcuugcugggaaugaccucaaaugcauaguaauuuauuacagugguaaggcgcucauggagaguagacucaccugaucccuguucuacuugagcugaagaugacagacaucaaugucuuucugaguaggauaggauuucuguagagguagaaggaagagaagcauuauaaaucaucacacgcuggcagguuucaguccuaggaagucgugggucauuuggcucuagacguucuguggcuuugaagaauccugcacagaaccggagcaaagcguggagcugcagccuuccugcuucgucucacacugcauugggccacaaccagcacugucaauuuuuaauuuaauuuuagccauuucuuugguauugaggcaacuagauugacuguagacaugcgcaacuccuaaauuccagacagcccacaaaacugcacacagaacacagagaagaaagacuuuguggcuuauguggcuuaaggaccuuuaaauguauaccuucagugaaugaauuuuguugaauuagaagucaauauuuuuauuuucaaacuaguauuuuucauuugacuaaaugcuuuauuuuuuuccuucugacauuuaaaagguacuccgaucaacaaaccaccuguuuugggcuauaaagaucucaaucucuucaaacucuuuagacuggucuaucaucaggggggauguggcaauguaaguauaccguugcuuuagaaguauguguuugugcguugagaagucugguugcuugaugcugcacugacguaggcauuuucuuaaagaacacagaaugcuaguguaacaguuauuuccuuugacaguuguuaacaaaaucuuaaucuuccagauugacaguggugcuguauggaagcaaauuuauauggaccuuggcauuccaauuuugaauucagcugcuuccuacaauguaaaaacugcuuauagaaaguaaguuguccagcuucauuaaagaauaauuauuagcaaguaaaguaguuugggcaaaaggauauauuguauggcagaccuuacauaauacagcuuccuugacaacaguuuuuuuuguuuguuugguugguugguuuugguuuuguucuuuuugucuuuuuguggagagguggcaagggcagagggcggguaugagggaauggggagaugagugggacugggguguaugaagugcaguuuacaaagaaucaauaaaaaguuaagccaggcaguaaugaauggcacaggccuuuaauugcagcucucagggaagcagaggcaggaggaucucugaguuuaagauccacgaugaguuacaggacagccaggccuacaucgagaaacacuguuggcaggcggauuucugaguucgaggccagccuggucuacagagugagucucaggacagccagggcuacacagagaaaccugucuugaaaagcugagagagagagagagagagagagagagagagagagagagagagagagagagagagagagagagagacugagacugucuugaacaguaccccuccugcccccaaaugaucauuuacagggaacagccuguaauuuuaauuaacacugcaaacaagggccauaaauguuaaaaguuuaagcuggcagucacguggggcugaaagguuuccugagucauagccuaccauucuccacuucccaugucaugcugauuuccucuuaaaagucagcgaugcaggagugcacaucguguccagauccagcucaccggcugcaguuuugguuaugugcauguucuagagcaguggcucucaaccuuccuaacucucugagccuugaauacagcuccucaugcccuggugaccuccaaccaugagauuauuuuccuugguacuucauaacuguaauuuugcugcuuuuaugaaucauaauguaaaugucugguaugcgugaucucugauaugugaccccugugaaagggugguuuggcacccccagagggguugcgaccuacaaguugagaacugcccuucuagagcuugaauacaguuccucaugccguggugaccuccaaccaugagauuauuuuccuugguacuucauaacuguaauuuugcugcuuuuaugaaucauaauguaaaugucugguaugcgugaucucugauaugugaccccugugaaagggugguuuggcacccccagagggguugcgaccuacaaguugagaacugcccuucuagagcagugcugugggaggcuuauuagucucugguucucaggauaauauuuuaguugaugguauuuuuuuguugauuguaucaaaggcauuuacuaacauaccaagaauacuuuaaacauggcucagguuuuacuacacauuuaccuaauauucacauuaaaugcagagacuaagauuucuuaagaugaaauguuguguguuuagauaucucuaugguuuugaggaguacugccguucugcaaauauucaguucagaacuauucaccaccaugaaccaaaaguaaaagaggaaaaaaaagacuuugaagacucaauggacgaagcucuaaaagaggccccggaaaugccuuugcuggacgugaagagugagcccgaggagaauacggacucaaacagugaaagcgacagagaagacacagagcuaaagucgccaagagugaguucuuguagcuuuaucugcuucaagcauuaguuugaacuuuuugugggcauuuuaauguaugugcauacuauuuguuuauguuccaguauuuaguaauauugcuucaagguuauuagagcagucucuuucuacagacagugcuuaucaguccuaccugccagccugugccacagccugaaacccuguccuaaacaaccaaaccaaacagacaaaaacaguaaacacacgcacgcacacacacacacacacagaccugcacacucaucuucucuguuacuguccguucaaggcucuguugucuggcucagucccguguacucuucuugcucagaugucuccccagugaagccugcacugguugcugccuuucuaauuacuuccuaucuccuuucucgcuccucuuaucugggauguacuugcucagucugaauugauuugcucucuuuuccucccucuguacuaaaguugcaucccaugaaggcaaggcugaguguugguuuugcucacugaugagauccgaggcuucuagaauaaagacgcacagcacccagaaagcgcucauuagguagcugaaugaaucaccucuaggugauuccugugcucccaaacuaccacgcuuccuaucaaucugugugcgugcuguacggcuuuaucuccgcauacauugauuuguauuuucccaucuaccucgccuccgcccccuguauuccuccucauugauuaagguuuuaugaaggauugccauucacuaucugauccaugcccaaugagcucuacauagcaugacuuaucauuuuauggguugccacacugucaagaauuuccguucuuuuuuuuuuuuuuuuuuuuaagacauggucugucuauuauguaucucuaauuguccuagaccaugcuggccucaaagucacagacauuuucuugcuucugcucucgaguguggggauuaaaggcaugcacuaccgugccuggcuuucagcuccuauguaucuuauguguuggugaggccauguuuaauggaaaggaaaggugaauucuuuauuuuuaucuuaugugugccaguguacacccgccuggaugugcgugcgugcaucagaugcauaccuggagcccacagaggccagcgaagagcaccagaucuccuggagcuggaguuaugggugguuuuaaucuaucuuaugggugcugaaaauugaauucagguccuuugcaagagcaucaaguacucuuaauuacugagacacugagacauccccccagcccccagaaaucuuauuuguaaacugacuguucugucaucuaauaaguaaauaaaguuuuguuauuuuguuaauuucaguuuuagagagggacuaauauagcccaggcgagaugcaacucacucuguagcuauggauaacuuugaacuuuuggcccuucagucuccauuuuccaagugcuggaaugauaagggugaacucuaccaugccuguugaccaguuagaggugugugugugugugugugugugugugugugugagugcacgcucacgugugcguguggugcaugcacauaucucugcaaaugggaagauaccgggugucuuguucucuuucuuacugccuuaguccuuugaaaccuggucucucacuaccuggagguaggcuguggccagcaguucccaguggcccugcuguuuuccccuguccuuccccuaacccccagcacuggugugggugcauguguagguuuguugguuuuuuguuuuguuuuguuuuaagauuuuauuuauuuauuauauguaaguacacugucgcugucuucagacacuccagaagagggagucagauuucguuacggaugguugugagccaccaugugguugcugggauuugaacuccacaccuucggaagagcaguugggugcucuuacccacugagccaucucaccagcccuuguuuuguuuuuuaaggcaggugcaggacuuugaacucagggucucgcguuuccacagcaaacucucuuagaggcugaaccgccuucccagcuccuuucuuuuuucuuucaaaucccugucaauucuaaguagaggagggaagccuucugccaucauauuagauggaccugaagcaaaguuuagagcaucuuaaaaagguucaccaguuucauagcugacgugcaagaugcuugguagcggcuucauaagacaagacuagugccuccuguaaccauuaaugaucuugguacuuauucaaagaaaucucacuuaguuacuuaauuaguuacuuaauuaguuaguuuauuuuuguauguauguauauuucaguugugcguguguacccucaaaaccuagaagaggauguuagaucuccuggagcuggacuuagaagcaguuuugagccacuugauaaggugcugagaaccaaacuugggccuuguagaagcgcauccaaugcucucagccacugagcuaucucuccagaccaaaagcucacuuuuuagauauugaugccaguagguccuuaaagcagaaucacuuaaauauacugauauuugauuuuuaaaagauacuugcugggcgugguggugcacaccuuuaauacuagcacuugggaggcagagucagguggauuucugaauucgaggccagccuggucuacagaguuccaggacagccagggcuauacagaaaaacccugucuugaaaaaccacaaaaaaaagaaaagaaaagaaaagaaaagaaaagaaaagaaaagaaaagaaaagaaaagaaaagaaaaaaaguauuuauuuuauguauaugaguacacuguagccgccuucagacacaccagaagagggcauuguaucccauuacagaugguugugagccaccaugugguugcugggaauugaauucaggaccucuggaagagcaguuggugcucuuaacugcugagccauuucuccagccccugauacuugauuuuuauuguaguaaaauauauugauauuuaaauuuuguuuuaauacaugauaugacuuggagaucacagaacuuucaaagaggccguaaguuaggggcuauauuuuugaagauuauuaauaacuugaacauuuuuuuaaacauuuacuguguguguguacacauacgugaaggugggagaacaauuugugggagucacuuucuccuuucgugaccauguggcccggucaugagcucaggucaucaggcuugguggcaaggacguaccuucucucugagccgucuuucgagccuagcauuacuggugggaaauucuaucccuggcauagaaaugauucauuuaaacucuuuuaucauagcuaacaguauagaguuagggauggagcccugaggacaacacuugcuaagcgugugcaaagccccagcacugccaaacaauagaauaaaacaauguugugagcagagaguuugcaggugucgguggggugcuaggugccaaaaccagggcuuugcucaugccccguucccacugagcuguacgcuaggcaccaggggaaaggggcuuccuuggguguuuguguccagggauuaugguaguguuggacauaauaaagagauuuauauugaugauucuuuugcuugcaaauggaagagaaugguccugaguugauuagugcucagauucugaucucgugccaggacgcagcacacuuacuacuguggagacuucagagaaagcuguaaaggugucuuucucucuuggagcauugccucucucaaagcuuuuaucuccucuacuaggggagaaggaaaauuguucgagaugcaaacuguaucaagaaggaaauagaggaagagaaaaucgaagacaaauuccuccgagaugauuuagaaaauaaggacgcaggugaugacgaugacgauggcgacccagcagcgaagagagagcaugagcugcuguucgggaggaagagcacaccaaagaacaaagagaagaagauuaaaaagccagaggacucugagagagacucagaugaagaggaagagaagagccaagagagguacauugucuuaugucugucuuccagaggcaccugucugggguccagccgcgcuuuguuccuguuuagagauucaggugugaggggaucucuucuuauugggacuuccauuccucuugucuaaugaaggugagacacauugugaagaugauguguaucgccuuucggaauuggagaauauacuggucgcaccauuuaauagcacuugugcccuaaacaguggccucaaagaaggcugcgccacccugugaaaagaaagguccugcaguugacagcagggaagggaacuggagaaaauggaggaaguggacagcggggacagcgacagcaaaguuccauuuuaaaaaagguacaaugugggaaagcuaacgaacacaugggugcacaggacgagagagagagaaacgcuucugugugucagcuugguuucagacacuuuccuuuuuccaguuauuguauuggagaauguggcaugcaccccugguucuagcuuagaaaauacauucuuuccccacaucucaucaauaaaauccagcuuuuuaauguccacucuguuugcuguugagugaaaacaguauuuuuuuuccauguaucagacuuucauggauugaaguaacuuaaaaauagcccccaauccagcaguugcgcuagauccagguaaugucucgccuugcuuccuagugggccauucugcacaugugaucaaaugaauugauuaguuuuuagguguuacuaaaaaucaaguuuuagaacaacagcguaacagucuuacuugaaaguagaagcuuuucucccguuauuuuguagugauuuuuaucacguaaugauaccuuuucuacaaguuugaggucuuuaugcuccauuuggagacaguggccugcuguauccaguugagagcuggcaggguugguaaauggcccuugggagagcuagugguagagaagcagacacuguaggugagcagcagaggcguccagugcuuggcgaggacacaaugagcgcuggcaguuggcugugcacuaggcuaguuuuuaaaaguuccgucacgaaguagaauacaggacuuaaaaaguagcaggagacaucuggcaguugcgaaugaugagaacaguuuaaacaucuaagcaggacguuaagcaaaggccagcuacuuaaaaaguucuaauuauaauaaugagucuauaaauaagcauagcuaagauucuuuauacuuuuaacauaaauggagcaaauauauuagagcaaagaauucaaucucccaugcaaagguuaauauucuguuuuacuaaauaaaaguugaguguacaaacagcagccagcauauagucccagucuguaucagggcccauggagauuucuguuuaguagguuuucuccaguacuuacaaugauuucuucacaacauuuaugagaagugucccuggagagcaaauauuccugaagcagauuagcuaugaaagcuucagccauguaccagggcccacugaaagaugccugugaguauugucgacccucacagcuccuuaagaccacgucugaagcuuugaaauucgcagaacaccucagccaucucugaggcagcgauauaccuuguggauacaauuuuaaaauauugcuggacuuuucauaugaauacccuucgugucuaauuaucaaaauaaaaguugcugggagaggaguuagaaguagaaacuaacagagacuuauaaagcucugcucuaccaucgcucuccuaugauuucaacaauagccucauuuaaagcagaguccaggccaagagagaguuacuaugggagguagccuuuguucaucauguuacccaccaaacagugucuuguaaagugagaagacaguagugcuaaaguagacuuaagauaacuaguugcaagaauuuacaaaauagcuuuagaaaauucucccagguaagguggcauuugaaugaaucuuuuuuuuuuuuuuuuuuuuuuuuuuuuuuugguuuuucgagacaggguuucucuguguagcccuggcuguccuggagcucacuuuguagaccaggcuggccucgaacucagaaauccaccugccucugccucccgagugcugggauuaaaggcgugcaccaccacgcccggcuugaaugaaucuuaacgaccauccuagggcauauguuuuuuuaauuuuuugguuuaaaagugauuuguuuauugacucugcaucuucauuaaccgugauucuugaauggccuuuaagaagaauggguuuaccuuuguguaguguaccuuuaugucaucaacuccuugguaaaugguccaugaaaucuccuccuccuccuccuccuccuccuccuccuccuccuccuccucuucuucuuccuccuccuccuccuccccugacaugucaccgagguaaacucggguugucaagacacaacgugcuggaucuuuucucaguucuuaguuugcccuccguugagcuauuaguagcauuaucaauguuguaauucacugcagggaagagacugagagccggugugacucggaaggggaggacgaggaggacgacacagagcccugccugacgggaaccaaagugaaggucaaguacggacgaggaaaaacucagaaaauuuaugaagccagcaucaaaagcacggagauggacgacggggagauucuguaccuagugcacuacuacggauggaacgucaggugagccgugaagcugugcgcuuacaaggcacgccuugcucuaaauauuaccagcgcuuccacuagaggccagcaggaucugcccuugaaacaacugagucuaucacucuuuuacugggaggcagaccacaagacaggaagccauggggcugagucugugagcgcucagggccccaccuuaggaacuagggcuaguacagggcucugggaaccuugcagcacugucaaggagcgaggacacaacucuaggcugcacaugccucuguuuccuuuugcagaagucaagccagugucaaguaccacaguaguuuggaguuggcuuaguaguuaaaaucuguguugguuaggacuuggauuugagcuuccguugugugguagguuuaagaaagucuuuguucugugcugauacagucaggaagcugaugugauucuaugauuggcuuucuuaauaaaucuuaccuggaaggagcaacaacuagaucaaaguuaauccuauaauugguaaagaggcagaagugacucaugagucacgagaaaaaggauauuuugccauuucuguggcuuggacaauguucccuguucuguguucagacaugauuaggaaguugucuuuuuuccugucuugauccccugugagcacggagcagacaugucuguacaguuggcugcauucaaaggaagggcaucuuagucagaccagcuuagaacaacacugaggccagaaaccuuauaauuucuggguaauuuaguccuauuucuaaaaugggacaucugugugagaggagcccugauguggcuguaacaccugccugacacaucacucagaccaggccagagaggaccaugcugagguccuccagagaggucugcucuuuuuuuggugugauguguccugggaaauucaggaguaagauguuuucuucuuuuuagcccuaaaucaaguauguaucuuucuuacugcguuuagaagauuguauuuaauuauauagauuuuuuuuuauaucagcauguaaucaggucuuguucucucuauucccuguauauuuuauaguuccugguauauuaguagacccuuaauaaauguucaaauuaagaaauaucgauauauaagguauuguuagcccucuguuccaaagggcuuaguuagcuauuggguaaucugggagaagaugauuuuuagcuguaguauaagcaucaugguaucuagagcagcuaaaaccuguacauacuugagcuuugcacgucuccauggcaacuagucuacaguguuacugaauaugaauaucugugcacuuggcauaaugcaagaaguauuacuuaguucugcauaguuuacucuauuugaucuguaaguuccaauugugagaacugaaaacaaagcacuacagauaguuuagaauugggaguuuacccaccccguccucucuuugaaccuugaagaagcucuuuucuaguuguugccuugaggguugaguguuuuuguuuuuuguuuuguuuuuucaaguugagguuucucuguguagcccugcccugccccaaaacucucuguguagaccagauuggccuggaacucaaagagaucugccugcuucugcccccuaguagugcugguaucaaaggcgugugccaucucugcccaacaggaacagacuuuuucucucacugcuggggcgugugugugugugugugcgugugcgugugugugugugugugugugcaugugugugagugugaauauauuucauauagugaaaggugaaauuuuuuuucuuuaagauaugaugaauggguaaaagcugacaggauaaucuggcccuuggacaaagguggaccaaagaaaaaacaaaagaagaaaguuaagguauguccauacauuuauaacacuuauagaugugggaauuauucauguaucuuuucuguuagauuuuguuuuuuaauaguuuuaccuucauaggaaaaauacaaagguacaggaauuuccgaugugcccuuugcccuaaguggguaucguguuaugcacugucggccccuuacccucacaagagggacccauuuguuauagugguaaauacccacagauuacacugggguagguauacaucagagguguaagacuucgcugggucucugugccuguagagguuugggcagauguguaaugccauuauucauccuuagaaccacacagaggaccucaucacccuggaaacccacuguucuccucuucccuccaccuccacagugucaacccugccugcuggcccacuguacacuuggccacgccuucuguccgguuccugcuguagaggucugccuaguguuuugucuguuucugaugccuuucauucccucugcaggaaaugagccagggggagugauucuauucaaaugaauggguuagaaaacuguucuagauuuuucuauaagugcauacugguauuuuacuuuaaauuaacugaccuuuuuguuuuggaauuaauagauuuucuuagagaaaauggaauguucauuuuugaaaggccuuggccuuucucaugcauuuuguuguuauuacucagaauaaagaagauagugaaaaggacgaaaagagggaugaagagaggcagaaguccaaacggggaagaccaccuuuaaaaucuacuuuuucgccaaacaugccauacaguuuaucuaagacgucaaacagugaaggaaaaucagguaccagaaaugcccauggcaaugugacaggcagcauaccucugucuggugagacagaaggggcucaguucugaggguuguugacuuuuaaaacuauauagauauuauguacacacacauaugcaucacugaacaaugggacacauucuaaggggacuucaucauggcacaaaugucauagaggaugauuacugaacuaaagggcuagugucccuaggugacaagagcuuacaacagggccucagguauaugcagccaucguggaccaaaguauaauuguguggcccaugagggucacucagugagaggcauagcagcuuaucuugguuuggaaccuagcaugauugaaaguacagaguguaauuggcagcugacacuuauuuugugguauauucuaguuuaaacucgagugauauuaacccaggaugccgucugucaggaggauuuuuagauacaaccaguuagcuguagggaaaugaaacaauccucgaaucccaguguguguugggcucugcuucaaaccaugugaugcaccaaugccuccuguuaguugggcaccgucagccuguuaccacacgugggagcuguugagagcacaggcuacauaggagggcuuguggugagcacagcagagcagauuuuacuccgcuguaauuguccccgucacuuuuccauucuuuuuucuauguaauuuaagagaucuuaaauggugguauuagaaaauuauucuccuuggagagaaaacuacuaaaggauagguuuaccaucagcugcaguguguacaccauaaagggggucuuuccgaauccuccugccaccugcugguagcucacgaucauacaggaaaccauacagaugcaagguuucuuggacgugugugcuguuucucaggcagccugugcuggugcaguguucagccuacacaaccauccacaucagagucacagaacugccucacugaggagcguuugacgugaggaaaugggauucuacauuccacuuuuacuaaaaccacagaacuuguauacuuaaugacguaaucauucagggacggagaagucagcugcacuucaguacucaacaccacaugcuuuccugacaccugucacuccaaccccacaguaucugccuccucuuuuggccuccauggacccaguacagaauauauaugcagauucuccuguucaucagauggaaacaaauucuaaacaaaggagagccaacaagcagaaaacauaaaacuuugucaaguaucgugguggugcacaccauuaaucucaguacuugagaggcagaggcagggggaaucucuugaguuucaggaaggccuggacuccaugcugaugcaggccaggcuacacacugagaacccaaaguuaucuuuaaaaaaaugaacaccuucaguguuugccuuucuaaaauucucuaaagaggguguaagcaauacagggauaguuuuuacauugugugguuuuauaguuuuggacugcugccuuaguuucugaaaaauucucugacagaaagugaauaauuugucuugccagcaggggucucuugccuguacuaagaccauuuaagguauggagaauucacauugcucguuuuuuuaaggauuuauuuauuuaauguauaugaguacacuguagcuguacagaugguuugagccaucaugugguugcugggaauugaacucaggaccucugcucacucgggucccgcuugcuccagcgccacauugcucauuuuaauccagacuaauuuuagguagaaugucauauuccucuagaaugcaaaguaguuaaucuuuguaguaagucaggucaagucaguuaacauacuagcuuuuuaucguuguuuguuuuacuuuuucuuuguuuauuuuuugagacaggguuucucuguguagcucuggcuguacuggaacucuauauuccaggaugacugggagcucagagauccacuugcccaugccucugcccccugagugcgggaauuaaaggcgugugucaccacguuguuuauccucacgguuuuauuucagcccuuccccucacauuuuagcacaaaucuuuguuuuacuucauagaaaaaaaugucucuagagauucagaaguauagaaaggaucucguuuacacuugguaguauuuuacuuauugcauugguaucucguguaaucgucuguacaacguauguuucccugcagacuccuguucaucugauagugaggcagacgaccagcuggagaagagcucagggggugaagaucuuucuccugaugucaaagaagaauuggaaaaaaaugaaaaugcacaugaugauaaacuagaugaagaaaacccaaagauuguacauauaucaaaagaaaacgacaggacucaggcacagcccucagacacccugacgguggaggcaggggacagcgaucaaauugugcauauuuuuggagacaaaguggaccaaguagaagaauuuaagaaacagguggaaaagucucccaaagggaagggaaggcgcagcaagacaaaagaccuuucguuagaacuuauaaagauuucaccuuucggccaggaggaagcaggcagcgaagcucauggggacguucauagccuggaguuuucuucacuagaauguaaaaacuuuucuucuacugaagaugacaucgacccauaugagaaagaaaaaaaguugaaacgaaaaauccugggacagcaauccccagaaaaaaaauugagacuugauaauggcauggaaaugacaacuggagugucccaagagaggucugacgauggcgcgggagccgagggcaugaaaggcgcacacguggaacagcacuuugaaacagaaggugaagggaugccaucgcugacagccgagcccgaccagggccuucaagaacugacuagugagaaaucggacaguccagccgaagaagaaccggugcacacgccacucaaagaagaggaggaugcgaugccucugaucgggccugaaaccuugguuugccaugagguagaccuggaugauuuagaugagaaggauaagaccaguauugaggaugugguaguagaaggcucugagucuaacucucuggcuuccguaccaccugccuuaccuccuguagcacagcauaacuuuuccguagcuuccccacucacucucagccaagacgagucccgaaguauaaagagugagagugacauuacaauugaaguugauagcaucgccgaagaaucacaagaaggccucugugagagggaaucggcgaacggguuugaagccaguguugccucuggugccuguaguauaauugcacacgagcgagagagcagagagaaggguaagacuugcgggggacugagccagucagggcuuggcuaugacagacguuuacaauugucuguuuaagaaaauaguggggggcuagagagauggcucagcgguuaagagcaccgacugcucuuccaaagguccugaguucaaaucccagcaaccacaugguggcucacaaccaucuguaacaagaucugacuccaucuccuggagugucugaagauagcuacaguguaacuuacauauaauaaauaaaucuuuuuuaaaaaauuuaaaaauuaaaaaaaaaaaagaaaagaaaauaguggaauggcauggacagguguguaaacggaccugucugccucugcuucuguuuucaagcuuuuccuuuauuucaggucagaaaaggccaagcgauggaaauaguggauuaauugcaaaaaagcaaaagcgaaccccaaagcggacaagugcugcagccaaaacugaaaagaacggagcagguggguguuugccagcgcucgacuuccggugcucggccuccggugcucaagcacccgugaccuugcgggugcuuguugcuguccguuccugcccagcacagacucgggacuugaucauuugagccauuccaaaaaugcgugagguuuauuauguucugaaaauaauuucauucuuuuuagugugugugugugugugugugugugugugugugugugcgcgcgugcgaaacauuuguacucacgugcacguguguguauaugcacauaucuguguaugcacaugccaucaaauguauguagaggucagagaacagccugugcagucacuucucugucugucuguauaugaugggauuaaacucagauguggaggcuugcacugcaagaacucuaccggccuccuccccccacccccaucccaccccgccuucauuuuaaucuaaagaugccuauuaguuuuacuuagaacugcaacagcuaaaauuaucacaaagcaauuaaauauaaggcauuucagaaucuucaagaaaagaaaagguuuguugugguguuaaaaguaugcaaaacauguguuuauacugggaauggucucuuuuagucaguguaguggcuauuccugguugucaacuugacaauauuuggaaugaacuacaauccggaauuggaaggcucaccagugacccuuaucuggaggcuuggagauccuuaucuggaucuugguuugaagaucuugagccauauuggcuauggauuccagaagauugaaucuccgaguuuaaggaacacaccuuuaaucugggcuacgccuuucaucugggauuaaaggugugguggaacacaccuuuaaucugggcuacaccuucugcuggagacaauauaaggacauuggaagaagggagucuagcucuugcuccugcuccuucgccugcuugcugcgugagacugaguaacugcuagauccuuggacuuccauucacagcugugacugaacgauuguugggaauugagcugccgacuguaagucaucaauaaauuccuuuauuaucuagagacuauccauaaguucugugacucuagagaacccugacuaauacagaaguugguaccaggagugguucuagaguaacagaaguacaaggaugaaucuuuuaaaauucuggaauuggcuuguugauccaccagcacuuucaacuauugaaaccucuacagauucucucccuccugggagcucagagaauuuugaagacccaugguugaaacuauauuccgaacuuaaagaagcuaaugcccuugauuuucuuaaugaauuaggugauucagugcacaaagcuuucuacaagauggggaaaaaaucgaaaaaugauuuuacuggcuggcugcucuuaguaucuguggaaaaaaugaugaaugaaaggaaggaguugugugauaaaaucgaaaggcuccagacacaaguaaacaaucuaaaaguugcuaaguguguccuugaggagaaucuucucucuuguagcaauagagcucaaguugcagaaaaucaaacggaaacucucauuguaagauuggcugaacuacagcgaaaauucaagucucagccucagagugugucgacaguuaaaguaagggcucuaauuggcaaagaaugggauccuacaacaugggauggggaugugugggaagaccauguugaagcugagaauuuugaauccucagauucucaaggguuugccccaccugaggaaguaguacccucagccccaccucuugaaauaaugccuuccccacaugaggaaauuaauuuugcagagucugcucacggcccaccaauaguuucuucuagaccuguaaccagacucaaagcaaaacaggcuccuagaggggagguagaaaguguaguccaugaggaaauucgcuacacuacuaaggagcuuaaugaguuugcuaauucauucaagcagaaaccuggugaauaugugugggaauggauuuuaagggugugggauaaggguggaaggaacauaaaacuagagcaggcugaguuuauugacauggguccucugaguagagauucuagguuuaauacggaagcucgcauaguuaaaaaaggugucaaaaguuuguuugaaugguuggcugagguguuuaucaaaagauggccuacuggaaaugacuuggagaugccugauauuccauggcuuaguguugaugaagggauuuuaagacuuagggaaauugcaaugcuagaguggauauauuguguaaagcauaauuguccacaaugggaagguccagaagauaugccuuucaccagcucuauaagacgcaaauuggugagaggggcaccagcacauuugaaggguuuuguucuuucccuuuuccuugugccagaucuuagcauuggagaugcuucugcucaauuagaugaauuaaauucacuggguuuaguuggauuccgagguaacaagggccagguggcagcauugaaucgcccgagacaaggugauucuaguuauuauaauggacagcguagacaaaagaauguuuauaauaacauacccaguaauggucagcacaggagaggugaaauuuauaauggcaugacucgguuggaccuuugguacuggcuaaccaaucaugguguuuccaggaaugaaauacauaggaagccuacugcauauuuguuugaucuguauaagcagaaaaauucucaaacaaaugaaagaaaggcuacauuagaucgugguaaacagccaaaugaaagaaaggcuacauuagaucgugguaaacagcaaucucggccagugaaucaauuuccagacuugagacaguuugcagauccagaaccccuugaaugaagggguggccagguuccgcugaggaaggaucuugauaagacacucaaagguuuugcuguuacccuuucuccaguucuuccccagagggaccuacggccuuuuacaaggguaacuguacacuggggaaaaggaaauaaucagacuuuucggggucugcuggauacugguucugaguugacacugaucccaggggaucccaagaaacauuguggcccuccaguuaaaguaggggcuuauggagggcaggugauuaauggaguuuugacugauguccgacucacaguagguccaguagguccccggacacauccuguggugauuuccccaguuccagaauguauaauugggauagauauacucagaaauuggcagaauucucauauugguucccugaacuguagagugagggcuauuaugguuggaaaggccaaauggaagccuuuagaguugccuuugccaaagaaaauagugaaucaaaaacaguaucguauuccuggaggcauugcagaaauuacugccacuaucaaggacuugaaagacgcagggguggugguucccaccacaucuccguuuaacucuccuaucuggccagugcagaaaacagauggaucauggagaaugacaguugauuaucgaaaacuaaaucagguaguaacuccaauugcagcugcuguaccagauguaguuucguuacuugagcaaauuaacacaucuccuggcaccugguaugcggcuauugaucuggcaaaugccuucuucucaguaccuguccauaaggaccaccagaagcaauuugcuuucaguuggcaaggccaacaguauaccuucacaguuuugccucaaggauauauuaacucuccugcccugugucauaauuuaguuagaagggaucuugaucguuuggaucuuccacaaaauaucacauuggugcacuauauugaugacauuaugcugauuggaccaagugagcaggaaguagcaaccacuuuggacucauugguaacacauaugcguaccagaggaugggaaauaaauccaaccaaaauucaaggaccaucuaccucagugaaauucuuaggaguccagugguguggggcaugcagagauauuccuucuaaggugaaagauaaguuauugcaccuggccccuccuacaaccaagaaagaagcacaacguuuagugggucuauuuggauucuggagacaacacaucccucacuuggguguguuacuuaggccuauuuaccaagugacucggaaagcugcuagcuuuguguggggccuggaacaggagaaggcccuucaacagguccaggcugcugugcaggcugcucuaccacuuggaccauaugacccagcagacccgaugguacuugaggugucuguggcugauagagaugcuguuuggagccucuggcaggccccuguaggugaaucacagaaaaggccuuugggauuuuggagcaaagcucuaccaucaucugcagacaacuauucucccuuugaaaaacagcucuuggccugccauugggccuuaguggaaacugaacgucugacaauaggacaccaagucacuaugcgaccugaacuacccaucaugagcuggguacuaucagacccugcaagucauaaagugggacgugcacagcagcagucuauuaucaaauggaagugguauauacgugaucgggccagagcagguccugaaggcacaagcaaguuacaugaagaaguugcucaaaugccuaugguuucuacuccuguuacaaugccaucugcugccaagcaugcaccuauagccucaugggguguucccuaugaucaacugaccgaagaggagaagacuagagccugguuuacugauggcucugcacguuaugcaggcaccacccagaaguggacagcugcagcauuacaaccccuuucugggacaaccuugaaagacacaggugaagggaaaucuucacagugggcagaacuucgggcaguacacaugguauuacaguuuguuugcaagaagaaauggccagauguacgauuauacacugacucaugggcuguagccaauggauuggcuggauggucagggacuuggaaagaucacaauuggaaaauuggugagaaagacaucuggggaagaaguauguggauagaucucuccaaaugggcaaaggaugugaagauauuugugucccauauaaaugcucaccaaaaggugacuucagcugaggaggaguucaauaaucaaguggauaagaugacccguucuguggacaaucagccucucuccccagccaucccugucauugcucaaugggcacaugaacaaaguggccaugguggucgagauggagguuaugcuugggcucagcaacaugggcuuccacucaccaaggcugaccuggcuacagcugcugcugauugccagaucugccaacagcagaaaccaacacugagccccagauauggcaccauuccucgaggugaccagccagcaaccugguggcagguugacuacauuggaccacuuccuucguggaaaggacagcguuuuguucuuacuggaguagauacuuauucugguuauggauuugccuuuccugcacguaaugccucugcuaaaaccaccauucacggauugacagaaugccucaucuaucgucaugguauuccacacaguauugcuucugaccaaggaacucauuucacagccagagaaguucgacagugggcccacgaucauggaauacacuggucuuaccacauuccccaucauccugaagcagcugggcugauagaaagauggaauggccuuuugaagacgcaguuacagcgccaauuaggugguaacagcuuggaaggcuggggcagaguucuucagaaggcaguauaugcuuugaaucagcgcucgauauaugguacaguuucacccauagccaggauucauggguccaggaaucaagggguggaaaaaggaauaguuccacuuacuaucacuccuagugacccucuaggaaaauuuuugcuuccuguccccauaacucuagguucugcuggccuagaaguuuuggcuccagagaggggaguccuccuaccaggagcuacaacaaacauuccauugaacuggaagcucagacuucccccuggucauuuugggcuucuaaugcccuuaaaccaacaggcuaaaaaaggaauaacaguguuaggaggggugauagauccagauuaccauggagaaauuggauuaccucuucacaauggugguaagcaagauuaugucuggaguguaggagaucccuuagggcgccucuuaguacuaccauguccugugauuaaagucaaugggaaacuacaacagccuaauccaagcaggaugacaaagaacgcagauccaucaggaaugaagguaugggucaauccuccaggaaaagagccaagaccugcugaggugcuggcugaaggagaaggaaauacagaauggguaguagaggaagguaguuauaaauaccaauuaaggccacguaaccaguugcagaaacgaggauuauaaaguaauaugaaugcccauuguaaauuuacuaaugcguuugcgauuguacgagggauaguuauaucauguuaggcguauuuacaaccuuguuauuguuucaugugaacaugagauauuauuugugucaaguugacaagggguggauuguaguggcuauuccugguugucaacuugacaauauuuggaaugaacuacaauccggaauuggaaggcucaccagugacccuuaucuggaggcuuggagauccuuaucuggaucuugguuugaagaucuugagccauauuggcuauggauuccagaagauugaaucuccgaguuuaaggaacacaccuuuaaucugggcuacgccuuucaucugggauuaaaggugugguggaacacaccuuuaaucugggcuacaccuucugcuggagacaauauaaggacauuggaagaagggagucuagcucuugcuccugcuccuucgccugcuugcugcgugagacugaguaacugcuagauccuuggacuuccauucacagcugugacugaacgauuguugggaauugagcugccgacuguaagucaucaauaaauuccuuuauuaucuagagacuauccauaaguucugugacucuagagaacccugacuaauacagucagaaaagcugauuuauaaauacuauagaaaucuuuauuuuauuuuauguccaugaauguuuugacuacauguauauaaauguaccaagcaccugccugguacccacauuguucagaagagagcaccccaucuccuggaaaaagaguuacagaugguuguaagcugucaugugggugcugggaauugaacccgagucagaagaaugcaggagcagccagugcucuuaaccucugagccaguucuucauccugaaaaguaaggucagugcucaucaaagaaauaaaacagugaacuggugugaauggguuagauuacaaacuucuuuaugaauaaaaauaaauagcagaaauaggucuucugauuaauaaagauugugacaaaggauggaauaagagauguagucaguaaaaugaauagguuucaguaugauuaguguugucaaagggcuuaguuaacguauaccgaacauaggccuauaaguuaacaacagaguguuagaagaauuuaggggaauauugaguuguaggugcccaguauuaggaaaagagauggauugugguguuuacaagaaagucuguuuucacaagaggaugagaccacugugggaaaguaaugaagaugagaaagcagccggaaaguuggcucagccuguccagugcuuguggcucaagcauaaauacugacugacauuugguccacagauguaagaugccaggugggcuuuuguacaccuuuaaaccuuuuguuugaggagggggugggggggagugagacaggcagguccgugggguucgcuggaggagggggugggggggagugagacaggcagguccgugggguucgcuggaggagggggugggggggagugagacaggcagguccgugggguucgcuggaggaggggguggggggagugagacaggcaggaccgugggguucgcuggaggaggggguggggggagugagacaggcagguccgugggguucgcuggaggagggggguggggggagugagacaggcagguccgugggguucgcuggaggagggggugggggggagugagacaggcagguccgugggguucgcuggaggaggggguggggggagugagacaggcagguccgugggguucgcuggcuagucagcugcgccagaucaguaagcccguuccuagugagagauucuguuucagaaaacgagguggacaguuccuauggaauaaugccugaggugggucugacauuugugcacauccacacaucuccacacaaacacacacacacacacacacacggauuaagauguuguugaguugguccauaaugaacuacagguagagacagaagucagagugacaguguagcauuucuuuuucaagauauuuaacccugaagagauggaaagagguuccuccgaaaugaacuaaccgccccuccucccccaaucuccaaggaugaaguagaacuagacucuggaaaccaaggccccagccauugaagaacauggauauuugacauaaaggucuuuaugcuaggcgaccugggaguagaacauuaugcagcaaacucugcuuuugaggacaaauaguaaucaaaauguaaccauuaugauuaaggcccaagaagaggccaguaagauggcucagcggguaaagcauuugcagugcgauccugacaauccccacauagagcugggacuuccacgaguccuccacagcaugugccuguagccccuccgcauccuacacacaagaauaagguuuucucucaaggguaguaaagucagacacaaaagcaggcugggaaacugagugugugaucuuugcccauugagaguaaagauaggguaaggguaaaagguaugccuugaaaaauugguaaaauaaaauuacaguuugcuuuuaugggaaaaccagaacaucucuccagguaaaucggcgagggggaggcagauguccaaaugaagccucuuuuguuaacacacacaucaaguugagcacagaccagcaugccuuuaaucgcagcugaggcaggaggaucaggaauuccagucuagccugacuagauacugaguguuggccgaucuaaacuguauauuaaggccauguuucaaaaauaaauguuaaagaagaaaagaacaaauguugggcgaguuuacaacaaggccuacuugugugcuucauauacauacuuggguuuggauggcuuguauguacacgaggcuacagaauauuguuuguuuuagaacccugauacuccauuuaguaacuagcagauccuuaaucauuauugugaaguguagcuccuucuuuuuucuuguaauuuuggaaagagugcccaugugccacugugugugugugugugugucuagguguguguauguguuaugugaauguguaugugaguguauguauguauguguugugugagcaugugugugagagugugugugucucagggcauaccuugugagagucaguuuuuuccuuguaucugagaucaaacucggauccucagugccuuuaccugcugagccaucucaccagcccuguagugcauacuuuaaaaaaucaaaaucaaacaguggggggaaaaacuuuagcaauauucaguaaggcuucauuuuaaagcaauucucguuuuuguuuuuuguuuuuuugguguuuuuuguuuguuuguuuuuuguuuuuguuuuuuuuuuuugcuuaggaucucuauuuccacguuucuguuggaauccuugguauauguauuauguauuauguuuaccuguggugguaccaagaaguguaaucugcuccuucugcugcauuuugguacuugagccuuacaugguuuacaguuggaggggacuuaccguuacaggacagagcagugacagcgaggaccuccccgccauggacagcuccaguaacugcaccccagugaagcgccuuacccugcccaagucacagaagcugccacggucuccugcaagaaccucgccucacaucaaagaugcagagaaggagaagcaccgagagaagcauccgaacuccucccccaggacauacaaguggagcuuccagcucaguaagggccugccugauagccugaguauaagcugggaaguguaaauaauauuagaaaacauuaacaaauuauauagcuguuccaaaucaauuuuccucacuuguauguaaaucucuguguguauauguuuucuuuuuuaauuuggauaacuugguaugacaaaaucuuugcuuaagaaacaaaacgugggcugggcaguggugguacacacaccuuuaaucccagcacucgggaggcagaggcagguggauuucugaguucgaggccagccuggucuacagagugaauuccaggucaaccagggcuacaaagaaacccugucucaaaaaaccaaaaaagaaaaaagaacgaaaaagaaaaaagaaacaaagcaugggcugaguauguguuucaccccuguaacccagcacacaugagggugaagcaggagaaucauaaguuugagggcagccugggcuacauagacuuuguauaagguauaacuuauuaaaucagugaaauggaagugccuucccuuugcugacaguuagaaauacuaaauacacaucagucagauugcuuuauuuuaauguuuucuuauguuucaugaugacugaugcauguuuaauacagaauacuugaguaaagaaaccuuaaucauaaauugaauguagucgcaucucguguaaagagcuuaugcagggcauaauaaacugcagcuuuuacugauuugcagguuugacuuuugauagcauugccuucucugcuuucaugaaauuguugugguuaaaauucagauuaauuuuaucuuuccuuuuagaugaauuagauaauaugaacaguacagagagaaucucuuuucuccaagaaaaacuacaggaaaucagaaaauacuacaugucuuugaagucugaaguugcaaccaucgacagaaggaggaaaagauugaaaaagaaagacagagaagguaaugcuccucccguuuuucccugccuucagauacucucucugccuucagauacucucucugccuucagauacucucucugccuucagauacacucucugccuucagauacacucucugccuucagauacagauacacucucugccuucagauacacucucucugucuucagauacacucucugccuucagauacacucucugccuucagauacacucugccuucagauacacucucugccuucagauacacucucugccuucagauacacucucugccuucagauacacucucugccuucagauacacucucucugccuucagauacacucucugccuucagauacacucucugccuucagauacacucucucugccuucagaugcacucucugccuucagauacacucucugccuucagauacacucucugccuucagauacacucucugccuucagauacacucucugccuucagauacacucucugccuucagauacacucucugccuucagauacacucucucugccuucagauacacucucugccuucagauacacucucugccuucagauacacucucugccuucagauacacucucugccuucagauacacucucucugccuucagauacacucucugccuucagauacaaucucugccuucagauacacucucucugccuucagauacacucucugccuucagauacacucucugccuucagauacacucucugccuucagauacacucucugccuucagauacacucucucugccuucagauacacucucugccuucagauacacucucugccuucagauacacucucucugccuucagauacacucucugccuucagauacacucucugccuucagauacacucucugccuucagauacacucucugcaucagauauacucucuaugccuucagauacacucucugccuucagauacagauacacucucugccuucagauacacucucugccuucagauacagauacacucucugccuucagauacagauacacucucugccuucagauacacucucucugucuucagauacacucucugccuucagauacagauacacucucugccuucagauacagauacacucucugccuucagauacacucucugccuucagauacagauacacucucugccuucagauacacucucugccuucagauacagauacacucucugccuucagauacagauacacucucugccuucagauacacucucucugucuucagauacacucucugccuucagauacacucugccuucagauacacucucugccuucagauacacucucucugucuucagauacacucucugccuucagauacacucugccuucagauacacucucugccuucagauacacucucugccuucagauacacucucucugccuucagauacacucucucugccuucagauacacucucugccuucagauacagauacacucucugccuucagauacacucucucugucuucagauacagauacacucucugccuucagauacacucucugccuucagauacagauacacucucugccuucagauacagauacacucucugccuucagauacacucucucugucuucagauacacucucugccuucagauacagauacacucucugccuucagauacagauacacucucugccuucagauacacucucugccuucagauacagauacacucucugccuucagauacacucucugccuucagauacagauacacucucugccuucagauacagauacacucucugccuucagauacacucucucugucuucagauacacucucugccuucagauacacucugccuucagauacacucucugccuucagauacacucucucugucuucagauacacucucugccuucagauacacucugccuucagauacacucucugccuucagauacacucucugccuucagauacacucucucugccuucagauacacucucucugccuucagauacacucucugccuucagauacagauacacucucugccuucagauacagauacacucucugccaucagauacacucucugccuucagauacacucucugccuucagauacagauacacucucugccuucagauacagauacacucucugccaucagauacacucucugccuucagauacacucucugccuucagauacagauacacucucugucuucagauacacucucugccuucagauacacucucugccuucagauacacucucugccuucagauacacucucugccuucagauacacucucugccuucagauacagauacacucucugccuucagauacagauacacucucugccaucagauacacucucugccuucagauacacucgcugccuucagauauacucucucugccuucagauacacucucugccuucagauacacucucugccuucagauacacucucugccuucagauacacucucugccuucagauacacucucucugccuucagauacacucucugccuucagauacacucucucugccuucagauacacucucugccuucagauacacucucugccuucagauacacucucugccuucagauacacucucucugccuucagauacaacucugccuucagauacacucucucugccuucagauacacucucucugccuucagauacacucucugccuucagauacacucucucugccuucagauacacucucugccuucagauacacucucugccuucagauacacucucugccuucagauacagauacacucuuugccuucagauacacucucucugucuucagauacagauacacucucugccuucagauacagauacacucucugccuucagauacacucucugccuucagauacacucucugcaucagauacacucucugccuucagauacacucucugccuucagauacaaucucugccuucagauacacucucucugccuucagauacacucucugccuucagauacacucucugccuucagauacacucucugccuucagauacacucucugccuucagauacacucucugccuucagauacagauacacucucugccuucagauacacucucugccuucagauacagauacacucucugcaucagauacacucucugccuucagauacacucucugccuucagauacacucucucugccuucagauacacucucugccuucagauacacucucucugccuucagauacacucucugccuucagauacacucucugccuucagauacacucucugccuucagauacacucucugccuucagauacacucucugccuucagauacagauacacucucugccuucagauacacucucugccuucagauacacucucucugucuucagauacacucucugccuucagauacacucucugccuucagauacacucucucugccuucagauacacucucucugccuucagauacacucucugccuucagauacagauacacucucugccaucagauacacucucugccuucagauacacucucucugccuucagauacagauacacucucugccuucagauacagauacacucucugccuucagauacagauacacucucugccuucagauacacucucugccuucagauacagauacacucucugccuucagauacagauacacucucugccuucagauacacucucugccuucagauacacucucugcaucagauacacucucugccuucagauacacucucugccuucagauacaaucucugccuucagauacacucucucugccuucagauacacucucugccuucagauacacucucugccuucagauacacucucugccuucagauacacucucugccuucagauacacucucugccuucagauacagauacacucucugccuucagauacacucucugccuucagauacagauacacucucugcaucagauacacucucugccuucagauacacucucugccuucagauacacucucucugccuucagauacacucucugccuucagauacacucucucugccuucagauacacucucugccuucagauacacucucugccuucagauacacucucucugccuucagauacacucucucagccuucagauacacucucugccuucagauacagauacacucucugccaucagauacacucucugccuucagauacacucucucugccuucagauacagauacacucucugccuucagauacagauacacucucugccuucagauacagauacacucucugccuucagauacagauacacucucugccuucagauacacucucugccuucagauacagauacacucucugccuucagauacacucucucugucuucagauacacucucugccuucagauacacucugccuucagauacacucucugccuucagauacacucucugccuucagauacacucucucugccuucagauacacucucucugccuucagauacacucucugccuucagauacagauacacucucugccaucagauacacucucugccuucagauacacucucugccuucagauacagauacacucucugccuucagauacagauacacucucugccaucagauacacucucugccuucagauacacucucugccuucagauacacucucugccuucagauacacucucugccgucagauacacucucucugccuucagauacacugugugccuucagauacacucucugccuucauauacacucucugccuucagauacacucucucugccuucagauacaacucugccuucagauacacucucucugccuucagauacacucucucugccuucagauacacucucucugccuucaaauacacucucugccuucagauacacucucugccuucagauacacucucugccuucagauacacucucugccuucagauacacucucucugccuucagauacacucucugccuucagauacacucucugccuucagauacagauacacucucugccuucagauacacucucucugucuucagauacacucucugccuucagauacacucucugccuucagauacacucucugccuucagauacacucucugccuucagauacagauacacucucugccuucagauacacucucucugucuucagauacacucucugccuucagauacacucucugccuucagauacacucucugccuucagauacacucucugccuucagauacacucucucugccuucagauacacucucugccuucagauacagauacacucucugccuucagauacacucucugccuucagauacacucucugccuucagauacacucucucugccuucagauacacucucugccuucagauacagauacacucucugccuucagauacagauacacucucugccuucagauacagauacacucucugccuucagauacagauacacucucugccuucagauacacucucucugucuucagauacacucucugccuucagauacacucucugccuucagauacagauacacucucucugccuucagauacacucucucugccuucagauacagauacacucucucugccuucagauacacucucugccuucagauacacucucugccuucagauacagauacacucucugccuucagauacagauacacucucugccaucagauacacucucugccuucagauacacucucugccuucagauacagauacacucucugccuucagauacagauacacucucugccaucagauacacucucugccuucagauacacucucugccuucagauacacucucugcaucagauacacucucugccuucagauacacucucugccuucagauacaaucucugccuucagauacagauacacucucugccuucagauacagauacacucucugccuucagauacagauacacucucugccaucagauacacucucugccuucagauacacucucugccuucagauacacucucugccuucagauacacucucugccuucagauacagauacacucucugccuucagauacagauacacucucugccaucagauacacucucugccuucagauacacucucugccuucagauauacucucucugccuucagauacacucucugccuucagauacacucucugccuucagauacacucucugccuucagauacacucucugccuucagauacacucucucugccuucagauacacucucugccuucagauacacucucucugccuucagauacacucucugccuucagauacacucucugccuucagauacacucucugccuucagauacacucucugccuucagauacacucucucugccuucagauacaacucugccuucagauacacucucucugccuucagauacacucucucugccuucagauacacucucucugccuucaaauacacucucugccuucagauacacucucugccuucagauacacucucugccuucagauacacucucugccuucagauacacucucucugccuucagauacacucucugccuucagauacacuccuguccuuugauuguaagcuugaaucucaagcccauggguaauagcugguugcauugagaguuaguguuuucuccucuuguugaaaguggguguacugcagcugaauuaaccagaaugacccuugaaaaagaguaugaacuacuuuaaaauuugugauuuacuaaacauguuggguuuuccaggaggauauaucuacccaacauauauuuacuggcugccccuauguuuguuauuugugauucaccaaaugaauaggccuaggaaucuucagcacuaccuauguggagccauaaaucauucauagacagcuacaaggcaacacuaaugagcauaugucacgugccaggucuccacaggugaugcagaagcuguaugaauuagacacaggcuucacuuucuaguaucuuaacauugcugcauagugugugccuuguaggacauuaaccagucuacugugaaauaaucuuaaagucguaucugugcuuuacuuuaagcaugcagagucgacagccagucaaacauuggacaugguaccuauucaaggucugccaaaauaacaguaacagaaauugaguucuguguccuaaacucauuaguaaucagaugaaaacaaggagaggugaucacucggugcgacuguagggagacuuguaguguccaagaugauaaugccagucacugggaaaaauaggagggagauucaugcauuguuggaucaaaacaaacuaugaucgcuccuguaucagucguuuuacauugcuguuaacaaaagaauguagggaaucaggacacaguauaucccaggaugugucuccggggucucuucccucccacugcuccaccuccagcuuuucaggaaagaaggccauccuaugacuccaucaaggauuaccccacugaugaggucagagccagcacgcuaggacuguuucugaaaugccucaugcacgcauacacagggguguucuuuccuccucuuccugacacuucucagucuaaucaaguugcccacugggaccaaccaucaaagucuccuccucaacuuccacccaagcaccucccuucuaccacaaaauucugcucugaccaagcgcacucacagaccgccgcgcuccccgauaaagcagcaccaagagcacacucacgugcccuuagaguuaaaaaaagcaagcugucagcucacacccccaggacugcaggacaggucucaaguuagggacaggaugagacugguugaaacuguguugagaaaugggaucaucaugccuacccuuuaaagaaagguucacuucucccuaccucuagcagaaacaugaacagaaccagcguuguagacuuagggccaccagcuauagcuaauggugacagaaaagggguaaaucaggagugaguaccgaaugguggcucucucuguccuuuccuaaaccacgauguaacccucccacucuugagaaccauagcuaaguaugcgcgucccugagacgggagaggaggcuucuccugaagaaacuaacuaugccuagacaaacugucuacccuagacaaagacaaagaccaaaagagggaaagaaaagacacuuaccucgaaaaaaacuguuauuuacuuaaaagcacaagauauaguaaacauuuuaagcuguucauggaggcuugucgccuuggcuguaaucuuagccuuucagggguggaggcaggggaucgagaguucaagggcagccugaaggagguggcugauucaaggcuaaccuggguuauauaagguuacauaacaaaauaaaacaaaaacaaaaaaacaaaaaaaagaagaaaaaugauuuuuuuucagauauaaagacaaaucuaugaaaguaugacaggggcauuuaagaaaauaauaaaaggggaauacauguaaaacugaaaaacaaaacaaaaccaaaaaacaacauuagaaaggaagagagccgggcaguggugaggccggccuuuagucccugcacucaggaggcagauugggaacgaagacuacaagaaaccugucucucgggggaaaaaaaggcaacaaaaagcaccucagauagauagaugucugugggguaaccugcagugucuguacacuccugaugcacccacacucaggcuccugaggaagguguggccguuucccuuagccugaauaacuccacgcaugcacacacccacaugcacaucugacuguugagagcggugagagagaguucgcccucugacagaacuucuggggaugcccuggccuauucuuaggccagcaguuuucaauacugaaaaauggccuggagcagauggaaagaaauuagacuuugaaaguuuguccauuuuaauaaaaaugguaaauacuaagaaguccgggcgugguggcacaugccuuuaaucccagcacuugggaggcagaggcaggugaauuucugaguuuaaggccagccuggucuacaaagugaguuccaggacagccaggacuauacagagaaacucugucucgaaaaaaaaaaacaaaacaaaaaaacaaacaaacaaaaagaagucauuacagcgucgguaaacacagggugggaugguauaacucaguucaaagcgcuuaccuagcagagaagccuuuggguccauugcccaguguauaucuucugcuacucuugccccuaccugacaccagacuucaucucucuuuuaauccuuacuuuuugugaugucugacuuuguuuaguuuuucauuuugguugcagugcugggaguggaauccagggccugugcauagcacccuggcuccugcgcugcccgcugccucccaaccuugugauaucucuucuguaggguuaauucccuuaauuggcccaaaggugagcccagcagagugcuugcugacaacuugcaccccuugugcaucguuuaaucggcccuugauugaagugaaugaugcuaaacaucuaguuacagccuguaaucccaacacuuguggaguagaggcgagaaaaucagaaauuaaggucauccuuggcuacauaucaaguuugaacuaaccuaggcaaugugagacugucgcagaaacaaacaacaaaucuuccuuagaauuuagcaucuaacuuuagguaucugaguagucauuucuugcucuaaccugguuguguugauuccacagugucucacgcaggagcgucaauguccucugcuucaucagacacuggaaugagcccuucuucaucgucucccccccaaaauguacuugcuguagagugcaggugaugaacaguucuccaccccacagcaguuugcugccauggacauaaauccccaaacccugaaauacaaccacagaaagcacucagccggcuaaguauauccuuccuguauaguuuccaggauuguaucuagacccuccucucuccuuuuuuuauuguugcagaaaauaagcuuauuaauaauugaagguuaggcagccugccauauuggucauaauuuuuccucuguauuuucuuucuuucuuucuuuuuuuuuuugugugugugugugugauagagaaaaaaaagggcacuuagcaaaauggaauuuguauaauaaagcuuucaaguguucuagaaaucauagacaagcgcacacaacagacaggagagcauuaucugguuagcaguuacugcugcacuuucacugagaugcauugaacacuuggugaguaggggguugauuuuguuuuauucuuguauuauuauaauuauuauaauaauuauuauuaauguugauuuuuuauucauuucaauuuuguggaagcacuugcuauguagaacugccaaaguauaugugcagcagugugcccagguuuaaaaguguaaaugggacaaaauaaauugugaaaggaaguguaguugacugaaaacugcaguuguaauaagucuuccacuuuuuauaggacuuuugagcacacaauuaugcaaauauuuuaauguuuauuaauguuuacaguggaauugugaauaaguuuucaguggacuaucuuaucccuugacaaaaauauuuugucuuuuuucuauguaauuucagaguuuuuauuuuguuacaaaaauacaaaaaugaaauauauaacaacaaugaaguuauuuaacaagauuucuaaagcugaaaauuuuguguaaaauaagguauuaucuugcaacuuguuaaauauauuuauucagacauuggaugguuguauuuuuauguauuuuuuaaaauauuaauaaaauugaaaaaaagacaauucuagguuaauucacucuuuggauggcaguaguggucagcugccccuuuugcagggggcugugucugcagccgcgggugcugcagggcgucugucucaaccuucccaaccgagcagcugagagugggcaucugggucacucaagucuguccuuguuuagaaacuuuggcaguccucguauuuaaaccacuuugaggaucacauuuuugguugcccuuaagaugcuuugucacaguuuuuguguucgcuguacugccgaauaaauuuuauaucucccaaagucaagaugcaacagucacguaaagccacuauguauucuuugucugugaauuguuacacagacugauacauuuguaaauaauucuuccaaaaucauguauuuaaagcaguuuugcauauacauuauguuaaaaaaaaggugauuuuuuuaaaaagcauuuuuaaacucauguuuguacauuaaagggguuguuuugaagccuccuuuucuguguuuauaugcuguagugugguagcccgggggguuuugacccugagggcggacagaggcacagcacauugcuacagcagagcauuaccgaaauuauauuucuccacgucaucuugccacauugugaaccugggauucagacuucuuccauuuucucagagaauuaaaacaaaaaaguacucuuguaauaugaacuuuccugucuuuucuuugcaaacagaaguaucucaaugucaaauaaaaaggagcccagugggcgugucuuaaaca

SEQ ID NO: 6687 - RNA, 106458 nt, Mus musculus
acggcaacggaaucugucgaaauuucuagaaagccuaauaugcuuaaccuacuagguuucuaacggucugcaguuccuacaguguaaauaacccuugauaaacaaaaguguuuaugggcuaaucgagaauucgccauuccucuaggaauacuuaguacuguguccaaacauaaaggcgauauucugccuuuaaaaaaaaaaagucacaucuccuggcagucuuuuauguugggaguuuguuuccacccggacacgaauggaagagcaccagagcacucccguuccggucggggggggggggguuggaucuuugcgcgcaugcgugcugacgcucaagggcggguuuucggggaagacgguauugacccgcgaacaaccgaagcuguuauucuaucaaaaucaagacggcgugugugccggacucuguggagacucugaagacuaaguugagguguccgaaauugcguccugacucguagaaagaaaucuacuaagcucuuaugagggugguguuuuaaaaaacacgauuuuaacguugccugcucgucugggucuccuuaacaaauccuaaccccgccuccacgucuguugggguuuucagcugcagcucuggguuuggaggagugcguuuuuauuacgguucccguggcuucucuuuugcucuuggcauaauuccuuugaaauuuauuucuucgaugcauuaacagacucagugggaucaagacuuuuuguuuuguuuuguuuuuuguuuuugucguauuuagcccuggauuaaaugucaaaaucgaaauuuacagcuuuauggauauuuugccuauagacuuucuaaguuaaugacugcuucauaauuauuuuuggaacucagguguuuuucaaauucacuuccaccauuacuucuuuuccugguacucaaggagaaacugcguccuuaaguuuugagaagcuagaauucccucuguuaagaacggcgggacuugauuugugacuaaccagaugaaaaacguugaguuuagccuggaaagggggcaaaggcuuaaaaugccagcgaggaaacugcgagagauuguuucuccaaaccaagggaauaaauuggcugugguggaagaugagcugccccguguuccuccagcccuggcugcaaauaaacgucuugcuguugaaacgaggacuaguucuaauggaacguuaugugguaugugauuccaaauguuucaguuucccacccaguuuacguuuucucucucucucucucucucucucucucucucucucccucucucucucucucucucuuccgagacaggguuucucugugcagcucuggcuguccuggaacucacucuguagacuaggcuguccucgaacucagaaauccaccugccucugccucccaagugcugggauuaaaggcgugcgccaccacugcccagccaguuuccuuuuuuuauaagucauuagucuuuaucacuauuuugaguugugcauucccccaaauuuaaaggagucaguguuuacauucaaaaauguaagauacaagucugguuuguaaagauguuugaaaaguaacuugguucccuggggaaauaggauucagcauguagaaugagagagacuugacuauuuccucuugugcaccucugccucccgagugcugggauuaaaggcauaggcugucuguuaaaucagaguuuuauaucaaucuaguguuuuuugguuuugagacaaguuuucccuuguccugauuggccuugaucucacagaaaucugccucuugaauucugggauuaaggcaugcauuaccaugccuggcuauauacaagguuuguucugguaagucucauauuuuuuuuuuuuucugcauuggauaaaauaucuuuuaggguuuucaaaaauaccacuuucaauugugugucuauguguaggugucuggaaacgaguucaggugcccauggcagccagaguagcuaaaucuaccuagagcuagacuuaacaggugauugggagccgucuacaggagauuccaaucuccaguccuuugcaagaucagcaagcacuuuuaucuugcucugccaucucuccagucccugaaaauguuuuuuaaaaaagacaucucauuuuauuuuacugagagaggaucacauugugaagcucugcuuggccuaaaacucacucuguagacugggcuagccucaaacucagagaauuuccucuaucucugcuuuuaagcauuccaguuaaagaccuuccacaccauggcugcuguuaaaacauuuuagaucucaccugcuuaccuuaccuguuuuaacucagccuuauuuuguuaaauaaugagcuauaaagucuuucauuagaauguauuuaaauauaucuaauuucucuuacaggaaagugacuucacauuugguuuuuacauuaauacagagauucucaguucuuguaucauggcuacacaguugcuaagggucagguuuugauuuaaaagcugcucagauuggacccguggcucaaugcuagagcuuacugugaaaagagccuugguugggucccugggaagaaucacaacccagcucucagggacucuuuuuuuuuuuuuuuuuuuuuuuaagauuuauuuauuuaaugcauaaguauacuguugcuaucuucagacucaccagaagagggcaccagaucccauuacagauggcugugagccaccaugugguugcugggaauugaacucaggaccucuggaagagcagcagucugugcucuuaacugcugagccaucucuccagcccacucucagugacucuuuugcuuucuuaggcuccuuggauuuaacuucugcaagacuguaucaccagccucuguuagaaaguccuccugcguccaagaaaaguguaaguaaaagaauuccaagucacguaugacagggaacguuuugaucuuuguucauuuuuaucacguuuuuaaccuuugcuguguacaaguaagaauggggggccauuuuuguaucugaaggucagaagacaaccuucaagaauguauucucuccuauuacgugagucccagcagucaaguuugaaucuucaagcuuggcagcugguuucuucaucuguugaaccauccuaccagcuccagcaguguuuuauagauuaugacuugaagagugugggacauacaagcaucuguugaauuguuaaucuuguuuuuguuuguaaauuaacacccaucaucaccuuaacauuaagaaaaaaauuuuuuuuuuccauuuucauuuguguacacgguauguguauguguguucauguuuguguauggagagguaaggggcauguguacaugucauggcuugagcuugcugucaggaagcaucuuccauugcccuuccaccuuauuucauucagucagggugucuuagucuaacugaccaccugcccuugggcucuccugccucagccuuccucucagggcugcaguuccaggcaggcugccacacccuccuagcauugacuuugguucuggggauccgagugcuggugaggcgagcguaacugcugagcgucuccccagccuuuuauguuuaguggaaaaaaggaaggggaagagcagcaugggguccgucucagcgcggagccccagagauggguucuaggcucacacucgagagccggaaaccggagcaguagaugugacccacacagcacagccuuguaaggcagcgcgugaccucagugacuaagaaagccgugcuuagguugcaguguagacggucaaguguggauuugaaucaguuucuuguuccacuucuguguguguguucacuuuguuacgucucacuauucugacugcacguugcucauucacugagaaauccucgugugcuucagagcagcuauggaagguguaguguugggaaugacguaaguaaagugugcagaccugccuucccgggucucagugcucaaaaggcuaugaaugucacucugcuagugcuaauuuaagcucauucaaucuuacucuuuuaugcccaaaggauuuuucuaaagaugcuguaguucggcaguuaccuuugaauaaaacagaagagaacaacgcaccaaaagguaaauuaauacaguugacuccgcuuaauaauccgcuugauaaagcugaguuaaaauguacagaaaauacuuuauuucauuaguuuugaaugcacaguucugugacauugaccuugauaacauucagugacaucgagccaggguuacuaucauucaccucuagacguuaagauccccccacugggcucugugcccucacuccucacucuugccccugugacuuugaccagcucagguaccuaugucaguggcauuauacaguguuaaccuuugugacuguuuuacuuuacauaaugugcuuaagcuuauccacauuguaguaugugucaguauuuucuuuguaaggauagaauuggcuuuuuuaaaaauuuaggguaauuuauuauuuuguguggauagguguuuugccugccugucugucuauacacagcacucuugcagugcccaaaaaggccagaggaggcagucagaucacuugggacugaaguuauagaggguuguuagucaccauaugggugcugggaauugaaugcaaguucucuuuaaaagcagcugugcucuuaacugcugaaccaucuuuccaguccagaacugguuuauucauucaauagcuuaguaguauuuauuuugugcuuggcaucaaauccagggccuucugcaugccaggcaaaucuauugucuguauccugagcuccuauuauuuuaauuuuugguuuucuuuucaaauuagguuaccaguagaaucuaaaaucuauaaaaggauuuacacaggagaagccuauuuugcuauuacaaacucauugcaaagguuugguuugggcucuuuauuuuauuguguuggcccuggcugaucuagaacuugcuagaguagaccaggcuagccucaauggugcagggaacuuugugccucuguaugcugagugcuagacaugagcugcagaucgaaaauuaaaguucauuuuuuuuuuuuuuuguuuacaaaguaucagggaucgaaccuaggaucccauacauucugagcaggcgcucugccacugagcuacaucgcuagcccucagucuuggcucucuuuguucuucagaaucuaaauauauuuuuguguuuuaauuuuucagcaaaugacaucuuuauuucucaguacaccaugggacagaaagaugcucugagaacuguuuuaaagcaaaaguaaguuucauuuacaaacacacuuauagugguaugcuaccuuaaauuagaaggaagcuguauguuagcauauguuagauaauccauacacagcgauuaagaagaacacagcaauguuuuaaaacugaccacagcgacuuguagggcuguggauguagcucaguggcagcaugcacagucuaggagugugaauguagcuuaaugcaggcucuaccugcccucugcccugcugucuuguucacucuaauuguuagcacagcccccguaucugacagugugcacagacggcaaaguaacuggagcuggaacaggaagagcauugcauuugguggaucauccagacacguaaaccguggggugccuacuuauucagcguggcucugcugcaacucaaaaggaguuaauaacgggagagaucagcaaguacuauagagacaggcuuguugaaaaggcaucaacuguauugcauccagggaggaaaguagugacuucgguagaagguugggaguucagaaagaaaagcuugacauuagcugugggcccaaugcuuauuugugucuucaacaagaagagcuuugugacuccacauagaugguguuuggcagaggcaauagcuauauauuauaaaguugggcagccagaagaauggcauuguguggugggaggcagucucaucugagaaagcaggagucucaugggaaagccugugggaguuggacuccgcccccuacuaaaucgcuggcuuuggucaaguaaacccuaauaccuccagacuucagucucauuauguaaaauuaaaaauaaggauggaaggccguaauaagauucucuaccuucccaauucuaucuguggccguugucauguaauuaugaugaaguaauugagaaaacuuggugacucaguuggguaugacgagguccgagauggagaaaccaaagugacuugauauguuugaggugcucagagaacaguuccucucuuagcuacgaggaggcaucagagagaaguaagugccagcacauucacugugcugcccucgggccugaugugagggaacucagggcugcccguggcaggucccugccuacagcgcuugaacucacuuaguaauuccuauguuuugguugauuucgccaguuuguuuuggucuaaauugagagugcaauggacuagcucuuuuaaaaaacugaagccagauaucugucuguuugcuuuguucuuguuuugugguaagggggaaugaacucaaggccuugggcaugcuagcauguagcacagagcuauuaucccaucuugcuguacucgugugaggcgcacugccuaaugguguguuuggugcucauuaaauaaguaagccagcagagaaagggaauuaucgugugagcuagaucaguuaugugcagcacaggcacaggguagauuggugguagccacaggcugguauaaugggaaauggggagauaauuaccagagaguccaguuucagucaggaugacuacguaguagaacuuuuuauguagccugacaaguauaggagauacuaauuacugauagaguagcuuaaaauguucuuaccauagaauaguuguguaagguaauggagauauucauuagcuugauugugcuauuucacauuguauacauguaucaaaacaucacauuauauacugcccauuauacuuuaaauuugucaaguguaucuuagcauaucugggaaaaacaguaugcaucauugauguuaguuuuuuuuucuguuuauuuuugagauuguauuuugauugcaauguuuuucucuuuccuuucuucccaucaaguccucccauaugccccuccucacuuuccuucaaauucuuuuuuauuuuuagauguuuacuuaauuuuauguaugugagcacacuguagcugucuucagacacaccagaagagggcaucagaucccauuacagaugguucugagccaccaugugguugcugggaauugaacucaggaccucuggaagagcagucagugcucuuaaccgcugagccaccuccccagccuucuccuucauauuguaugcuucuuuuucaucaguuguuacuggaugcauaguguauuugcaugugcauauagauccccagaugaagccuguugaguccauuuaguguuacuuguuauguaugcuccagggcugacugguuggucauaucuucccagggaaggcccccucucucacucccagcuuccuucccucgguugccugugguucucuguguaggccugagaccuugugggcuuuccucauccaguuugccauguucauugguguuuuucuucugcucacaucugggcagucauguuggugagacuugguggguguggcuugugauguuacuaggagacacaaccucacaguaaagucccagaucaucuggcucuuagagucucucugcccccucuuccucgguguucccugagccuuagguaagggcuuugugguggucaugagucaugaggacucugcccuuugauggguugugguuuucuguaguguucuccaucugcugggaagagaaguuuucuugaugcgggguccucguuuguggguguaaggacaaguguuuauagauucuuguuaggguuugugcugguuuaguaaauuagugguuguagauucuccucuagugaccaugauuucacuagcacuggcuaguuagauuucuaguaccucuuuuguugagcaagucuuaagucuucugagagagcaguugguuacuagcaggauauaugugccaccucugcaccuggggguuagcuugcccugcugguuguugauguaguucauggugucaaagguggauaggaguguugguuuucugucucuuuuggaagccagcaaggcaccuucagguaccauggaagccaguccucagggaggggacauucaggucaggucagcucugucucugggccguuucugaaguugcugugccuuucagaagucuuagacagcccuggccaaccauugaaaagacggcuucucaugucuggcaugggguuuugucagguggucuuugguuuuuagagagaguguugucagcccagguaaaggaagucauuaaaacuauauauuuauacucugaauugccugcauuccaguuauuuaauuccuugugccauuuucaggaguccguguuguuguuuuacucccuccccccucccucaggagccccaccucuccucucagguucccgcacagaucuggugucuccgugcuccgugcaccuucuuccguauccacccuccucccuucccgugaugcggagcuuccuuuuccacugcccauccgaucgccuguccucugcucucccccuguuccagucccagcuucuggguuggacccuucccccuccccucaucagaucacguguacgcugcuguuccucucuucgugcuccccaaaccaccuacuagagcaguggucccauugucccucguuucuguacuuacuacgagcuauguguucacaucugaagguuuagagcuaggagccuccaauuacagagcaugcgacguuugucuguccugcugggccugaggugccucacucaguaugcuucuuuucuauuucuguuuaccugaaaaauucaugauuucuuuuuucuugagcacuaaauaguauuccauaauguauauguguauggaccacauucucaguauccauucuucagcuguaggacauuuagguuguuuccauauugugacuggaacaguaaugacauggcuguggaguaggguauugaguccuuuggccauauaccaagggguggauuagcuggguccuaugguagauuuauguauuuagcuuuuccagaauuuuccacacugauuuucauaauggugcaacaguuugcauuccagcuaagggaauaagaguuccccugcacccucgggugcccugcauccucuggugcccugcauccacggguccccugcauccauggguccccugcauccucggguccccugcauccgcgguuccccugcaucccccuguuuguugcuggcuguuccauugaucuuugccuccguugucaaguacaggauugucucugucauuuccaucagccuuguguguggguuuauucuccuuaaacuuccuccuugauuucauugaccuguuucuuuugugucuuuaaacucuuugaguucuuuggggaaguuuaugauugcucuuuuaaguucuguguccugguguuaucuagguaauucucaugggcaggcauuucucuaggacugguaggcuuuggagaggagacacugacuuggucuuuuauauuguugguauugucuuaaugcgaucugggcauguggucuuccuuuaaguucguuuuuuuuuuuuuuuuuuuuuuuuuaaguuugcuauggauagaguaggcucggggagaagagagaauguggggauggguugggucuugaaguuagaaguuggaauauagugcaguggucagaagggacuagggugcuuccuguuccaagaugggaguguggaggucugaguggacauguagagucaugaaguaugguggauagguaggaggaacacuggcccaugccuagagcuucugcugugaagaccggacuagguagacccagucuaaauuugguagauuucagagaagacauagauguaagguuguguacguagcagucuguacucuggaggagggcgugguguggagucgguaguggaaugagcacuaaugguccuguggguagaugcagguaagguagguccaagugggaguuaaauguugguuacaguucaggaggagauggugaggcuaggccuagaguuaggauuuuuggggcccugugguagccuagagucuguugcugcaaaacaacuaguccauggcacugacugggaccuggccuagaccugguggguuguggaaauauaaguacugggcguguggggcacucccaggcuacacccuggaggaggaugugagaagucugaguauggaaugaagugguaggcacuguugguuuucuggcuuuuuaaauuuuuuugaaaugugcugggauuggaaauuagaugucaugcauguaagcauauacuuccugcacuauaucuccaacccuuaaguuuguaauucuucuaaaagcauuuggugaauacaaccaucaguucuuagaaucagaugcagcucugcugccuuugggaauuaaacccuaugcuuuguauuugugcuucuugaucaucugucugucuaacugcggcuaugugguugucauuuguaaaucauaguuucaaaacugguauuacugccuucaaggaauagcuuuuuaauauuuauuuauuuauuuauugguuuuucaagauaggguuucucuguauaguccuagcuguccuggaacucacucuguagaccaggcugaucucgaacucagaaauccaccugccucugccucccaagcgcugggauuaaaggugugugccaccacauccggcuaaggaauaacuuuuuauuucuuuaguccuuaaugaccuaaauuuaguaauacuaacuaaaugacuuuaguuaauauuaucgaaauaaccacuuaaauuuuuuuauauguuuggguucuuuuugcuugcuugaaugucuguauaccaugugcauaccucaagaagucagaagaguccaauccccuggaacuauauuuaaaggugguugugagccaccuugugguggugucaggaauugaaucugggucuucugaaaaacagccagagcacuuaacuucugaggcaucucacuagccucugcuuuaauuaaaaaaacaaacaaacaaaaccccaagauggagcugcagagaugguucaguuguuaugagugcucgaagcacuguagaagucuguguucgguucugagcaccuacaucaggcaacucacacucuuccacagugcaagcuccaggcucacaugcacacacauccucucaugcacaugcugcacauaacuacaaauaaaacaagaucaaagagaaacccagaaggccacuuuaggagacucccagauuagggcauguaggcauuucuucuaaugguucaaugcagauuucugaaaaccuuuguuucuuugucuuuaaagagcucaaagcaugccuguuuuuaaggcggugaaaguacaucuuuuugaagacacgaguacagaaaagaauacuguugcucaggagacugaaacuccacccaauagaauugauucagcuacaacuguggcugcggcaacugccgcugccaucgcaacagcagcuccuuugaucaagguacuucucucugcugggcgucucuggacccugagacacggcuguuuguacagaacugacucuggcacagucgugucugacugaacacuuagagacaugcuaguucccaguuggaaaggcucuucuuacgugugguuuguggguuguuucucagaaaccgugaaaauugccccuugugaaugugcugguuuagagaagccaggacguuaucccuguagggcugacaguccuuguucuggaugaucagucucuaagaaucaaagccagggcccacauguggugauggguaaguguugucacacugcguuguauugcuagacuugccuuccuggaggaaccagaggauuuuugcaugauauuuuauaucauaauacuagccugucaguuuguaauggggaagcagaaauauggcaggauaggcauaagguuuuagaggcagugggaagcagagucaagacucagauucaggguuguugaccucccuagccuggcgcuggagaaguacccaaggcugugcuuuucuguuuuuguuuuuguaucccaggcugaccuugacuuugcucuguagccaaggaugagcuuuagcugcugauccuccuguacccaaguucuggccuuacagauaaacgccgucagccugcuaugcggugcgagggaucaaagccucggagucaagcguguugagcacucuacugagcuccaucccuaccguguacucuuuccaggcaggaucugucugucugucuggacuugcguuccuucugugauuauaggaaugugccauuucacagcucgggucuggaaccuugaggagggauggcaaaagaguagagaaaggacagguguacauauacacacacauagagaaaagcugagggucaggugggcuguaugcacucugguggagccucauugccuaccccauaaccuggaaccucagcuauuguacacagcaugggaggcaggguuagcuccucucagugugaagucucuguagggcagcaguuucagacugugaacagccaggaagaagccgccacaguugguagucuuucuguguuuuuguuuuucaugacaggguucucuccacagccuuggcucucuauacagagagccugucuaggcuuaaaggcgugugccaccaugacuguuuuuucuucuagcacacugauuaaucgucuguaaacacauuugggucagaggaagaaggcuuugccaguucugagucugauccauaugaguccaaggccuugguuccuguccaggcgagcuugguucugugcucauggcagcaauacacguuuauucucaguuuuguccccuccacacaugccgucauggguggcaucaaaauugacuugguuuugcuguuuccuucucuuuaguuuuaagaaucuccccccccccggcauuauagaaucuuuugugucagauuugauguguauaaaucaugauuggcuugcacaucauucuuuaugcuguguagauacuugguguguugucgguuauaguguuguuguugcugugagaccucuccuuauaguugaccuuucuuccuuuuguaguauuguauguguguucacauggaggccagaauauguauguauaguucaagaaacaaaacauaccuaaggauuacuugauuuuguuucuuaauuuugugacucuaaaaucaaaggcauggagucaugagaaauuucgugagcaaaggcucaaguuuacuaccgucucaguaccaguugcuguaaauaaccuuccuaggaccugagcacaccuuuaaugucuuucuacgaugugaaauucuauuuugauguuuuguuuuagguacagagugauuuggaggcaaagguuaauuguguuggagaguuacuuacuaaguuacaggagacugauaaacaguuacagcgcgugacagagcaccaagccagcguucagaguaagcaagagaaagugcacugucaugaccacgacaagcagaugaacgcguucauggagcagcauaucaggcaccuugaaaaacuacagcaacagcagauagacauucagguaugugauaaagcugugcgagcucccagcucuaacuauuguuaacuaguagcugucauagcacucuagguugugacaguuugauuuccuaaaucaugauugucuugcucauuauucuuuaugcuguguagauacuugguauguucuagguuauaguguuggugcugugagaccucuccuuauaguuggcuuuucuuccuuuugcaguauuguagguguguucauguggaagccagaaguuaauuucaauaucuuccucagucacccucugccuuauuauuugagacaaagucucccugacuccugagcgcaccaauuuggucguccagcaagcuccaggggugugccuguuugcucccuuuccucccaguaaugagucugcacacuugaccuaagcuuggguccucacgcucgcucgcucgcucgcucgcucgcucgcaaggcaaacacugcuugcugagcucucuccccagcccgguuacauuauuuuuaaagcagugauuuguuuaugucagcaguuccaagucuguuuauaugaauuggaaucauugggaaagcuuuauaaaaaugcauauacuuugaugucuuggaggcugagggagcagaucuaugaaggugcuugggugucauugaaagcuuccucaagaugcugaugcucccauggacagaacucccuacaauguguaguugguacacaguaccuacaaauguuccugcauuuaguuuauucaaaguaucaguaccguaaugccuuuugaguaugauauguugagauauuaaaagaugaagaacuagcuuuacaaauggcugaguuuuuauuuuggaauuuccuaguucuggaacacgacccagcuccaaaacauuuuagaaauaggaauauauaaccauugacaguuucuucuuuuugucuuuugagacagaguuucucuguaucucccuggcuguccuggaacuugcucuuuagaccaggguggccuugaacccagagauuugacugccucugcugccuccuagcuugcaccaccaccacugccagguuacauuuauuuuucuauguucacguggggguggggguggggguggggcuggggagggguguucugcaugcguaggugugcaugugcugaggcugauauagggaaucguccucagucagucuuccaugucaccuuaaaggucaccgugucucaaucaagcucaaggcucauugauaugauugggcuuuuuagucggcuuacucugggggacuucuuauuuccaccucugucuaggcuugaauucagcauuuguuugugcucugggaaucugaacuuuuguccucaugcuuguggggaaagcauuuaaccacugaacuguccccucaguugcuuuuuaguuauuguacuauuuugaaguuuuaauaguuacauuaaaauguaacacucagaagaauguacaaaaauuaaaugcuuauuaagugcuuucauuuucaagauuuuaauuuuuuucuauauucacauuuucaagacuucuuaauagggcuuguuuugacguuuucaugagauuagaaauacuuaccggcaugauuucagccauguaauaaggcuuuaggaagucuucagugugggacuugaguguauagugcacugucuagugagaagccaggugacugucagacugcugggcccuccucuguaagcaguuuuaauucucugggccuugacccccgcuaaaaagccauuuucucucuuucucaucaaguaagaaaaaggcauagguuagagagauggcucagugguuaagagcacugacugcucucccagaggucccaaguucaauucucaguaaccacacgguggcucacaaccaucuguaaugggaucugaugcccucuucuggggugucuaaagacagcuacaguguacucauagaaauuaaauaaauaaauaaauagauaaauaaauaaaccuucugaaaucaguuuuauuuauuaaaaauucauuucauauauaccuuaaaacuucuuaccauuuuuaaauuaugaauguuuugucugcacauacguaaguguaccccguuuucauugaacauuaaauauaauaagccacuuucaauccucauaagucucgauauaucuuguuccuugauauccuaaaauuacauguaaaaucauuugaaauuaaugaaauaaugcuauuucuucuagacccauuuuauugaugcugcacucaaggcuagcagucuucaacuuggcauguccacguccagagcaguggggaaguauucuggaaaacugggaagcccuaguguugggagcaguguuuuuucacacaacacauuuguuucuaaacgagguaaaauacuuaguuucuugagaauaagaugaacccguguucuucauguguaaaagguggaaauuacuuauaaaguagcaggguacuuugucucaaaaauaaaauuauuuuugaauuguugauuuuauaucauuuuuuuguucuucaaauaaacuuuagguuauuuuaaagguuuaaguuacgaacuacaauaauuccugguuuaugguucuaauuaaucagaaaaaaauuaauuuguuauaaaucaaaaugcuuguaauuauuguguagcccucugagaagcuagcuguguggucaugauuuccuugcuuugucagagacaaucccccuaguacaguuagugcccagugugcuguugggcuuuaggaguuuuaggggcacuaauacaacagaggucaugcaucucuuucuguuuucucuuuugucgcuugaggcuggguuuuagauuauaacccaggcuggucuagaacuugcagguguuagcaugccgguccagcauguucuuucuucagucguauuagaaugaacuucuaagcgugagauugauuacuagguguuauuagguacuauccccccaggugauagauuaguauuccuugccacugagaauguagcgggacagagggauggcucggugaucagcacugucuugagugcgccuggacaagacccagguucaguucucagcacugaccuggaagcuaacuaacugcuuauaauuccauuccagggaauccauugcccucuucuggccucaugcuugugacgcacagaugugcuuacagccaaaaaccaacaugcaugguggcucacauccauucguaacucgaguuucaggagaucaguguccuuuucuagcuccacaggcaccgugcacacacacacacacacacacacacacacacacacacacacugcacuuauaggcaaaacacucacacucauacauaaguaaagaucaaucuucuuuugaaaacuaucuagcaaugcaguuuuuccacagauuugagaguacucaaauauuaucacauugauucuuaauuuacaggcuuuaucuauaaagacauuuauaguuuccauuuauuuugauuucuagugaguauuuuuuuuuuccuuuuucuuggagacggucucuuuaugugguccuggcugacguugcuauuuaaacaagguugacuuugaguucagagagauauacuugccucugccucaguguuagcauuaaaggcacgugccaccaugccccuccugcguuaaaggcacgugccuccaugccccuccugcuuuuuugaaaggguuucucucugaccugcaacuuaacaauaggguguuugccauuuugagagcuccagggaucucugccuccccacgcacaugccaccacauuaaccucuuuuaaaauguggcucuguaccaugcuugcaaggcaaccaccuuaccauuuguucucaaaaaagcuuaguuuuuuuaaauuaaaaacuaauuuuugaaacagugucuuauuguguaucccuggcuguccugaacucuauauagaacagguuagccucaaacucacagagguccaccuuacucgauaaaguguuuuuguuuuuguuuuaaagauuuauuuauuuauuucauguaugugaguacacugucauugucuucagacacaucagaagaggacauuagaucccauuacagaugguugugagccaccaugugguugcuaggaauugaacucaggaccucuggaagagcagucagugcucuuaacugcugagccaucucucuagcccuaaaaaaguguuuugaaguuaaauuuaucuuuauuauugugauuauuuuguguguguguguguguguguguguguguguguguguguguguguguguguggugcucagugguugaacucagggccucaccauuggagacacaccauaguccccuauugauuaguuucuuccuuucuguuaaagugccuuuaagugaagacacagauuuugaugggcagaaaucuccuuuagagaccccagcaccucgcagguuugccccuguaccuguuucaagggauggaaaaauaacaaaaagggaaagcccuacagaagaaaaagaaaauauggaaaugaacaguccuaaagguaggaauccagcaauuaguauccacauguaguuuucuuuacgcugggaccaaauaccugacaggaagcaacuuaagcaggcagugugauuuuagcccaugcuauaaaaagggaugcauucaaucaugggaaggcaugauugcaggaggcugcuuagauguuggucauguugaaucuauagucaggaagcugaaagcagauaggaagugaguccaggcuauaaaaccucgaagccuguucccagugacucacuuuuuccagcaaggcuuugccucuuaaaggguccauaacuuuccaaaacagugcagccagcuggagaggacauuuucaaacacagacgcccauaggggaagauccgcauucagaccgcagcucuucucuggacugauugcuucuuugcguauguuuuuguuauuuugugauggucucacuccaauacggccuguagccuaguggccuugaacucaugauucuucugcauuccccuccugacuacugagauacagcuaugagcaccaccucuggcuggaccuuacaaucagaguugcaugagauuugccccuugggauuuaagauuaugugccuaguggucacuaaacucuacuuagauggcuaguuucaggauuucccgugguauuuagauucuuuaauguaauuaagauauauaucuuuuuuuuuuuuuuuuucgagacaggguuucucuguagcccuggcuguccuggaacucacuuuguagaccaggcuggccucgaacucagaaauccaccugccucugccucccaaaugcugggauuaaaggugugcgccaccacgccuggugacagguauauauaauuuuauuaccuucagauuacuuaaaacuuucaagaauaggauuuguaauaacuaaaaaauaaugucuuacugaacacaaagcugaucagagaauauuuuuuuuuauugcuuuuagguauagauuuaaguacaacucagggaaauuaacauuuaucacaacauucagcuggaauaaaugcccauauauggacuuaaugaagcugaagaacuuuuccauuuuauuugaaauacuauuaugcuccugagccuuaaaauguagcccuucuaguaaaacuuaauacaauauuaagcugcaggcuuuuauucuugggaucauuugaacauuuaagucuuucuuuagccaaguuuuaagaauucagaagacaguuaccacaccauaaguaauucuuauauauucuuaaaaacaaggaugggggacauucagguaauuguaaauaucagaugagccuuucgagccguauaugagauuaaaaaccuuacucucaaacuggccaugguggccacgccuuuaaucccaguguuugggaggcagaggcaggcagagcucugaauucagucuacagaguaagacacguuccaaguuccaagacaagacaagguccaagacagccagggcuacacagaaaaacccugacuugaaaaaaaaaaucaaacaaaaaccauuacucucugauagagauauguguagacuuuuuacucauauuaaucaguuuuuuacaacucuaauuuuuaauaagauggaaauauuuugucuccccugaugaguguauuuaugcccauauugucuucauuucuuuucaagugcaauaacugaaccccauggguuaaguaauuuauaaagaaaagagguuuauuuagcuuccuguuccagacauucaaagcaugacaguggguggugucuguuugcucugauucucugcugggccaugguguggcggaaggcauuacauggcaagaaagccagcuagccagagaaagcuuggucuuacuacagaguugcuccuuugauaacuaauccacucgugggauagaguccauaugaccuagucacaucccgaggacuucacauuucuaauaccacuaauacguaacuuugagaauuaacuuuccaacacauggaauguagggaauacuugcaaagaaccauagugguucuagagugaguugaguagauaguaaucauaagagcuuaauuuagauggagaggagaugcacgggaaauggaauacaaaggagaaaugaacuaauuuggaaaaugacaugacagucauuuuuuuuuucuguuguaggaaauguaagacuguuggaacaaguacugaauaguaaugaguguuugacaagaaagacugaaucaucagauauaaccucacuaacucagccaaaaaugggauggaauuuagagaaaagagacagguaaaaacaagagauugcaacuaguaggacuagaaaaagcuguucacaaucuaacauuuucuuuaggaauucaaugacaucauugcuuucuaaugagaacugagcauuugaggcaguacagugacucggagucuuccagggcucacuugcaggugacucuuguugaugcuggaccagguguggaaucugaauucuuugucgugugaacacacuggagucucuguuuguuagcuuagucuguuggagauuugguacguuuuuuuuuuuuucuacuuugaacugacaaaucuccuuuguuaaguguguguucacuuccuaccuggauaucgccucucagcuacccgugagaaccucagaccuccucuggucuucccugggcacacauggaguccucugugaugauagugcuuuacugugaaugccucauugucuagauuuaaagugucuguuggccacaguguucaaucacugagcuauucgaucgaucaggugucugagcuauuacacagauaucucugugguugaaaaaaaccaugaaaauguuuguccuucggcucagugugauuaggcuguguaaugauaagccugauggagaauacucaaggaagcuccaaacuuguuccucccuuccauggggugaagcuagugguuuucaaggcuacagagcuugggaagugucuuacguaugggcaaguuuauacaaauaugcaagcuagaccugauggaugugcaugcccagcacuugugaaacagaggcagacagagcucugugaguucaaggcuagccuggucuacauagugagaccgucucucacagaacccaagaccacauguguucagcuugcuccucuaacucugaaccaacuccuuugcuuuaguaaacucucguuggucuguuacaggcuucugaaucggguuuugaugaguuucgaguguucucauugccuguggaggggcagcuugucaaacgcuccuucucuguucucugagagcgucugacucacagcugcuuguaagcaggagccuuuucugccuuuuuccugaugcacuuaagugucucucaucagauuuguuuucagccuuugagacuuacugcuaaaugaguuaacccuuucuuguucuuucugaacucuggcugcuucaacucagcuguucuggcucaaacuccucuccaaguugacugauucagucugacuuuuugcuuugcuuggccucagacuaacucuggcaauuuguuuuaaucuucuggcugcuacuuauuuucuggcucauucugucuacugucuggcuggucgccugugucuagcuuguccucugucuacaaccucccucuucccuuuccucucucuucuugugagaguugggcauauuuuauucugucagaucuuucucugauuggucacuuugucugucacucaauuagacaugacuuucaaacauggauacuuccaucuacaaacuaacuuuacuuuguuugggauuaaagcuguacacuaagggcgugucuguauuccagccagaggguuaaaggugugcacuaaggcaagcugagccacaccacaucuagaaguagguuuuucaguaaauaacaaucucagguucagagugugaucaaauauccugcaacaauuuaggaaaaucuucuugucuuuuguagcacugaaacucuacauucacaaauauuuccuuccucugaagagcggggaacagcucaaguacccgugccgaaguauaaugauguuguucaugaucuuggccagaagaaacaagcaagugacaugcuccagguaaaguggccauggugucaaaacccauaauccugagguaaaaacugugaaaucaggcauguuggcacccauuugcaauccuagcacuguggagguggagguaauuacaaguuuaaggucauccugacauacauacugugucugagaccagcuugugcaacaucacacugucuagaaacagauagugugcuacaguaugcacacacaccccgaguaaauguaauaaugcaaacaaacagaagaaauaaaaaagccauuaaaacacucagaaggaagaaugggaauaaagcucugggaagcgcgaacucaaaucucuucccuuuacaaacagcucaggccugcacugggggaugucuccuagcaaauggccagaccugugccaccaaccguuucugacucugcacagcguuuuccuccccucgcgcuuuuuaaauuuucuucugagguacucuuucuuaguauauagcucuugaugaccuaggaauugcuuuaaaccaaauuggccucaaagguuaggguccgggucaggguuagaacagcuguccuaauucaggguuaggguuagggucccaggcccacagcugccaugcagggaucauagcaggugccacugccccugucuuugccuuucugacuaauaaaggcgugugaggaggagggaaagggguguggguggcccuugcuugucuaguucccagcaucuagagcagcuugcucuuuguucugcuuccuucacaaguagagcuuugauugaugagcggaugaccuagcaccacucuucauuuccucucuggcacaaauaauguuuguaauaguuuuucuaacuggaaaacaaaccaaacagaagaaugccaguaucaaucacuuuucauuuagacaaccugaacccuagauuauauugauucuaguguaugcuugcagcaauguacuagcucuucuuuguauuaaguauugauuuguguguguguguguguguguguguguguguguguguguaagcacgcacauauauaugcaacacguacccaaggaugccagaaggguguuagaugcccuggagccagagucuagguggugguggccaccugaugugagugccggggaaugggcuccagcccugaagagcaguguccacucugacccgcccugccauuuucccagcacuguuucuuuaguguaaagcagucaauguaaguuuaacauaguaaaugucugccuuucauuucucuuaagauaaagcaaucuccaguuaccuugaggcuuucagaucauccgcauaauccugccuugcuccagacaaccaauacaaggucugucuugaaagaugcugcgaagauucugagaggaguacaaaacaauaaaaaaguacuagaagaaaaccuggaagcuaucguucgugcaaaggauggagcugcuauguauucauuuaucaaugcuuuagcuaccaauaggugaggcaggaugugggugucagauccuauuaaugaaguugcuagauuugcuuacuuacuuucuuuuuuaaagauucauuuauguguaagaguguuuugccuacauguuuguguguguaccacgugugugccuaguacccauggaguucagagaugagccccaggaucuggagucaggggugguugugagugcuagcacggaguacucucaccccccuccccccaccccccccccucgggccaaucucuuuucuaagcacucacugugcuuauugcauuuguuuguuuguuuuuuugguuuuucgagacaaaguuucucuguauagcccuggcuguccuggaacucacuuuguagaccaggcuggccucgaacucagaaauccgccugccucugccucccgagugcugggauuaaaggcgugcaccaccacugcuuauugcguuugcauauuuggccucugaagaugugggacugguguggacagacauggagguccuguguuuuacugacugcaguuucccauuucguuucccuccuccaguucuucacagacacuuuccuuguaacauuuaaugaguacaaucacuuuuuguuuucucaggaggggcauugguuacaaguagcuuuaaaacuagacuauauuuaacggauccugguccuauucucaguauauuaaggcuaauuuaagaacauuuccuuuuuucucuuuuguagagagaugucagagaaaauuaggaucagaaagcagguagaugaauggauuaaaaucauuucagcagaaauccagguauguuauagaaaaaguggaaauuaagucaguucucagaauauagcauaaaauccaguuuacugauugcccuuucuuucuuucuuucuuucuuucuuucuuucuuucuuucuuucuuucuuucuuuuaaaaagauuuauuuaaguacacuguagcugucuucagacacucuagaagagggcgucggaucuaguuacagaugguugugagccaccaugugguuguugggauuugaacucaggaccuucggaagagcagucagugcucuuaacugcugagccaugucaccagcccccucccugccuuuucuuuuuaaugugucuauuuuauuuaguaaacucuaaacagaaaacggaauucuaccugcaaagguguuuuaagccagcagacuggggaccaucgauucacuuaggcaaacaccaacauuccucacucaugggacagucaguuccggggaugggaaaucuuucuuacauccaugacgagugcagcauaucuucagacagacaucagaucuuacguuuuguguguuugaagguauagagcuaggcaaggucacgguuacuuuugucuuggagugcaaggcaguugcuuuccuccagugugcucacauauuuacucaugucaauagcaagggaagugucggcucggcuuccacagccaugagcacaaaaagugauucagcauuguuacacacacgcacacgcacauauauaaugcauuuguaaggaauuuauacuagucacugcauaacuuaccaaauaaaaagaugaagugaccugucgcuguaugccagugagcagaguaugucuucaucacuguuaauuccauguaaauaugcuuauuuaaauauucaaauaauguaaguuugcauaugucagcucaguuuccuuaugaacuaugugcuuauuuaaguuuguuccucuaccguagcuaacugcugggauucgggcaccugaaggcaggaaccgugugaugguuuccucccacgcugccgccgccucugggugcucguaacgcgcuaggacuuuaguuuuaggauugcuuuguucgcuucugguuaugagccaggaucucucugugcagcccaugcugcccuccagcuggagcuuucccuggcuccuauggucaggaguugcaggcaugcacugcuccgccuccagcccugaguucaggaguugcaggcaugcacugcuccgccuccagcccuuuaguuuuuuguuuccagaaaguauuuuuuucauguauaagcuaauauucuuuauuuuuaaagcauuuugaagaacuaaacaauauaguaaauaaauuccaauauuuguuaguguugaaagcauuaugauuuguuuuggcuuaaguaauuuuaauuuucuuugccuuaggaugaacuuaugagaaaagauuaugaacaaaagagauuugauccaaagaaucaaagaaacaagaaagcucuaacuaugaguagagauauuaaagccaauaaccaagaaaaaacggugaacagaucuguaauuccaagaagccauuaucaaaagcaaacccaggagcaguuuacaaguccaccugugaggaacuugccugccuccggcccgcagaaagagaggaguguaaggaacgcgccugccucaggcccucagaaagagagggacgaagggagagccucucccaccuuguguuuagaugccacaguguaucacuuccuaaaagauagaaauaaugaaacuaugaagagcuguacaaaccuagacuagauuuacaccaucaacuguauaagauuuuggaccuguaguaguguagagaccuacauaaaaucuguacuugccuccuccgaaggccucuuaguguguuuuuguucuuuuauuuuuggcuuuugguugcucaggagacagauucucauauuuucccaggcuaaccucaaaccuagcaguuuucccaccguauccuuuaaggaagcugggaagcuagaccaggcacagcagcaugccugacuuagagcuaaagcugugaaucacaguauguguacuauguauguccaaagccacgcuucucagccugugggcugagacaauucauagcagcaaaauuacaguuaugaagucgcaacaaaauaaauuuauguuuaggggucaccacgagaugaggagcugucuuaaaggucacaguguuaggacagcugagaaccacuggccuagagauuaucgacugucuguuauuagucagauucauuuuacugaaaagcauguuccaucuuuuuguguauguucuguuuuagaccuaaaaauuacauuuaaugccuaaugaguuguagacacaguacuggguauuuggagggauuuucuuuaccauucuaacccagcauuaauguuuuuaaggccaaguaagcauggauuaucaagcaaagaaauguuuaauuuaaugcuugucucuagugcuugauaaaugcuuccuuucugugacauuuugagauuuacuuauuuauuuauuuauccacuuuuuuuucugcauauaugucugcacaccagaagagggcaucggaucccauaggacuacaguuauagaugguugugagcugccaugugguugcuggaaauugaacucaauaccucuggaagagcagccaguguucuuuuuuuuuuuaauuuauuuauuuauuuuauguauaugaguacacacuuuaguuguacagaugguugugagccuucaugugauuguugggaauugaacuuaggaccucugcuugcucuaguuaaccccacuugcuccggccaaagauuuauuuauuaguauaaguucacuguagcugucuucaaacgcaccagaagaggguaucagaucucauuaugggugguugugagccaccaugugguugcugggauuugaaaucaguaccuuuggaagagcagucggugcucuuacccacugaaccaucucaccagcccgcagccaauguucuuaaucacugagccaucucuccaauccauuucucuggcauuuugauugaaaguggagccuggaguauauaaagucauuuaaagacuguuuauuguauuuaaacauaauaauuauguaaaauguauuuaaacauuacuuuaggaacugagaauauucauaguaauguaagaccuuuuauguuuccuagguggaagauuuuaauauuuuacaguaauuguaacauguuuugcauugguagggccucuugaagucagccacaacguugcaagacgaggauuauauguuacagauauaugggaagccaguuuaucagggccaccgcagcacucuuaagaaaggaccguaucucagauucaguucuccgucuccuaaggccaagccacagaggccaagggugauagagcuagugaaagguaaggaaguucagugccugucacugcuccauuuacagagaggcuuagugcauagcauggcuuuauguuuguuaucugugcgcagcacucagugucugaugaggagcgggaggaagaagagcagagcuucaguaccguuaucugccagggaacaguguuugugggcauuuuugugguuugcuaccaaaaagucuucgccaauaaaaaugaucgauuuuuuuguuggcuuuuaauuaaauaagaacauuuuauuauuauguguuuugacucaggccagccauuucuuugauauauuugaauaugacuuaguuaaauaauaagucuguuaauuuugguuacauuuuuaauuuuuuuguccuucuuugaaguuaguaagcuucacuaacagguaguuagcagauaccaagucucugaaguuaguaagcuaacuagcagguaacugguggauaccaagucucugaaguuaguaagcuaacuaacagguagcugguggauaccaagucucugaaguuaguaagcuaacuagcagguagcugguggauaccaagucucugaaguuaguaagcuaacuagcagguagcugguggauaccaagccacuuccuuuccuccuagagguggagcuguggcaggcaguugcucagacccccuuccuuuauaaaugcuggcugaucaggcuggugauccacuuaccuguaaauccuacagauacuauuauaaaggcaugcaaauuaugauguuugcccuaauauuuuucuuaaauacuggagauuuauuguuaaaauuguauuuggagauuugaaagccuuuccaaaacaacaacuuuacaacacugucagauccccaauaaaccuuuuaagguaacagucagugagagccagugggcccuucauccccaagccugguaccugcgguuucuccccucugugggagagaagaaguccuucuucucuagagacacagauaagacagacuugaaguucucuucugcuuacuuguuaauuugguuuuuguuguuguuguuuugucuuuuuuuuuugaaaccagaucuguuuuuguaguccuggcuguccugacacuaaauauguagaucacucuguccuugaacucacagauuugccugucucuggcucccaagugcugaacuuaaaugguguguaccccaaauucuggcugguuuuuuuuuuaagauuuauuuuuauuuuuauuuucauuuaugcaugugugugcccauggaagccagcagaggacaucuggucccuuggagcuggaacugugggugguuggguugugagugcugggaaucaaacucagguccucuggaagagcagcagucacugucagccaccgggucaucuuuucaacccucaauuuuguuuuucuaaagaaaggacuuucuguaguguaccccuggcuggccucaggcuuacagcagucuuccugccucugccuccuuccgcugggccauuaugccugacaaacuuuuaagauuuugauaauuuagaguauaaugucuauauggaucuacauaaaacagauuaaaaaauauauacuaacuuccauaaauucuaaguaaguauauagaauuagauuaauugugcauacuuucaaaggauaagggcugauuauucagaauauagaacaagcaaagguauaaugagagaauugggggaaauccuguucuaaaauaugaccuuuaacuuucuuguauugugaaggauaguuggugaguuuagagagauguucuucaacauuuuucuuauaucagaguagcucuguacaaguguaucagggacagacagcugugguuuacaggugagcugcuggguuuuuuuccuuucuccuucaucuuccucuuccuccuccuccuccucuuuucuuuuuuucccccuugggcaaaguuucuuuaugugucccuggcugcccuggaacuugcuccauagaccaggcuggucucaaacucagagguccuccugccucuacuuccugagugcugggauuuaaggcgugcgccaccagcaccuuagcugcuggcuuuuguuuuuguuuuguuuuuuuguuuuuguuuauuugguuuuucgagacaggguuucucuguauagcccuggcuguccuggaacucacuuuguagaccaggcuggccucgaauucagaaauccacccugccucugccuccugagugcuggguucaaaggcgugugucaccacgcccagccuuagcugcuguuuuaaugaguaaauuuuuauugacuauagccagguucauuuacuguucauggcugcuuucaugauugucaccagaguugaacaguugcaccugagauuacauggucuaaguuagaccaaaguaauuccugucuggccaaccucugaucuacguaguacuucugcuugagacccuauauuaaauuggaugaaaucuuacugggaaaaacaauuguauuucuagguggcuagcuaauagaucguuguugaauuuuaaauuucugccaaugauuauuauuauaggcacuaaagucaagucagcaaaaacacaaacugacuuucaugcugcaucacguaugaaaauggauucuaaaauacagcaucccaucaccgcacuaccucaugcugaucagcaguauauggucagcccaagcagagaaaugccuacuguuucagguacccuggaaggucaucuaauuccuauggcaauccucuuagguaagacacaaugaauauguggcuguagggaagggggagggguccauugcuugugaucaguagcaggaguuauaacggucaccuacuuucuuaugucuggagagagcuucagaauguagguuaugcaggguaacagugaucucuuaaacagugaguucuugccauaaucucauuuauaggaaauauucucuugguguauugcuauagaugacaugauugacaugccauugaccuacauaauaauugaagaagucaaguuuguuugaauauugucaugcaugaggagagauacuuugaagcacuguuauguacuuuuaaaccagguugugauaaguaaaagcuagaugaccauauauauacuaggggaaauggucgcuuauuuccuauaugagagcucuaagggucauauuaaaaauuggacagcucugcagguaugaaaucacauaccuagcaucccuuuccucagaagcacaaggcaggaaaaccacaugacuggaugcuaggaacagacccgcaggcucucuguaagaacagcaggugcucuuaaccgcugagccaccccuucaucccugaguacauaaaaacguuauauuuuuauuuguguguuugugugugugccugugugaguuuaugugcaccacguguguucagguacucaugaaggccacugggcauucgguucccugaaacuggacuuuuguagguaggcaagccaccugauguggguucuaggaacugaacucugguucucuagaagagcagcaagugcucugaaguucugagccaucccuccaguccauauauauggaaauacaaauuaaacuacuuggagauacauuguauauauaauauauauacauaguauauauacauauacauauguucacacacacacacauauggaugaguguauaugugugugugugugugugugugugugcccaaaguaguuuuaguuuuuauuucagugauggcuagacauauggagugcuuugaaaaacaugaucaucucucucucucuauuucuuucuuucuuucuuucuuucuuucuuucuuucuuucuuucuuucuuucuuucuaacuuuauucaguuauuuuucuauuuguuaacuagcaguuuuauuuccuugguauuuaacuucugcagcucuugguaaauucugaauaucaguucagcccuuugucugagguguagcugguacagaugaugucccgggccgugggccgccugugcucugcugaccguuuccuuugcugagcagaaacuugacuuuccuguagaccaugugcuggugcuuggggcuaguuucugugcgguugguccucuacugaaaaaguucuguugggggcuggagaacucagugguuaagaccacuagguugcucuucuagaggacccagguucaauuccuagcacccacauggcaucuuacaacugucuaacuccagucccagaggauccaaucccucacacaugcaggcaaaacacuaaugcacauuuuuuaaaaaagagaugcauuuuccucagugucuugaauuguaucuucucuguguuuuuuuccuccuccuccuccuccuccuccuccuccuccuccuccuccuccuccuccuccuucuucuucuucuucuucuagaaguugcaguguuucagguuuuaaagucuuugauccauuugaaauugauuuuuuuaugaagugaaaauuacaaaucuaauuucauucuucugcauucugcauucuucugcuguagaaacacagcuuugccagaacuguuuguugaacaggcuguccuuuuccacauacauuuuugcuuccuccuuugucaaaaauuaagugagcauagccaucuuauuuuuggguccucucucccauuucauugguuuaccugucuauuuuuaugcuaggaucaaucaggcugucucuaucacuaugucucuauaguauaauuugagauuggacaaucuauaguaauaucuccauaguguucuuacuccauaggauugcuuugucuauucaugaucuuuuguaguuacaaaugaauucuuguauugucuucucucaaccugugaaauaugacacuggaauuuggguagguauugccuuaaaucugaaaugaauuuugguagaauagucauuuuuacaauauuaguuuugccaauccaagagcacaggauaucuuucuaucaucagcaucuucuauaauuaccuuuuuaauaucuugaaguuuuuuuguuguagaagccuuuucacuuugguuaaauauauuccucaacacauaauguuuuggaguuauuuugagugaaauauuuuuccugauuucuuucucugggaguauauuguuaguauaaaugaagacuacuaugucugucugucugucugugagacagggucucauacuagacgauguugaccuugagucaccauguagccuaggcaucugagugcuggaguuaagggcuugugcuguguccuugcacagccucagggacuugggccugacuggcccagcaagagaaugaagagaagacaggcagagggcauauacagaaaagcugggauccagugggcugggcugugaugcagagaccucuacaccuaggaggcucccuguuuauuacauacaguugaacuaagaggcugggguuacugaauagaccucaauaaagaggaaggguuaguacauacagagaaacaaggagacagguuuaguuaaucuugauuuguuccaucccuguaguggaggauacacccaggggacaugggaggagagagcuaugguggauauuuucuccacaaacugucugcauuuccacuuggaggaggagaacagcccuugaccuuuccucagccuugccaggggaaggcuuugccguuuucccaugaggcugaggcuuugagguccuugaaaugacugucccucugggccacuauguccagcuccuuagucuuuacuucaaaauauaaaaaacaagcagaacuuuugaaaugagaccugacaguauagaguaugcucuaauaggcagauacuaaccuuuauuuuaagcauuaagauagcguaugugaagucggaauugcauacaaauaaugaagagacugacauggugggcacauguguagaccgugguggugaggagcgaggaaauugcaagaugccucuuuccuuuugugagcaagaccagucacaaagauccaggcagucaauuugauuuuuccuuuuauguuagaaacagcugacucauucugugcccuacauuucauaggacaaacccaaagcaauagugacuccaugccaccugcuggagucacuguaaacaagccacgccccgugacugugaccacuucuauuccuccggcaucucgaaaagggaacgcuggagucaagaaacccaacguagccauuguagagaugaaaucagagaagaaggacccuccccagcucucuguacagguaugccagggugcacgagcagacccaacagagcgcggaaacccauuuacgccaugagaacccacaguucauugcuuaacuuuaugaagaccuugcuuucacugcuuuauuggugugaccuggugguaauguggugucgcuaugcuugcucugcaguguuuacccuccuaagucaguguccauaucacagagcggggaaugggugaacaaugcgcuauaauuaacuuuuaaaaagaagguauguggggcuggagagauggcucagcgguuaagggcacuggcugcucuuccagagguccuaaguucaauuuccagcaaccacaugguggcucacaaccaucuguaaugggauucaaugcccucuucuggcaugcauauguguguacagacagagcauucauauaccauaacaacaaacaaacaaacaaacaaacagacaaguagaugauacauaccuguagucuaagcacccagaaaguagccauaggaagauugccacagguucaaggucagccugguccaucuagcagguuucuagccagcucguuagggcuacacagagagucacugccucaauaauaaauaagugaauaaauaaaccaaaacauacaauaaaagaagcaauaguuaauggaaggugugacuaauauagucauuauuucaaacuuuauccaaucauaggacaugaaugaauguagaaagaacccauuuuuauacacaaaaacuauucaaguuuaugcucuuuccaauuuaaugugcaauuuuagugaaaugcuauuuguuagaaauaaacaugagauuuuuuuucuugaacuuuaggguaauuuugauaucuggaagaauaaaggguuuagaaaagaguuuuguuaugagcugggcauuuggcuuauuugagccaacauuggagagguagagguugaaaggucaggaguucaaggucauccuuaaccccaggucagguucagggccaagcagcauagguuaugagacaccacgcugguuacuagaccagugcagugggauuucagaaucagcuuuauuauucagaaagaauguauacaugguagagauuuguuauaaggaaaaaaauguguguuguauuugucuuaaugacauaagaaaagauuaguuuuaugcuucaaguuuuucuguguagcaaaugagcuccaaauuggcuaguugaaauuauaaaaaacaaaaccauaaaaauuugaacauaauuucauugacuuuuauuaaaacugaagcaaauucuggauuuuggggaagauacuuuaaauacaguaaauaaaggaaaggaggguugcaucuaaaaucuaaagguucuguaugucaaagaaccuuacaaaggaaggggggcuucagugagaauaaaugaaagcaagagcccaggaaaggauuuguuuuuaaauacaaagacaucuuuaugccauaagaaaacauagaucuaaguccagauuuuguccagguacaugagugagauucuacaggaggguuaaaaguauauuuaaaaauaaggaaauuagauguaaguuuuccuuguagcuaagauaauaaaauuuuuuaaaaggauaauauauucccauguaauuauugcuauuauaaaacugcucauuuuaguugaugguuggauaaaacuuagaauuauguuuuuugaugauguaaacagaaauuggauaggauuuuaccaguaauuacaaagaguauugaauauucaugcucugugggcccagaaguucaucaaaaucuaucuaauaugcuauaguaacucaaggcuugagaagaaaacccugcauauaugaagauacugggaucuaggugugacaguggggacacuggcagugaggaauggcugaauaaggaauggaaaauccuuuaauauuacccaguuauguaaaaguauaacgucugcagagaaacaggauaugacuagguaauaauggcgcccccuuaauccuagagcuugggaggcagagacaggcagaucucugugaguuugaagcuagccuggacgauagaaugaguuucaggguaaccaaggccacacagagaagccccgucucaaaugaucaaaacauaaauaaaauaaaauaaaauaaaauaaaauaaaaugaaggaggaggagaaugaggagguauuaugaccuaaaaacaaugaaaacucaggguugagaacacuuuaacuugcuuaaacgggugggaaacagagacgaguauaggucauggaagugaaguuaucuuaagauagaauuuuaucaguuuuuuuuuuccuuuaaaugcuuaguauaauaugcuuucauaauucaaaguaucuguuuaugacaauaaaaauaugaagggcauauuuuguugucuguuuuugauaguuacuuaagucauagugguaaacagcaagccagauguucuguucuguucuguuguagauauuaccuaguguggauauugauagcguuucauacagcaguacugacggggcuuccucuccaccaagucccaaagaagccucucuuccuccacugcacaccuggauccagguagguuucagaguucuuucauagcauuaacuauuacuccaugcagagcucuuaucauaucauaauguauuauaguggaugcaguagcucauacuuugaagccuaguacuugagaggcaaaaggcagucagacuucugugaguuugaggccagccuguucuacagaguuacagccauagcuauguaugucauaauauguaacaauaauuucagcauaugguaaaaucgaaaugaggguuacauuguuuacaaauuucuaaagacguugcuuugagaucuuuauaaauauucaggacauggcaauuuuuggaguaacaugguaauugugagacuuucacaggugaagaauuucugugucuuugguaauauuugauuuauaugaaaauuauaaauuggaaugugaaauuuuuauacauuuacuuauugugugugucuguauauguguguacguguguaugugcgugugcaccugcacaugugugcaugccacaguccacauggggcaugaggucagaggacaacuaauggggagucuguuuuuccuuccagcacaugugaaaggguuagacucagguugucuggcuuggcugcaaguguuuuuacccauccagaguuaggauuauaauacugauaaguaguauauauuuugucacauuguuaacauauaaaaauauacauuuucuuguauuaauuugcuucugaauaaugauaauaugacuuuuauuacaguaaaauagcacuguaacauaucucugguaucuaauauaucaaauugaucauggaguucauaguucuuaagaauaaaaaacaauugcuggacaugaugucagaauaaggcaaaugucugugaaucugaggucagcaacauaagggcuacaugaugagaccucagcucagaaugaaaacaagcaaaccagaaaccaaagucaugaaucagucgggcacaguucucacaccuuuaaucccagcauguaggaggcagagauaggaagauuucugugaguuugagccagccuggucugacacagucagaucugucaaaggggagcagggcugaccgagcucauaaagcuuucaugauucugagcacuguguuagaauugauccuaaguggaauucauacccacucgaacuaguuaacuguuuauaaguaauuuuguuuuucuuaggaguuuauuggaacauguaugauaacaaaaauauauuuugaauuauguauaauuguucucagcaagaagaggugccccuuccaggaacuaacuuugaugccauuuuuaguaauuagaguuuauauaguaaggccuagauagugaacuugaauauaauuugacuuuuauuaagauuuuuaaaagacuuauucauuucuuaaaauuaugugggggccugugugcggcuuuauaugcaucaggcccaugcaggugcccauauaagccagagggcacuggauucccuuaaacuggaguuacggcaguugugucugccuggugugggcauagugaaccaaacugucucugagagcaacaagugcuuguaaccugagagacaucacuccagucugucucuuuuuaacuuaaaauaaaacuuuuauuuggggaguguguguguguguguguaaugcaugugcaugggugugugaauguagaggucagaagacaacuuucaggaguucuuuccuaacgugugguucucagaaucacacugggucaucuggcuuguugacaaauauaagccagguaaagccaucuugugagcccugguuuucuuuacuuuuaaaaugaucggaaucuguuucugucuuuugugagucagugaauguauauacuuacagagcuacauguggaaguguuuccuucaggguguaaaacuagccuguugauaguucuuuacauuucucacugcaguccggaguuagggcucaguggguaagagcacuugcgccuaaggcuuagcaccugagcuuaaucccuaagacccacaugauaccaggagaaagcugaccuguauuagccuuugacccuccacacggacgcuuugaugccgcuguggauacacaaaauaaaauaaagaaauguaagcuucuucgcaguuguguuuguugcuguagauuaaaugucagacugguauuguguuugucucucacuguggcccagacuaucuuagaacucagagcagcccuuuuagcuuuaaacuuccaggacuuuuccugccccaggcuccugaguucaggaauuaggagguaugaaacauauuacccugauaauuuaaaaaagauauuuuuauugaaaauaauuuuuggcuaggugguggagggcguaugucuccaauccuagcacucaggaagcagaggcaggcaaaucucucugaguucuaaaccagccuugucuacagagcaagucccaaaacagccaggguuauacagagaauccccguguugaaaaaccaaagcagcaacaauaacaacaacaacaauuacauacauauauauauauauaaauuuuuaucauuuuugaaaugacgagauaauagauugaggacugaccuguaucucauuuacuaauuaaaucacuucugaacagaauauuaaaguagcagggcuauauuaagauuauaguguaugggaaaauauaagaaauuauauguuuuaaaauugaaggcaguaaaacuuucugaaauguuuccuuagacuccagacuuuaugaagguggaugaagaagaggugccccuuccaggaacuaacuuugaugaaguaaucgauguuauucagguaacaaagcuuagagacauagaaagucauuuccuuacaaagacuuuuccaggugguugaauggauuuugacuauuacaacuaaguuugagaaacaugacuuuacuuugauuuaaauagacuuuaaaauuuaaauaugcuuauuuaaauuucuuuuaaagguuaugaaguuuguuaauuguuuuucuucccuguagugucguguuuuugucauaaacuuaaugcuagcccacugucucccaccuggaacacgccuguugcugccaucucuccagcuucccuuccuccaguccaaucuauuacauuuaacucuugauuuccagaggcaaaguuagguuuguaucggggaaaaguuaugaauagucagaaguccaagggaaauccuguauggaugucaguuaugaaaaggcaggaaagaaaggcaggaaacauaaaccacaugaaaaauggagacacauacgagauuauuuuaauguuaugaacaagacauucagcauuagcgaaaauacuucucacauuucuuugacuuuguuaugaaaacugagggacuggagagauggcucagcacugaauagggauugaggcucugagaggaccugaggucaguucccagcacccacguggugaccccagugcagaggauccaacuucuucugaccucucaugcugaacacaugcuuacacucucucucucucucucucucucucucucucucucucacacacacacacacacacacacacacacacacucacacacacagaauuagcacauacuugaaauaaaauguaauccuuagaccaugcagagguaggcacugucuuuguguuggagaugcguuucccuaugugagugcugugcaguguuuugaggcuaggcuccuucuuugucuucauagcccuaaugcugcugcuguuuaauagaguuggaguucaaguggaaggagcgacuacagaacucacaguggauuuggggcugagugacaagggucucuucuauuccucacaggauauugaugagcugugauauuuaaagagacuagauaauuuugaggugcuuauuuaauuauagauaaauuuauaucuguaauuuaggucacaaugauuaugaaagagaaaauggaugguggauaacuuagguggcaaaguugaccaugaguugauaauuguugaagcuggggacuagguacaugcaagucauuuauauaaaaucuguaguaccuaagcauuacuuuauuuauuuuuaaacauguaacauuuuccauaaggaaaaguaaaaaaaaaaaaaaaaaaccagagcaauuacuuugggaugugauaugaugaugaaaguuauguguaagauaaacuaaauguaaauugcagguucugacagggugaacaaauguuugggauuauuggggguggugguuugugagcucauaaaauuuuggauauuucauaagguucaaugcuccccagguguucuagcuucaugaugauacaaaauuuauauauauauauauauuuuaauguuuugugucuggugaugugaaaucaaacucaggguagacgaguguucuaccauugaaccauacccagagccugaacacugaguuuaaaaaggacagauuaugaaaaauacauguucuccaguguugucuaacucaugucuguguugggacaaguguaauauguacggcauauuuaaugucauacuaccuaaggaaaaggguuauuggcugguuugugaauguugguuaauucauacagcugaguucuuugucuaugcuugccacaugaacagauacuugaagauaaucguuuuguuuucauuguguuaccaggaagaagaaaaacgugaugaaauuccugaaugcucugcaccaauguuggaguuuaacagaaguguuaaaguuguuccuacaaaauauaaugguccuucauuuccuccuguaguuucugcuuaccaucccacuacugauauuuuagauaaaguaauugagagaaaagaaacauuggaaaauaguuuaauucagugguaaguuuauaauucuauuggugugaauaaaaucagaagggcagauaaaaauggaaauagcuuagaagaauauucagugagagugaaagguaguauccugagguauaaguacagccagagacacaguauacgcuuagcuuugaaaaccuuaagauaaguuuguguugaacagauguuggaaauauaugucaauuaaguuuguguugaacagauauuggaaauauaugucaaguaauuaacuacuuaccuuugaaucuaggauuaugagugaauugaauccugugaauuaaaaaaauaauaauuuucugauuuucccacaguaaaaacuuaccauuucuaugacaguaauuuuugauaugacuauccgcuacucuaaagaaaugcauugaacgaggcuucuacucuacucuuugcuuuucuuuuccucuuccaaacagugacuuaugaaauacauuuuucuuuacuuuucgaggaaaaaauuuacccugcuuagcaguuugaguguuuaugauuuuauugagaggagagcaggagacucuagucuuuaaaaaaaauuuuaaaucaaguugcaucacuuuaauaaacucacaacuaaagcggcggauggcuaguuuaaggaugcuguuuaagcacuugccuagucccagacuccgcucagugacugucauuggagcuuuggucugaucuguuagcuaugugugcuccgagugagaagcagcccgcucacccgagugagaagcccacucacagcugucaacacaaacggugugcuuaccuagggugagugcagggagcuuucugucaggccgaagagcucaagguugauuucauugucugccucccaaaaggacaguuucguccuuuuggaaaggagacaaguucucuuccuuccagcuguaaguuccagaaggcugcuuuugcauguucaucuaugaguacagcuuauucuuuaaagugauauagcaaacauuuuauacuuuuaaccaaauucagguguauuuaacuuuauacuucuaggguagaacaagaaauaaugucaagaauuaucucugggcucuuuccacuccagcaacaggccagacuugaugccagugucucaguaagugaggcgagcgaaccgucagcuucugacauugguacgucagagggaaccuguugccacuuaguuacugaggauuucuguauccuuggcugucucacuuucugcuccucugcagaugagauuaguauuccuuucccucuguuuuuacagauugcagcuuugggguugcugacccauucucuaggauucuauuguuccuccacagaaaaaugucugugucuguguauaaauuauauaaaauauauuauguaauauacauacauauguguuauuguggaggaacaauagaauauuguaugcaugcaugccccggucagagacaacgugggcuccaggagcuccucaggucaucagcugggugccuuuacccacuaaaacagcuuucugccaccuccuuuuauuuuucuuuugcugcaaccuaauauuuagcaaaggggacuuuauacaggaaagauuuauuuuaugugaugguuugagagaauagcaguucauugugguaggaaacacaugccagucagagugugcuguggcuggcuguuuccucacugagaaagcuugggaccagugagagugugcuguggccggccacauugucacucagaaagcacaggaguauaauauaguuggacacauugcauccuuagaaagcuaggagacauaacugacucauauuuaacucuuuucucuuuugaguaaaguccagagcccuaguacaagagauggugccagccacauaggggugggucuuuuccuccuaguuaaaucucucuagaaauguucucacagaauguccagaggugugucucuagucgauuccaaaguccauuuaucaucagcacacauuuauaauagguaucaauauaguacgguugucugacacgucuuucuuacucacuagacuaugcauuauucaguagucaggaugcugcugcuuuugcccagcccuugaggguuuaaguucucucugagugguuaaacgagccauuccucuuuccuucuucuuccuggugauuuccagccuuuuaauucuuuaacuauuguguacuaaaaacuucauucuuuucacuguucugugcaucauuaugugcuaaaaacuuaacucuuuauuacuguuuugugcuucauguaagugcuggggaaaguuuuucucucuuauuauuuauaauucucuguugcuugaauaagcagugguaaacuuaacucuuacauuauaaacuuacaguauauucucuggcaguuuacauaucauguacagcaacagggaauucaguagaggauuugcuaaggcuccuuuccuuucucucuugccuagaaaccuugucuguugcuggccagacaagaaggaagcguggaacaguuaacuuuuagugaaccaggaaaagaaagucaugcucacagauagaaaaaccuuuacacaaaccaauaugcauagacacacacauucuuauacacauucaccuuuuguugggcacaaccaucucaucaacuuacauacacacacaucuuccuucaaaugcguauuuguauuugguggcuagaacaaaaguccccaugagcagguuucauugagcaggcgccagugcagaaaaaacacacucauucuggaugaaaaauacacuucaaucuuuauugauuagagaaagaaaaaacaacuuuuuuauuguuuauaaaaaagcccuguucuugugaguaagaagaaacuggcugucucauggugagaagaagccugccugcuccugcuguguugugcugugcacugcucagcucugcuucccuucugcuccugcucuuauuguuaucguuccugguucuuguacuuuuucaaggcacaugaucacaugguauucuaagcaucuuuuuucaaaguucacgacaaguucaaucauaaguucaaauugaaaauugaauaagaaguaucucgccgggcagugguggcgcacgccuuugaucccagcucgggaggcagaggcagaggcaggcagauuucuaaguucaaggccagccugguccacagagugaaucccaggacagccaggacuacauagagaaacccugucucaaaaaaacaaaacaacaaagcaacaacaacaaaaagacuaguugucuuauuuagcauucauuaucugccacuagcuccacagguuuauuaagaauuuaaaaugauaauuccuaugucaaaguuagcacaguuuugucaagaagcaaaucaucugccuaggagcucauuaguuggaguuuuguauagaucaauccagucaauguuuuaucuucugucuuugcaccuacaauaaaucguucacucucaguucaugaccuuuaguuaucagguaacgguuuuacauucagccuagaaggaagguuuucccuggucauaaaucugguucaagccuguguucuauccuagugcaaugagcccaugacaggugaagauuuacacaacccuaauugcagcuuuccuauuacagagggcucuauagaauacuacaggaauucuauagaauaauuauaaaaucaucaauuuauagcauuguuacagaagaguauaucuuuguugaucugcagaaaauuuacccaauacagugggcuaaugcccaggaauuguuuuuuuuuuuuuuuuuguuuuuuuuuuuuuuuuugagacaggguuucucuguguagcccuggcuguccugggauucacucuguagaccaggcuggccucgaacucagaaauccaccugccucugccucccaauucugggauuaaaggcgugcgccaccaccgcccgacuaggaauuguuauauuaauuuaauaaugacaggaaaucauuuuuaaaauaaucagcaauaagagucaauccuugcaacucagaauuaucuaucacagccacucaaaaugaugugucaucuccagauugucacuuguauccuuuagccuuuccuagauggcuccuaacauggggagcuugugccugcuucucuuucucauuuggcauccagucuggcuugaaucuguauagccccugugcaugucaccacagucucugaguucaugugugucaguccuguugugucuugacacaguuuucuuagugucaccauccucuggcucuuccaaucuucccaccuccuauucugcacaagccccugagccuugagaggcaaggguugauggagacagaguuccaacgucucucacucucuccauauugucuagucuaggucuuuguguuagugaauguuggcuuuaaagccuuugauaggcaugcuauaauucauauaacauaaccacagagguuaggaauggacaaaggggcuauggcagaggggaggaucucccaaggaaggggaaauaaaaaacacuguggagguguguguugggguggggugggugggagggagggcaggagggagggcaggaggguacugaagcaggaaaauuaaacaggaauggggagggaaagggaguuuaagggagggccaacuaauacuaaggaccauuugagggaucauauggaaaugaauuaauacuucuguagaaauacauauacauacauacauguauauauguguguguguuuguguguguguguaucugucugucuguguauacauguauacuacgguaugcucugguuaucagaggacaacuugaaggaguuggcuugcuccuuccacugugguuccagggggcugaacucagguagucaggcauggcagcaagcauuuuuuaccucuuaaucaucuugccuauccuagugcaauauuuugccaaucauguucuugcuuaaguuaguauuauuugcuggauauaucauaauuuguuaauccaguuaccagaugguugauauuuccugucuuuuaguuuaggucuaugguaaaacugauaagaauacuugcugacaauuuuuuguuuggaaugcagcuuuuaauuuauccuagucaugugauaaauaaaugguuauuaggacuugcuaagcaucuugcaaauggugguaccaugauaucccaagcaguacugugguucuuauuugccuguugagaggaauaugcugaguagugauggcuagccggaucuaauugcgauauaaaggcuuucuuuaucugugcaugcgugcgugccuguuugugucugugugucuguguguguucccaggaacugaacccaggacccuugcccaggcuaggcuagaacucuaccauucaacgacuccuucaacacucauaguauguuuugagguauauuuuauaugcaauauaaaaugagaauguaaaacgcucuucauuuuuucuuuauucuuucuccuuuugcauauggauuucagauuucuguaguauucuuuaaaagauuauccugucuccauugaauuaucuuaauauuuuuauugaaaacuaauuggccgggcuggugagauggcucaguggguaagagcacccaacuguucuuccgaagguccagaguucaaaucccagcaaccacaugguggcucacagccaucuguaacaagaucugacgcccucuucuggagugucugaagacagcuacaguguacuuacauauaguaaauaaauaaaucuuuuaaaaaaaaaaaaaaaagaaaacuaguuggccauaaaucuguagauguuucuguucuuccuuuuuuauuuaauuuuuuaaauguguguguauguuugccugcauuguuuuaugugcaccacauauguccuuuuuaaaaaauacuucuucuuccugucuuuccacucuugggauagccuguuguccuuuacagccugacuuuuacuucccaaguccugcaguagaagcuucaggaggcucagcaugcgacgucaccgaccaguguccuugagcuagagggagggagagcuugccucuugcuuaauguauccuuguguuuuggucagaaguagaaauaggauuguugggggggguaugggggacuuuugguauagcacuggaaauguaaaugagcuaaauaccuaauaaaaaaauggaaaaaaaaaaaaaaagaaauaggauuguuuccagcugaggaaauuugguauauauguaauaguuuucauugacuucuguguggugaggaaggaggcauauuacaugaauuuuuacuuguguuuuuuuucucugccuugguuuguuagaaaggaugcuauuuaagcugcuaucugucuuucuuguggccaguagcuuugcuucgcuucucaguguucacgccuccuucacgaucacacauagcuaucagccuccuaagaucuuaagauguaagguguggcugcacccauguuucuuggcauuaucugaaguucuuguuuuuuaguugcaggaacaagcaguggagcgcuccagcguaugguugaugccagaguuccugugaacucggacauggucagccauuuugucaaugaagcucugacugagaccauugcugucauguuagcugacagagaagcagagaggcaaagggcugcugccacaaguguuccuggugaucuuucaggaacugaaacuaaccuguugguaggagugacuuuccguucccuugugaccuaaggguuguggagaauaucuuagauauucucugugugugugugugugugugugugugugugucugucuuuccaucuauguuugcuugagacagucucacccuauaguccaagcugucucuguagcucaggguggucucaagcucaagauaaccuucccacuucaguaucuauguaaaaaugccacuauucuauguagaagcuagcacaucuacauacaagaagguauuuuaaacuuaauguuuuaagagcauagauugugauagaauuccuuggugauguaauuaacauucccuaguuguuuauuauuauuauuauuauuauuauuauuauuauuauuauuauuauuauuauuuugagauuagcuuucuuguagccccaggcuggccuugaagucacugugcaccugaggguggccuugaacuggauaacuggauucaaguaugagcuaucauacucaauuuagcuuuuuccuuuuuuuuuuuuuuuuuuuuggagaaaauguaaaaucuacagaaaaguuacaaguguauuacagugaccagugaccauuuuuucccuguauuuacucucuguauuucacacugguggcaguugaacguuucuaaagucuaucucuauacaugcuauaugcuuaaaaaaauauuuuaagcauaugaguguuuugucuggauguuugucugucugcuucuugcaugcaguacccacacaagccagaagaaggcaucugaucuccuggaacagagagauaaguuuccaugugggugcuggaaauugaacccauguccucugaagcaacagccagugcgcuuaacugcuaagucaucucuccagcccuauauuauauucuuuuuaaaaaaaaguuugagaguugggaauaugugacucuaccucaaaagcauuagcagcauucccuaaagaaaucuuugugguuuacaggcucagaaauagcugcagaguuuuauaaaguugguaacagaguuaauuuuggauuuguaucauuccuacgauagauuagaaauucuauucaacauagugauggugaucacacaaacaauaauccaaguauauaaaauacauuuucucuuaaacuaguaaagaaggugucuguagacucuagauacuaaauaugugugugaccugaagguacaaaagauccucagugagaagaggaaagucagcggucucagcacagagugggaggaaggccgagugaggggauggagggccggaaugugagcaaagcaaaccguuuauguguacgaaguguccuagcccguuauuucuauagguuuacugaaaaugauuaauaaaaccagauuuuauagauauaagucuaauuuugauuuguauaauuugggaaggauagacaucuucaugaugcuaggucuucauccucauccuccucaucuucaucaucaucaucauauaguuucauggaugauuaaauagcucauacaacuuauagaacuuugugaauacucaguuccuaauaguuuaucauuguugguagucaguuaccagugcuugaaggauaccuccagaccucucaugaggaauaaggugggccauuuuauuugugcguguguguguguguguguguguguguguguguauaaacagauuuuuauguuguauguauauacagucaagaaguggaaaagauacaguauuuuuuuuuuuuugcgugagaguuugcuaccuguugagcaguguuccaggauuucuaauaaucuuucaugauuuuggaugauacuggucauguccggggaaguaugguuguagacucuugccaucaguuuaaguuagguaguaguuagcaacauggcauggaauauauaaaagcauuuuaaaguggauaauaauguucuuaaaaugaacgaaggaaaugacaagauuguucccucacagaaaagaaauacaaauugcccacauacccacaaaaggcccuggaacaguaggcauucuccuugccucugcugauaguguaggguagcccaguccuacaggggagcuccacagagucugcucagaaugacagcagugcuuucaggaguuaggccugagagcucacuccauugguaaaucuguguacaugugauugacuuagggcaggauuaccugauaacucugaggaaagaaacaagagagaaaggaaacaagacaguguuuuuauuguuauccuuuuaugucuuugaauuuuggaaccuuuugaauauggcucauuaauauuaagaugcuuccuucuuuucuuguuugcaccuggcucugauggucaccucccguacccucucuuuuuucuuacuugccauuacuuuuuacacggugugccuuuauucuuaacacccagucagucggucagccagccagccagccagucagucagccagucagcuucucuuuuguugccuggccaaccaugcagcccauugaguuuguaguugggguugaucuucaucucugucugauuaaucuuuuucucugauuuagaagacaauaauggauuucuuucagacaguuauuucaauugcccaagaguuuccuggggccagucuuauacuggcgacuaaauauuuaagccccagagcacgaaggcuuuucuuuuacugucacuuagaccaucgguuuaaguccugugugguguaggauugaguucauauuacuguuugauaucauuuuuguuuggguuauuauaaacguacguguucuguuucacuaauuugucucaggcaagaguuugugcuccaguagcgacgccgcagcccacuccccccugcucaccaucaccugugagggagcacgugcgagugaaaacgccagacucuucucccugugaauccgauccagaugcggcuucuucuauaaaagagauacgcguugaaaaagguggaaaccuuguuucuuuaaaaaaugugugugagagugugugugugccucuguacuucauggcacguguguggaggucaggggaaacuuggucaaguugcuucucuccauucacuuuaacagugcuugacuugcugaggcaucuugccugaaccuaaaacuuuuauuucuauaauucaguuuuauguuuaguaacuauaaguaguuuuuacuuaguagucuuuaguaaaugccuuuuuuuuccccaaggaagcuaaggaauugcuugucacuugacugcuuaugugcuguagcagauagcacacacuagguauuuuauaaguuaaauuaagaguucuuuuguuugaguuccagacugugaggucacacuaaggggcugccuuuggugacagccgccuugcuguaucaugaaugacaaaaggugucauauagcagcgagagagccagaggcucaggcugaggccucaccucucauggagcugcugaucccacgcaggacucugugccccggguggcucacaggggccucccucccacccuccgcagugcgacacaggguuaaggaugagguuccagcauaacccugcagggaggcguucacagaaaaguaguauuucugaaaauacggaguuuaguaacugcugaaacggcuuuaaauguauaguagucuuaaaaugccaucuuuucaagguuuuaauuuuuaugccuuuuuuaaaaaaauuuacuuaauuuuauauacgugagugcacugucacagucuucagacucaccagaagagggcauuggaucccauuacagaugguugugagccaccaugugguugcuaggaauugaacucagggccucuggcaaagcagucggugcucuuaaccacugagccaucucuccaccccccuacauuuuauaccuuaauaaauguagaaauguucuuauuaaagccaucauugucaucgucauuaugauuguuuaaugccaguauuaucuaaaacaaggagucaucacauuagaaagcuauugacugagucuuuguuuucucuuucucaccuuuaggaagugauaugccugcugucaugcuuguuaguacaccaacacgcacuccugucgcuaccccuccuccagcagcagcucuuaccccaacuuuguccgaaacuuccauugacaaguugaaguuaucaagcccugaacuucccaagccaugggacaguggagaccugccacuggaugaagagaauccuaacucucuucaagagcuuccucacccaagagcgguguaagugagagcacucccuguuacucugcagcucugccagagccacucuucacacuguuccugcgcagaaguggcauagaaagggccggggacggggcuuguugugagucccgcugaccugcgauuuucucuguaacugagguggugguuguuuaguugguauccucccuggccucauuaguguugggauugcagacaucuuucuaccauucauggcuucaaucuauucuuuagaaaaaauaacuuuuguacauuuuaaauauuuuaaaauuacaaauauucucuuguguuugccaaagcuuuaaaguaaauaagaauaaaccaucagauuauuaaugaaauauguaauuauuucuccaguguagaucaucagaugcugugcgcaguuaauguuuguauuacuaaaccauauugauuccuuuuguggcuagagcagcuuuccagguggccucugauaaagcccaacuucagaacaaggagucuuccuaacgaguuacaggagucacugugcuaaaagagaccuuauucugguuuuaugcauaugaauggauguaggccuucagugauuuguaauucaaaaugugccuuucucuucuuaguguaaugucuguggcuaaugaagaaccugagaguguggacuuuucugcucagccugcaccuccggagccagcucccucagcaccacuuccugagggcaccaaggccccuucccuccagcgaguaccaaguucagguucauccacccuggagaacacucugagcacugucacugaaacagaaacgcuagacaggcauauaucugaaggggagaucuuauuuagcuguggucaaaacuuggcuaccaagagugaguugacauauaguaauugacuuuguuaguuaaagcagucuccuuagugauagcuuuucuuuuaaaaauguuuuuguuuaucuuuccagauuuaacaugguuuaauagauagauguucugugcagguugguuaacuuuucugggcuuugauuuugaagaaugaaaucucccucagaauucuuuucuuuagaauuaauuugauaauaauagcucaagauauauucuguuaguauauuuuugucuuugcauguacaaauaccuaaauacaucuuagauguguaccuuuauauaggaucacgguuuguauauucuuguaaaacuuggacuuguuacaaaguaaugugugguaaacguauuucaguuccagcacacauggaucaugcccuuuuccagugguuguugaucuacugggcauugcuuaagugaggggcguuuauuuagacuguugcagacugcgugccaggcuguaaccacccucccugcacgacugcacuuccugaugacguccauaaaccaugucuacagguggaugcugagguagauggccaccuuaggauuagcaauauuccaucagcgggcuuccuggggagaauaaacagcuuuucacuucagucaguuaaauauguuuaacagcuuguaggggagcccguuucugaaguuuaacaacuuguagggaugcccauuucuugguuucauggcuauuuugguccuugaaguuagucugggacuggagagccagcucuaagcugcucacaccggucuguaaauacacuuugagggggucagaugcccucuucugaccuccauggcaccaagcaugcacuugggacacaggcauauacguggggaaaacaucuauacacacaaaauaauaacaacaauucaaauuauuaaaaccggucagaaccaggcaugcugaugcacaccuuugaccaggcaugcugaugcacaccuuugauagcucugaaggcuucaaguccagccugagauaccuugucuugacaaaucagacauauauuaaaaacuaaauaauucugauggcuaaauaggugaaauaaaaagcucauguuuguuauguuuguuuugaguaauuuaucuaauaaugaccuaaauaugaacuuuaccaguuuugcuacugaacuuuaaguuuaagugcagcaccuguguuuucugagcagauuucuuaguaaaugucuccuuuuugucuuaacugcucuacuuugcuuucugcuuuuaggaccuggggacuuguuucugaugaacauaaaugacagcuuauccagcacucugcaggaugcccuugaaaugguaaggagaagcugacuccaggcccacugcaagaauggcuugaugucuaguugccguugagcaguuucugaguuuucacuuguuugagggauacacacaaagguuagugaauuguuaccaugagaccaggcacaguuguaaaucccugucuguggucacagacacuucagaggcucaguugaggaggcugagagcuacuuugcaccaccuugcuuagcaggaaaaggaaagauagcagggaaggagggagggagguagacauacuaguaguagaggguuguuuacuauuucauuauauauuuaauuauauaauccuauauaaugggagaaugaacagaaaauuguuacugaccucuaagguucugauagucaaaaaauacauguuaauguaauuagguaaugagaucuggaauuguuucagcagugccuugaacaggaucuuaaguacucuaagucuccugugguaguuugugauauauagauagauauauagauuuauguauauaugcauuaauauguauguguauauaaauuuaauggguuaaaaaucaaaauggcacagcggucaagaggaggaccacuauugcagaggacccauguuugguuuccagcccccacaucagguggguuacagccaccuguaacuccaguuuuuggagaucugacguccuccuaugcacuucaugggcaccuuaugugcacauacucacacacggacaugaauuaaaaguaaugaaaauaaauucuuuauaaaacacuaaaauaagaauaagauccagggaaaguagucauuccugguuacucgagccacagaugagaaaaaggcauugaugauaccauguuagagauuuuauuuacauggauacagcuaucauacacacauagaugagaaaaaggcauugaugauaucauguuagagauuuuauuuacauggauacagcugucauacacacauauuaauuuucuuuuacaacuguuaagggaugaaauuuuucacauuuugaaauguuuccaaguaacuuaacaaaggugauuaugcucugcugcgcauuccauucauugcuaagcauuguucacuuugcuguuucucucaaagcaguguuucacaaaggaguaggaaaaugcuucaggaagucuuuuuuuuaaaaagaaaaaaagaaaaacaagucuccugagaagauuuuguuugaacaguuauuuucuaacaaugacuuguuaaguaauuauuugagucuccuguauuacagucacuguugcaaaauaauaugugagaagacauaauuauaguaaucuuacuuucagagaauuacauguauguuuggcuuacuuaauacaccacuaugggauuguuauuuauucuuagaacuuuaucugguauuaaaguaaauugaucaacugaacccagacaaaauuauaaccuuucuuuuucuacauuugagaauauuucuaauuguaauuuuguuacuguauauaaguuuauaguaaaugcaaaugaaaaauauaaucuaggaaagcccagaguuaacugaaaccaugugcuguuagguacguuaacccuacacagcuaggagguguagccagaguuaauaaacuguauuucauuaaaacagaauauccaaaaauaauuuaaauaauuugcuauacuuuaucuuauagccaaaaggcaagaaauuguuguuuuaaugaauuuuaaaucauauucauucuuguauuaagaaggaaauucauuuugucugaugcggaggcucacagcaucucauguuuuucagacagguguuuugaggcacagugaagccuagggaaaguguugcguaaaugaggcuuucugugccuccccuaguuuagacugccggauguccgcccagaggaggaagagcacugaggggcuguggagacucucguguuucugaagcuuuuuguugucuguggcccagguugcagcauuuccccugugcuugacugcugguuugccacaccucguccugauaugcacuacauaaacgggaagcaggaugucaugugagcccuacacucaagccaucagaacgucaugaaagcacuaguuuaguugugugagacagaagaucugucauacauuugcacuuaaauugcuuuguaguguuuguauauauuugaggcagcugugaaauguuuuuauuauagucaaauggcaaugagagcuacaugacaauagugagcucaucuucugguaucauuucuuccuaaaguuucaucagucagaguugagaaaguggaguuguaugauagccguuuuugauguugucuuugugucugcucuaggaagaugacccucccagugaagggcaggugauuaggaggccccacaaaaagcgucaugaagaugccaucguugcccuucuuacuaagcaacaacgggaguuauuaguuucacagcaagaggagguacuuuucaaccauaaagauuuuuggggggagggcuagauauaaauacaggaaaaauauuaaauauccaacuuuuaauuuugauaagacaguguuuaagauacucuauaaucagagucaugguccuuuuaaccuagauugaacugagcuuuguaacugagaaaaauuucgacaaucuccuccaaacuuuuauguuacaauuuaaaaacacaacaaaaaaauaugaagcuuuaaagauacaauuauuuuguguguguguguguguguguguauguauguguguguguguguauguguguguauguauguguguguguguauguguguguguguauguguguguguauguauguguguguguguguauguguguguguauguauguauguguguguauguauguguguguguauguguguguguguguguauguguguguguguauguauguguguguguguauguguguguguguauauguguguguguguguguguguguguguguucgguuccagcccacacccacauacauaugaauacacauacaauaccaaaugccuuuuuaaacuuguuuucagaaaagguuuccauguacuuacuuacugugugugggagcaagugcacacccagauguagaggucaaggcugacuugggguaguagguucuucccuaccauucggguuccagggauugaauuccuuagcagaugucacagaugguagcccuuacuugcuaagcugucuugcugggcccuaaccuaacuuuuuagacuuauuauuuguguaccugaaaugugacauuauaagcacuuguguguuaugaaucaucauauuuacaagagaguuccugcuuuggaugauuuacuauaaugggccuaaugguuuuucuuauuacugaaggacuuggauaacagcgugggugagcuuagugaaggacagaggcucgugcugaaagcagcagaggacaucucagcaggaccguccggccaaaugcugccgcccacuucuccugcagagcccuccuaucagcacgcagacccucggcugguauugcagcagucugacauggccucagguacacacaacuaguucuucuugguguuucuaaaaaauacuacuuuaauccuauugcagucucuuacauucuucccaggcuguugcuguaguguacuuuacauuacaauccagcgauguguucuuuguaugaauagaugaaggcuugaagauuuuauuauaucuuuucuaugauauacaacacuuucuccugaauauguuuugugugucuucauucguaugggcacauugggagggauaugagacaauuuuuguaauauacauacuuaaaaauuuauaauauagauguacuauuuuaauguauacuagaaaaauauaaccucucagaaccaauagccauguuuaagacagaguucaaugagaucauaccacucuagaaauguguucucuauagagugugauuucucagauguaguguuuaguguguuugggcuaucuuuaagaguaacugcaauuucuguuguagcacuuuggcgauuacuagcauagaguuaauucucauugucugugguaguguagccuauaaguuaagcacguauauauuaggaaacacugaacucuuaggagaaauacaggauuggguuccaggaagccucuuggaacguugucacaugaucgguauuuaaccuggcuuuauguguguuucuguuuaaagacauuguauuuaguuucugugauugauucaccaacacugaaaucacagccaaaacacuauaauucauucccaaagaaguguauauaacacauaguccuccccaggcgugucagagucuucuugugcucaggaacacugggcaguaauuuucuuuugaaaugauuuagguaucauucuaaguucccaaagcacaaaugugcgugucuguacuuaggucugucugucuuucugucugucugucucugugucuugcacauacguaaguggggaggaaggaaaguauaaaggagagugaaugaacacaaaaauguggaaaacuuggcauuaacuucacuguucaaaggucaucucuuauagcuaauguaaaaaggcagaguggggaauuuuauggugggugaugguuuuucacugcauugcuaagagccacaaaaagaccauaaaguuucugugaacagugaguuuucauuagaauuauguuucugugaguagguaacuuugcaaauggaaauuggccaguuagguggguucugacuuucccagacucauuaaugcauucuguauuagguuggugcaaaaucaauugugguuuuagacaauaaaauuuaaaucacuguaacuaaacucuaacacaucuuuaucagauagaaacuauuauaaucaacaugcuuuuuucuacaagaaauugacuugcuuauuucuauaacauaaaacucuaugcuuugcagcuugacaaauuccugaaaaguauuuucugcauucugcugguuguggaaauacucauccugcuaaaaguucugcaaaagcuuaaagaggcagcaguugguuggugagauaagugaagcugguguaucaggcaacagcuugguacuaauuucuuuggcccuguccguucaccuuuugaagcacuggcugcgcagggcgcugaguaaccccgagcuuucccgccugugccuaaaucccaaguguccacuuagaggcugcuuacuaacaaugcgauggccuuugcuacacuuguucccugacugccucauaacuuauuucaccuaugcaaacucuucuguuugccacaaggcugguuaccuccccucaguuucuuucuuuauucuuuuuguuuuuuucgaguccccucaguuucauacgccuaacuuccucagaaucuggguggcaaaucuccugccucuaucuaccagaguuuuaaucugucuacugaaacuuucaccuucuacauccugcuuuuuguuaauaggccaucagguuuuuauugacacaaaguacucaagggucgucccuauaguaaguaguuggcugugguuguggagaagacgcugacagagaguugggccucgcuggccagggcugucuaagcaucccagugugcugagugucucaagcaucccagugugcgagugucucaagcaucccagugugcugagcgucucaagcaucccagugugcgagugucucaagcaucccagugugcugagugcuccucagaugccaugguuuccugggguucaggaagauuccguggcuggauggauuggccacgggcaggagccaggauuuuucuuuccaugcaaguuuagcuuugggaaguguuuuggagcuuuuuaguccaaccucugaguuggucacugaugguugucagauacgaaccacuuuuugcuccauguugcaguccaaucaaauaauguuugguuaucgcugcauagaauaacaggguggaaguucaaagguaugacuuauaaauuauuuuuuagucaucucaugagguccucacccaacuuuucuacuuuuccaacuuaauucaagugucuagcggccaucagugauccacacugaauucuuggcaacauuaguguagucauaagagcaucgcuucaguaaugaacgauugucaccagguuugaugacugggccacugcacaccucguugucaaggccuucaucucuuuugcagagcgucuccacacaccucugccuuguguguucauuagcacuuucagggccagaugaguugguaauguuguuaguugucuguacuuuuucauugucuauuugaacuggaauaagaaaauugcuucaacuuguuucuuguucauagucauuacuauaauauaaauauaaaguaggcaacaaguagugucacuagcaaaaaaccaaaaccaaacaaagccaaaagacccacgacuccgaaguaggagcguuaaaaugauauaaaauauuaccguauuuauuuaagaauuuauuccaaaaucaaaagauaaauuucaacaauacaaaaaaguuuacucuugccgggcaugguggcacauaccuuuaaucccagcacuugggaggcagaggcaagcuaauuucugaguucgaggccagccuggucuauagagugaguuccaggacagccagggcuauacagagaaacccugucucaaaaaaacagaaaaaaaaaaguuuauucuuacaccagcuugaauaaaugacacuuuaggacauuugaaauuagacauuagagcauuguggaauauuuaguguuggcuucaugcucagcgagagcguuagauuguucagaauugaaagaaauucaggacugaaguuuucaguauaauacacauaaaauugcuguuuuucucauuuugugcauaugguaagaguauuacacuugcuacauacuuucagauuaguuuuuauacaacauaaaaugcaacacagcugacugggaaagugcaagaacccaacagacacuagagggcucucauagagcaccugagagacacuaggaguuaagucuuggcucuuaccgccuguccagcauuucuuaugucucaggugguacccagaucgcuugugauguaguaauuauuuuuguguggaaucauugugcucuaaugucuaauuucaaauguccuaaagugucauuuauucaagcugguguaagaguaaacuuuuuuuuuuuuuuucuguuuuuuugagacaggguuucucuguauagcccuggcuguccuggaacucacucuauaggccaggcuggccucgaacucagaaauugauaacuauuauugauaaucauugauaacuauuauuucuuuuugaaacugguaauuaucuuaaaaagguaaccauauuugagaauaagauggauuguguguaacuuaauacuuuuugcucugauuaaaauauuuuauuaucuauuugugagugcaugugugcaugucugugugugcaugcacacuuagauaaugacuuccagagcuugagucuccugugugggucuuagaaauugaacuuaagucgucaggauugccagccacuaaacugucucagugaccuuucaguaugauuuaucagacuguucugaauauacaguauucuugaguauacagaauugaaaaguaauaugauauagacuuuauacuugccaucacccaguauaauguacaaauuauucuagaaaacauuuuuaauaaaucauaacaucaaaagauuccuuaauuggaaguuuauaaagacagguuuuagauaaugacuagucugcaaaauaaguguuuuuauuuauuuaauacuuuuuacuaguuugcaaagaaucagguuuuauuauaucuuuuuuugacuaaauuuuaauauuugagauuuaaucuuuaaauauacauuuacauauauaugcauguauguauacacacacacaacacacaugugaauguguguguacauggaggcuagaagaguuagggccucuggagcuggaguuacaggcaguugugagcuuccugauguggugcugacacuaacccugcauccugcgcuugagcuugaccacugaguagccccucuagccucugaguucucaacagcaggcucacuguauugucuuaaccauaacaaugaaguaauauggcacaauauugguuguguaugugcauguguguauacauacacacuuagauguguaugugacuauauuuggaagaggcaauagcugagugguugagaguuuggguuuuuuaaacuccugaaauguauuuuaauucuaacucugugugucuuucuuuguucaaguaacuuaugucuaaacuuccuauuuuucauuuuuuaaauuaauuuuuaaguuuaguaugcaaguaguaguggguuucauuucaguauuugccugugcguccacgugugugugugugugugugauuauaugguauucuuauucauucuuuuccaccugcccaccuuuugcuauccuuccuucucagcucucaccaguguccuuccuucuugccagucuccuuuuucuuuugaguccuaugcaucccauaacccuuucacuugucccuacuccuguaagauggucuccuccuuucucaugguccccuucuacauuaacaacuuauacagagguagacugggauauuugucuuucugagucugucuagcuuacuuugcuuaacgcgaugauuucaaguuccauccauuuucuuacaaaugucauuauuucuuuuuucuuuacaguugaauacaauucugugauguuaauguauauuuucuguauucaucuuuugauagacguuuuggucuguuuccauuucuuuagcuuguaaauaguccaucaguaaccaugugcauccugugguauguugacuuacaaguccucugugcucuaaguggguccuguggugauuuugucuuuagcuuuugaggaaccuccacacugacuuccaugaaggcaauaccaguuuauaucccaccaacagugaauacgcauuuuucuuucuucacauuuuuuagcauuugccuuuauuucugauaauaacuaugcugauugggguaaaauggaaucucaagcaguuuucauuugcauuucccuaauggcugggaauauuaaauacuuuuuugaauauuuauugacauuuguaguucuguuuagaaauuguugucucuguguguguguguguguguguguguguguguguguaagccugugcauggguguggaaaccugaggucaguacugacagcuuccuuuacaaugcuuccccuugcuuucugaauuaguuucucuuacuaaacguggagacugccaauugauuugacugccuguccaguaagccuuugggaucuacuugccucugucuucccagcacugaggguacaggcacagcaaugcgccuggauuuuacauggcggcuaacgaucugaacacagagccuccugucugcacagugagcauggucccuguguccccagcccguguucucucuaagaaguuuauucaguucauuacuccauuauuguugggauaauucacuuuuaaaaauacuuuguuucuucuuguuuuacgugcauugguguuuuaccuguauguaugucugugacggugucagauagccuggaauuggaguuacagacgguggcgagcugggaccugggaguugaacuuagguucucuguaagagcagcaagugcuccuaacugcugagccaucucuucagccccaguuagguuuuuuuuuuuuuuuuuuuaaguguuuuguuugugcaguucuuuauauuuuggauaguaaucucuugucugacauguagcucacaaagauacacauuuuucuccuucuguaagcugccuccucccucuguugguaguuucuccauuggguaggaacugcuugauuucuuguacucucauuugcuuauucuuagaauaauuuccuauguuaccauaggaguucuuuucacaaagcccaugccugugacuguaucuuaaggaccucuagcaguuugagaguuuuaggccuuauaacuguggagguguuucauccacuugauuucugugcagggcaagaacuaucgauacccauaccuuuucacauguagauacccaguuuuucuaacacucuguuaaagaggcuguccucuuucuuuuuuuuuuuuuuuuuuagagauuuauuuauuuauuauauguaaguacacuguagcugucuugagacacuuuagaaggagggcgucagaucucauuacagaugguugugagccaccaugugguugcugggaugugaacucaggaccuuuggaagagcguuugcugcucuuaaccgcugagccaucucaccagcccuccuuuuccuaaugauuguguuucguuaaagauuaguggguguaguugugcagguugauuucugggucccccguucgagucauugcucugugucuuaguuacucgucuuguugcugugauaaauaucuuaccaaagcaaccuagugaagaauggguucaucacugcagggaaggcguggcgggaggagugggaggagcuggaugauggccgccgaugcuccacuugcuuucuucuuuuaauucagccuaggacccugcccauggaaugccuaagguggucuucccgccuccguuaaccuaauguagauaauuccucacagcaugcccagaggcucguuuucuaggaaauucaagauccugucaggcugaugauguuaaccauuacaacucuaaaucuuacuaauuuggcauccaguccaauuacuuuuaagccauaacuuuccacccuuuucccccauagacucaugaccauuuuauaauaaaaaauucauuuaauccaaaaaaaucuccaucauuuuuaaucauuacaacauuguuuaaaaguccagaagggaauaauugggacaauuagaggaaaucagaccaaagcgagacuaaaacucagcagagaauguaucaaauccugcaacucuguguucagcucugggaccugugaugcaaucucugggccccaaaggacuuaaguagccccuucuucaucccuccaucucugucacuaccgcauacauauccuuaucuugugucaacucuacuccgugucuggaguuguccuuggcagcuguuccuugguucugguauuucuaacauccuggguucuccauuguaaauuaggucuuucuuuuguaguuuccugcaauggccucucaggaccuccgguccugcucugcauugcuuugccucggggcuuucugacaugguagucagcccuccaugauccccuuagucugcuucucaugccggcaaagccagugauggugaugccaaguucuguugccagcuugagauggagccugaccccucagaccacagccacaucagcuucugcuucugucugcugagccuggagaaacccuuccgguucagagaacagggagcugcuucgguagcaguguguuucaggucaggggcuccccuugcaaaugaauugacauuuuuuaugaaauggagccuucacuggcuggagccuugcccucaggacaccuuugcuguuguguagaacacagcagcagacuuccuuaauggugcgagucacuugagcaguugcagcugccuucaaaccugccuugccuguaagguuaacuugcuccugcuauuuuccuuguaaaaguacacauuuucuuucugcuuagcugcuuuucuuccucacauaguccuagaguggagcaguuggacaguugcugcgccacagccaagugugcuccugucuuggaauuuccugugccaaacaaauuaguccuuuacauuuaaauugaaccccacucaagucuucaggacauaaaugaagucaaauucuuugccaggacaucacaggagugccauuaacccaguuucuaacagaguccucauuccuuccuggagccucauaaaccuccacuguuuguguuucucuuguuagcuuuucuuccaggcuccuacccagaaaggcccgguaagcucugcuuacagcguucuagccucugcuuacagcguucuagccuuugccuacagcguucuagccuuugcuagccaccacugacagccuguccucagucuucccauaaaucauggucauguuuaucacagcagcaguccacuucucagugccagucccuguccuucugugucugcugcugggacacagcauucauuuggggcuauaguucaagggcacaggcauuacagaagggaggacaggacagcaggugcguaaggcuacugccgagagggaugguugaugaggcucagcccgcuuuguccuuuguauucccuccagaaccguggccaucuccaggcaugcgguccuuccgcagucaaucugacguggauaauccgcacaaacaugcccaaacgcuugucugcuaagugaaucuagguccuauccaauugauagcauuaaccaucgcagucuguaucgcucccuuauuaaacuuuguuuuaaugggucuuaaaauucuguggugagguuugugggguuuuuuuuuuggucauguuucuucuaucaaaauuuacugauuuuaaaaacuaauaauucguacauuaaaaagguccauaaaauaaaacauugucccuuuuugauuaggagauuuuauugcaccuugucauuauuaaccuuguauuaaauuuaaauggccaauuaaaacaaauaguucugagaccaugcauacagguguaacacuaacauucauuuaguuuuuuugagcucuuugggcagaugugaugaccuuaccaccuucuugucuguggccuugaugaacagucugagucauaugaauagcaaaaugauccaaaaggaacucugaaagcacaaaggcuuaccuggaacuauauuaaugguggcagcuucaccaaguaggauaauguagggcuaucuuccagcuucccagcagaaaggugaugggucuuuccuuucagcuuagcaaguuugcgugcugugugaacuaugugauagucuaguucaggcgcaauaccagcuuuucucuggccugaaugauucaggagucaccugagcagugaagccagcacuucgauugcaggucauuuuugcuauugccgcaaggagcaucucagacagacguacuuggcauugacucccccagagucaccagaaagaaccucaggugcauuucagucgacuuuauacuucaauugugacauugacuagagcacaguuaccuaccaagcagguuugauaacagcagucuccacuuggcccacagcaacaguaccgguaccgauaguuuuauagacaccugggaggcaggugcguacauuggcugcucaguuaggcaaauuaaugguaggauacauuccaaagcuaccagcaguaggguugcauugguacuguuaucuucaugacugacuguauucuugacccaaggcaagcuagccauugacaccagcaugcugccugcauccuaaggagaaaucaacacaaaugcuaccgugccagguucauaaccaauucuuuuuauaaauugucuucuuuuauauguauagauguuuugacuacauguacaucagugcaccacacaugucccuguugcacacagaggccagaagagggcaucagauugcccggaacuggagugauggaugguuguaagcugcccugugggaguuagacacucacugacccugaauucuaugcaugagcgguagcuguaaaaggaguuauaaauucuagcugucccauauagaagacacacaauccagguaucuuauuuacaaguuguaagccuagauugggcagguuuggagcuauucuaauuuacaucccaacauuuagcauuugaauacauaacagcaccagaccaacugccauagccaauuuuccuaagaaauuuucuuucuuucuuuucuuuuuuuuuuuaaagauuuauuauauguaaguacacuguagcugucuucaggcaccccaguagagggggucagaucucauuauggauggcugugagccaucuugugguugcugggauuugaacucaggaccuucagaagagcagccagugcucuuaacuguugagccaucucuccagcccaugaauuuucuuaauguaaacacuucauuaauaauuucuugggggcuggagagagaucugaugcuuuuucuggguugucugaagacagcuacaguauacuuacauauauauaauaaauaaaucaaucuaaaaaaaccaaucucuucacaucucuucugacugaaggcugcucaguggaauccauuuuuguugauagcaauaauugcuuuauuuccaauguuuaagccagaggcuugguuaugauuuagccaguuuuagagagccagcuucaaacucagcaauacccauagcaaucauuuggcuagcauggucagccccagauaugccuuuaaagucuguguguccuggugcacggaaaauauccuugcuauuuccagggaggaguaauugcugacucuaugcucagcuuucaguuuauccaggcccugggccaucucuuuucaauguuuuaguguccuucugucucucaccacuuuuguacaucaguggugaccuuguucaguacaugucagguaauaguuaauaguuuguguugcuaauguaagacagagcagagauuagugagauagagucaaacagaaaguuguuuuuucuuuuuuuaauaaagaagauuguuaaugcccuugccaaacuaaccgagagagagagagagagagagagagagagagagagagagagagagagagagagagagagaggagauagcauuaauaaauauuagaggcagcaaauucuagcagagccugcgaaucauuagggaauaacuuuaaaagcacauccccccugccgggauugacagcgcacacuuuugaugccaacguuuggaggcagaggcagguggauauccaugacuuugaggccagccuggucuauauagagaguucuaggacaaccagagcuacauagugagacucugucuuggggaaacaaaacaaaacuaccaaaacuaaaaacacuaaaagaaauggaugagcuuguagguaacuaugaugucaaaguucaaucaagaagauauaaacaacucuuccugucauaauguguucuuuccuuugcuccugugauggagauggcaaucuuccuuuucuguguguagcagcauuccuucaagaauccuggaguacuggcuugguggccaugaacugccuuuguuugugcuugucuugaaauacucuucauuuccccaccagauagacuuuaaaaauagacucaccugcuuguuuguguccuuuuucuaaauaacauggauuuacaaguggaaaauuccacaucuggccucauguaggauuuuugaccuucaguaagauuuuacaguuguucucauagauucuaugucuaauaauuuugcuguuauauuauagguuugaucuugauaguaagagaauuuuucuauuauauuauuuauuguuauaaugaagagaaaagguaauagcuuugcauguuuauguuaguguccagucauggcacuacuacuaagacucuuacuaauucccauaguuauuuuaggaucaccaauacuauugguucuauuccuuuauuagagacccaaauccuuuagagguuuugggguuuaccauaucaucagcaaagaaguuuuuuuuuucucucaacagcagauaagcuaauucucaauuuauuugcuagacaguuaaagaaaaaauguuagagaagugacauaggaccagagaaggucauacauacagaaugaaaacagcaagugugacagcagagcauuaguuacucuacaguuugcauguuauugucuuuguuuuaauuggucuuauaguguacuagagaauuaaggaggaagucauucugauaaauugcuuuguacauauuaacuacuauagagauaaauauuaaagcucaauggguaaauuuugcuuugugcaaaguccauuaaaaacuugauuuagagagaaccggacagcuucugggacgggcagaagcacagagccgcugaggcagcagccugggcgggccgcagacaaccggccaccauccggaccagaggacagguguccgccuggcuugggaggcgaccucagccucagcagcagcggucgccaucuggguuccgggacuccgcgggaccuaggaaauuagucugaacagguuagagggugcgccagagaaccggacagcuucugggacgggcggaagcacagagccgcugaggcagcagccugggcgggccgcagauaaccggccaccauccggaccagaggacagguguccgccuggcuugggaggcgaccucagccucagcagcagcggucgccaucuggguuccgggacuccgcgggaccuaggaaauuagucugaacagguuagagggugcgccagagaaccggacagcuucugggacgggcagaagcacagagccgcugaggcagcagccugggcgggccgcagauaaccggccaccauccggaccagaggacagguguccgccuggcucgggagacggccuuggccucaggagcagcggucaccaucuugguuccaggacucccuggaacuuaggauuuuagucugcacaggugagagucugcaccacagaagcugacagcuucugggaacugccaaagcaacacagcuucugagagaggcccuguuuugggccuuuuucuucgaccaggaggagguccaaaaacaagauaucugcgcaccuucccuguaagagagcuugccagcagagagugcucugagcacugaaacucagaggagagaaucugucucccaggucugcugagagacgguaacagaaucaccagaagaacaaucucuaaacagagucaacuauaacuacuaacuccagagauuaccagauggcgaaagguaaacguaggaauccuacuaacaggaaccaagaccacucaccaucaucagaacccaguacucccacuucgcccaguccagggcaccccaacacacccgaaaaccuagaccuagauuuaaaagcauaucucaugaugaugguagaggacaucaagaaggacuuuaauaaaucacuuaaagaaauacaggagaacacugccaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagaaacaauaaagaaaacucaaagugaggcaacacuggagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaaugagaagaccaaaccuacggauaauaggaguggaugagaaugaagauuuucaacucaaaggaccagcaaacaucuucaacaaaauuauugaagaaaacuucccaaauauaaagaaagagauaccuaugaacauacaagaagccuacagaacuccaaauagacuggaccagaaaagaaauuccucccgacacauaauaaucagaacaacaaaugcacuaaauaaagauagaauacuaaaagcgguaagggaaaaaggucaaguaacauacaaaggcaagccuaucagaauuacaccagauuuuucaccagagacuaugaaagccagaagagccuggacagauguuauacagacacuaaaagaacacaaauuccagcccaggcuacuauacccagccaaacucucaauuaccauagauggagaaaccaaaguauuccacgacaaaaccaaauucucacauuaucucuccacgaauccagcccuucaaaggguaauaacagaaaaaaaccaauacaagaacgggaacaaugcccuagaaaaaacaagaagguaaucccucaacaaaccuaaaagaagacagccacaagaacagaaugccaacuuuaacaacaaaaauaacaggaagcaacaauuacuuuuccuuaauaucucuuaacaucaauggucucaacuccccaauaaaaagacauagacuaacaaacuggcuacacaaacaagacccaacauuuugcuguuuacaggagacacaucucagagaaaaagauagacacuaccucagaauaaaaggcuggaaaacaauuuuccaagcaaauggacugaagaaacaagcuggaguagccauccuaauaucugauaagauugacuuccaacccaaagucaucaaaaaagacaaggaggggcacuuuguucucaucaaagguaaaauccuccaagaggaacucucaauucugaauaucuaugcgccaaauacaagggcagccacauucauuaaagaaacuuuaauaaagcucaaagcacacauugcaccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaacaggccucaacagauucaaaaauauugaaauugucccauguauccuaucagaucaccaugcacuaaggcugaucuucaauaacaaaaaaaauaacagaaagccaacacucacguggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcucugagugccuccaugaagaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuagagggcacagagacaaaauccuaauuaacaaaaucagaacugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauaaauagucucccagccaaaaaaagcccaggaccagacggguuuagugcagaguucuaucagaccuucaaagaagaucuaauuccaguucugcacaaacuuuuucacaagauagaaguagaaaguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauuccaggaaugcagggaugguuuaauauacgaaaauccaucaauguaauccacuauauaaacaaacucaaagacaaaaaccacaugaucaucucguuggaugcagaaaaagcauuugacaagauccaacacccauucaugauaaaaguucuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaggaggaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagucacaaauaauauaaaauaucucggcgugacucuaacuaaggaagugaaagaucuguaugauaaaaacuucaagucucugaagaaagaaauuaaagaagaucucagaagauggaaagaucucccaugcucauggacuggcaggaucaauauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaacucuucucaaggauaaaagaaccucugguggaaucaccaugccggaccuaaagcuuuacuacagagcaauugugguaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaaauggugcuggcacaacugguuguuaucauguagaagaaugcgaaucgauccauacuuaucuccuuguacuaaggucaaaucuaaguggaucaaagaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaagagaccaccaacagauugggaaaggaucuuuaccuauccuaaaucagauaggggacuaauauccaacauauauaaagaacucaagaagguggacuucagaaaaucaaacaaccccauuaaaaaauggggcucagaacugaacaaagaauucucaccugaggaauaccgaauggcagagaagcaccugaaaaaauguucaacauccuuaaucaucagggaaaugcaaaucaaaacaacccuaagauuccaccucacaccagucagaaugucuaagaucaaaaauucaggugacagcagaugcuggcgaggauguggagaaagaggaacacuccuccauuguuggugggauugcaggcuuguacaaccacucuggaaauccgucuggcgguuccucagaaaauuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaaguuacaauuuccuaaagacaugaaacucaagaaaaaugaagacugaaguguggacacuaugccccuccuuagaagugggaacaaaucacccuuggaaggaguuacagagacaaaguuuggagcugagauuaaaggguggaccauguagagacugccuuauccagggauccaccccauaaucagcauccaaacgcugacaccauugcauacacuagcaagauuuuaucgaaaggacccagauguagcugucucuugugagacuaugccggggccuagcaaacacagaaguggaugcccacagucagcuaauggauggaucacagggcucccaauggaugagcuagagaaaguacccaaggagcuaaagggaucugcaacccuauagguggaucaacauuaugaacuaaccaguaccccggagcucuugacucuagcugcauauguaucaaaagauggccuagucggccaucacuggaaagagaggcccauuggacacacaaacuuuauaugccccagaacaggggaacgccagggccaaaaagggggagugggcagguaggggaguggggguggguggguaugggggacuuuugguauagcauuggaaauguaaaugagcuaaauaccuaauaaaaaauggaaaaaaaaaaaaacuugauuuaauauaaaauguccagcagagagugguuauuuguuauaucuaggaaauggucagcucugcaauccuagugaaggugauugccuuuaaaggcaaaaugucuguggugccauuaagauguuucauuuuaaacaaguuaggucaugaguaacucuuuuuaagucuuucauuauugauuaaauaaaauuaugcuauauuuaaaagauaaccaauaaaaagaaaaaguaagguuuucuuagaaauauuuguggaaggagcuggcuggcucagucaguaaagcaauuucugugcaagcaugagaacccgagauugaaccacaucaaauggugagcaugaggcuggagacacggcucaaguuuaaaacacgugcugcucuugcagaagaccuggguuucguuuccagcacccacaugaaggcucacacgcaucuguaacuccugcuccauagcauguaccauccucuuaccucacugggcacuagauaugcacaugggggcauauauacacaugugggcaacacauaaggcuaaaaaauaagucuuaacuugcaggggagagggggaguaaugccagccaucauggugcacacuuacaaucucaauguuggggcaccagaagaaucucuuuggacucgcuagccagccagaguagcauaauuuguaagcuuuaggcuaaagagaaucuuaaaggagauugacagcauucccaaaaauggagaccugaagugguccccuggccucuacaaaguugucuuagaguuucauugcugugaaauguagagaucaucuuuauguacuguguggaaacaucgccucaauaaaaagcuuauggccaaugagcugagguaggacuagaaggugggacauccaacauagagagagaggauucugggaaauagucaggccagggagauuuguccagacucugauagagagagacucgagaagcugaggaaagguaacuaaucuaaccauguggcaugacuuagacuaguuuaaacaaggugauugagucaugaauuagcagaaacaagccagagcuguuggucuagguguuuauucauauauaaaaagucucagagucauuaucuuggggaacaaagaagcuggguagaaaagccacaguaacagugaagagacaccaugaucaaggcaccucuuauaaaggcaaacauuuaauugaggcuggcucacaguuucagagguccaguccauuauccucaugaugggaggcaugguggcaggcagcggacacagugcuggagauggagcucagaguucuacgucuugauccucagaccgcagacuaugccacacaggguggagauugggcauauaaaaccuuagagccucuccccacagggacacacuuccuccaaccaggccauacuccuaauaguaccauucccugugggcuaagcauucaaacacaggagucuaugggggcuauuccuauucaaaccaccacaacagucaagcacccguguguaugugcacccauguauacaugugcagcuguguaaacaugaacacacgcacacauaugcaugcauuaaaauucauuuuaggaaaaauaugaaauauaaauauaaagccaaauguuaaaagcugucgauuuuacguaucuguugauucacagcuuucagacaguucacugagugaguuauaaaugugaaagcucuuggaguauaaagggcagcacacauguacagugauaccagauacauagauacuucugcucuuaccuuuguacuguuuggaucgaggugauguuuagauuagggaaaauaaugaucagugugaucaucugaagauaaauccuacagaacagagcuaauugaugccggcauguucuagccaggaauuguuccuuacauaggauuacuuuuuuuccauggacauauauucauuguacauaguacuacauuucaaaggaacggacauuuuuauaacacuaugucauguacuuuggccauguccucccauaucccugugguagucuugucaaucugacacagucuguuaucugaggagggagucucaacgagagauucucucucuucacuuggccuauagguaugacugugaagaguaucuagacuaguggaaggcccacccacugugggcgacaccagucccugggcagaguauccuggauuuguaugagcggagacagcaagcugaguguagcuucacgcguuaguuaccucauucaucugugcucuuucuugacugugugugaucugacuucaccuucgccuggguggggaccuggcgcugugagccaggcagagccuuucucccucaaguuccuuuuccaggggaucuuaucacagcaacagggaaugaaaauaagacacccucuguccuccccuuugucaucucuucuccuccuauuagucucuaucuguagcaagguuacauucuuaaauagaaaguauuauauugaaucugacuuuuagugauuuacuguuucugaguagcugcuuaggaaugcugggaaguguagucuguugcuuacuguuuuacuaagguaacucugacaaguuaacuuuuucuuuaccuguuugauauagguaauauuugugaagauuuaugugccagucaugguccaaugagcuuaagggagcuggaguugcagccugauucuaaccuuauucuucccauaacacacacuacaacagcagucagcgaugguaauuuaccagaagcagcugaagauuuuucucagguaccaaaacaagaaauuuguacuuuacuuaagauaagaauuguaaacucugugaguucaaggacagccagggcuacauagggagacccaugucucaaaacgaacaagaacaaaaacagacuugauuucaaucccuaaaacauuuuaggggccgggagaagcagagacagucuuacuaugcagucuaugaugccucaacacacacagcaucuucuagaauguucucaaaggaggaaggagaaccagcuccacgaguuguccuuugaccuacucaugaacacuugucagcacaauucccugcccacacaaaauaaaugaaauuuuaaagaauaaaaaguauauaaaaugucugacaccuaguuaagucacuguuaucguuuaugacucugcuauaaaaaagccagcucagugauuugugccuauuaaguauuucauauuuauagcuuuaaaauuuauacaauauguuccacaaaagcauaacaauuuuauaaugagugaaaccaauagcccaugaaaccuuguauauuaaaaaauuagaaugcuuguucucaaagauuuuaaucuaaauaaauguucaugguaauaaauacaguuuuauauucaugguuaguaauuuauuccucauuguaaauuaauuuauucaaucaguauucuuugcaugguauuuuacaacauuccaugauaucaaggaagaauauuaaaaauauaugauaaaaguugcuuauggaauacaauauuauguaggguuuguuauugcuaaucuguguucaaacaaagaucaggaaaaacuaauaaauaugcaaauagugucugcauuaaagaaaagauuuugugacuaaaaggcaagaacuucauggaugcaaugacaaaagccccguagaugacaaugagaauuaaauaauuaguucuuaccaaaaauaagaacuucuacucuccaaacacaguacuaagaggaugaaaaguagcagaguaggagacaaguuagcucagagcauagagaggaccagcguuaaaugugcguacagcgcaacucaaagugcacacacccucauccagaagaugcaugaaaggucagucagcgugagcugcugugagacacuaggaaaugcagaguaaagccagcgaccucuguacccugauuagaaagcagaaggcucugaggcugcccuggaucugcuggcaaggaugugcaacagcugagcuccaguacguugccccugggaauuccgagugguaucaacgugcagcugacaugugacgaacacauuuuacuuccuaagaaaauauagaacagaugagugcucauaggaacucuguauuugucuuagccccaacuuggaagcaacacaauguucagcaaauggugauuggagaaaguauauuauguuauauacucuagaauaccacuguucccagggcacugugaguacaggaacucuugagauagacaauaauucuuauuuauuuauuuacuuacuuacuuuuuauugauucuuugugaguuucacaccaugcaucccagucccacuucucuccccaucccccaccgcccuuggcucuugcaaccuccuacccccaaaauaauaaaaaacauauacaaacaaacaaaaacaaagcauagaaaacaucucaucaugguagcuguaguaugucaaagcauaucucacagucuaucccucuguccacacagcuucacuuguaaauguucauugcagugagucauuggucugacaccaucaguacuggauccucgccagucuccucccaguuauccuguuguugcccuggaucguggagauucugcagccccgaaucagcaggacugacccuuuuacuggucucaguaguucccagaugauagagauuuuggaggugggccaacucagagcccuggaucugagccuguauaguagcugagcugcccagccugcuggcucuuccucauccaugcucccaaggcaggcaaacucuacugcuccagcugagccauccaguggugccaucagcaggaggcagggccagcucuugugcucucauacccugcagucagcucagcugcaccuaugccuccagagccagcucggcugccuaguuaaugcacaggucccacugucccaagccugugaggggcugggccugcucucccacgugcuauagcuagugagaggccagggauagcucucucccuuaggccagcucuccugaccacugcaggagauuggggggggggugagagggcaucaccccuguacccaugccaccucauggcaaacgaguagugggccugcucuccuaugccuuuugggaaggcucacccugugcccccuccaccagggccagcucugcugugcugcccaggugaggugcagggccugcuuucccaagugcugcagcaggcaaguaacaagggccagcucuuugccuuucaggaccccacggccuguuuucccaacugccaccaauugggaggcucccccccccaaaauuauguugaguaaaagcuaguaccuucuccuuguaaaaaauauacaaugauuccacuuaauaaaauucuaaccaaauacagucaugaucacuuguaauccauacuuaugaggcugcgucagaggaucacauguugaaacuuguaaaauaaaaaagagagagagagagagacgcuagaaaaugcagucuagucuguaacaaagcauuucaguuguuggcuuugcauagugggaaagauggugcagaugccuuuguuggccugucaccugcaucugucacucuggagucacacgugucauaaaucccagcaucucugcauuaccuaagagguguggugcucacaagagggaugggugucuucacacucucacacugugaacugugccuuaaguccaaucaugaaauagcuacuuaaaagcaaaucaaauucucaaauguuuauauaauagaaccaauuuaacuuuuaacuuaaaaaaauaauauaauggcuucauuucuuaaauucuuuaguaccaacaaaagcaagauucagacauuaaacaaguugaacacaagccaauacaaagacaucuaaccaguguaagaaauaaaccugacaguacacuuucacagcaucaagguaagcuauuuuuguaucagauagugauauuuaaauaauuauguucauuaaauauuugagaauauguauuagaucaaacuugguguccugauaaugaacaaauauacaaugaaaauauuuuuauacaaaucuaauuauuguuuccaggaguuauuuaaucuguuuucucucauuuaguauauuuagaugaaaaucuuauauuugacuauaagauuugcucacucuuuuauuucauuaauaaguacuauuucuagugggguuuuaaaauccuuagccacuguucuuucccuuuaagguuacugccauuaauaugcuguguuaagaucauuaguguuaugagucaucaggaaaaugcaaaugaaaacuacuucacuucagucagaguagucaucaagaugagugagcagccaacacacucuggcaaagauguggggaacgagcaacccuugucuacucucagaguguagacugguauacuacuguagaaaucagcauggaggguucucacaaagcggaaacagagcuuccuuaugccugagccauacccuucuuggccuuauucuaagaggacccuaagucagcacgucauggaaauuguuauucagccauguugguucucaguguuuacuguagcugggaaguggagucagccuaccugucauuaacagaugaaugauuuaaaagguggcacuuaggcacuauggagucauuuccagcuguaaagaaagcuggagaagcuggagaaggugguccagugggugaugugcuuuuugcaugagugagggcuugaguuuugacccccacuccacaucccagccagaugagccagugaguacuggucgcuccagcgcugaguggcagagacaggagguuccuggggacucauuagcgagcgugucggccacaaaccagccucagaaacuaaggcagagaauggauuaaggacgacgcucugacauugucuaugucuggccuucuacacaagcacacaccagcacacuuauuccccagcccacauacacuaaaugaaaaaugaacuuaggacauuugaggaauguggacagaacuggaacuuaucuuaagugaagucaccaagacucagacauauacuacagauuuucucccuuaugcaggucccagauuaugacgcuuauaaauguauaugucucaauaacuguucuguugcugugaagagauaccaugaccaagacaacuuauagaagagagcauuuuauuggagguuugcuuauaguuucaaagacuuaguccauuaucaucaugacagggagcauggcagcaggaaggcagacauaguacuggggaaagaacugagagcugucuccugguccacagacagaguaagacccugggccugaugggcuuuagaagccuccaagcccaccccagugacauacugccuccaacagggccacacucccuuaaguaaagcuacaccuucuaauccuucccaaauaguucuaguaacuggggaucaaacaguucaagaguaugagccgauuauucaugggccauuuucauucagaucacuacaauguguauaaauacuuaugguuuaccuuuuaauguuaggaauguuuuaccuaaauauaugucugaaucaucauuuuagucccauucaguaucucuuuaaccuaacauauugauuuuacauuuuagaaucuaaagaaaauuggccuauuuuggaagauacaaauucaaugccagccugcauuaaacaaagaauuuuaggguagucuaagccauauagcaagacccuaucucaaaacacaauaaggaaaaugucgccuauaaaacuauucuaaugaugauuuuaagauuaaucaugacaauauauagacaugagcaaauaaacauuccuaagauuguaagacugacucaaagcccugcugaguauuguaaacuguucauggucaauaucauucaguaacuuuaggguuuuuuuuaaauacauggcuuaaaauuaauuguguuuucuugugagaucuuuccuauaaucaacaaucauuucccucuacacuuagggaaauaucuuugguaacauuuaugagccuguaucucuggcaaugugauguugcuuucagcuacaaugcaugugugugaccagaggauagcagaagugauguuuguugacuuauagcuguuauucagugaugacuagcugacauuuaguaagacaguaaagaucauuaugaaaaauaagagaaaccacauuauuagcuaaaagggauuuuguuuugagauaugguuuuacuauguauagcugacuggaauggaggacucuauguagaccaggcuagccuugaacucacagaaauguaccugcuuccacuuccucaguguugggaucaaaggcauguacacuuaugcccagcccaguuagcuuagugucuuugcaucuacuuuuguaucuaauaagaaaauauaacuuguuguaguggcacccaccuuuaaucacagcacuuaggaggcagaggcaggcugaucucugugaguuugaggccaggaugaucuacauaggggauucaggaacauucagagcugcuguaguaagacucagucuuggaggggagaaaaaaaaaaguaggccuauuuuagcuuuaacuauaaaauaagguauuuguauagauauaagguuucaucucacaauuaauguauaucugucuguacagaguacuugugaaugaaagucauugccuuggcacacauaaucaagaccuucccaauaaaauguaugcacuugguuuauuucccuccucuucugaaauucugaaacauuucaaacaugucagcgaauaggagucagaguggcagaauaaugugagggcccugugaccuuggagacccugaagagauucaguccucucagggacacaaaucuuaagacaagggaauuaaaaccacaucuuuucugccagguaaauguuguaagauuacuugaauccuaauaauggcuacuuuacaguggaguugucauguauuuugcucugaaauguaaauucacuuauuauguguauauaaggcaauggagcuaacuacuagagucacauuuccuucagugagcuagcucucacugaaaguugguacaagacaaggugggacacaggcucuuccacuauauggcugaagaauuaccaggaucuucuuuuauuuccagaucuuuaacauaaaaggaaaaaucauuacugugacaggugaugucuuuggaguaucauaagaauaggagcuuuugggcuggagagauggcucagcgguuaagagcacugacugcucuuccgaagguccugaguucaauucccggcaaccacaugguggcucacaaccaucuguaacaagaucuggcgcccucuucuggagugucugaagacagcuacaguguaguuacauauaauaaauaaauaaaucuuuaaaaaaauuauuaaaaaaaaaaaaaagaauaggagcuuuucaaaccagguacuguggcaaaugccuacagugccaggaguuagccugaggcaagagguaggucuagugucaggaaacacaggaauaagcaagccaguaauaacgauagugauggcguccuuucaucuuccacugaaugugcuggguauguucuuuagccuuggaccgaggcuaccacucuugagucagugugcuaggcacguggccagcaugcuuacgugaaaggcacuucuucaaaaggcgacuuucauuuuauuuuccccucuugcucugugucuuaguguuuuguugcugugaaaagacacuaugaccaaggcaacucuaauaaaagaaagcauuuaauuagggccuugcuuacagguucagaggguuaguccauuguugccauagcagagagcauggagucaugaaggcauggugcuggagaaguagcugagagcuacauccugauccaccaacagcaugggguggggaggcugggccuggugugagcuuucgaaaccuccaagccaaccuccagcgauacacuuccuccaacaaggccacacaacaagaaucacacuaaguucacuaugaccaauuuuauuuuucuguucagguuaacuaaauauaaaacaagaaacuaguuuuaaauccguuuauuuaugaugaaccagagaacauuuaaauuguacaaaguaagugugauaaagucaucacuuuaaaaaauauuuucuuuggauuucucaaaauauuuuaagauuauaagcaagauuuaaugaguaggagagccagcauauugugcuacagucagugguggagauuuaagcugugugcuuuacgauuaaaugcuaggguagaguggguugucaaaguuacuugagaaacacaguuguucuguuuucuuauuuguagacugugcucucucucucucucucucucucucucucucucucucugugugugugugugugugugugugugugugugugugugugugugugugaguucuaauguuccgauuauuuccuggccgccuuccacuguuccgucacagauugugguuguaacucaguguaggagaauuagcaaacacaaaguuucugucuauuuaaaagauguuucugugcaagcaaaauauuuuuuauuuaauaaaauuacuaauuuugcuuuuguaauugaaauacagcucaaguacaauuccuaccagaauuaucauuauuuuaguagcuuuaaaacgauagcugaacuuuuuuccaaucuuaaagugugguggccauuucaaaccacauguauguagugggaaguauaggucaguguuaggccaacagccuggugcacagggccugaguuccauucccaguaccacaagcaaacauagacagacaugcaggucucagagagggagaugauagggcacagacuaaaaagcacccaaagccaaguauucaaauuggcaacaagcagugucugagugucaugugucuucuacaaaucugugcuuuccuaauccaaaaucucaaaguucacauucccccaaacagaaauaugaucaggcacaucacagcaaccucccacuccuaauaccaacuuacuugguguuuauugcuaugaagagacaccaugcccauggcagcucuuagaaaggagagcauugaauuggggcuggcuuaugguucagagguucaguccauugucaucaaucauggugagaagcauggcagccugcagacagacauggugcuggagaaggagcugagacuucuacaucuggauaggcagcaggaagagagaaagagacacuagacuuggcuugaguauuugaaaccucaaagcccacccccagugacacaccuccucuaacaaggccacaccuaacugugccacuuccucaaaacuaaacauucaagccugugugccugugaagaccauuccucuucauaccaccacaucaucuuguguuucaguugaugugagaauaucugcauacagucagggacauaauccuuaugaagaaaagacacuucucuggagcaguagguuuuaaaauagauuuuuuuuugagagagagagagagacauaguuucucuguguagcccugguugucaugggucucacucuauagaucaggcuggccuugaacucagagauccaccuaccucugccuucugaguucuggauuaaagaugugugccaccacugcccaacaccagaugaauguuuuaacuuuagcuuuuguaugaaaaaucuuugauuuaaaagacggggaaauauagaucaucuagggaugaaauguauacaguuaaguuaguucuuuaagaaugaacuaaacagagggccagggagacaucacuaagccugacucccagaguuaagccucacaauuuacaugguggaagaagaggacaaacuccccagauuuguccuuugccuucagcauguguguguugccuucaggcacucaaguaaguaagucuauaauaaaggagauguaagcaggggauggggagcgugugauacauuaccugggagggaagugaagugggcagccugcauaaaggauuacacuagaaaguaagccgugcaggcccaagucagauggcaguuugcaggaaucggcucucuccuucuaccuuguugggucccgggacuaaacuuggguuggcaggcuuggcagcaagagccuuuaccuacugagccaucuugcaugcccuccaaaaucacugaaguaacuguguagauuggcagcaucuuuauguuuuauuauuaaugaagcaaauagucccgggagcaggagaaacuugggucgguguugucucuaccguagcaucugcucuuccagugugcgagggucuuuuacacagcacaaucuucuccaacagaauuuaccacaaauacaagucuuaccugugcugcuugaugaguaauugcguacuaaaugcuuuaguaacuuaaagguuuauaugaauaaaauaaaaaguaaacggacuguuucagccagcauagcaguaaaguucucgccuagcccggguccaccuggccauauacuggauaucaaggggcucgauuagcucaggugagcaucaggaccaaggacugacagcugcugugugugcucccucgcagagcuagccacucuguguugcugcucggugucugcagauggcgcuucuaaauggaaacagacaggagcuuuuauaauuaaugaagacccagauucuaggcuuuuccuugacacuacccaaggcagagacugggaguuguggaagcuuagcuggugcucacaguucugauucagaagaggaagcacaauuuggagcaacacugcugaauggcuuguuuguuuuggggacuuaugcuucugcuguauauagagccauacagcauagagagcgugcagucuggagucaggcucccuagguuaaaaccauccuccgcuggugaguuugaacaaguugcuuaaccucucugugcuuuucuggccugugguaugauacagcuuuccuuagguugauacagucauuaaagaaaaacaugccuaagauguggcguauuaggaaauuuggaaguaguagcuauaguuagccugacuguaugaagggaacugcuucuuucccccuaauuauaauguaagcagcugcuccuuuaagagggaggaguugaaccugugcugucccagagauucaaugacgcuggugagaaagugcucauagguauguguucugugugacuuaagcagauauguuguuucauuuguucuucaucggggaauacuaaguuagguuuagguaaagaauguuuaaauuugugugugcuguguguacauauuguuuucuucagcaguuuuucauggacuugcacacugucuaguuauauccagcaaagcuuacuagaaagggugccuuucacgcuauaaccagaucuuugggcagguaauguuuaauaaauuguauuuugucaacaguucucuuauuuuauguguguuuuauagaugugagugcaugugguauguguccauuggaaacuagaaaauaaccucagguguccuuauuuuagcuaggcuagcuggccagagcgcucucagcaucugucugucucuagggucauagccauguccagcuucugaguggaugaaggaacucagccugaguggcaggugcagggcagacucagcucucacauuuugaauccaaaagagaagugaucauuccggacucaacuagcacguacaccaugacacccugguucaggcuggaugcgaguacacaggacaguauggaaaacauacauuucucggagaaaaacucuuuaugaugaaaggcaaacacaggaaacaucuuuuauaagaaaaauaaagaaguacuuucuuaaaagauguuugugcgggaccauaauuacucuucaauugaagacggagggccauuugcucuguuaaauauguaauagcacaauaaaacuaauaaugaauguauacauauucgugcuauuuggagucgugcuagcagaagggucuaaguggcugugaccaucaaaaguuuucuuaaaauccauuuguugucagcuucucagcccagaaucaacaggcagggacauagaugcuuuuuuuucuguuaauauaauugcaauaauacuuuaucaccuaagagucuaggaacuuagguagcaguugggagccuuucguaccaaugagaacuuaggcgguccuagaaauacuauguugacuauuuucuaauuauugugucauuuaaucaaucauuaacugugccaguuuccccaaaaugguuuagcuugcuguauccauaacacuuuacaggaagcagcacaaaauuaguuuccauguguuucuguggugucacaaaauacauauauucuacaagugaaguacuuauuuuuggcaaaaaagaaaaaagaaagaaaaaaaaagaaaggaagaaaagggaaagccaacauuacaccaaacugcaauuaaugaauauaagaauuuagaaaucaaaacuuuguuuagucugaggaaaaacaauucuuucaacuauauccacauggcuucuuguuuguaucaacugagggcgacuguuacugucuugugugaauucucuggggcagggaccuggcuuuguugaaugagccaguuguuucccuuuguguugcccaucucuuaaguuccaucugguuuguaucagacuguuuucacacugcagcgcugcuucucuguauccugacacuccagagcuggacuagcaaagcucgcugcugugaugaccuugcugccagggccucacagcugugccccacagccuggagcuguuaucagaguaguggugacauagaaccuggguggcucuauucccacugguguccaugcagugagcagaaguccauccuccuuccccaugccugaaacuuacgacaguggcacaucuuucaagcuccuguuuuagggcaugggaugucguuguucuuauuuuuaaguggcuuccugugugugugugugugugugugugugugugugaacgcucauuuuucauucuaugacucuucuaaaagucaccagguccagccuuagggaggagaacuggucacugucagacuuaauuuucauucucaaauuuaguuaggaguggcuaguguggcagaaaccacuuuuaagauggcacagaugauaucgugggguuuuagugauaaucgugagccauaauuuuggggaaauuuucguguuuaggaagcauccccgucucagcaagcagaugauagaaagagauuaucuuagcuuuagcuccaacuugcuuuauaaacguuacuuucuuugcuuucagccuuuguagcugccaaaugucacauguaagaaccuugcaacugagacuucccugcacucugugaccugguguaggucugucaagugagauggcaggaaugagcguugaguaacaguuaguuauauuccaguacaguuacagugccugccguucccuaggaaacugagaggauguacagaauguagugagaccucaagagauauuuucaagauuaguuaaagcuaguuuguuuuuauuuaguuuuugucuuuuuucacuuacaguuuguuuuuaacguagauagcuauggauaguaaaaacaaaaacuaaucuuugccucugaagagguucaugccuaauauuagaguuuuuaaaggaguuuauguuugacaguaacaaaguguuacaucaucaucaagaaucaguuaaaacucaaucuacucccuuuuaauugcugaaacuaaccuguugacuuuuccaauuuuaauuuuuuaugcaugaguaacauauauguauguagagaaguacacauggucaaagaagcagccccagcagagccccccgugcacaggcaguguccagcgggggagagcagcuuguggccaggcccaugaucucucgccauccuucccuccacccacaccgacauaccucuguccugacuuguaggacuuguuugauugugcgcuuuauguaaaugaaaucauacagagugcauggcuucuuucauaggugaaccuaucguaacuuuuuuaaagguucuuuucauuucaaaaccauuauggcaugcuuuuauagaacguugucugggggauuuguuuuaguagcugucucacaggcgcuugaaguaacaggaaguucacugcagauaaagcugucuacuaaaacauggucucucaguucucaaccagacgguagugguggaaugucccucuagacauucuugccccuaaauggcaggcaguccaugucauaacacuucagaguagugcacucacguacuuaacugcuuuuuaaugaguuuuaauaauugaauguacauuauuaaaguaaauuguggucuguauucagaguagauggcuccaucaucaauuuccugaauuaaccagcaacuuuuuggcaguuggauagaugcuuuugugcuaccagauggugucucugaaaguacuguuauuucaaagaguugauguaccuacuuagacacggagccaauaacaacuuaauuuagaggauugcuuguuuaaaaacacuaacuuguuuuuaauguauuuuuaaauacccuaauaguacucuuaguuuuuauucucagugaacucaaauuuguauuaaaauugaaucuauccugaguguuuuuaacuuuaauugucuccuuauuuguuuuaaauucugaacauucauuucaaaguucacguuuuguuuuaugaaugaaaaacuuuaagaggguucaucuauauauuccugguagauagguaagggucuuguagauuguuuguuuuguuuaauaauauuguuuuguuuuuguuuguuuguuuguuuguuucgagacaggguuucucuguguagcccuggcuguccuggaacucacucuguaaaccaggcuggcgucgaacucagaaauccgccugccucugccucccaagcucugggauuaaaggugugcgccaccacuaccaggcauuuaauaauauuguacgauagaucuugcuuuuuagguuuuuaaauuuuuuuucauaugugugucuugccuauguuauaugugugcacacgugccugcuugaugcccagaagacauuagauccugaauuagaguuguggguaguugugauccaccacgugugugccgggaaucugaccugugucaucugcaagagcagcaagugcucuuaucuuaaccacugagccaucucuccaucuccucggaucucgugugugugugugugugugugugugugugugagagagagagagagagagagagagagagagagagagagagagagaucgugugauauuaggaauaugugguaagcaaguccuauacuacuaagcuauauguauaugcaccccauaccuugccacuuuuaauuaaaacugcaaggcuacaagauugugggugguuauuuaaaacaaaagauuaaagugcugaaauaagauauguuuaggagaagccaaguauggaaaagugguccaucccaggacaucucuguaugccuuuaugacgcauuucaggaagaugcucucucuccuggccuuggguuccauuuccaaauguaaagucacuagcuuuguauucccugcugucuucagaccuuauguaaaggcuaacaagccuguuccaaguuacucccaugauauggaggcacuuaugcaugguagacucacuuugcagucgguauuacccacucaaaguagaaguguauggaucaaacagacgugugugucugucacccuuuggcuucaguaccaugucgagcauuaggauaagguaagguaugcuaguagccucgccacuggcucucagaugacauggacuuggcuauaggucaucuuuccucagcuguagagcaagagccccucucccaggacucccaucuaacacauggaaguugagaaacugcuucuugucagagaauaaauuacagucagcucuaacacugauagagugguuucuauuaguaggaauacugugagguaccaugagucuuucccaguuuugguagagagguguuuuguguuucuguaaagaagaucuuuuucuaagaauuauuaauuuuuugauuuauuaauuuuuauauuuuauguguaugaguguuuugucuacauguguauaagugcaaugugugugccuggugccaucagaggccacagagggugccagaucuggaguuccugaugguuguuaggucaccgugugggugcaggaaaccccgugcaggcccucugcagcaagggcucuuaacccuggucucugauggcagcaccagcagugguggugguccuugugacacuuccaguauguggcucucaggagugugcuggguuuacagaggccccugacccucaggaaggacugcccccucucucccgcuccauggacacagauggucgguucuucaguggaagagccucuaucagaguuagcuccauuaagccagcgagaccagacaguagcuucucugcucgcucugggagacucaggaagagcaggaagugagcagagguucaccacaguuagugaggccucagacgcuccugucagaggcgggugcucaguccgggccgcuaugcagauuuugaauguaugagugacucguauuuaccauccucuucauaaaaccccaucuucuuuaaaaguauccuugugaacuuugguuucuuuuucuugauguguucugugcauuucauauuuuaaaacacuuaauuuucagauguuuucuguaguauaauaauuuaaacugaauguccccagucagauuguguggccaagaauaaugaaauggguaguguuuauaaacucuguaauuucuuuuuaaaaaccagcaucucacuauauagcagugguucucaaccauccuaaugcugugacccuucaacacaguuucuuauguuauuuugaccccaacuauaaaacuauuuuuauuguuacuucauaauuguaauuuugcuacuguuauacaaucauaauguaaauaucugugcuuuccgauggucuuaggugaccccuguuuuaaaaggguuggugggugacagagggucacaacccauaggcugagaaccacugccauauaaacuuuugaguguauugguauagaugugagccauuaagccuggccuaauccuuacaguguugcucacuuaugucuuaccuucuuauaaaguuuaccugaaguucuuguugaaugaaggaaagcucaagggccagcaggaugguucagugguugacgcuccucgcccccgaggacuuuaguucaaucucuggaccugugggggaaggagaggaaugacugcaaaccugugcacacaugugucccccaacacaaaaacauaaauacauauaaaauuuaaaaagaagcuugagagacaguuuuuguaucauagagaaacugauaaaagaauacugcuuguacucugugacacauuuuuuuccccuuauugcucagcuccaagaguuuguuugaaacagugguuggugguuguugauuguauuuuggaguacagguugacaucaugcuaucauuguggucugguucuuaguguucagcgaguuuuguugaccugaggacugacgguuaaauaguuuuaucuaacaugcuuggggcaggaauauuuugauuagauuauuuaaauuucagaauauugauauauacauaaugcuaucuagggauggugcuuaugauuaaacaugaaauucacuguguuucagauauaccuuaccucauagcucggagauaauuuuauacaauauuuuuuuaguccacaauaauggcuguggccacgacaugaggucagauguggaauuuucuauugugaguucgccguuggguuuugcugauuuuuggaguguuuugguuuucagaguuuuagaguaggagaauucagccugugugcggcugcaugauuucacuuucccugcugcuuuucuuccucccucgacaugaagagaggccugcguucuucauuuaacugcuccucccuuggcucaauaguacuccccuuugcugcuugagaacugguggguuuucaguguggccucagauggccagggcaguggagguccuaaacuuuuuuuuguaaugguuaaguccuuaggugaguuauagaaugcaaauuauaacuuucuaagaaacagcccaugaguuucgcucacuuuuuuaagaauuggauuaauuuugcgauuaccugcagugugauccauggcucuuugcuuccucucaucucaucuucuggauaaagauaagaaucaguuaggcaaggucucuuuugcugauagucauuacauucguguguguguguguguguguguguguguguguguguguguguguguguggcuuccuucuuuacuaggucacuagacgaagcaucuguugaccuaguuuuaugggaggaacuaacggaauaagugcauuuggccugaguucuuucuugugaauaggaauugugauuauuucuaacuaauauuuuacugggggugggggagcagagcuuuguuuuaauguagcuccucugggugccguggguaggacacagaaggaguccagugugugucuugccucuauauguacaggugagguugcugcuuuuaaaagcccugcauuuggaggucguaaaguuucuugcacuuucauaccaugccuucucuuuuaucaugagcaaaguagaaacacugguggccauuuuuaacccuucuaaagugugugcauacucacccaggauuaaggacgucagcucucuaaaagguacauuagagcccagggaacgaagccuucaucccuuuggaaaguuuguaaacugcugaauuagaagcugcaggugugguguacagagcgccgaggguaauacuuggcuaguuccaucuggggaagguuauuuguugggacaggauagaguuuaaacuuugaagucaguuuuaaacaaagcgaagcagcuggaagcuggcauaagaagaaacaagucuuucacauuaacuauugcugcguuagagaaaaggagcugggguuguuuucacaggugccugggcuuucauuuuuccuauauaagcuacuacguuuuugucuuaaacuguaaauuuuaagauaagcauuugucaauucauuugaaaaacaagcaguaauaaacucaaguauagcagggcuuacaugucugaaacauacuucagaaugugauagggaacguuaggaagauaacucagccauuaaauggcucauaaccaaauggauaaaguaaccuguuguaacaguuuaaaauacuccuuuaaguaugagagauaaaauguuucuagugacuguggaaagugaaggccuaggaaacucaguauccucaugacacugagugucaucaccagugugcuucugcaucaaaacagguagcauuuugcucucaagcacugauaggauguugcaaagccugcaggcuggguuaagugugugaggagaauuuaaugcagcaggagagguuagcagcugcuuacacaaggaaucgaagcaagagcagaugagaacaagguggacaggaaaaugcuuccagagccuaauaaaacaccacagaaacucuguagcauuuucagacagcuggaaagcaacugcauugcugggaauaguugcuauuuuuaaaaacaagguggagagugaaugcaagcaggcuguuaagaagagccauagguucuugaggaagaagcagguuguuuguuucuuagucagucuacuugauuucaagagccccuaugugccuagaaucgagcuagaacuguguggaacugugcuauauuaaagcaucaagcuacauuuaauauaggcagaaaaauauauauugcagucccugggagcacaugccuaacagcauggcgggcgcacaagcgagcugggcugggugcaguggcgcaggccuuuaguuccagcacuggguuccaggccuggggaggcagaagcaaguggaucucugugaguucaaggccaaccuaauaugcauagucucaggacagacagaacuauguaucaagacccuguuucaaaaaacaaaacauaaaacaucuuugugaaccaacuaugcuagucacucagucccuguccaugcucuugaggaagcauugcucacuggauauuacagugcagcuuggugaguagcacaggcaagugccacccaggauugacaaggaaagacaucccuaacauuuuagcacugcugcugggaacagagcagagggugggcuuuacccgccagccugggguaucaauaaaggaauaaaauaaaaugaaaaaagaaaaacuugguguuggggguguggcgaggugggggugauuuggggagaguuugaggaugaguauggucaagauauauuaaauguucagagaauuaagaaaaacaucuuuuaauaaaguagucauagaccaauugacccauagauagcuauaacuaugucucuuuuccaaacuacauaggugaaauaauguuuauaguuguaugauauucuuuccccuggacuaauuaggacauuccauggaccuggauuaaagauugcaguugguucuuuuaaacuuuaucucuaacuccacaguuuauaagaaacuagucuuuacugacauguuuaaaaagcccaaauagagacagucaaaugucuuaaccacugcguagucaucuuguagaacacuguaauuuauacaugugucuugagccaaguacacguaucaggaugaggcauuucugacucuguggccaucucuggagcugcccagaaaaggcuucuuucucucugucucggcugugugaaaggcugugcuucgugggguccucuuagcuugcagguaagagcucuaauaaugggucaccaggcacaguccacagccccagauucucuagccccagaagacuuguaagaugcguaauuauuaguauuucuaaaauacacguaauaaauacacacauaucuaaaugagcauuagaaauucuguauugagucaggcgugguggcucacaccuuuaaucccagcacucgggaggcagaggcagguggauuucugugagucaguccagccuggucuacagcgugagucccaagacagccagagcuacauugaaagacccugucuggggugggggaaaaaaaaguguugauuuacuucauauaaauugcuuuuagguuuugcauuccuuagucuuauaaacccagcagccgagaguggaaaauaugaauuuucaguauuuuaaagcaaaaguuugguauuuugaauguuuuaaaaguaucuuaaguuaugugucuggaagugucagaucuagcgucugacuccggcaucuccaccguaagugcaugccaggcuuaaugacauacugcaaccccugggaucaaggagucaucuuguguucagaccccaaaccagcuguugaaacaaugacaucauaguguaaugacacaacuggaaauucuaaaguugaacuuuaaagcaucaagcuacauuuaauauaggcagaaaaauauauauugcucuaauggugauuuauuaagauguccuguucuuuauguuuuuuuuuucuuuugcucugacagcuguaacugggugugaagguauuagccuuuuugucuguuaacaguaaucaagugguacuuuuuaaaauaacccgucuaaaauuuuuucuuuuaaaguucuaaagcugugguuauuuaaaaaauauuuucaugaacuuaaaaaaaaaucuuccuagaguauauauuagcaaauagcauuuuauaagaugguaccuuuuauugguauaauuuuuauuuaaaaucaugguacaacuauuuggaggccuuccagaguacaaggucauauguagcccaggcugagggucucauuagcccaggcagagggucucacauagccugggcuaaggaugucauuagcccuggcuaacucuaaccccacuacggacccuccugagugcugcugugugguagcgcauguggcuuaugcuggaggugucuguguuaaacaggcacuacaaacuaagccacgcccauccccaucccuccuuuguucucuugcuaguuuccaugcagucucauucucagugccauuuguagcccucccccagggccgauaccuguugggauggcuccuguucaguaccuaggaguaagagcuaacuuacuugagugaccuuucuguguuccaguagcauuuauaacaacucaggugccuaauacucaacaaacccuuuugaggcccucucacagcugagaauggggguucagaaaauguauguggcuaacugcagucucuuccugucuucccugcccuucccugcaucucuuuagaugcuuuaaugcauugagcucuuccuuccucauuuggcugucaguccuuucacacauccagucacuuugugagauuaggcaggcuggagcuuuuguuuuccucacugcuauauucugcggagucuagagcaaagccuggcacacagaagaugcucacuugcuguuugugggggggcugagaaggaggggggauaagagcccagcuccuccguuccauuaucuuuccuucccuuuacucccccugcacagaagccuucagggcaaagacuaugucagcccauucuuaagcugaccucauggguucuuaaccaugaccuauccuaaagggacuguuuggggcucaugagaugugcaagccuggugacccccuguacugguuaguuuugugucaacuugacagagcuggaguuaucacagagaaaggagcuucaguugaggaaaugccuccaugagaugcaauuguaaggcauuuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcucccugaccugcuugaguuccaguccugacuuccuuuggugaugaacagcagcauggaaguguaagccaaauaaacccuuuccuccccaacuugcuucuuggucaugauguuugugcaggaauagaaacccugacuaagacaaauugguaccagcagagugggguauuccuguggcaaccugaccauguuuuggggaggacuguggaaggacuuuggaacuuugggcuugaagauccauccguuguuaagagcucugucggauguuguguaggagcuuggaagauaauguugagaacagugcagaagauggaggccuggcuugugaaguuucagagggaaaauuaaagacucuuuucagggacauugcuauuuuggaguuugauuauucugugguucugguuagcugggacugaagaaucaguugugauuaacaagauaccagaacuacuaaagcaaaaccuuugcauuacugggacuauugaugcugguuagcuggaguuaagaaauuaguggugauuaagaagagaccagcaucauugaggugacaacuucugggaaguguuuucugaaagcacaaagaggcuguguuccagagauggccaagguuguacuccugcugcagcaggacuugguaauauguaagagucacccaggugguacugguuuugaaggcaugaagggaucaugcaaagcagcugaagcucggcacugugagaggccauggaaggccauuggugagggugcagccucaguugcaaaugaaggcccaggacugaaggggucaugcaguguuuuggagaugccaguaccaugagaugaccaccaagagcagcagcagcacugggguacaggcaucuggagccuagaggaugaugugugugcuacaaagggcauggcuggagaagugacccaagcccuuggaggagcccagaagaucgugaguuggaucccagacauuggacgguuggagauugauuuuugcuuuugauugugacugugcccugauauuuucccucuugaaggaagaaacuguuuuaguggagcccacaguuaagagacuuuuaauuguaaaaagacuuugaauuuuaaaagagauggauauuuuaaagagauugaaaauuuaagaauauguaaagacugugggacuuuuaaaguuauuuagaauggggaugaauaagauuguaaggguugaggcuuacuagugauguuuuugugugucaaguugacaaggggucaauuguacugguuaguuuugugucaacuugacagagcuggaguuaucacagagaaaggagcuucaguugaggaaaugccuccaugagaugcaauuguaaggcauuuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcucccugaccugcuugaguuccaguccugacuuccuuuggugaugaacagcagcauggaaguguaagccaaauaaacccuuuccuccccaacuugcuucuuggucaugauguuugugcaggaauagaaacccugacuaagacaccccccaagccacauaaaggcaaagggagagaagcagcugcacagaguugcccucugaccuccacacgugugcuguggccugcauaugcccccauacgugucguguacacaugcacucaugagcuuuaaaaaggaaaggaaccagcguucuucuuagcugccacugucacuacacacacgaacaugaaaucaccuccaguuccuuuuuauuguaauuaaagacaguuacaaacaagugccaccaauuuugaauuagacagauuacgcucgacuuuauuuugacagucucuuccugaauacuucccuaugacuuucucucccaugucuucacacuuccaacaucuccccaccguguucucguuucauucaacccucuaggcgauuguagcucauuacacuaaucugucuguagcucguucuguguuuuuaaaaugguucuacaaucuuuggaagcuuugauuccaguugccugcuguaaaguccaucuacgcaucuugugggcaucuauacugaucaaggaauagcaaguccagucucugaucucuauacaucuccauaggccucucauuccugucuacuugguccaucagaccugccauuugagcagccccaugcucaaugcuucauaagugccaggcucccucccuccaaacuaucuugacucucugaccauugccacagaccccucugcuuguucuuaucuguaucuuuucuaaagugcauuuguucacauuaguauuuucuuugaaauguuuugugaguucuccguuucuuuaugcaggggcuggcccugccuucaucagcauuucagaacucaugauuuuuuucagaccaguuuguauuuggcaccagaacacugugccccuugcacacaaaccuaaaucuguucugcuugucuccuuuguguuauugccuucccaacacuucuaagucccagcucaacagcuacuucuacgugacuuuaauugugcacgccccgucugcacugggauguuaggaacaucuggagagugggcauuaccuucgauccuuguguccacucugugccaucugagcucuggaugcacagcaacuccauacagauguuuacacagcacacaccuuugaaaagccaguucagggggaaaaaaaugccgggcgugguggcgcacaccuuugaucgcagaggcaggcggauuucugaguucgaggccagccuggucuacagagugaguuccaggacagccagggcuauacagagaaacccugucucgaaaaaccaaaaaaaagaaaaaaagaaaagaaaaaaagaaaagaaaagccaagccaagccaguucagggcuggaaagauggcucagugguuaagagcacugacuacucuuccaaaggucuugaguucaauucccagcaaccacaugguggcucacaaccaucuguaauaggagccaaugcccucuucuggugcuucugaagacagcuacaauguuaccauauaaauaaaauaaaucuaaaaaaauaaagaagaaaagaaaagccaucuuggucaucugaugugucccacaggaucacuauuagauaagagaugggagaaagguccuuaaaauguuugucguuaaaauguuuguaauuaugagacuucuauaagaaauuauauaauuuuuugggucacuugcuaaucagaagaggucauauuaaacaauuuaauaugugaauuuaugcuuauagauuauauaaagcagucuuguucgguuagauaacucuauggcaacaauguuguuugggauagccaaguaacucaaggaauggaguucuucaggcuacuuggggaaguaacggaguauaggggugggacaucugucagcgguagacuccagucaguccugugcuaaucuauaacuucaucguagacuaagcucugcugcuggacguuccuuuauuggaugcuucucuugguuauuuguguacucuaggucauagcuuuguaaaauauuaguuuauuuuaacaauaauuauauccuauaaguauuuuuagaugugcuuuucagaguaucguuauuuugauuuucaugcuaucccuguaggucuaauacugcgugcaauguguggaguagaauuuuuguacagauuaaauguuuuccaugucaaaugucaauacuauuugaaugaccacuuuagccuucuuucuuagacaauguuguauaaaaauguuaacuaauaauguacugcuguucagcaccuaucagugagcaguuguucacagaugcaucuucacugagaguccauuuaguaggaggaggaggaaagcaaagugcuuugacgaacuugcgcuucaguuuggaaugcuuucauuuguuuccuaaucaggccacuucaguucuccaucuuccuccuucgacgcucagggcugggguuagaggccagcgccacgaugcugccgcgccacgaugcugccgcgccacgaugcugccgcgccacgaugcuaccuucggauguuuccuccucuccuaggcuucuuuuuagaagugauucuguaaucaguagcacacccccacugcggcugcugcaguggcuugcagucucugaugcagugagagcgacauuagggucuuucauggagacaguggcucugucugagcacucacugcacugggguuuugggguuugaaugauguugacagugcugagcucugcucugaggucggguuccaugugcucugcaagauggguucuguucuauuuaacaugaaaacacugaacuuuggagugguaaauggugacaagagcagagacuagcucuagcagucugacuuagcaucuauacuacaguuguauaguaacucuuuugacaguuucagacacagcugugacaauucccccaucacccuuuuaucucccgucuacuccugcugaccccuuucuucuccucugugugaacucagugagggaaaaagcccagucuugcguaccauaauuuuuauugcccguucuucuguaaaaauguugcuuucaagagauccacgguaaagggaaauuccaagcaacuugagaaaagacauuuccuuguaugcgauccuuauucucagggucuccccuacugugugggaagaggagagcaugcgugcaaucagccgcugucugaaugccuuucuccuuugugcagguggcccggcagaucugcuccucauugcacaugugucacccgccaggaugucugugacucuacccucugcgaaccuugaggacugcucucagucccugagcaccagcuccaugcauggcggcaccgaauccucagggacagacaccuucugagcaggaggagagcagcacaagguucaugaagacucaugaaggcuuacaagguucaugaagacaugucacucuggcugcagaccaugucuguauacuguuggccuuugaacauauuuuuaggggaaauauuucuaauauauuauuaagacaaaaguguccuuugaauauuuaguaaggcuuuuaaauaaaguagauauaacucaacuaag

SEQ ID NO: 6688 - RNA, 1331 nt, Mus musculus
cuuuuguuuguuugucuuguuguugaacaaucguuuauugagaucccucccucucagccgcuacaaccuugaggucacuuucuccgcuuguagaucuuguuugcuaguuccaugaagguggaugagggcaggggcucagagcacugcucuuugagacuccugagaugguuguuacugucuuccucuuacuugaagaacacagucugcagauccagugccucauacagugcuuuuaccuacgccacuucuucuggguucuucugucuauaauucuccucuaagaucuggcgcuguuaaagaguggcucuuagcagacacuaaaacaucagccaagcugcauuuguuguccuggaugccaaugccgaccuuuccaaucacacugaggucuccaaagagaucaagguaguugucccggaccugaagaaucugcccaucuccaguaggaucuucagggcauuggcaugcuccugcugcgggaaauauuaaaaauaaaauaaaaaaaugaaccugccaucucucagcggggccaggccauacucccgagcuccugccaccugccaacuggacuauagggcucccaccgggccaacucccucagcagccaucucucuggagggguccccaaguucaucuccuuuccaugcaaugccccacacacuccacgaucagccaucucaacaccuaauuacccgguagaaacacgacucuuaaagcuuaauuauccaaucagauucauauaacaauaagaucacaauuuacaagaugccaauacaguaauuucagagccaauugauaacauaaaacuuuaacccaauuaucuaaccuugugaaaaucuuagcuacucguggauguuuaaaaccacgcgagaucaggaucuucuuccugucugucugccuccauggugauuccucggucuccccaauuccuagcuccgccucccuuuuccugcccaaucacaggccugccacugcccuaaugugauugggcagggaaaauccugcaaccugguccuucucccccaucaauguacauggcaaccgcuauaggcagguagaaagagcagaaagcugucuuguauuugacaauagauuuguaccucuuuucaguguaucugccaagauccacauggcccugggaugcugugaugaggucgagagucugccccaucucagucugaaaggaacucugcagaaagagcuccagcagguucagguaguagggcugcucccugcaguagaacuucagcaggcgguagauggaggcuuccagaagcagagcaucguugauggcauccaagccuaugccugcuucugauaccagcagaucugca

SEQ ID NO: 6689 - RNA, 1331 nt, Mus musculus
ugcagaucugcugguaucagaagcaggcauaggcuuggaugccaucaacgaugcucugcuucuggaagccuccaucuaccgccugcugaaguucuacugcagggagcagcccuacuaccugaaccugcuggagcucuuucugcagaguuccuuucagacugagauggggcagacucucgaccucaucacagcaucccagggccauguggaucuuggcagauacacugaaaagagguacaaaucuauugucaaauacaagacagcuuucugcucuuucuaccugccuauagcgguugccauguacauugaugggggagaaggaccagguugcaggauuuucccugcccaaucacauuagggcaguggcaggccugugauugggcaggaaaagggaggcggagcuaggaauuggggagaccgaggaaucaccauggaggcagacagacaggaagaagauccugaucucgcgugguuuuaaacauccacgaguagcuaagauuuucacaagguuagauaauuggguuaaaguuuuauguuaucaauuggcucugaaauuacuguauuggcaucuuguaaauugugaucuuauuguuauaugaaucugauuggauaauuaagcuuuaagagucguguuucuaccggguaauuagguguugagauggcugaucguggaguguguggggcauugcauggaaaggagaugaacuuggggaccccuccagagagauggcugcugagggaguuggcccggugggagcccuauaguccaguuggcagguggcaggagcucgggaguauggccuggccccgcugagagauggcagguucauuuuuuuauuuuauuuuuaauauuucccgcagcaggagcaugccaaugcccugaagauccuacuggagaugggcagauucuucagguccgggacaacuaccuugaucucuuuggagaccucagugugauuggaaaggucggcauuggcauccaggacaacaaaugcagcuuggcugauguuuuagugucugcuaagagccacucuuuaacagcgccagaucuuagaggagaauuauagacagaagaacccagaagaaguggcguagguaaaagcacuguaugaggcacuggaucugcagacuguguucuucaaguaagaggaagacaguaacaaccaucucaggagucucaaagagcagugcucugagccccugcccucauccaccuucauggaacuagcaaacaagaucuacaagcggagaaagugaccucaagguuguagcggcugagagggagggaucucaauaaacgauuguucaacaacaagacaaacaaacaaaag

SEQ ID NO: 6690 - RNA, 2492 nt, Mus musculus
ugcucaauaaacauuuauuucuuucuccuuugacuuuuaccccuuggcagaaaagcaaagauuugaguuaagaccaugauuuguggcagugugaauaaauuauagccaauuccaggaguuugaccugucucauuuugacagcgucuucuauuuggucccuuaaguugccauacaugucuuaaucauacaagcuuauuaaaacauaugcacaaacaaaaaacugacuuguuauuauguuagaaauaggaaguugcucaugcauuaagaucuugacacacaggaaguuugaaugaauaaguagaaaagguuccaagcuauuaaaauguccugcuuccugauuuauucauuuaucguaccuguaauucugaaagugggcgaaggagcuuuguuuccagggcccguguggcuuccugcagaggcauuaaagcaaggcuggaauuauucuuuccugcagugcagcugucuggcugacaagucaguccucggcugagauccucugaguuuuuaggccuguuguaucuauuuuuaugaaggcauuaauuuuucauugguaaaaaagcugagacugaagaaacauuguuguucugccuuuugagauggguuuguccuucuguacuuaggacucuaugacucuucaggucauuguucucagcuuaggcucugucccacacuucuuagacguguacuuucuaagguuccuguccuugcaaggacagagacaguaugcuucugggauaccgaggugacugugaacuacugugugcucucuuccugagugugcuuguuuuccguauguaagguuuugcuuuaaaaugcuuuuguaaagccgggcaguggggcagugguggugcacaccuuuaaucccagcacuugggaggcagagacagguggauuucugaguuccaggccagccuggucuacagagugaguuccaggacagccagggcuacacagagaaaccuugucuggaaaaaccgaaacaaaacaaaacaaaacaacaacaaaaaaagcuuucguagaaauguuaguagcauaauagugugcgugcuggaaaggacaguauucgcuggaugucuaaauagcuuccaaaaaaacgaaucaguacuggaaauggugaaagaguggauauuuuaacauuucauccaaauguacagguuauaaggacuauucuuagaauucauuguccuuuguaacuuaguaguaguugggcaauccauauauaugugugugugaaccugaacauuucaaucuuggaauuccuuuccaaauguagaaucaguuuuacacuugcuuugcagaaugucacuggcuuacggucuucaaaucaaugguguacuuuuuguuuucuuucagguauuuaaaccacguccgggcugcaucuccacaggaucuugcuggcggcuauacuucuucucuugcuugucacagagcgcuacaggaugcguucagugggcucuucuggcagcccagauaaccuguauuuucucauguauaagaucuggauuguggagccaaaccaagggguuugaaaguauagagguuuguaaaguuccagccccgcagcugcacagcacaccaccacugcugcugugcucagguguuuauugcagucuggaccaagcugagaaauguguugcauauagauucauggaagagguuuauuuuuuacuucuguucuuuagacagggaugaagaacauuaaaccucaucugacagaaaagaaauaaaugauuugccuauguuuggaguugacuuacacauuuuauaaaaaauaaagccugacuuuaugguacauuuuugugggauuuuuuuuucuuccuccuccuccuuguguuuuucuggaacauauuuccaaaugccuuuuugauuauaacauucagugcuauuauccaagucuauauuuucccuauaaaaacuucuuuuuccccuuaaugucguauugauagugguacagacaaguggagauguuucaucuuagcagcaggccgugucaagaaagcacaacugugauguggcucuuccucagcaguaagagucugggggacuguuuugagccaugcaaagugaggcaaaccuaaugugguucccagcugugagccacagaaaugauaaaccagagcaggccauuaaccugcuuuaauggcagauucaaagaugugagcuaauaaaacuuaauacaucaauggcaccuuucacugcuaaugugagcucauuuuaugaugagauguugagacuggaaaagguaccauguaagugaaauuucucugcauaaauuauagacugauguaguuuuccacccaccaaagcuucaagggauuuuacugugcuugugguuuuguguaguuuggguguguguuggucagaagcaugagcaucccagccugugugagucugucgcaugggccccuggguauggaacauaggcuuuuccaggaaauuaaaggauauucuaucaaauuucugucacaacaaaugcuaacuuuauggacaua

SEQ ID NO: 6691 - RNA, 66177 nt, Mus musculus
gcaccucucuuccgggcccgcgauuugcuacgagagcccggaagggccaagcccguagcuccgccucugaagccgcucagccggggcgcuugggguuaggggaagcggcuccgugauuuacuuagcagucggucgcggagcaccaugcaggcgucccggcacagcauccaagcggagccaggcugguacgucucugcccagcagccagaggaggcgguggcugcagacgaguggaguccguugcuaagcaacguaagugggcuuuacuggcugcgcuggguuccugugcgcuucgguaucuuucagggcuugcaagaggagccuuggacugcaggggacugacccugggguggggcccgaaccacugaccccaggcgaguuuggaauguggcagcagcauggagcacucagucaauagugagaggcuuggaacaccagcgggaugagccucgguuuugugacucaccauugcuuugugucauugucgccucugucuccucuagccuugugaggucuugcaagaacaucacacgauguuucuuuucuggauuuaaucauggggccaagggaaagaugagcuauaggcacuuuaauacucaagucccuguaagugaagaugaggagaggucucugguaaugugcacauugcucguccuuaaccuaaagccgguguagugggcugugugugcccgggggccccggagccucuucggucuugaauguccagccuaggagggccuugggcaugcuagaaaaacucccuaacucagagcugcuuuccaguccugccacuccacuuuuuaugaaucccuggacuguaacagcugaugguuugguuuauguugucccuguaagauauuccugcuaaucgacuuaauucauuaggcauauaaacaaaagguuaguuuauugcgguccucguacuugaggaagaagaguuagggacagaaguuccaugcugacacugggauucuucaggaagcacgugacugaggcccguuccuccucugucuccacccuaucuugaucucuugaagucacaaggcuguggcucccacugaagccagcugggcccugcaugggaggaaguaauuuuccuggaagacucguuuccuugaguugcaccaauaggucagaacggagggaaaggaacaaguguuauguccaaaugugcuuuuccuugggguaauaacuccuaugacggaaagcaacuugggaagggaagggcuuauuucaucuuacagcuacaguccgucuugaaggaaagucagggcaggaaucuggaggcagaaacugaaacgggagacccggaggaaauauugacuugccccuacuggcuugcucaguuugcucuccuucauccccaggaaggccugccugcucagggaugcccccaccuaaaacaggccgugucuuggccagucucuuuagggcauucucccaauugagauccccucuucuccaaugagacuagccuguguuacaugggcgaaagaacuagccacguccugguuaauuaguguucacacgauuccucaaguguguagaauggcucagcacacuuuaacuuccuuccucaggcauuuaauguggguaaaugguguguuuccaggaaccucacaggcagggauccuccggugcuuccuuuggucucuccgucuuuaacgugaugaacgccaucaugggaagcggcauccuugguuuggcguaugugauggcuaacacggguauccuuggauuuaggugaggccuguuuccauauuuugucaucacacgguuccauuuugauaaggaauuuugauuccagaaguuaccggucuacaauuucuaguuggauuacuucugggguuuuaaugcuguuuuguuccccuugugccuaucuaguucugugcuuuggaggaaugcucccuacagucaugcauggcuugagggggugggcauucauguaggaaccucaagaaaggaaccccggggcucuaagauagcgugggcuuuaaaacagcaccagcaaagcggggcucugguguaagaaucagaacccaagggcuuauagggcacaaaaaagaaagggaaggccacugagcauugucccuuuugggcagguuguugcuaggggaagcuuuggagauaagguaagugguuaggaugucaugugauagauaagcagcuuuccuggucagacaugacugggguccauagggcacaguggguaaggaucuagaaaacaaguuacuuuaggaauuguuauuguuuaacuaaaagggggagaggguaccaaguggaguagccauggcuaauaguucugaagugcggcaaugcuuuuucguuccugggugauccuuauagaguauacuuaaacaaaccuagaugguaaaaccuucuacacaucuauacaguauugccuguugcucauaggcuaaaaaaaucaccuaauauagugcaguccacgugcuaguauaguaaaugccgcagcaguuguaauguaaucguauuuguuuaucaacacaugcaaaaaagauccagugaaagaagaaaccuguuccuggauuggacgucgugcugagaggaacuggagaagucguuuuaagggccuuguguuuuguuuuucaauguuuugauucuuguuauaauagccuaaaaaacaaauacaccauauaccauauaaaacuuuucuuucuauauguccuuauuacauaagcuuuuuaaauuuaaucuacucuuauucucguauuuuccuuuuccaacuuuuucuuuaaaacucagacauaagcacacuuacuacccgagagccaggaucaguuuacacaccuugcucauggggagguguuucgggagcaggacacagcugcagccuccuugccugugacaacaaagccuuuucugaagccccugaaggacugguccugguaguugggagguagagacaggaagaucggggaauucagggucuuccucagccauauaaguucaagugagacccugcuucaaaaaacaaacaaaccaacagccacaacaauaaaaaaagugugcccuaaaaucaugauuuuuuaaaagaauacaguaugauaguauaauaaauacaggaaccgaggauuguauuacuucuucuuaguggauauucaguacuagauguaaaagcacguguugcguucaugauuauaugauuggcaaugcaguagucugcuuuccccagcuucaccgugagcaugaauaauguguucccuaugacacgaggacagccauguugucucugagacuucauuguuaacccagauaucacugugcaauacaggacugauguugauuuuuauuaaucuaaaaauguggcuaaucuaaaaaaaaaaaaaaaccacuuuguauuagucaggguucucuagagucacaaaacuuauggacagucucuagauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcagaagguggagcccagauuaaagguguguuccuuaaacucggagauucaaucuucuggaauccauagccacuauggcucaagaucuucaaaccaagauccagauaaggaucuccaagccuccagauaagggucacugcugagccuuccaauuccggauuguaguuuauuccaaauauugucaaguugacaaccaggaauagccacuacacacuugaucuacaauugauuuaugauuuuaaaaaguucaagcucauuugugucaggcuggccaaugugaaucaaaacuuaucagucaggcaaguuaaaagcaauuuuuuuaggugcaaauaaaauauccuucuccugucuuaggcugcuaaauaagacuucuuuaacgccuggagcccaacauuauguucugggcuuauuuauuuucaagaguuagucaugggccagugucuuaguacuguucuauugcugugacuacacagcaugaccaaggcagcuuauagaagaaagcacuuuaaaugggggcuugcuuacagugucagaggguaagcauugucaucaugcuggucaggguagcuggggagugugguaggcugcagacaggcaggcauggcaccgagcaguagcugggagcauacauuccugaucaccugcaggaggcacugaacaagcaauaccuccaaaccuuuccugauuuggucacccgcugcuaaucaagcauucagugagccuggugugagccugugagggcuguuuucaugaaucacagccagucacggggcugcuguuguuaacauagcuuuguauguucgaugcuuuacugccgucgcuggcuuccauggcugguguccaucucacuggccgcagacaugaaauccuucagacccagaucucugagcaucgagcaccggguccuggcgccuguuuagucaguagaagccaacuuaaagugcaaaaucucacuucaguuucuucucuuucuuccaaaugucuuaauaagcaaaaccgcuucuaaguagcccacucugcuuucguuggugucgucacacuguaauuuugugaggucucugaugucgguuuccugaaugcuugcuacuuaccaguaagucuuuagugccucacagagaggauuucugugccuuugcuauggugcacuagggaccuggguuugcuagaagccuaccuugccaggaucuuucggagaauaagcaggaauuacuuaugccauuuauuuucgcagcguuuacacggguuuuuagauuguauccuuagaaauguguuacuugcguuguucggggguugagcugggaagaacugcaugcuccauagagccuaggaaucgucaggucaacaguacaggcaaagccaugguuacagggcccacauagagccuaggaaucgucagcucgacaguacaggcaaagccaugguuacagggcccacaucacuggaaggagagggaguuggggaaauggggcaagaguaagucauugagacuuagaacaggaaaauuagucacuaaagggaaauauuuaaaucacugagugcugaaaugcagucagcagacagugcaaagugagggacuuguguuuuaaguaaaguuucuuucuuucugacuucacuuuucauuuuaaaagcauuucauuugacuuaaguacaagucgguaaauacagaacagugauuucuuugaugucugcagcucugcuucucagagacggucccuacaagcaucugacugaagaaaugacggaucaugaaaaagcaagcuuggaggaaaccuaacgguguuguuuuauguuuuaguuuccugcugcuguuuguugcucuccuggcuucuuacucaguccaucuccugcuugccaugugcauccacaccggugaguaacaccaugcugcucacuugacccagccucgugcauaagaaaugaaugucuccccucugaugugugagagucaaacgaaagcguacguauuuagcaagcacaaacaggccccaggcuuggaacuccagcaccaacacgccccaagcgucugguuuccaaugagcauauaucauuaaugguguggugauugguuuuguuuucuuguguuaaggacaaaagcugccauuguuuguuuguuguuggguuuuguuuuguuuccccaagaccggguuucuguuuguaguccuagcuguagaacuugcucaguagaccaggcuggccucaagcucagacccaucugccucugccuccugagugguggaaucaaaggugugccaccaccucccagagaaagcugguguuuugaucaccugcucucucuuagcuuugaauuaaauuuguguugcagcccaacacuagcuucaccucugcaagguggaacucuucuuuguucucacugguuuuguggcuuucagacuuacagaggcagcauucaugcuccaaauagauuuuguuguuguuuguuuguuuguuuguuggguuuuuugagucaggauuucucuguguaguccuggcugucauggaacucacucuguagaccaggcuggccucaaacucagaaauccgccuaccucugccucccaagugcugggauuaaaggcgugcaccaccacagcccagccaaauagauuuuuuuaaagugggauuauucuagggcccaaacaaaugagaaccauaaagguauuguuuugagauuuugagacucuugagagcagaguucuaaaacaaccauuccacuuuauuuuccuugucugugggucagaaaagccucuuuuguuguguuugauggacagauuuaguaacaaaucaccuaggugauucuuacgaaaaaaccaauuuaggauccagaguuuagagcugcagcuucuaccaguagcugggugguguugacaggcaggcugaccagugcuuuccucugccuucagggcaaauguacaaacugauuuaaaaaaaaaaacauagaaggcaguguaagguggcuguuaucacagcuuguuacugugaacucaggaauaauaauaccuuuaaauagcauuuauaaggccugccaggaauaucagucacacaauuucccuucuucacauggaaaagguucuuuaaaucaggauacuuccucuagcauuguaauagauucuuuugauaccugcuguuaaaaaaugaagacuugacucaacugugcagcagucaguuuuaguguaauuauucgggacuaguauuuaaauggauagaauuuuaaaaguaauauuaauuuuauccuucagagcauuuaaccucaauauccugacacuguuguuaacuaugggacacacgaagugagaacaccuguuucucuuuccuuuuccucuuuucuucucuguagcuugcuuggguccugaacuaaccucuccacggcucuccacucacacugcugcccugucuacaccgacugcucagucccuguaaggcgcucgcucaguggagguaugcucucucuugugcuccugugacugcagaauggugugugguuaucucccccucuguuggaaaagggguauuauguucacguuagaaucacuggucagaaaaaaaagaguuaaaaucuuucuaaaagauaauguuuuuguuuugguugguuaguuggcuuuugucuagaguuaaaaggugaagagaaaacuucauggguacaaaaggauaggaucuuuucacaugaaauuguuuuacuugaaauuauaagcagcauugcauuuugucugugggggcuugggaacggaggaggcacgucaaggugccaaugcccccagccuuacuucauugacugugcaauggucuugacaacacuuuccuccuaggauuguucugagaaugaagcaaaaccaugaauagaagauauaagaaugggaugaauagugagcucuuugggaaagaaucucaaagaacugcacagucuuauacaugauguaaucucagaagcacuggcugauggucguugugugaaaacacagcuuaugcucugggauuagaacaauugcccucccuccucuggccuccacaucaccuucagcagaugggacccaguguucuggggcaguguacugcuucuggcuccuccucccccacugcagcacugcacacugugcauugugcacuacaucauggccauugugcgccuucagagccacuaguuuaaugguagugcaguguuuaucucacgucaguaacuucaggaaucucguuuaucuccaucccccagacucugacccauggguucacugucuauucuauggccucaucuuuuacuguuuuccaacuccccaaaccccagaucaugguacauagcacuggggcaguagaugagcccuuacauccagaucuguaggcagcaggaaggaagaaagcuagaaggggccuggugugggcuuugucucuuagugcauaccuucuccaacaagaccacacccucuaauauuuuccaaagaauuucaccaacuggaaaccaaacauucaaauagugacccuaugggggcauucucauucaaacuagcgugguaccucugguuggccuaaaaagaaacuuucuuauuuauuuaugaauuuuauguauguaggugcuuuguuguauguaugucugcauaccacaagaaggcauuagaucauaagcugugauguuuuugcuuagaauugaacucagaaccucuggaagaauagccaguauucuuaagugcugagucaucucuccagacaagccuggaacuuccuauguaguccagacuggucucauauugacagaguuucaccuguucugccuccuaaguguugagauuaaaggcaugcccugacaugcccugcucucagguacuuucuuaugugcagugaaaacccaagccucuuuaagaacaacauuuauuaaguugauugugugcuccacaucuguaaccuaacaacugcaucagcuagauuuuugucaucuguauuagaggcuagcaaaaggaaacaguaaaagaugaaguggauuccugcaggcugcauagucaguuggcugguuagaacuaaucuugcaugucauagcaugucguaccaagagguacauagucugugccacuucccaccaugcaaaccuugaagcuuaauucuggauucugcauuugacucugggucauccuucuggagguagagcucaagugagacugcgcaggcugaggaagaggcacauuagcagaaggcuggcauggccaucuccucucacaccgauugcaggaugcuuuguauagaauuuguucugcccaaaauaaaauaccuccagcuacaaauaacuggggggugggggagcuuucgagaaagccauggcuucuuccugugacuaagccuguuagucagaagucgagcuuccauuuauccuuugagugccucacaguuugucaacagagagcuccguggugcgagacaguucagagaaugaucugugcuaaaacaaccacaaaagaaauacagaaacaacagugagaugccuucguaaauaugcgcaaaugacagauccaagucagugucccaacagaugcuaggaaggcugggacaagaggaaccgacuucucaggcacccuggaaggagaccagcaggccuuugugguuguuuauucuuauaaaaccauacuuguaccacagggucuggcaagcuuacuccucuuggcauuuauccaaagacuuaggucuacacaaaacuuacauaugcgauguuuauagcaguuguauuuauaaauugccaaauuuagggagugcccaaauacccuucaguagaugaaugcccaagcgaacagugacauugaaacaacacaaaauuauuuuguacuaauaagaaaugaagcaucaggcccugaagcggcauggaggccucauaaaagcaaauuaucaggugaaagaaaccauaugcugcaagagcccugcuugcaggugugcauacacagagugaagccagccucuguguguguguguggggaggguauaaucuaugcccauuguaguggcguuacucacaauggugaaacauagaaacacccugcaugccuuucaguugaagaauauagguaaagaagcgcugaucucuauguauuuuguuuggaauauuauccugccuuuaaaaacgggcuaaaaagggggcaucuucccagugacaggagcagagaggagccuggcagacaucaugauaacgaugaagugagauaaggcagacaggaagaaaaccguguguucucacauguggacacuaacaagagcaguuaagaagcaggaugagacuguuugacagggauacuggccgggguggggugggggagauggggaguuccugauugaggcuacacaggaugcggagucuggaaauaugaugcacagcaugcuggucguggugaauaucaagguuacuggaaauuugccaagagaauaaagaggggcagaaggggggggagguugaguggauaugauuauuucuuugaauaucauaguuucaauguauaucaaaacacguugagcacuuuagauauacauaauuaagcgaaagaagagaccaaccagaaaagauuguguaugauuuggucucagcucuaugaucuuaaaggaaggcaaaaccaugaagaguaaaggagucagcgguuagcagggguuaggagggaaagaugauugaacaggagacgauuuagggcagagggaaggugucacgugacagcauagugguggauaugcacucaucaagauccguagacugucugucuagugccaaaggggaaccuucauagcaacuguggauugguuuuguaugauguugacaggccagagcuccuugauaauaacagauguaccauuguauagcuggaagguagcguuguaugcgggcagacgguguaucacagccuuacacuuuauuaauuuugcugagacccuacaaacaaucuaaaaauauaaucuguuacagaaaagcaaauggugagagaaaauaauucaggaacaacaugaagaguagaaaugaauaauaaaagcccacaaggccucauuccuacauaaagaacuacaggcaacuaaggaauucggagagggagaaauaagucuuccccaacgaagaacacaccaguugauuauccaauaccaaauggucagccgcaaacauucacuaaagcaucauuauauaaguugagaagauugaauuuauguauuuaaaaacauauauguauaugcauauaccauaugaguauguaacaacaauaaaugggggaagaggccaugaguuugaacaagaagggguagaugagagggaggaaaggaaggugucuuagucaggguuucuauuccugcacaaacaucaugaccaagaagcaaguugggggguuuauucggcuuacacuuccauacuguuguucaucaccacggaagucaggacuggaacucaagcaggucaggaagcaggagcugaugcagaggccauggagggauguuccuuacuggcuugcuuccccuggcuugcucuccugcuauuuuauagaaccaagacuaccagcccagagauggucccacccacaaggggccuuucccccuugaucacuaauugagaaaaugccuuacaguuggaucucauggaggcauuuccccaacugaagcuccuuucucugugauaacuccagcugugucaaguugacacaaaacuagccaguacaaaagggauggggaagugauguugcuaacuauaauagcaaggaaaaaaauaguucuuaaaaaggaacagcaaacaagggucucuucuaaucuaggauaaaaacauguaaaauaauaaauaaugcaucuguaaaauaacaagaaaauaauaucaaaagguauccagaaaccacaagugccacagaaguuagagaaaacaagaaaaaaaaaaaaaagggaagaggagagaagagaaggaaggaaagagaaaauaaaauaaaauuacuuuuguagucggauuggaacacuuaauuuccagggauucucacagaaagaauaaacagcuugaaaaugagagaagagauuacuaccauaccaccuugaaugugcccaguuuucaccugaaaaugaaagaaaaaaaauuaaaaaguuagagcaguccaggagaccagcaugcaagugauagaacgugcacagaaggggauaaauggaaaggcagggaauuaucaacagaauaacacaaaagagcugguguaacagcuuccacaauaacauauucuuucuagaagaucauugugaaauaauucacaccaauuguauuguaaaugaugggaaagccaguuuuaaaagaugguaucuuaaaaguuuacacagaagagacaaauaaacagggaaguggcuguugguuagaagugccucuuaugaaagccuggaccauagcacccugguggcuguagcugccagccuguccaaaaagaccaggcuccagcuucggcagaaagugccuccaaggaaagaggcagauggcucuaggggaggauccucagcaguuucaucugccuuccacaugcagugugugcacccacggagaggugugagcgcgcgacauacacacaccucauauacacaaacaagaaaguaaaaaucaagacacaguaacaguuuuuacaggagcuguaaaguggacuguauaucagucuuucugcaauucuuggaaaagaugcuuguaaacuagaauuccauagccagccaaacuccugggaacgugguuucaguaaugacauuucauacaugcaaugucugagaaacaaucccuccaguaucuuacauaauaagcaguuuaagagugaaggaugcucgccagaauucaggaguaacagaaaugaggaaucgggagagaaggaaaggaaacucccaggucagcagauccaagcaccggugcgcguuucacagaagcauagcgcugcugccacgccauucugcacucagcauccuuugcaggguggcagcucuaauuuccaccaucugaccuugaguagagagagguagguagguacagaagucucagggauggaaucaaggcaggcagugugcagagccagcacaggagugacggccaagugcuaguaaagacgaaggagccaugguuugggccuugugggccacugggcaaggccacuaguggaacacagaaggcagaggugacucgagauuaaaaguaaguucaguuucgaauauauggacuuugaaguauguguggguggaauggucugagcucugaagcauaggauagagguucauugcuucgguguucuuuaucuguuagaguaagggaauaaucagagacaagugcaugagcagauguucaugcuguagugugccuaacauggggacuaggugagaagucugggcaagugaggaggaaagcgcggguaccguuggagggacgggaguuagagaauauuccuagaucacugggcugaaaaagcuagcagacacaaaagcauauccugagcauuauacgcaaugcacccaaaguaacugaccacugcuguugagcaagguguaaaggacaaaauuggagggaagauccugaagacuauauaaggauuugccuagggaacgagaacccacuaggauuauugaaaaaguccagguagagaacagaaucugccacuugcucuguccaaagagaauuuuggcucuuuuagaacgcaugauauagccuguaacuccaauaaagaguuuugaguccauuucucuuccucuuccuaaagaaggucacuggaggugcgugugcacauauaugugcggaggccagaggccaacaguggguguguucuucacucucccucuaguuuuuaaggcggggucucauggaaccuggagcucaccagcuucacaacuggcggcugagcccagugaacaaacucugagaauccaccuguccugcaagugcugcagcugcaggcacuagacccuauggcaagcuuuugugggugcugggaauccaaacucaggccucacugcuugaggggcaggcacuuuagcugaaccagcucccuggccccaagguuaucauucuccaugaugaccugaaacuccacucaugaugaaaaaaagauuuuucuauaagcucugguuucuucuuuuuuaaaaaaaguaauuucauuuauuuauuuguuuguuuauucacuguacauuggugucuaugugagcgugucagaucuccuggaacuggaauuacagacaguugugaacugcuguguaggugcugggaauugaacccagguccuuuuugaagagcaaccagugcuuuuagcugcugagccauuucccagccccuuuugcuuguuuuaaagcagaaggcuuuuaaucaaugauuggcagcccuggccuggacuuuacuuucuaggucgggcuaacuugcuaccugaagugacccuccugaugggugggguuuaggaguguacuaccacacccaaguaacaucuuaaccagguauuucccagcugcugcugcugucugcuaugaaauugccucccugacaggcugcauacugcccuuccaaggacagccacauuucuggaaccugugagugucaugucaaaagaccaggcugaccucgaacucagaaaucugccugccucugccucccgagugcugggauuaaaggcgugcgccaccacgccuggcuauauuacugauucuugacugggugugauuucucccccagagcaucuggcaguggcuauagacauuucugguucucaugaccagggaugggauggauggacauggugcuauuggccaccaguguguuaaggccagggauccuguugaacaucccacaguacacagacagcucuaucugauagagagcuacauggucaugagcagcccugggcuagauuguguguacgauguguguguaugaucugcucaucauuuuaccuaacguuagaguaagaacuuucuuugcagaagcuaagcuuucugcuuuuagguagggaagaauggcugugagguccugaagcauuccuuuuuauugauggugaguaugcauguguguguguugaguauggauguguguagcaugguacaugcauacaggucugagaacaacuucaugguuuucuccucucagcuuuacaugggugccagggagggaauacccucugaaccuucucacucuuccucauuguugucuuaaucagaaacuuacaugcuugagucuggaggaagggcucaggaguuaagaccacuggcugcucuuguagaggaucuggguucaauucccagcacaacacagggugggaauucaguucaagggaaucugaugcccuguuuuggucucugcaggcaccaggcaugaucacagugcacugacagaugugcaggaaaaacuucauacacauaaaauaaagcuuuuguuguuguuuugagacaggaucucuuuauguagccccuggcuguccuggaacucacuauauagacugcucuagccucuuaauucacagaaauccaucugucucuuccuuucaagugcugugauuaaagaugugcacccccaugcuuggccuauagaccccaguauauacuuauaagugugaggccaugcagucuuaugagauucuucuguuggcaguugccuuuucauguuuaaauuauaaucuccuauuuauuaagggcuuuuuucucacacucuucauuguaagcaguaaggacuuagcucagaugggccauauuuccccuugccucucuugauuuccauuucuacucaguaggucaucacugaucauuucauguauaacugcagaauauacagaaccuugguuuaguuuccauugguuggaaagcucuuuucagcuccugucucuccuucccauagagcauguucuucucuuaugccagcgguccucaaccuuccuaacacugagacccuuuaauauagugccuuagucaggguuucuauuccugcacaaacaucaugaccaagaagcaaguuggggaggaaaggguuuauucguuuuauauuuccacauugcuguucaucacuuaaaaaaaaaagucaggacuggaacucaagcaggucaagaagugggagcugaugcagaggccauggagggguguuacuuacuggcuugcuuucucugccuuacucagcuugcucucuuauagaaccaggacuaccagccuagagaugguccuacccaucaggggccuuccccccuugaucacuaauugagaaaaugccuuacagcuggaucucauggaggcaucuccccaacugaagcuccuuucucugugauaacuccagccugggucaaguugacacacaaaaccagucaguauauacaguuccucauguccuggugacuccaaccauaaaauuauguucauugcuacuucaugacuguaauuuugauauuauuaugaacugugauguaaauauuuuuggagauaaaaguuugucaaaggggucacaauccacagauugagaacugcugccuuacacuguccaagauagcauuuguuuuguauuuugugaugauuccuaaaguauucauauuaucuguagauugaauuuaaugggcgaaaaccagugcgccuguuaauaggcugugacuguaaauauuccucacugcacagcaaacuagucaagugggaauccagaaccuuccuaugcaugcaguauuucagccucucuuggcaacugaaagagccuuaguacccugucauucuguuuucuucuaauugcauggaaagauuguuagucaugucauaaccaguuggcacagugacacugaaguuuauauuaagaaagaucagaaguagucuuaaaacuagugaauauucaagaacuuuauugcccucuauacacuguuagggaaaaaaaagcaagaagaaaaugauggaaaacagaagaaagaaaagaauuucagaauaauaagaguacuuuccaaauggccaacuuucugagaguugaacuauguuuggauaacuugugucccucaauccagauccaaagauaauauugcuucugcugaaacuugggcucauaccguaaccagaguuuauuaauuguccuauuucauugaggaaaaaaugcaaagcagacaggcucuggaguaacuagcuggaagugcuccacugccucgugggaagcagcuuuccagggaugacuguggaggccagagccgugggccugaugggcguuaaggaaaaaguccucguguacuggagaagacucacagccucuccauuccuccaaaacacagcacugauugcuuuucauauaaaaaaaaugauuucuaaaaacacacugcuagugauuguuucagcucauaggaagguuugcuccaagggcuacuuguagaggccugcauuaauuauauauuaugaugucauuccuauucuguaggacuaugccacucucucauugguuaucaacacuuaguuuugugucucugaaacaucuucuuaauguuuguaaugcuguaaaauguaugaaggaaccaaaaacaaacaagcaaacaaacaaacaaacaaacaaaaaauuccuuugcuuguaaaucaagcagcaaauuacuuggcacuagaaaaauaaauagaauuucaguuuaacugccaacucucagguuucuagaggaaguggaacuauuucaguuuuguuggguuuuuguugugaagcagcuuagggggucuugcuguguugcucaccugcuuucaaauucuuauucucaagugauccuccugccucagccucacaaguaacuggcauuccaggccugugccaauacacuugacauugcaguucuuaaaaacaaaguuccgccuuugcuguacaagucauuauaacauauuugagcuccuuuccucaaaaaugcggaaagccaaaaaaagugacuacuuucucacuguuuacgugucuacuucauggauuguauuugaauccugguuuucuuuuucccaauuaaaauaauaugggcauuuucuuguuauuauaaaugggcuuucaugguuguauuauuuuauuaguuaucaguaccaugauuuacuuaagcaccuuguugcacguuucgguuagcccuguguuuccaguguaaaucauggcaugauuaaauaucuagugaggucccugguuuuauucuuaucuccuaggaccaaaucucccagggucaaauuuaaaggguggccgucgucguucagacugcaucccgaccaucacuccagucucugacucucaccagcauguagaaacagcccaagccacagaagagagcuuggaaauugcuucccagugcucuuugguucacuggcuaagauguggagaaagcacuuggcuggcuguguccgaauuucauuuucacaaagccucaaagcaaagccaaaagccauuauucauauuccugaugucucaggcaggggaaagugcuucuaauuuuugcaacauaaaagaggcccugaugacagugacagagcugagcaggacccagaccugcugacgggaaagcuagauuuagggcuggagcacuggacccacccccagcuaaaagcccagugccuuuccucuuucgguuugggacuuugugaugcuuagagauauuuuaugacacugaagaaauaguagaaccagagggcaaguuugagauugcacaacuucacaagcugcagcuaaaacugucuucauuaagcgguuauauucgcuguguuuucuggcacaagcaaucugguuggauuuuaacuuuuaaaauuuagaauuaauguuuacuguuuaaauuugauauugaaauaccugcucccuuuagaguuuuucaguguguuuuuuuuguuuuguuuguuuguuuuugcuaauugguauuuguuuucccugcuucccagauacacaaacaauuaauuacuuuccacugcuuaaauauaaaacaaggcuggcauguagaacaucuauguagcauguaaaaggcuugaauccaguacccuacacaaacaugaagcugacagacauuuguuuacguacugacaaacaaauacaaaagaggucauuugaaaagcaaugacacuggaagucugacacuggaaaaccucauugcuuuaaguccuuaaaagaaauguuuuucuuauuuauuuucauuuuaaaacauggucuggugugauuuuucaguugccauauuagaucuguucagauuaacaugcauauaugcuccuuugacaugauauuauaagggaauuaaugagcuguuuaacuauuuuauuuaugagaagaaaagaauuuugguuucaaaagaacuugacccuaggggaaagauugauuaucuccuagggaauaugaaagugaauuuuaguagaagucaucuugagguagagcauuugaaacaauguacuucaaaugcucagaucacgauagagggcuaauauccaauauauacgaagaacucaagaagguagacuccagagaaccaaauaacccuauuuaagaaauagggugcaggccggguguggugacgcacaccuuuaaucccagcacucgggaggcagaaacagguggauuucugaguuugaggccagccuggucuacaaaguaaguuccaggacagccgggacuauacagagaaacccugucucaaaaaaaccaaaaaaaaaaaaaaaaaaaaaaaaaauagggugcagagcuaaacaaagaauucucaacugaggaauaccaaauggcugagaaacaccuaagaaaauguucaacauccuuagucaucagggaauugcaaaucaaaacaacccugagauucuacuucauaucagucagaauggcuaagauuaaaaacucaggugacagcagaugcuggcaaggauguggagaaagaggaacaguccuccaaugcuggugggauugcaagcugguacaaccacucugaaaaucaguuuggcgguuccucagaaaaucagacauaguaccugaggauccagcaauaccacuccugggcauggcauauacccagaagaugcuccaacguguaauaaggacacaugcuccacuauguucauagcagccuuauuuauaauagccagaaguuggaaagaacccagacaucucucaacagaggaauggauagagaaaaugugguacauuuacacaauggaguacuaugcagcuauuaaaaacaaugcauuuaugaaauucuuaggcaaauggauggaucuagaggauaucauccugagugaugaaacccaaucacaaaagaacacacaugauaugcacucacugagaagugguuauuagcccagaaaccuagaauacccaagauacaauucacaaaacacaugaaacucaagaagaaggaagaccaaaguguggauacuucaaucccucuuaaaagggagaacaaaauacccauggaacggggcuggugagauggcucaguggguaagagcacccgacugcucuuccgaagguccagaguucaaaucccagcaaccacaugguggcucacaaccauccguaacaagaucugacucccucuucuggugugucugaagacaguguauuuauauauaauaaauaaauaaaucuuuaaaaaaaaaaauacccauggaaggaguuauagagacaaaguguggagcagagacuugaaggaaugaccacauagagacugccccaccuggggauccaucccauauacaaucaccaaacccagacacaauuguggauaccaacaagcauuugcugacaggagccugauauagcugucucuugagagguucugucagugucugacaaauacagaaguguaugcucacagucauccauuggacugagcacaggguccccaaugaaggaacuggaaaaaguaccuaaggaucugaagggguuuguagccccauaggaggaacaucaauaugaacuaaccaguaccccuagucccugggacuaaaccaccaaccaaagaaaacacauggugggacucauggcucuagcuacagauguagcagaggauggccuagucggucaucagugggaggagagguccuugguccugugaagguucuaugccccaguguagaggaaugccagggccaggaacaaggaguggauggguuggugagcagggggaggggauaggggguuuucagaggugaaaccaggaaagagauaacauuugaaauguaaauaaagaaaauaucuaauuagaagaagaaggagaaggagaaggagaaggagaaggagaaggagaagaagaagaagaagaagaagaagaagaagaagaagaagaagaagaagagaaaagaagaggaagaggaagaagaagaagaaaagaagaagaggaagaagaagaagaagaagaaaagaagaaggaggaggaggaggaagaagaagaauaagaauaaaugaugcucggaucaucacaagaaugcugcagucauaaaaacuggguuuuuacugccugcaucuccucggcccucccuguacucucauuuugucuuucuaaguuugucucacuauaugcaucacuacaauuaucuuguuuaauucuauuuaauuuagcuuaaguuuacauagaugauaguauugcguauuuauggaauguugaugaauucauugaauaugcaguuuaagcucacagcuguaucuaauaagauguaaguguggccaucauugagaaagacagaaaccgugaccggcauugcugaugagucaccauuaugucugacuagacagugacuaaagggggaaaggcucagagaauggggguguuuaucauuggaaaaccaggaauuuguuuuucaaguaguaaggcauuuaggucagguaauuuuuauaaagugauuuaaaaaaaaacaaaaaacggacaacauagaaauguuuuucuuaagcaguaauggaagucuggagccauggugcguagguuccugucaaccugccagaaacaggggcugucagcccaguuuucuuaacguuuaagagaccacaccucagguuuggucuuuggucucucuacagaaaagaauuucuguucaaaccaguaugaaccagaguuggaguuuauuaaaugacauuuuuaauauaaacuuugagcacaagguugagagaaagaggcugcuaugaaacauggcacaccugagcgagagugugggcuucccuaggccugugugaccuucauaacugugugaccuucauaacuggccuacucagauaaaguauaucuucaguacuaaacuguauauguaugcuauguuuaacaauucaaauguaaaugcauuuuuaaaacuagauauaucacucaaaaaagauuccaagucccuugaaccuugauaauagauuguaaaaaauacccuuuuauuauucaguauuccacuguuuucuuccugguucagaguuacuauauggaauccaccuaugauuuuuaaaauguuuguuuuuauguaugugaauauucuucauucuaaacauacaaaaggauuuuuuguuuuuguucccaaguggcaguuggaaaaagcccacauauguccaaagagaugcacuaaaacuggcuuuaacuaguccgugacuaacagaaaguauauauggcucucccaagccuagugucucccagccugcuucuccucacuguaagugcuaugggcuuaugcacuuccuggacuagagagccucaugaacuagguagaacacaggcugucugggcagaguguaacgugacucucuuacaagccuucucauuuuccucuguauuuaguaaccacacuucuugagcacaaugaaaugagaauguaauuuaacacucuuaugaugagaaaagaaaauaugugccccacuucccaacuguaggauaaaggcacuguuacuauugugaauacauuaucuucaaucuaagcucuuggaaaggcagaugucccugaaauuguggcacaccugucauaccucauguccaauaucuagaaauucuugcuggugacaauuucuguuuggauaguguguauccaaguacaugaguccuguauaugcaaacaaggugaucucaaggaaucaggccacugaauucacguaggcugagaagucuggacuuguaacaucucccuauuguaguagacucuggcuuuacagagcaugaaccuuuaaagguuuuccccaaaguuaguaccgcugcucuauccaugauuguaagguggcuagaccccagccgcuaggucucaguuaccacuggacaguuuuuccugcuuuugguauuucagaacauuuaagagaaucccaggucuccccuagauggccuacaagaugagagcuaccagaugccucucaguugguuacaguauuagugugcugacauugcuuuuuuuuuuuuaccauaguuagaaacuuaguaagaauauaaaauaaccauuaauauggacauuuaagaaacagaaucaguaugugagauacacuagagaaguauaauaaaaugaauccuuagggaaucuaaaaacaaaaacaaaaccaagcugugugugugugaguguuuccccugcaugugucucugugugccauaugucucugugcccucagaggcuggaagagaucaccagauccccugaaccuggaguuacagagcugugagcuacagacccaucacuauuugucaaagacaaauucugcaaaaaacaccuaaaucuugggcacauggguggcauuuagaguggaaauuaacuuuucaaaaagaaaacucucaaaggccuugcaagaagcagcuaggccuuccuccuuccucuaccuucauccaggagguccaagcgaccccuaguccccacuggcugaagccgggaguggcacugugccuagccuaagagaaguaaccuucccaaauaguuuguguaaaauaacaauuguacuuugucgugacagccgugacgucuuacgaagaucugggacucuucgcuuuuggauuaccuggaaagguaauuucacucuccccucagugugucuagagccuaagcagcauuucucuucugcuucauguucagaaagacauauauauaugagaaggaccuuaagagauugagaggaaacgaaaguaggaagagacggaacggugggaacugaaaauauggaaacaucugugguccuuccgaagcccgucucuaaaccaguucaguucuaagucuugcugcccaccugaugaacugcagaguaguaaugggggccguacaguuucuuuauucguuucggucauauccucugaguaaauccauaaaagggaaggaaacaacauagaauuaaaauuauagcaugcccauuuucaaaagcaguaauuagguaguauuuuuaaaagcugaacagugcugaaagauucccuagcugucccauuguuuacaugugagaaaaguaaggcuuuuaagaccuguuaccaauuguuacccaauacugguucuauaucugaggacuaauagaugcuacauaugcugguucuccuuggaauaauaaauuguauuuggcacugguuuccaauagguuuucuaacuauaaaguuguugggaaacacugucccuagaggccaccauagcuaagcauugcugauagggaacauuguuccuagagaccaccauagcuaagcauugcugauagggaacauuguuccuagagaccaccauagcuaagcauugcugauagggaacacugucccuagagaccaucauagcuaggcacugcugauaguguuacuaugcuuguguucuuuucccugucucaagagcuguuauuagacgcguucucacgaccggccaggaagaacaccacagaccagaaucuucugcggcaaagcuuuauuucuuacaucuucaggagcaagcguguaagaagcaagagagcaagaagcaagagagcaagaagcaagagagagaagcaagagagagagaaaacgaaaccccgucccuuuuuaaggagaauucuccuucgccucggacgugucacuccuugauuggcugcagcccaucggccgaguugacgucacggggaaagcagagcacaaguagucauaagauacccuuggcacaugcgcagauuauuuguuuaccacuuagaacacaggaugucagcgccaucuuguaacggcgaaugugggggcggcucccaacaucucccccuuuuucuuuuaauaagagcaaauaggccacccauauuaaugagaguggagauagaggucaaauccccaguguguagguaaaggagccauguacaggauuagcucuuaggcuuacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccuugcaacucucucgggcugcugaagcacacucacucuaucccgugcaaugagucuagccucaugggauauaagagcugaguggccagcgaccuauugccuaagcauagauauaucaggggaagcuccauguucuaguccugcaagcgccugggcaauaaccaccuugucucuccuaguuugggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagcgacagguccaagcgcguggaguugaccugaagucucaauucccgaaggaucuguucaaauucagccauccaauucuguaacauauacugaaaaagacuuuuugacaaauuagcuguccuaguaaauuuaacauacugaauggaaauaacacacaaucccggaaacuuuuguucacaucccugcugaguuauuugucauaauacaucuaguuguaucuggacaagaucuaugaguugauuaaccagcaugagaccucccuguaucuugacauuagcugaggccuguucaucuaugacuguagucacugaggcugacaaaguguuaauggugucagucgucuggaccuguccagacagagccaaggcugucugaauuaaggccaaacccaguuccuaguuagugguaaaaaagcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguacccaaaauggguugucuucauucugugggaaaacacagauagcuccccuggaucuuaucaaaauaggauccgggccauaccauuuauuaucaaggacauuuuuccauuuaaccaucucauugggccuaucuggcucugaacaaugacguucagccgcaguauggccaugaacaucaauauuuaaaaaauugaguguaaagagugccaaagacacagacacucuuggugcucgggguacagucuccucaaaaguuccccucuucuguuuuauaagauaggcuuugagggugcgaugcgcacgcucaacaauacccuguccuugaggguuguauggaaguccagucagguggguuacguccaucugacggcagaacuguuggaauuuuugagacguauaagcugguccauuaucagucuuaaggagucuggguuucccccaagcacuccaugccucaagacaauguugaaucacaugugaggcuuuuucuccgguuaacggagaggcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuuaccacauaacaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaagcggcugccaagguuugaaccugugcagcgguauaagguacaauuaaaagauauggacuuugcccaaagugggugauugcugcuuuuagaccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaagguugcgaauccucaauacguuguaauugugcauucuguaaggccuuuucuaccuuuuguaaggccugguuagcagcuagaguaagagcccuaggggaggagauaugaggaucuccuucuaaaauacuaaacaaaggccuuaacucagcggaaggaaucuuuaaaaaaggucugagccaauuaauaucucccaacagcuuuugaaaaucauuuaagguauggaggugaucucuucuuaucuaaacauguaaauauugauuucucucaaaggaggaaauaugcgugacauccaucugucagaccuguaauggccugagccacgaggguuuaccccuacgugaguagauaaaauuugacaacaaucuaaaggcauuauuaaguaaucagaaucacuuucaguagaaccaaucccucuggcagcucaaggaauaccagaagaagaaaaaacagccauguaggcuuggcaaaauuauuauuaguugagcuauucugucccuuugugauauagaaaagacaacuugaggacaagaacagagaaccugaaguuccccuuuacaauucugaucuacaacuccaggguagacaauaagaccuuguaggcugcaagagccugccucugucauuauuguccaguggcuucaccugcucgggagagcgccuuccaggcccuaauagccuuuucauuugauucagaacuacuaaaaacuggcuccuugagcucaucuagugaugaguauaggcuccuucucuuagaagccuccgcugauugaucuuuuuucuuuucuuuuuccuucuccuuccuucuaaucucuccccagguauucuuaccugaccuaaacuuuuccucagguucaagacccuuggaaaggccuguauacuuauuuugugaaccauauuuucucuuugcuccuacucucucuccccgcuuuacuucugauagcuuguccugaauuuccucuagaauuuucagcccuaucuuaaucacuugauaacaugugaaaaggaacaaaagggcuucuaacacuagagaaaguuuaaggccaagcauaccucguaaagccauuuuccacuuuacuucugauagacuguccugaauuucguuagaaaguucaaggccaggcguaccuuguaaagcuauuccccacuuuacuucugauagacugucuugaauuucguuagaaaguucaaggccaggcguaccucguaaagcuauacuuacugguauccaccguuccccagcugaaaaguucugaauucauguaguugaauccuucuuaacagucugcuuuacgggaaccuuuauuaccgcgacccgcaguucugguucuggaaugagggaucuuccuugcgccagucccgaguuuuuucucgucccggaauucggcaccaauuguuauuagacgcguucucacgaccggccaggaagaacaccacagaccagaaucuucugcggcaaagcuuuauuucuuacaucuucaggagcaagcguguaagaagcaagagagcaagaagcaagagagcaagaagcaagagagagaagcaagagagagagaaaacgaaaccccgucccuuuuuaaggagaauucuccuucgccucggacgugucacuccuugauuggcugcagcccaucggccgaguugacgucacggggaaagcagagcacaaguagucauaagauacccuuggcacaugcgcagauuauuuguuuaccacuuagaacacaggaugucagcgccaucuuguaacggcgaaugugggggcggcucccaacaaagagccacuuaaccuaugaguugccucccacacuuguucucccguuuguaaucuaaauggaguccaucuuguaaauggcuaaacuaguuucuaagaaguaagucucagagggagucacuucuccccaaugggaaggaaguccaguucucauuacuccugggguguagagggagcacaugagccuuagguaacaccagggcuuucaucuucauaaucuaaauagacagcgcgcuacucgagggcaaaggcuuuagucaggcguccccaagaacauuuucuuccuagagagcagaauguuuacccuaucucugguucacuuccuaagaaaagaaugaagaagaagaaaaugugcauaagacaaugccccaggucaggacccgaguucagauccccagcacccauggaaaaccuggacguagccaaauauuccuguaacccccgugcuaagggagagugcagaaacggguucucaccaacagcuagcucuaaguccagucagagacuguccccugaaaccagguaaucaccugcaggauacugcauaucccgcacagcauauguacuucaucaccaagcacaugggugcaugcguaugcauacagcagggcacacaacagcugaagccauaacagcaacaacaaagacacacccugguugaguuaaugaccuguagguguguguccuugugucuccgguggcacucugccauuagcucacaguaguaguucccucaucccugcaucucaucagugcagccugagaguguaagccguggagucugucacuguuuacauagguguccauucuaaguaagcagcugcacugggcagaguguacccagagugaggacuuguuagauucugcuuguacuuugucccuauucuauuauugauccgaaauucccauuuucuucccucuggcuaugaugugugguuggauaauaucauuuucagaaucaaagaaaucguuuuugaaaaauuuaaggaauguuuuuuaaauugucuuuaaauuuguguguauacuuuucagaugaguuuauauugaguagugcuaugccauauacuguaguaagcacagaaaaaaauauauaggcagacauucauucuggcuuucuaaacauuaaauaccuaauuuuagccaaggaauggagaagggguuaguucuaagaugcuguauuugcaguauauucauagaaaauagagguauuuccuguguggccgguggguuucauuugcacugcaagcgauacacacaaagucagaacuaucuucccacaaacaacuggauuucuaggaacucauuugagcugaggugcaagcugccuuguagaaaacucagaguggccgugaccacugucuuaggguuacugucacugugauagaacaucagaaacaaacgcagacugggaggaaaggguuuauuuggcuuauacuuccaggaaacaguccaucacugaaggaagucagggcaggaacucaaacaggacaggaaccuggagacaguagugaugcagaggccauggaaggguguuacuuacugguuugcuccucguggcuugcucagaaugcuuucuuauagaacccagagccaccagcccagggauggcaccacuguaggugggcuaggccugcccacaucaucacuaauuaagaaaaucccugcaggccugcguagcaccauguuacagaggcauuuucucuguuucaccagugacucuggcuuguaucaaguugacauaaaaccagcuaguacaauagcaucucuggaaggcuuaccagaguuuuagaucuuuggccuuccucuucagacugcagggacucuaguucucacuaguuuccaggauaggcagagcuugucccaggaagaauucccuguagaggugaaccuuacgugugaccuguccucggucuguggaggccugcaugauucaagguagcuagucagcuccaaauguuugcugguggucacagcccagguguugaguggucaggaggcccaagacagucuaauauuuaaacacuuccucucgguucuccagggagcucauccaaguccagaaacaagagccaacaacaggcagcuuagucauggacauacuuuaacucagaucuuuuuuuauuguuagcccauugcagacuuucguauucuguuuguuuguuuguuuguuuguuuguuuguuuguuuuucaagacaggguuuuuuuuuguguauaguccuaguuguccuggaauuagcuuuguaaaccagacagagauccacuugccucugccuccugagcacugggauuaaaggugagcuaccccugccuggcucaacuuuuauacucuugaaauugugaaaaucacuuccugguuuacuaaauccuagaugauguggcaacauuggauccacuuucucaagugucugacuggagaggaagacuggguaggaagcagagggaggggccuccagucacuguccucaccacaccugcugcuuuacacuuaguuuauuucacucuuuaaguuugaaauauuuugcuucaauuuuccugcucugaucauuauauccuagcguuuucuguugugguuucuuuaaucuuugagacugggauguccacaggacaagccgcugucagaagacuuaucaguuccuuuauguacuauauauaguguuggcaccacccacuccaaucuguuuauggagauauuaaagggagacuuuuuaaauauacauuaauuucauguaguacacugggucucaaucuguggaccacagccuuuuugggaguuuaacagcccuuucgcagggaccaccuaagaccauuggaaaacacagguaugugcauuacgauucauaacaguagcaacauaauggcaugaaauaacaaugaaaauaacauuaugauugggggucaccacaacaugaggaacuguguuaaagggucacagccuuaggaaggcugagaaacacugagguaggacaaacagcugauaaaauuaauucuuugcaaucugucucuuuggucaugaauucugcaucuaucuuuguuggauuugauauuggacuuuaauaaaaaucuuuccuuuucuacuguuuuuccuuuuaucuucugaauauauuuguucucuucuagguggugguggcaggcaccauaauaauucagaauauuggagguaagcauuggaagugugucauguauacaacaggucauggaaaucauuguuuuccuggcuucuggccuuccugcuggucuagcuuggacacuaaaucucuguagacauagccaucuucagaagucucuuuauuugccuccugcucuuucuuggauccuuuuuaguaucagugguaaacaugcuaauguccacccuagccaggucuugauuauaguugcccuaugucuacagugcacucauuaguuuucaguggcugugguggugagagggugcaguuuggaaaugcucccaaagugagaauugacuauuuuucuucugcauucacccuguuaacccacucacaggugcccuguuauagggacuggagcccugugggcugugugaacagucaggugugcacaauguccgcuagaagcuaagacguuaggaaugaccaaguggcuucuaauaaaucuaaggacaagagacauucucaauuuuaucuuuccucuggucucuacuaaaaacugauccuacaaaugauccuaauuaugagucuguguuagaaaugaaaauuacugcuaauuauagacaguuggccgaauguauuaaacauuuaacuccaaaguacagaaaucgcuuauacaugcuguaaagagauuucauagagcugagcagcaucuucauuucuuuuuaccacuggugaaaugcuaaagaaauacugucaguguguggaaaauccacagggaaagugaugugaacuuugggucuuacacaaguuugugugcucacaaguuuuaauagucuuauauaauuauguaauugaacuuaagaucugagcuauuucacuguaaguauuguucaacuaaacuguaccuuuaguguuuuaguuguggggaaggagcgucugaucaaugaauuguuauggaauccugaauguccacauuuuaaugcuuugaguuuucaugaaacagugacuucguacuucacuccaaaaaccaggaaaacuaacuucagccuuugggaauuuuuguaguacaauugcuuucaagauuucuuguagaauaauuucuaguuagcaaauauguauugcuuaacucugcuuaguuauaauucuucugcaggcccucauuaagauuuugugcagauugaauugagcuauuguugaauaauuuauguugaagauuuaguuagggaauuugaauccaagcuuuaaucucagcgugaugcccacugucuguuuccuguaguuuuaacggcagugaccucuguuucucugaccugacuuagacauggcugcuuuagcugcucuuucucugaggucaucggaaguggaaacuuaaggguucuuuggaaaguugguuggaugauguuuugcuggggcaaacacgugaaggugaaaagcuaaggcagacuugugaaggaagguuuaacugaagcagacacaggagagaggauguucugcuaaagaaaggacacaugaugaaggauucuuugcuaccaacacacauuuagguugcauaguugaguuauauuuguugggacaccauagagagaaaugcaucaaaaaacuucuaguggcaugcugcaguuucuugccauuucagcuuccgcuuccguuucugaagacuccggcugauuggcagagugaugucagcugagacaggagcaugagcugaggcaagacacaugauguuugaaggguauaaacaggacucugcagagugacagagauagagcuuggcuugcuuauauagcuagcuguagcucaaaucuucgcugaucuucgcuuugcugagagaggcacagcugagaacuucuccuggugucccucugggucccuccugcugacucaagccaaggccaaggccuggcugucucugcuaggucaugucaccaauauugcuaacccuagucuacugaacuggacugcugguguauccaugaaauguuugucaguggaucgagcugccacuguuaaccugugaauugaacugcugauuuccagacaacacagacaggaguugcuccaaaaaacuuucuaaauagcuccacuucccccauauccuuucuuuucuacuaccucuggugggugguggauuacaagggagguuaaaacauuuaaaaagccaucauuaaaaauaagguuuaaaaaaaucaucuccaccuguacucaucuuaugugcugucaauucuucagcaguuauggcccauuccucuuuguacuuccagcacccaacagugucugcagcuuugcuggaaugagaggcguuuagaugaccaguccucuagaucuaagcauuucgaguuagagagauggcucagugguuaagagcacugacugcucuuuuagaggacccagguucaauucccagcauccacauggcaacucagaucuguuugcaacucaaguuccagagggauuuuaugcccccuucugucccccacaagugcuacaugcacaugguacacagccguacgugccacuagaacaccaaccccccacaccccaaaaaaagugaaaauaagaggggacuggaggguggauagauuaguugguaaggugcuugcugggcaagcaaggauccgagugcagguucccagcacucagacagcccagugugacgauggauaccuuaacccagggcaggagaagcagagaggaggcucuugggacucuggccagcugacauagcugagucaguggcagcacuuugaguggggagccugucucagacauguaaguuaaagagcccaugucaacacgggcacacgcacauacacaugugcaugcaugcaugcgugcaagaacaaacaacaugccagguccuucaguagugucaaggccaaaaguaaaagauaaagaaaaaaaaaacuagacuaauccaguuuuugguuuuuuguuuuuuugggguuuuuuugagagcaaaauugguucugaugcaaacaaguccacagagaggcuaauuuaaguuccuugucuaggauacucuugcucguucguucuguguucuguaacagaauaccauugacuggguaauuuuuguaauaaacaguuauuagcucuuggaggcucgaaguccaaaaugaaggaaaccaaguugagugagggcucuuuuaccagaucaaauguggcgggagccuucaggugcucacauagagcacuguugucagacuuuuauuuuuguuacaauggggcuaaauccgugugugaguguggagucuucccuuucccauccuuacaugccaccucaaacacuuuuuccuuuugggacugcuuccuacuggggacacugucagacuuagcacguagcccugccauuaagcugugugauugaaguggagaugacccaccaccuuuuaaaaaguguucuuugucccugaaaacaucccgaugaagcugugugggcagcccuuugaauggggugggggugggguucuuggauuuggggugugaaccaucaggucucugcguucuuacggcugguguucgcuugcuuguuuuagaacuagauagaaaagggcaacuuagaugccacauuuuaaaugcccuuacguucaggaaagcuaggaaugcuuauuuuacagugauggaugcauuauuuuagucacauuacuugaaagcugacuuauugagagccugugaggaauaaguaaguggcagcagguuuccagagacuucagcccucagccaacaggcauaaauuauuccuccuuacaauagaauuugaagcuuccucuugucaguagugcacugggucacaugucagaugccuuguguucugucaccuccagccuuuggucaaguaggcacaugcuucaaggaucucccucucccucucccucucccucucccucucccucucccucucccucucccucucccucucccucucccucucccucuccccccccucauucucuuggcuuuaguuuugccuuuguuaaaaauuuuggugggaaaugcagagcuuggaaucuguuuucaucuagaaguguagauucugaugugguucuuggggaaggugccauggcaugucaauucuuuuaggcauuaauggggcagagucuguauuuuuaguuaggugucaugucuuaaagcuuccuaacucuuucagucucucccccuucccuuuuuguguuacagguuguuacugugcagucuagguuagccucugagucuuagucuuucugccuuggugccugggcacugggauugcagauguucaccacugggauugcaggaguguaccacaccuaauauauuaguuacuuuaccuaaugcugcaaccaaguaccugagcaggggcuuuaucucugcuuacagcuccaggggacaagauccuggaggggaagguagcgcuucaguacccuaaggcugcugacagagugccccacagucaguacccuaaggcugcugacagagugccccacagucaggaaguggagagcagggguuaguggugcuccccuucuguccccauuuucuuuaauccaggacuccuucccacagagugacacuguccacaguccugggguggcucuuucagccacaguuaaacuugucucccaggaguucuagauccugucaaguugacaaauguuguuagccauuacacccagcuucucgcucucuuuuuaaguuaaagacuuuucacaaaauauaugucaugcauaucuccuguggccccaacuucuguucugugcuauguaauguuuaaacaucuucaccuucuuguuuuaaucccuaacacuaaaaggaaaaacaagagcaaaaugaucauaaauucauaaauuacauuugacuacuuauucugugggucuuuggugaaggccugguuuauucccuuaccauagucauaaacaaacaggcacucacgcugaccacaggcaccagugugacuuaccaaagugacugugguaggggcuuccuuccaauaaccugugaaaaugccaauuaugacauuuagggcucuuaagguuuuagaguuauuggccuuuagaacauggagagccauaagaaaaugaucuggucucucagcagugauuuggagccugaaugaggcgaggaccagcuguagcucucuguguccccugccuucagcagagcuagcguuugcugugagaaaguuucugcugggccagagggagaaaggagccauccuagagcguuaauguugaauguuguugcuggcaagagaaugcgagugcuggguuugaacuuacugaaguaccuucuaagaggaccgaguaguguggugggaaggccagcuguucucacagcgccugcuguuucauuacucacucuucccaccaucugaaaaauagucaguuucacaugaaauuaaacuucugugguagaccauuccguaggcggcacugucacuggaaaucaaacagcaaaccuccccucagcucaguuacgccaaggaaaguccuacucacucuuggaaguccacggcuaaagcagagccacuuaauguuccuaauucacacaucuugcucaacucacaacauuuccaugaguggcucugagcagcgggccaacuuccucuacuucuauaauaugugagucuucauggcuuagcuccuagggccucacagaagauuaaccauugacucgcuguacguugucaggagaaaccuagcuucacgggaaccucccgaaauggcuaggauggcccaaguuuuccggacuggaaagucuggcaccgaauccacagacguuagcagccuugauuaaugccucaguucgggcuauuaggugugggagaaccacagcugccuaugcacuaagauagcucagagucugcaucuuacagacaagacccagcaaacaaccacaguccaugaugaaauguuagacagcuuauauuguguucuuccucuucuuaugacugugaaggaggagcccaggguagugauacagggacaggucuggccugucccucaggagcugggcuuggaagugcugcuacaccaccaucugcuggucaggcacacugcagcuuugugguugguugguuguuuuguuuuguuuugcuuuaaaaccugaacaguauuaucuccaaauucuagaaaauauugcaaaagucuagaaguaugggaaauuugagaggagucccuuuucacaagucagaggccuaaacaaacagaggcacuauggcauuugccuugacaaaauuuaguaguaacaucauuucaaaagcagugcauuagcaguuauuucaguugacguuugauaacaagauuuuaaaaauagaugacucugugugugugugugugugugugugugugugugugugugugugugugucugaggauugcaugcaggcuaagcaggcuuuuccccuagcccuccuuucccuucuguuagagacaagcaggccuugaacuucuugauccucugauaucagccccgagucacuggaauucuagagccuagccacuaggccugcuucucugguccugcuuagguuuagggucuuaacaaacuguaaaauaagggcucuuuuaggacagugaaguaacauuuuccaccaugugaaauuuuuuccaguuuugcacaacuuagggaaauuacauuguuuuauagagauuuugagggaaaaaaaaaaggauucuucuuaagaaagagacugauacaguuugagugggucuaaaauuuccaugcauuuagaaaucuaguggaaacaccagguuaaugagccaucuugaauacaguaguuauuauccaugacuaaagacaaaccauggaaagacaaaccauagugccucuguuuguuuaggccucugacuaaccucugagcguugcugggcuccccacccccaaccccgcgagugcugagaacccagugcuauuuuuaaaauagcugaaugucaucccagcuucaugcauguucuccuaagugccugacaacaugacugauugucuuuuagacaaaugauuguuuagacccaaacucagucaagucuuuucuuucuuaaaguuaugugguuaacuaaugacaaacggagaaauaucucagguugcuuggggagcgcuaguucuaaagcuuagagacacaggggaaggggauugcuuuuugucuuuucuuucagguuucagugauguguuaaaucucugauacaugcaaauaggagacuuucucuuugcagcucugccucuacugacaugcaacuaaauaaugacagcagauacuaugaaguccuggcaugaagcucaugaauuuugagccaguuacuccaacaaacgggcuacagccccaaauggacuccauuaacaaagcaggaugucuccaguguggugcaaaacuuugaucuucauuagagagaugguuauuuucuuugagcccagcugaugaacucagcagccaaaagcuguuuguugcuuaaaugcugauaaaaauaaauaaaggcuucauucuagagagggcccuuugacagaguuuucuuauuuuucuuggcuuuggcugauggcuucccccaccugcccagggcaaacuagcuuguaauagagcgagccccucaagucagaccaacuguuugcaccagcacccacguagcaaaugugugcacaggacucccaaucucugugggcgaaaucauggcuuccuggcaggucaguaugaaaaaggugugcaaagaacuuccuaucacuuagaauguagccaagcauggaagaugcuugcugugcucagugugagcaguguccucauucucuagccuugcuccucuguguccaaacucaugacucccaugaccucaggcaguagugagacuuuucuaccugcuguugccugaccagacgucucugucucagugcuuuccugauggaaccaucgcuuuuccaugugauuuuucaauuccugugucuugacuagguugacagcauucuucauuuucuuuccagcauaguuucauucaaaacaaaggggaaagaauaccuauucggcuaauguggugaaacuaacugauuuguaauggcugauaacugucguccagguguaucuuagacacggaucuuggcucugguguuaaggaggccagaacuguuugccuguaacugugguccuuguggaugacgcuggucagccauuaauuuggaggaagcauguuguauuaggagucuguaccauggagagauuccagcaaaaaucauuuacaaauuuuugcuuauggccugucucuccaagaugucuuaagcauuuccuuaugccauuaauagaagacaugggacaaaagacaaggcaaccagcuuuucaaccuagugaccuucugguuaaaaacaguggauauaugagcuuuuccgcugauaauauuuuucuaaaccuuucucagcuuacuuuauugacuggaucuuuugauguggcugucuguaauuaagguguauuucuaguguaucugaaucuuuuguucucaguauuguguauuauauguuaagguguuaguacuuacaugaaaauuuauuugugguuaagaaaaaguagcuuuaacagugagauuucuuuguuuuacuugcucaaccagugggauuuuccccacgguagacucugugguuuuguagcucuuaaaacacaccagcauucuccaaggaagaagcaggguuuuacaucuuuuauuauacucguguauacugagaggccuuuuuuaaaaaaacagaaacauauguuuagugaguucguauuucuuaaaauccacauggcucuucagacuggaaucuguugacacaggacucccauuugaacagcagggugaaggcuucaggacagaagugauggagugauuagccagaggcuaauagaauccugggaagaauggcagauuguauaugggaagaaauacaaucucacgcucauuguagcuuuuuuacaauuaaagaucaaaaaaaauagaaaauuacuggaagcgauggaugucugaaacuuuagagaugcagaugguguuggaugagucccagccgaaggcccgaugcucagaugauaaaaguguugggucggaagucguucugcgggccuuguucuguugcaucccuuuucugaauguacuuuugucucuuuaccccuccuccucucucaagauacauuuaaggaguuucuaagccaaucgcaaaaccucugcaucacaucauguacauauaguuaguucucuggaaaacaaacuaccgugaugacuccaaacccuugagcaaggagguaagcaucagccuuccucuguccugugcccagcucauggugucucuccugagaaaguauaacaagcgagaagacauuucuauauccauagacauuucuuacaggagccauagcuaagggcuuguacgcaugucucgauggcucucggugagcagccauguuucuucuggagaaaaagaaacagucauaaauuacaagacacuggugcauguuuucaucgcaagugaucguuacuugccuguucuaaaauuaacuuuaccauaaguaccugcuauuuaaaaaaaacaaaaacaaacaaacaaacaaacaaaaaccguguugucauguaauuauuucuuguccugcaagcugacaugugucauuauucuucagaguuaaauuauugcagcaucauaccugcagggcucagcuacucuccaacagcuugccuggaaaaugcacuguucuuaaacugugcauccucucauccaacuuccuccaggccuccauuguucagacuuggcauucacugguguucuuaguuuuuauaaggccaaagagaaaguggaauguuuccugaaauauaaauaaguaauaaaagcagugugcacauagaauacacucuucauucuucaagggugguuuuuuucauuggcucuuuaaaaaaaaaugugugugugugugagugugugugauaucaaucuguggggaaaagauuguuaaacugaagguaugacuccggaucaucuggguuuccagagagcugaguaaguuuccccuucuguauuugccuaagugaguucuauguuccauggccauauucaugauggaaacuuuacagggguguguguguguguguguguguguguguguguguguguaggacagaagaggguaucagauuccuggagcuggagcuacagcuaguuaagagccgcccagcaguucugggagccaaccacugagcaucucuuccagcaccagaaugaccguguauuuucauaaccauguaaggaacaguaccauuguuauaugauagacaagccagcuauuucucauacgcuaccagauaaaauccagauacaaugcuuccuuugguugcuaacacacacagggcauggauaugaagcucuggagccucagcaggcuguauggagccgugaaucagagaacagccuuauauaauauaaaguuccuguuuauucugcuuauguuuuauaauauguagcagagagaggaagagaacgagggaccuggacuucugagugugaccuuucuuccuaguuaaaauuaaaaaaaaaaaacaagugauaaguuauuaauauuacuuguuuuguguuuuuuuuuuccuuguuuuccgagacaggguuuuucuguguaucccuggcuguccuggaacucacuuuguagaccaggcuggccucgaacucagaaaucugccugucucugccucccgagugcugggauuaaaggcgugcgccaccacgccuggcuucauguuuguuauuaaauuaacuuuuuguacauuggacagaggagacaaugcaaaagggaguuuuugcaaagcuuuauaaauggccuauuacaaagugcccgguucuaacaaagguuauaugauaaacuugccgauucuucucuacagagccauuuaccuugcuuucugcugucuguguguuugggauaguucauuguaaguuaucuucuauaugcugcccaagagccaacagacauauguguuccuggauagauuacucuucgaaucuauuugaauggcuuaauuguaauaggaauucucuuuguucuuuuugcagcuaugucaucuuaucuuuuaauuauuaaaacagagcuuccugcugcuauuucagaauuuuuaccuagugaccacaguggguaagaaaaaauguuccauuguaucuguccauccaccagccugcccauucauaaucuauucauucauuuguccauugugcuuugacuaaaaccuagugucgagggagggagagcaauguagugcuuagccucaggaugcuuacaggguuuguggaguggagcagucauagaggaaacacuguccacaugucugcacaugucugcugaugacccaccguguugagcacugugcugccaaccacagcagccccgggccuugugcuccgugaagguaaaggccaagucaagucugaauuagcucuuagagcaaaguaaagaagccuucuaggguaugaaacuggaggagauuaggggaagccucaggaucucaacgugggagugacauggagugaucucugcugucacccucucagcaaggcguugugacaaagaauaugaugguugcagccacugugggagguucauauuagacagcauaaagaacuacgggugaagucuugugcuacuuugccuuccuuaauauugugaaagagcugcaccacgcauacugcuuucuccuuuaaacacagacuccuacauaguauguucguugccuuagcucuuuuuauggguaaggaacacauucauuauacuuuucuuuuugauaucuagaacaagacuuccuuuuuuucccuagaaaaauaagcucagguuaagccugcuaguuguccaguuuucaaaccauaacaaaggacugcccuguuucuagacuggaguauuugguugguuuuccccaauaauuaaacuuaucuggaacgcaggggaaaacuucagacuugaguuuucagcuuagagaaguugacuucccuugaagaagcagacuagugcagaugugcaugcaaggaaaguuaguuauuuucuaucaaaauaggaacugucaagauggcauuaaaauggggaugguaacguccucuauccucagaaagcauccuucacacggcacuuuguagcucauuagggucccacagcaugcuccccauuccuggauuuauggucagcucuaccugguuguguugaauauguucuauuagauaucugacugcucuaagaaguagcugugugaaauauacuuuuuuuguauuuguuguaaaaaucuuaauaaccacuuuuguuauuugaauuccaaguugggaaguguguguauggagcuaagaacucaaggcagugugaggaagaauaaaacaguaaggaaacaugcgucccauucacuucacaauggcuagccuccagcauccgacuccugaccagcuaacgggucacgagcugugcguuucuuuaccuggugcuuugaaggcaccagugagggcugggaguuugacucucacacaagcguucaccagcauacccaagguccuggguucaagucucaguaccagaaaaaaagcaaaaacaaacaagccuuuugaaaaggcuggagaagcucagcgguuaagggcaccaacugcucuuuuagaggaucuggguucaauucccagcacccauguggcagcucacaacugucucuagcuccaguuccugaggggauccgaugcccucacacagacagacauccaugcaggcaaaaauaacagugcacauaaaauuaauuaauuaacuaauuaagagaaaaaagaggucaucaaugaccuugucuuuaauuaguugcuuccuuaacagaauuauuauaaugaucagauaagauagcacgugugcacgucuuccgaguguguagccuggugucugugaggagagcagggaaucccagcgacagagauuguauuaaaggcagacuuuccuaucuuagucaguuugccaggaagcucagagucaaccguggagaaacuggucguccuaaugguugucauaugucaccgagcuuguugcuuaccuuuugucuuaguuuuaaguccugacuucuauuaacauguuuuaaguaaacuuagaaacacuuaaagugcugugcaguagaacugcuauuagaacugagggguuuugucugcuaaaacauuuucacucuaaaucuguugccaugucuacuguuguuuucucauuguuucaaacaguugaaaacuccuguuucacucauacuaguaaaaccuuuguauaaauguucucuuucuggcaggaaugggcuuuuaaaaacuucaugcuucaauuacuugucaccgauuuucacccaccgugugugaaaauugcacacuuuugaugacucauauuguuuuacauguccucuauucauuuauuuagagacuauauuaauuggauacagggcauuaggcuuugaagccuaaucuuguaaagucggagacaaauguugcaguaaugaauauggcuuggggggcaguuuauuccuaggugaguuguguggaaguauuucuucacugagaucacaugauauugauguuuuauuuugacauuugguuuaccauaaguuuaguuaagauauuuuauuuucuggguugucuguggguaugaauaccuucaugaacuaugacccuuuauaaagaugcugucaaaucacuuuguguuuauauauccuaauuucaaaacguuacuauugaaagucgaaaucaguaauacuuauacuaagcucuuaugauacauccauauuuuuccuagaauaacuuguauuuuuuaaaucuuuagcuguuaaaagucgggagcucucuguuaacauuuaauggucuugucaggggacuaugauugacacaauuaaguugucuugcauuugaguuacauaauugauaugggaugugagcacgguccuaauugagaacauacgauacucuuguuccauucuauucaagaaugaaauuaaagcaacuuauaaauaaaucugguuuucauugaaaaauggaaaaaacaucugcgugccaagcaugugcaauacagcuaaggauuuauacucuggguuucauaguuggagcauuuuuaucauauaggauuaaauccacagaucaaacaaguuuucuaggaaauauaaaaccucugacucuaauucuuuuggcucaaagagaauguauacuaggucacaguaggaaaacaggaguuugguuagauaauucuuuuuuucucucucuuagaaaaaaaaaauuacgugcaauaaauuauccuaaaaccuugguuuguaaaauaaauguauuuaauauguacuuuuuaagacugcuuauugcugguuuguauucucuggguuuaggcuuaaucuuauuuguucuuuggacaaucuccauuggcaaaugcagugcaauugucuggggccugcaagugaaaugugaacucacuccccauaucuuacuauguagccuuuauugauaauggaugaaugauaaagaaaucauugucuuaacgauugauuuuauuaacaucaaucaacaaguauaagaaaugacucccaauaaccaguauccaggucuagacaaacuguuuuaaaacaaaacccuuuucuuauuacgauuuuaaguucaauccugaagagaaagugaagcaugaaauagaugaaggaucaucuggaaaaaaacaaaaaaugccaugaacucagacuugcagcugggacugcgaguuuucucauugcugcuguggagaacauggugaagaugcuggacagagugaccucugagcccccuccagcccaagcauucccuagcucugcaaguuugaugccuccacacccuauagucagggcugugucagucuccacucuaacagauauacacgacugcguuuucugcacccacauucagccacaacucaggauaucaaaguguuccuuuaauccuaugcaagaggaaagcugugguccuauagcuuaacacacacccuuugcuacaacucuaccuucccgguaguucucuccccucucucucucucuuucuuucucucucucucucucagagucaaguugguuuguaaccauuuuuuccuucuuucuuuuuuuuugauuagaacacugaucgugagcggcacccucuuaacagauauuccguauacaaugcaguguuguuauccagcaggaacagcagugcuaacagauggagucugcuccgcuacucccucggggccauuuucuacuggcacugcaacugucugggucugauacugggucccagaaggaaagauguuucagacagagccccgggcucgcugccagguucagaguuuaguuaccagguguuucuugggaaaggcuauugugaaguuccucuuugguuuuuuuauucaagagugacuagaagaugaacgugcugagugucaguuuguguuuauucuaugguugcuuucauagugcuuccugcaccccagccacugaggggcacgugcaggugcagcuagaaagcacagcaucagcccugcagagcaggaaugcaugugcaucuggcagcgcauuugcaaaggacaggaguuggagcaggacucucaaggagggugucacuacccagcaguagugaguaaaggucuaucaaaagggugccaucacaagccagaguguaaugaucugcacugaacagugaagaccacgcgugcuagaagccagcucuuaaacccaggcaaagggauacucucgggauuugucagggcagugggacacuggcuaccuguaagcguguaagaggauaguuuaucacaggguaggguuaaguugaaagcaucugccaaacaccauaggaauccccauugaucguugauggucccagaccugcucuagccuggguuuucuuucuuucauuuuuucguuuucccagacaggcuuucucuguguaguucuggccauccugagacucacccuguagaccaggcuauccucaaacucagguauuccccugccucugccucccaagugguuggauuaaaggccaacaucacgaccacccagcuggguuuuauugucuuacauuguuacaauugugcuuauauuuaauauguucugcugaucuucuugguuaauuacuauacuuucauugugcugguuacauauugccauccuuuuuccagagaguacuaauuggacaauaacauaguaauacauguuggaccaaguauaccacauccuugauuauuuuacuaacuuaauuucaguaaucucaggauagauauauaguuauuagauuuuucuuccuauggauuugcuaguucauguacuucuaucaugaacuguuugucuuucaugugugcauguauuaaggucuuggggaauuaacuuuaacuuuaaaauguuuauauagcuguacuaaauuaaaauuauauauguacccauguauuacaaccauguaguaauagccauuuuuuauauucuagauauauccuucugacuuuaaauauauauuuauauuauuaaaaauaauaaauauuuuauauauuauauauuuggcguauacaauaugccuuguaguucuuauauaaauauguauuuauuauaacauauuaaauaauauuuuguauauauuauacauauacauaaauauagauauaguauauauauuuuaauauacauugcauaaacauauaaaauauguauuguauuauaaguaaauuaaauuuaaauauguuauuauuaaauauauguugauaguguuacuuuuuccucuuuguacugauauuugucuuucauucauuuuggguaugaauguguguacacaugagugugaauguacacauguuguaugcauacguguguggagagagaggacagccuaggguguugcuucuuaggugcuguucagcucguuuucuuuuuaagacgaggucuuucacuguguucacacuugcuagugaggcugaucuggccggcagaccugccuccagguccccagagcaugcugggucugugccaagugcccagguuuuuuuuuuuguuuuguuuuguuuuuuuuuuguuuguuuuuuuuuuaaaugugaguucuguggaugugauuccucaagcuugcaaugcaggcaaucuacugacaggcccagccccauguuccugcucuguuagcaaacacgugaacacucuacuaaccaaccauucuuacucaguguucucaaagcuguuagagaaaagguuagcacuuuggagaaauguagagagguccgacaagggaaaugacuccuuccuugcuuuaucacccagaaacaaugaaguuccuguccuaauaauaucuguauuuuucuuuaaacaguaucagacuacaaacacacuucauauccauucuuucggaguuguacaauuaaauaauuugcuugcauccaguuuucaugauuuucucaauuuuccuuauuuuaaauguucucaauaaauaccacuuuauaaaaguuucuguuccuauugcugauguuuuguugcucaugguauuuuauaagucuuauagagcauaauuauuugaaggcucuuagcaucauugccaguugcuuuccaugugagaauuagugcgcuuuuagcuuucagccguguuuggcauaccucaguacuccucacaauaggaguuaccucauuuuuuaaguauuuguuauuuugguaauugaaaaaauggcaucucauugggcacuuuuguguguuuguuuagguuuagcuguuguuuggagacaaggucucacuauguaguccagaccagccucacacuguugaucuugccuuugugcugagcuauaggcuuauagcaauaccauuuuaauacacucccuaaguucauaccuguuauuaauagugcagggcuuuccuaacaacauuuaacaaaaaaguggggucuuguuuuuaauggaugaucccucccucuuucccuuuucucuucuuccucccuuccuuuucuuuuucuuucuuuuuuuuaagcucucucucccuuuucucucccuuucucuuucccuccccucuuccucccccucccccccgcccccucccgucuucucuguauguguguuagaauagacaugaaugaguccuguguccuaugccuaacaguguuuuuccgacaggucuugguaucuugauggacagauguugcugaucaucaucuguguaggcaucguguuuccucucucacugcuucccaagauaggugagucuacagagagugagggacuaaaaccucacaccaccauguauuuagaagaguagugcuugugaguccuuuuaaauuuggcccauuuuugguuguuccauccucagcccugccuagcuaacuaaauguguaugacuuggcuuacggcagcauucugucugccccgcuaaaaugaaguccuuacagcagaccauugaggagcaaggcuucccaugcaucgcacugcucguggugggccaguuccuguucugcugugcagagcuacauaaugaucugugacagucgggcccuaggcccagauaccaagcugcaguagaaaacaugcccacgaugcauggcucuguuuguaagucgggaucacuugccuuauaaauugcuuuuuauuuuauugguauuuuacaggcuuucuuggcuacacaagcagucuaucauuuuucuuuaugguguucuuugcucuugugguaaguucaaaauauaaagcauugcucauuucaucucaaaacgcaacuguguuagugacugacguuucuagcagcuuugcacucggcaccauagcccacuucguaucauuagcaucacugguuuuuuuguuuuuuggguuuuuuuuaacauaaaaguaauuucagucacaggauuauucauuuugucuauuuuaaagaagcuuaaaacaaauuuaguaucuuguaguuggucagagagggacauacagaacuugcuaggacucuagguagaauagaccccuggacagcuguagcagcacucuguggagcagugggcucugucagucaguuagcagagcguccugaugcuuuauuucacugaugaaauuauaguuuuauaguuugagacuugguuggaaagcucuaaggagaacugggauaugaacgcaauccuauccgcccugcuuauucaguguaaaauguucccauaaagauaaugugggaaaauaauauuuuucuucauaugcagaaaauauauuuuaauuaucagauuuuuauuauauaucagauggcaguuuuacuucuuuuauauuuauaaaauaauuuaauauaggcuuuuuaauucuccuaagacagauccuugcauauaauauuuuaauaaacuuuuuccuuugcacuguauuuuauuccauauuaaguauauaaaugucaaaccuuacauagaauaaaauaucuuucauuugccaggaauauguauaucccaagugaccuuuuucugagcacacaacuugcagccccguauuacugcguuugugugcacacaaagucacaugcacacacagccacacaaacaugcaaccacauacccacucuguaugaagacaccagucauauuugcaucacaucugucuuugguuaaaucaucuucugagacacagaauaaagcaacuuaaaauaagugcaaguagcccugauuucacucuucauaaacauuuauguuguaaggaauuuguuaaggcugaaauauuuaacagcgcuuggucauuuuuuaauuuaucuacauuaaaauuaucccucuacccaccccaguugucaaucaaguaaugacaaguuagcauauaauuuuuagguucuauacuauaaagagaaacaguagguauuuucaucacaagggaguagaugagaagcauccaugagguuagaugguaucccacauacacauaggaauguaugaaucuuaaucgccuguagauaacauacugaauuuugcccuggcgcuuaaucgacaaggcaagcauuucauagguagaaguaauuccguuuucacagucaauagcuuaacacagguggagugcauugaugcaauaugucuauugcaguguuuuguuucugcugcagcagauacucuuuaauucaaugcagguuucugcugcaggggucacauggaaauaauucucccauauuaauccugaugcuccacaaaucaucuacuugaauuucuaccugugagaagaguugaaauuuagacucuagcaagaccaugaaguuuauacuuuuuaaugcuguuuuuuuauugccauguuuauuagagauucuauuucuauuuuuguuuuugucuuuuuuuguuuucugagacaggguuuuacuguguaacccuggcugcccaugagcuuacuauguagaccagacaggccuggaauucacagaaauguaucugcccaugccucugcccccuuagggcuggcauucaagcuguuuucuaccaugcccagcuaacuaacucuaaaaaacacauaccaguuuuuaaaacgugagacgccggcaauucucucccguccugugguuggguccuagcccauuccuuaccugucucagcaucucugcccauuguuuacuuugagacugguaugcauaaguuuauuacauuuauguuauaguuuauagaaucgauccagaaaacgucgucuuaauuguucucgugaagcaaugcagaccggagugucucuacuagcuauucuuccagaucccgauugccauuaaaaauuuagcauacauuuuccuuugagaguaucuacguuuaaacauguuucaauuuggcaguggcucaaagugacaguaagagaugccuucaucccuuauuuuucuaaccuaccuucuugucacuggcauugagagaguuggggugaguugcugagaucucuguaaaggaacaugggaggaaguaagcugggagcugcccugcagaaauggaagggccuuuugugcaagggcauuaaguauuuuuagugccuaaggugauuucucuucuucucuucccaucccccagagugcccuucuugcccagucugucuucagcgccaagcaaggacuuccugugacucuccucucucuugugcuugggucucugcccacuccucaccugucugcaucucucuccaccccaaugcaccaugcagguuugaagcugggaugacccacaggaauuagcuguaauaauggaauuuauguuaguguaaaacuaaguugccaauaauguuuuccuaaucaaugaaauaggcuauauuguaucuugaaggauuuugacuuggcauucaaggacugguacucagcagucucaggaagccaggaggcucuguugcugucagaggcugcucuccccccccccuccacccacccaguaagaggaaaacaggagacauugaauuugcaguggcaucaguagggcugaacccugcuuuuccagcuaccuucauucucaccccacacuccaucucucuuuuaaaacaaaacaaaaccuaaauaaaaccaaaccaaacaaacaaacaaaaaaaaacccaacuuuucaggaaaagaaaagauaaugagauucuugguucuuguuuuguucuugucucuugauaaauugaugguuggaguugguuuuauuuugaaaacuuaccuggaaauacccaguuugucccuuagacacccccacccccuuggggguuagauuuuaaauuaaaagugacucuuggguucucucauuaacuuaauccuaaaaguguguguuuucuuuagauuuaucacuguauaaaauuuugauugaauuuguuaaagucccaaacuagauaaguuccaaauaggaauaguauuuacuuacuugucuccgcaaagacaaaagcuuccuuucuuccucugccccuuuguaugcugggauuuagccuggagcaaacauuugcagaguaauuaugugccugcaacagggcuacaauggcaguguugacacagccacaacuggggcugcaggaacaggacggccacaauuaagagucaaauccugaagcaugcccguugaugguccugggaaacagcaucccuccagcuggaguucccuagcucugcacccgauucuggccagcuuucuccacacucaccaauagcacgaacgugaaaaccugaagaggugaaaguguguguucaucaggaguaccaacaagcacacugagaauuaaagucuccccccacuucugccucucuucugcucugucugccacugacgauaauagauaaucuuugcaguuauuauugaaagugugcuuccucuuugaguugcacuuuaaaaacagaaccaguguacugcuggaguuuugaaaauugacacaagagucuuugaugagcaggauuccccacugaucagauguaaagcacuccugucaugcugggcccuccccuccgcccagugaccauguuaaagggugaccccauucucucugggaaaaucggagcaucaaggaaacuucuguuuggcuuuauugaaagcaucaacuugugaugaauuucacuacagaucaucuaagugcugguugcauuuacuuuuacagguaguaauuaaaaaaugggccguuccuuguccugugaccuuagauugcaucaaugaagucuuucagguaauaauuuuuagcuuuuuuuuauuuuuaaccuuucaacuaaaaaaaagaaauugaagauaaaugauuauuuuccuaguuggugaaagguaauaguuacguaacaguuuagaccuuuucuuugaaguaauuugauuugaaauucuaguaguaauaaauucaucauauuuguugauguauucugacuuuuaauaccuauugguuuuucuuuuccccucaauacucuuaaacagauuucaaacgcaacagaugacuguaaaccaaagcucuuucauuucuccaaagagguguguaaguuauuaacagauacuuuugguugauuuuucacauuucaaguuuuaagagauuuguguuacagggucucuuaggucuuuguaccuguaacuaauuaauuuucaugaaagugcuaaguauaggauugccuaccagaagaauaauauuauuuaacacaggguggcccauuaugaaacagccaccuuuuucuuuucuuucuuuuggcaugcuuuuaaauggagccuguuuuaaaugggccuuugccuaaaagaacagauuuaccaaaugucuggucuggccaguaagguccucuguggauauggcuuuccuguugcgcucuggacuuguaaagcuaaaucgccaauuacaucaaaaacuccucccuggugaguaggacuuuggucucuaguuaaacagccucaucaaugggccagcauuugaguacugccaguaccuucugagcagaacuccagggaaauuuaugauguucacagcagagaccagaaacccaagucccaugcccacucuuaagagagcuguaggcuccggaaagugccuggaagaaucccugagcacaagcaggcaaacaggggcuccggcuuugcucucacggaaaaggcggagccuuccuguuucugggagucucuuccucucgacuuuguuuuucugcugaaaugugguuuugcaggccccagacaccagacucuccucuccucgcugcacagcuuuguuaguauagaauguuaauguggguuguucuccgugcaaaacuuucccuuuuaucuccaguuuauaacaagaagcgucuucccaagccuugugaggaggucaccacaucucucacacggcggagaccuccgugggccuuagaucagggcaggggaguugacaggccaggaaacugagcagcuuaugaaacagagaacgugucuuaagcucucauuccccuaauacagcuucaagaaacacaacguccuagguacgauauuccaaaguaggccuucaucuggaacuucuuuuggugaagagcccaacacuagcucaggagaaauauuuuuagaccagaaaagagaaaauaaaucauuaccauccauuuguuaaagacaguucuuuaauguagagguaauaacguuuggcuugcuaguuuucucuggcucuuguuaaguauucuaauaauaauuuuuaaagaaaccuuaggcuuauguauuacaugagauccuaaggaguuuuucaggucuagaauuaaugaucuuggugcucauuaagaaagaucuuggucauggauucuggcaguacaaagauguggcuucuauuuggaguacuuacuuggaucgaguaacuaaaagcagauuugaaagcauuagcacuauugcugcuuggguaaugagauguauuuaaaucgugcauaccuuaagaacaacuggaauuauaauaaaaauuauuuuaaauguagcucuuuauauauuaccuaaauuaguuuuaucuuauccaaauaauguagaaagugaucauuguaauaaagcaacaugauuugagaggccagccagaaaaugugguuagaaucggcaagccaccuaagcuauaguaguugcuggccacugcagauccucuucucuccucucuccccucucucucucucucucucucucucucucucucucucuuucugucugucguaugaagagaucauucacaaaagauggcacagauuugacuaaguuguuuuuuagaaagagcuuuauuguugugcuggcaauggcucagcuguaugagugucuucggcaagccugacuccuuagucacccucugaccucugcaagggcuaacuaaauaacaauguaauuaaagcaagaagaacugagguuauuaucaaauacaaaugauguaacagauaauaguguuuuguucuaauuuuuuuucagagcguuuacgccauaccaaccauggcuuuuuccuuucucugccauaccucaguauugcccauauacugugagcuucaaagguacuguggaacgcuguggccuucagaucaagucacauucucacuuaugaacccuuccccauugcccugaauuccaaguguuagcuuacaaacaaaacaaaguaauuguuuuagucgggguuuuauuacugugaagagacuccaugaccacagcaacucuuuuuuuuuuuuaaagauuuauuuauuuauuauguaaguacacuguagcugucuucagacacucuagaaaagggcgucagaucuuguuacggauguuugugagccaccaugugguugcugggauuugaacucaggaacuucggaagagcagucagugcucuuaaccacugagccaucucaccagccccccacagcaacuuuuuuuuuuuguuuuuuucgagaggguuucucuguguaacccuggcuguccuggaacucacucuguugaccuagaacucagaaauccgccugccucugccucccgagugcugggauuaaaggcgugugccaccacacccagcaacagcaacucuuauaaaggaaaacauuuaguuggggcuggcuuaugguuuagagguucaguccauugucgucauggugggcaggcagacauggugcuggagaagccaaggguucuacaucuguauccauaagcaucaggaggagacuguguaccacacgggguguagcuugaacauaggagaccucgaagcccaccccaucccccagugacacacuuccuccaauaaggccacacccacuucaacaaggccacaccuccuaguagugucacucccucuaagucaagcauucaaacacaggagucuguggagcugauuccuauucauagcaccacagcagccaagagcucagucuguccucacugggaagguugccagugacaccaucucuguuucugaguguccaccugugaauucuaguguguagucaucgaagaacucaugauuggcccugacuggccuugcaaugcucguuucuucagauaugauucauaucacuggcuuugucaaccuucacuggguauuuguuuguuuguuguuucagcccuucaaagaaaaggaugcagaaugugaccaacacagcgauugcguugagcuuucugguuuacuuugugucugcacucuuuggcuaccucacuuuuuauggugaauauauuuuuaauuuuaauuaugcaacgaaagaaggacagaugcccucaucccaccuguggccuugcuuucugccacuugcuuguaaggccaucuauccaggccauuuuagcacuguggcgaaucugacaaaucacgcuuaaggccuguacucaggcacguuggugccuuucucuucagaugccugaaagacacucguaaaaauauaaguauauauuuuggagauguuuccugcaaaguuuguggagguuuuuccuuuuucauuaagaauaucgaaaacaaaaacaaaauguagagcaagaaagaaaagauaagcaaaacucacaagcaaucacagcacagcacccagccccucggcucacccaguguugcacgcacucgucaguucacaguaacugcgaggacuuggcuguuuucuuaggcgauguguaucugccggugaccugcuggagggcucugugcaccuuuccgguuuuagacgucugaggucacagcuguuggccuuuagugacacuucccuucccauugucccagcgucagacaguguuuucuucuaccgcugcacuuccugggcccagggagaagagaauugguuuugaaauccaacaaaccugggucacguaacuaauugucaugcccuaacuagcucugggaccuugaggggagcccacgccuugaaguauccucacuccuaaucuguaacgugagcauaacuuaauaagguuguagagaaacagaagugaggucuacauacaguccugcugcaguauuuggcacauaauaauccuuuccaagugagagccguccauagcuguccauuaccaccauccucaccauuguaacuggcuccguuuuagauauccuaugucagcacgguacuucuaguuagucuuagcugcguguuggaugugcacacgggugcaugcuugcgcauguauagguggagguuagaggacaaccccaggugucauucuucaagaagccuuccaccuuguuuuugugaggcccaguuucacacuuggccuggaauugacaaguaggcuagacugucugucagcaaguuguggcgacacuaccugccuuugccucccagcccugggguucugagacauccaucacacccagguuucuuuaaagcuugguucugaggauugaacaaagauccucguagcugcaaggcuacccagccccucuuccuacgacagcuucucggugcaugcucugucgcaugguggcuucuguguaugcgcuauucgugugcuguuuucagugugggacacaucuucaguuguuccggguguuuccuccuccuugucuguuauuucaguaguguuauuucacuaucaucgaagugugagcuugcauuuagucagggugcugcagggugacagugguggaguucuguguauauccugcugaaaagugugcuucccgagcugaguguaggccugcugcccagagcagugaacgugaggcagauugucagccucuccuccucaucaaaaugacaaaaucucuaaacauacaugcuauacuuuguuguauuuugguugucagguuuacuaguuuaaagacgugagcuuagucaaagcuuucuuuagcaagauccuaaaacuggacucuuggcuuuuaaaaagauauauugugccacauggcugcauauauuuuuaauugcaauuaucacccauuauaagcacugcugauuaucacugagauucuuaggacuaaaagaguuucacauguaugaaucuugaugaguuuagaauauuggugucaugcggugaguuuuagauuucagaguauuucacacuuucaguuuuuagaucagugcuacucauccuguguucaucuuggaaaucuuuaaugucuaauaaauacagagcccuucuccuccuuguaggacaauagagcaaccuggaagaagucuccaauucccacuaauacccaggaugauuaaaaauagucaugugaaucccaugagagacugggugcuuccgaacucuagauaaccugacaaggaccgccuaaggugcaacagagacagaaaagggacucagccaaugagcugacagcuaagcgagagucgagugucuugcuaagauugcuuccguccucauaacucagaugagccuguuuagauugacuaaugaggccgccaccuucagguuagaguggagcugaagccucgauucucuuccuuucuucuccauaucuacaaaucuccaaagccuucaacacuuggcugccuuugauaaacauaaaacccaggccguguuccuuuguuuuggguucuaauuaaagugaacuuuaguaaaccauggcuuacccaagccccugucauguguuuagccacuauccauacagaugaaguguuuuuuagacagggauuugccaugcuaucagguaaagcugucagggugccucuaacuuaaccccuuuuccuuagcccgugagcuuccagaugccaugcacugaaggaauucccagcggauaggaccgcaccaugaguaggcggcugacaggugcuagcacccuuccaaaggcagaaggcacucggaugggugauaguuucuuccuugcaguacuucuuuguccccauuguuaaucacaaugaagaaacgccuucuacuguggcuuuuagaugguguagucccagcucucuuagcugcucgugucagcaggaaauggucagucugguaggccucgccugaaguucaaucguacaauucaucuuuuuagguuagcaguuugauccuagaucaguaaaauggccuguccuggaauuaaaagacagcuuucuaaaugcacgccaguauucuuucugcuaccuuauggaaaucuuccuuggcuacaggaaugcuaaacaggcagacaugugaugccacugguccaaaggacaaaaaaaaaaaaaaaaugguccuuuuggaaaucuaugaugcuuucucugaguccaaauaaguguguuauaaucuguuccuuagguaagaaugcagaguggcuagcucagaagguuuucacccugggacaaaaaggauuucuaguaauauaguuauuaauacuucuggaacugguuggaauccuuaucuagacucuuaaagcuuaguugguauuguuauuaugacuucugucauaauuaugacauaccauauuaguuauggcuucugucagacuaaagggaucucuaaauaucaaccagcauuaauucuacucguucuaaucacagauguuaaagagggaaaguguuccuugggugagccacgccagugcccaaacauuggguaagcaggccauuuuaaugucugcgagguuguuaagcaagaaguguuaauagcucauuuuaugacucagaaaauggaaauaaaguaguuugccauauuucuccaaagacucacaaguaucucagauuuggaaauaggauccagauuucuuggcucuucccaguucuccuaccuagcccuggucuugauucucuaauuuuugucuaacacucuagacaguugcauucucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucaccauccucuccugugccugugguugcuagccugguucagagccucuguuacuuuagugauuauggcacugauuuucuguguuuguguuucugauauuuuuuguccacucugugcuuguauguaguucagaucauaauacacuccucuuucuaucuuaguuacauuccucauugcugcaacaaaaugcaugaggugccaagcagccugagggagaaggguuuacucuggcucacaguuggggguuccagucucuagccuggaaggcacaguggccagagcuagucagaagaaugaggaguaaugaaguccugucccgcacacuuucuucucuucuauacagcccgacaucccagucugugggauuuaaaaacucuguccuauuuuaagucuaaacugaucuuugucuagagguccugaggugugguugaacaccaucauuguucuuaggugaccugggugaggggaacagugcgaauggaaggaagcuaccagguagagagccugguuggcuucucucaguccuaucucugaauggaccugauuuacuaagcaagccauuuucuugacccuucauucuuucuuuuacgcaagauggaaauggacagagcugauacuguacacaaaacacucugcagaaguguaagcaaucccuggaguguguccugcacaggacaucguggaaucugagaaacacugguggugaggggucacuauaucacaagcguggggugcucugccuaccccacacagugugcucuuaggcagacugccuggcacucuugagccuucauaucucauauugcuauggugaccaaauucaccagugcacauguaagcacuuuauaggcacaaguguguaaacccuuuccuuaacaguauggacaaguucuaaggaguuugcuuugguuucuguuuuguguuucauuuuacuuuguuuuugugauuaggucucacuggccucgaacauugauaaguaggccagacuagccucaaacucacaaagauuccucugccucucugccucucugccucucugccucugccuccccauaguugugauuacagccaugcaccaccacaccugguuaaagagauauuguuaauuguuuuagucguaauuuugaagauccuguguguacugauuaaaaauuucuuaaaagaauacaaaagcauuuacaugggcuggcaagaugucccagaaggugaaagcccuugccaccaagcucagugaaccaaguuuggucccagaaccaggucccacauguccucugagcuccacauaugugcaauggcucagacacccccaaauaaggaagucaacucuguaauacaugucagaaaguagcauacaucucaggacaugcuuaguaucuuuguauuuccuaguacagagagaaaaaggccagaaacuaauuucagaaugguauccaagccuaguauaaaccaguaaugcaacagaaaauaacuuugguauuauuggcauagugguacaaaguuuauuauucgacccugauugcugcugcuguuguuguuuuaauuuauuuacagacaaaguggagucagaauugcuacaagguuauaguaaauacuugccacaugauguuauugucauggcugugaaguugugcauacuauucgccgugcuucugacagccccucuaauccacuucccuguaaguaugccuaaagguuuuguugcuuagugucguggcucccuaauauggcaacacuaaugcuuugcagaccagaaccucugaaucacaucuagccuuguguaucuuauucauuugucagguaauugauccaagaccucauacuagcacauggucccaugaaagcacagaaauaacagugagccucgacggacgcuaaucugugcucucugagguucccuuuagauuuaccucucccucaguuuuguuuccaauuuagaaacuauaguucuaaaguuuuaggguugcaggggguggugucuuccuauauucuguuuucaaaagaaugugcacaaagaagagaaagucgauucagcaaaaauaagcucuucuuggucuacagccucuucccauaggggaagcugguucacucuaaggcuuuauacucgcucuaagauuuaggaggcagagcagauucccauucugcauccagucgcugcacagaagaaucugaagaauuuccgugaaaaugaaaacaacagcuuuggguagaaaggcuucugccugggugucuugaacucacaugaguucuuacagacgggaccugcaggaauccuugcccucccugugagaccgcagggucagggguccggccggggcugcagaaacgugugggcuguggcugccaguggucugcccuggcaguggaagaugugggaaugcuuuugcauuccacaccauggaacagauaacaaaacaaaacagaaaaugguguuucucuuccaugccauguuuuguuuuuuuaugcuugaaaguuugucuguugaauuuaaugaaaguuguucuuugugauuucguaacgcaguguuauggcuuguaauucuuuaaauuauauuuucuggaaaaaucgccugugaaacuuuguguggaauuuaagaaaaauaauuuuuaugacacucucucagaaagguuuaugagaauaaaaacaccgcauaaugacaguuuaugcugugucuggggaauacaaaugauuugggguaauaauauuaugguuacuguacaugugcuccucuaagcaagugcugugcccuccauccuccacccuucgccugaccuccuuccccugcucuuaggccaggaaagcuuuaaugaugauccuguucuccaauuacccguucuccuggauccgacauucccugaccacagcagcgcucaacgccaucaucguggugcucgccaucuaugucccggacauuagaaauguauuuggugugguugguaaguuucccacuuuaaaaaaacccauguaguaaaggggacggggauguuucaucaguggaagagcgucucccagcacgggugggcuccucagguuuggucuccagccccacaaaagccagagggguaauaaagucaucacucucucagcugagcucacacggccuguuucuuccucuccaggcgccagcacaucgacaugcuugauuuuuguguucccaggguuauuuuaucuuaaacucagccgagaggacuuccucuccuggaaaaagcuugggguagguuguuuccaacuguuuaaaaaggcuucuauuuuaaggaauaguguguuuauuacuguaucuaagaagacagaauaucuuaauuuacaaaguucauuuuagagucuggcaugauggcucaugcuuguaaucccagcucuuaggggauugaggcaggaggauugcugaguguucaaggcuagccugagccacagcuugagaccccauguacugacacugaaugaaaguccgcaguggagaggacggaggcucacacucagcaucucuucugucuccacaggcuuuguuccugcuccucacaggcgcuguggucggaagcuucaguuuagugcucaucauuuuugacugggucaacaaaugaaaaaguuuuuauuaugaagacuaacuuaccucucuauaaacaagaagggaucauuguggaaggugccauauaugaaaauuacacucaggaaaacuguuaauagggaagccggacagagcagcaauaggaauuuagccauuuuaauuuuaaccaaaauuagaaauacucaaaauacuugaaauguucuuaaaugugcagagucacucuuuuguuuggaaguuucauuuucuguguuuuguucugugucugaagcaggaccuagcuguguagaccaagcuggccuugaacucacagcagucugcuauugggauuugguucuaagacaaaggucuuaauuugguucccaaagccuggcuuccaggccugagggucccuguccucagcuggcuucaauugauaauuuacaaaaaaaaaaaaaau

SEQ ID NO: 6692 - RNA, 6919 nt, Mus musculus
cuguuugucccuuugcuuggauaggucccuucuggagagcaguaaaguggaaugccuuucuacccaagggucuuggcuuuuucaccuucuguccugcauggcuuuaccuucugagucccuuuagccuucacccccgaggagcuggcccuggaagcagaggucagugcucucccacaguuccacgccagcugugugcuucuccugcuuacgucauucugaagcuggccacauagcgugcaagccuggccccucucagcagcuucaggugagaguucgucgauuaacgagcuccuugcccccucuuuuuuuuuuuuuucuguuuaugaaauaaugcucauagguguucagcugcuuaaauaaaucuuaacucuaguaauaccaaaauagcccuaaaucuacaacagaugcagggaugcccccgggggcaaauguuaaguguggcgacagcugggcaucaauuaauacugugucaccuguuccuaagacagugcccugggagguuuggcaagagacaaauauccuuuguaacacugcacagaauugaguuacuaccacggugguggagguggcccacuuuccuuuaaccuucuguccugccggguugcuugcuugagucacauuuucugugaguuuggaggaagccgaugagaaggcuggcaagaaccgugaccccuucauaaccuuguccacguacccccaacauuauuuucugggaaauaugggccuucuccuuaugagcuuaauggucauaauuuauuagguaauaacuauuuaaaauaaaacuaagaaacgcacaaaacacacuuuucuaacauuuggagaguuauuugcuaaauuaaaagacaaaaugccaagaccguaaauuacuuucauauguucagggugaauguuuaaguuguacuuuuuuuuuucuuaacagaauguuuacucaugagcuuagcauuuaaaugguuaaaacaagccuuugaaguuaacacuccauuaagaugaauggggguaauucacaccucugcggggcuguauuauuucagucuggcuguggagaaaacaggacagcagugggcugauuuacuguccuuuaaacacccaacugcuggaaagcuuuguucuggugguggugguggugauguuggugauguugguggugaugguggugauguuggugguggugauugugguuaguggaagugguggugguaguggugguaguuaguggaggugguggugguggugauggcgguggugguggugguggugaugguggugauguuggugguggugauugugguuaguggaagugguggugguggugguggugauggcggcgguggugguggugguggugguggugguggugguggugguggugguggugaaggaggugguaguuucuuuuguuuguuguuuuccuuuuucaccuggaaacaggaucuuaaagucaucacuguauuuaggugcagaacuggagucuugaacagugguagauugucuacucaagugugccccuuggugauucugccugugacaguugauggcuguggccagaucaacucaaagcuuucuggcuuuguucaguuccacacucucauguaugcuccuguaaaguguagcuuucccagagcaaggcagggaugaucauuuucaggucaauugacauaugcucuaguaagguaagaauuaauuggcuuucugcuacucuuaaaaacuuuacuuuuacaaaguuuuauguucuuguuugccucuauauaaagaucuaccuuaaaagccagcuuuaaucccaauagguggaacucucugaauucaaggccagucuaaaaaaaucaacuaacaacuuucuuauggccuucaggaugacucagcauaaagucccuugcuaggcaagcaucaguccagguccaugacuuguccucagaccuccacucccaaccccuauccugugugugugcaugcucgugugugugugugugugugugugugugugugugugugugugugucucgugugugugugugugugugugugugugugugugucucucuguaugacaggggggggggguguaguaaaauuaaguuuuuuuaagacacuuuccuguauuccugcauagugaggugaacagaaugagcaaggaaggguggauuccuuucucaagguaucauuuguaacagcgcucaucuguguuggaaguguauaacccacucauuggaagugcuaaagccauuuaaccuuugaaaggauucauuucugagccuaggaauaaaauguucuuaacacacauaaaguggcuaacauugugugaaaguuagugaauuugaaagaccucuuuucaaggugggcagguuucccucccuuucucugcucugcguguuugugggaucagguuacuggguacccugcagggagcuggguguggagguuccuccucugcugucugcaaggcugguguugccagugggcuguggggagauggaagggagacugaaagggacccacccgagcugcaccgucucuacccugagaacagcauucugcaguuggaaugcccccaugcuaaacaggcagacucugacgucuaauaucugaccucaggacaucuccgaaccuuuugugguacugagaaguuuguuuuucuaauuuaaaugaacgauuuugucacucuucugccuguacucuggcagucuuuccgcugugggguggagaaauuggaaaaggggcuggguggaggaugaguagaccugcaggcaugguuucuuuauggagagacaguuccuucucucaccucucucuuggugagcuguuguccaggcucaccauacugcuagucaagaagagcaagaggaagagcaggaagacucagcuuggcccugcgccaaguggacaggugggcgugagagcucccuuccccugugggaccaaguaaauggggauaaaggugggaggggugggggcagauggcugaaaagacaagaaacaugggaugcuauuuaaaagaaaaguuaguggccuguagaaaauaucucucacuuguuugaauguauauaugucuaucuaaugucauuaguggacuuaagugcagaagcaaagggcuagguauguaguuaccuaauacaauaagaaaauaauacaauacauacaauacaaaacccagggauugcccuagucccaaaaacauaaagcuaggagcuagcuguccaucuugccugagaagaguucagauacaacuugaacuuuucugaccuuucagauggacugaaugauugaaacuacuuaaagagguaggugugugugugugugugucugugugugugugugugugugugugcgcgcgcaccuguguauaagcagaguucagaaaagugucaccucuaucacucucuaccuuugaggcagagucucucugccacacccagcauguuacaugagugcgggguuucaaacucagaugcuccaaauuagccagcauucacaugguucuuaaccaucuuuucagcccagugagagguucugggucaggcuugccuggaacucacuauguagcucaggaugaccucaaauuccugguucuccuccugcaucagacuccugagcuaccacaccaugcaugccuggcucucgcugaagauuuguauuacuugaaaaccaguuuucucucaaccaggagaaauacacuugauuucuucagguggugugguaguugggagagccugagucagcugcuaaaucucugaguauggacacuuuucuuacuacuguuccgcagaucagcuggcucccagccaagggccucuucugcugugucagccacuuaggcaacagaagacacuguucuugcugcucaaagcccauuuuuauuguaauaacauucugaguuucaguagcuuuacaccuuuggaacauugcagaauguggcuaacagaaacuacaggcuuuuuacaggugaauuacuguagucuugagacccuauguuuaaacuguggauuuaaagaaaaaaaaaucuuuuaaagauuuacuuaguauuauacauaaguacacuguagcugacuuccaccgcaccagaagagugagucagaucucauuacucacucuuauaugguugugagcugccauauaguugcugggauuugaacucaagaccuucguaagagcagucaucgcucuuacccacugagcuaucucgccagcccuaaaauauuuuugaaagaauauacaugcugcuagagaugaauguuaagugucccccaaaggcugguuuauuaaauguucggucccuaguuuggcaccauugggaggcagcaggagcuuucagagguaggacacgugaaagguccucuggucaucagacacaugccauugaagcuuggaaccauaccccuccauaucuucauuuucugaaugcugaaaagagauccguucccucccccauguucaucauguacuccaccaucagccucuuaaagcaaggagaccaaauggccaugggcagaaagcuucaaaacugggccagaacaaacuucuacuguuuuuaaguugacugucuugaguaauuccucuauguaugugugugugugugugugugugugugugugugugugugaguaugaagaaagauugaauaugacgcuauuacaucacauacuguccgcuaacccucccaguaacugacacuuguuuaaaaucaugacucuagugcaucagccauuguuccugcuuuuuuguuuuuuuugacauccuuccuuuuuuuuuuuuccaucucauucacggaagaaaaaaggccaagugagaaagcgaguguuccacauuguuaucuccuucucccagucuguguuacuaucccuggagagcacccacccuugaguuucucagccgcgagucucauuaggaacaagcuucaugcauuugucuguuuucuguaucucuaguugcuccacgaccaccuugaacucgccaccugggaaucuguuucccugcgcagcuaaucucucugcucacagccugcuguucucacccggcuuccuagccugccaucucacucucaccgcugcugccugcaacccaggcuucccaucuuaggagaaaaucugcacuguggucagcaaggcucgcauguacagugucauauuauaggcgcgugguguggcacauaccuagagcuuucuuucucaucugacaugacuaaaauuguacaccacggagcaguucagauuuccucagcccugcagccuugggcuacccccacuguccccuccuggagugcaucguguagggacgguguauaaaccauuaugucuagaggagacuuuucacugucugcccuucagagccugauuuguuuggcuuagcauauucuccaguuuugcccaggcacacacaagagugucucuuucucucaaaucugacugugugauauguacacaucaggauuucuucguucauugaccaguggacauuugggcuauuuccgccucuuggcuacuacagacagugcagugaugggcuuaugaauacaaauagcccuucguggcgcuguuugcaauuauuugggcguauggaaucaugggguuguucuacuuuuagucucggaguuggucucuagcugcaguaccaccuuacacucucccaagacuggcucugcucuccccuuaucaucgacaguguuugcagcagccaucuuucugggcugggaugccaugucucagugaagucuuguuuuaccuuugggagaugacucgugcuguccgguauccuuagcaacuuguaugucuucuuuggagaaacucucagccuagucuuuucguuuuguuuugauuugauuuuaaauccaauuauuuggggcuacaauuccuuauauauuuaggauauugacugcucaucagguuuauagcuuguaaguacugccuuuccgucuguggcugucuucacgcucuguucauuguuuccaucuauuguuuugggaaccgaagccagggucuccuguguguuagauuaguucucuagaguguuaccugcucccggugauuaguucuuauaauugguccucaguaaauacacacgagcccuucccucguggcacauuuagaagguucuccuguggcuuuuaugaauggugugagaauugccccuuuugccucucugcuguucccaggagauaaggcgugauuguagguaagaugcuguagcagccuucuuugcucauuuacaauggacagaauugaguugcucacagcccuagaggccagaaagggcaauauccagguauugucggagcgggugucucagaggggcugccucgucuccuguccagccuaggacgcuacaccgugcagcggggagaggcuguucugaauacuaaaaaguucaagagccacagagaaaacgcagucaccucucugucaacgauggcggagccuucaagaccccaucacuuccuaaaggcccagccuucaaaaaucauuccccagaggugggcauuucagaaagagcagugcgaggacaaacaggaaccaccaggaggaagacauuauuacugcucuucccugauucuggauuaucagugauguggaggcaaacaaauccuugguucuauuaucauguuuguuuaguuugaaucucugucauaaagguuuacagcugauaccaaacacacucaaugcccucugcauccuaugacucaggaggucauguuuuuugguuuuuggguuuuuuuguuuguuuguuuuggguuuuuuuuuuuuuuuuggcuguuuacuguaaauuaaaggagaaaaguuacuccaugaguauacccuaccuuuucauugugaaaauuuucagacaugaauauguauugaacuaaucugcccaaguacacaucauugaaauccagcauguauucaaaucugacuuguuacccauauccaaauaaaauuuauuuuuaaaagau

SEQ ID NO: 6693 - RNA, 60126 nt, Mus musculus
auuagauucgcuucugggaaguucugaggaaagaaucauggcaugcuguagcuaagccaccaaugagauugagaaagucuuggaaaucuagcugcccaucacaguugagguccagcuucuucaucaugcggucaaggacaccgggguccuucugguucuuugugaaggcggccagcuccguguucaugaaggaaaggaauucaguuuuggagaguugagagccguuuccauccuucccgcuguacuuuuggaggacagcaaucagggacucaaugcaucucuccaucucuguaggcauuuuugccaaguuggggagcgagguccagcugcgacuguggcugacggugacuugaacaggaguggccaguuuuucuuuuucuaauuaguauuacguauuuauucauucguacauucauccacauauccauuucaagagagauccuuaccuggaaccuccuagauagcucgugcuagcuuagaacuugagauuuuccugccuuggccucccugguccugggauuguauguguucacuacugugcagggcaaauuuuagcuuuaauuggcaauaauucucccuauucuggauuauauaacccagaauuauuuugauauuuuuaaauacuguggaaagaucaaauugggcuaacuaauguaccaccaccaucuccuuacuuaaaaauaauuuucuugauuuauuuuuugcaucauauauauauauauauauauauauauauauauauauauauauauauauauauaaaacauauauacaauuuggauuaccccuccccuaucccuccucuccuccugccuccauucccacuuaaacccucccauucucccuugcaguuuccuaucacaguggcuguuuaucauuuacuccuuugaaacucauuaucucaggcauuuuguuucaguaguaagcuuaacaacacaaggagguucuaguaagagccuacauugccugcaucauaucgugaugaaaaucaguccguguguguguguguguguguguguguagcuccagcuggcuugaaacuugcucuuuaggucaagcuggccucaaauucacagaggguaccugccucggucugccucccuaaugcugauauuaaaagcaugcaccaccgugccuagcucuucauauauuucuuuuguugcugaaauuacuucccuguaggaaauauaaacaaaauuuaccucaaccugaaauuccaaugacaaauugaggcaugauucuaccaaaguuuacacuggggaccaauguauaaauaaaucaaugacuuuauugggcuuccuuuaauaguuaagagguuacuuacagaggugugggccuacucacaaaggucauagcugaaaaaggucaucgccuuuagccagcagaaacaagcccccaccauucccuaguauuccccaggcuauauacucuagccccuccagaggccuuguucaaggagagcaaaguuguauaccauaagugggcauaacugaacuccccaagauagaguuugcuugguucaaaggacagucaugcuguaacaggcccccagaccuuagcauaacugacaacauaauggaaaaaccauucaggccuuggaacccagcaccaccugccaaaagaagaacaaaggccuaauccagcgaagaccauagcucugugaaagucucuaaaugcacuaaccuugucuucugcagcucugcuucuggcuaacugugcuugcuaacugagguguguucacccaggauguggguuugauugcuuguuuguuuguuggaauuaaaagcuuacccuguaaaaggcccaguguaguugccaaccugcuaauaaagacuuucuauuggcuugagucugugucuuuguucuaaaucucucauuucacuuuuuuuuuuuuuuuuuuuuuuuuuuuuuuuuuuuuuuugagacagaguuucucucuauagcccuggcuguccuggagcucacuuuguagaccaggcuggccucgaacucagaaauccaccugccucugccucccgagugcugggauuaaaggcauguaccaucacaccggcuucauuucacuucuucaucagccuuucaucaccauuacaaacuacuugacauaauuuauuaccaaucaguuggcuugagucuuuuugcuguaguuggacagaaguuaugagcaggauuugacacuccagaccccugaguaccagagguugauggauugauacaacagcuucagaaagcuuguuacuucggcucaugaacacuaaguuuggggacugagaguuagcucagugguuacuuauggccucagaagcuggagacuuacaguuccaaguacucaggaagauguuuccugcuuugggccuuuguuaccugagucuggcacaccauugcuggcauacuuccaucucucuacagccacccacauuagcagcacuuagugucagcuaagccuuuagucccugugucuuaggaguugacacucuuggccucuaacaguggcugcuguuauaauucucaguccuggccacuggagccaguaguagccccuugcagaucuuugaaugcuggguccucuguucuuacgacuuagaaggaaucuggaacucucucagagcauaccaucuuccacuuuuggucuucaagaccuuccaccuucuguagucuuggccagcuucucuugccuucucuccuuccaugguccuucaccauuuugggugccucugcucaccacaguuucuucccuaggguuguucucugggucccuucaguccccuucuucuuuuuuuuuuuaaagguuuauuuuuaauauguguaugcauaugcaugaggaggccaggagagcgcaucagacccccuggagcugaaguuauugugagcauccuaauguggguucuggaaauucaaccuagauccucuggaagaacaaccaguucucuuuuuuuuaaagauuuauuuauuuauuauauguaaguacacuguaacuguccucagacacuccagaagagggagucagaucucauuacggaugguugugagccaccaugugguugcugggauuugaacuccagaccuucggaagagcagucgggugcucuuacccgcccccuucuugaugcuuuugcuguuaucacuguagccugucaucacagugagccucagguugcaauucuuaggagcaacacaaaggagcagaccuccucauugaaucaaacaguagagagggagaaagaaggggagaaagggaagggagaagggagacgggggagggagagggaagacaagagagagggagaaggagcuggagagggagaggagaaaggggaggggaggaggagggagagggcucugcaggaaaggguauauaccauuaagccugcauuuaauccacagcaccuaguuggaagaaggaaugaacugacucuugaaaguuguucucuggccuccaaauagcuacuguggcaugugcauauuugcauauacacaaaauaaauaaaugugauuuaaaaaaauuaaagccaagcgagcagccuagcgauagagccagaagggcgugggcagaauguaaaagagcaggauucuaauuagcaucaauagcagcaaagcauccaguuccaucaaucaaaaccuuguuuaaacaucaaucaugagguuuacauaagagccagugagauaguucagugaguaaaagcaccugcugcuagaacugauggcccaagcucaauuccugggacccacaagaugaaagaaaacaaaacaacaacaacaacaaaaucuuauaaguugucuucugacuucugcauauacagccuggugcauggacaugcauggacacaugcauacacacaugcaugcaugcaugcacauacucucgggcaugugcagaaagacagaaacagagacagcaagagaaagagaggcagauaaauaaaugaauaaaaggaaauaaaauauaauaaaagccuuacauaaaaaaacacacacaagccucacacuguaccaaucauggcuuucucuuggugugcagaggcaaauucuuucccuucuagucuaagagagaauaauccaagcuaaccagaccuguaggguucccuaaggcucgccucggccuggugaagucuuccaaagcagaugcaagcugucccgaacagucaaggcugagcuggaagccauggccccagcagccagggcuguagagaugcccaagacuggaguguggauucgggaagaugucugugaagguuccagugggcacagcagccaagcaacaaggggaaugacucaggugaguuuccacgcaagacaagcaugagacauuuaucaaagagucgcauagauugcaccccaaacagcuuagcuuauuuggagaaaaaguaaaaauuaaaaggugccuaagauaauaaagacuuaucacuaacagaguuuuucaauuuuuuucauuuuguuuguuauuuuguuguuuguuuguuuguuuguuuuuuagacaaaaucacacacuguagcccaggcucgcccagcucuugucgcaacccucucuccucucaacuguccugcuucagccucccaaguguuaggauuggagggauaaacuaccaugcccaacuaacaugaacauucuuuuuuuuaauuuuuuuuuauuuuauauacauuguuuuuuugccuccauacaugugugucugugugaggaugucggaccccuggaacuggaguuacagacaguugugagcugccacuugggugcugggaauuguacccaggucuucuggaagagcaguaguuauucggugcuuaacucauguuuuaaaaaugccccuaaagggccugggacuuuaguuucagugguagaauacuugucugacaagcccuggguucugguccucagcuccugcaggcaggggugugguguagguaggggacaggucgaaaagcuucuagaaauuauuguguccucuagccuguuuuuggaaucuuaaaaggaagaggacuuagcuugcccggggacuucagucugugaugacuuggcucuacugugucugggcuguagugagguagaaucuccaggugggagguugugaccucagcaagcugcucauauauaaugguaguaagaacacaaggagaggacacaggacaguauaaccccacccccaucaccacucccucacccugagaacaacaagguccuaccucugaaaacucccuaaagccuucggauuaaugaauccaucaaugacuaacuggaugaugaauacagccaucauagaccaaccauguccucauggcuccaucuuuuaguacugcacugaagaccaagguuauaaaacaugagucaugguggggugguggcucaaaacauuacuaauguuaaauuuaaauguagaaccuugagugugugucuguaaagggguuuggucuggaacaucgacuggccucuucauuucaguuauuuuacucuucagcccuaggauuucuauuuagcuccuuaaaguaauuuuaauuaaaaauaguguccaccauaggcucacuuuucugaacacucagucuccacauggaaacacuguuuggaaagauauuuaaccuuugagagguagagggcuucgcugggggaagcaugccacugugugcuggcucugaaguugcaaaggcuggccggacuucugacucucugcuuccugaguguagugugguguguguggggugugugugugugugugugugugugugugugaagucugguuccugacuaucagccuggccccaugcugcugcucugacuucucuaguaagguauuauaucacccuagaacuggaagcuaaauuaaacccauucuucucuuccuucuuuuuucugauuuguucuuuuuuugagacaagaucucacuauucagcccggaaauuggcuagaauuggcuguguagaccggguggccacaaacucauagagaguccucugcuucucaagugguaggauuuaagggguacacugcacaagaacuaacuuguuuuuuuuaucaucaagcuauuuuaucacagaaacagaagagaaacuaauacacuacuucucuguauccuggauuagaugugacgcuauguucauacacuccuuguacucuuaaggguguuuuccuuugauucucugaauguauuuugaauggcugcuuuaaauguuuguccaguuggccauaugggcccucugaccauguaacuuuucuuuauuguuuuucucuggcuaugugucaaauuuuccuguuucuuuucauaucucauaauuauuuuguuuaaaguugacucuuucagggaauuuguuauagcauuuuuuuuucauucuuacacguggcugaaguccuucacacguuccccauggcucacugcuuuuacuuguuuaguuagccacuugguaagacuauuuuuagaaacauucauuucccuuucauugugccugcuagaucagccugugcccuguccaagauaccccauggcaaauacacaguacuuccuuugcggggaugccugguacuaggugaccccauuuuacaaucagcauuugacuucauguugaacaugauauaaacaacaccaucuguccaggaguaucacgaggcgcagacugaucacuuacuucuaagagaagaacccuaaaaaaaucaucagaguuaauugggaucacaugaguguaugaggaaaaugaagcccuggaccuaggaaagguggaacacccucaucuggacccccaaaagagaagacaccgaacacuguggaguucugccaaccacucuucuggccaccaguuugugcaucuggggacugacaaaggacuccuuacugucccggggaccucagcucagcucagcucagucagucaccaaugcugccauggccuccucggauuguccacucagucucuacccuguggcuuccuugcuucaacaauucaacucaacccugagcuucagcucugacuucucacccuacaauccuccugugcccacacauagacuuggccuaucugcuuucugucucugccuauaugcaguagacuucuuugaacuuugcuguguugucuuuaacccuuuuguagcuauuuugagacugcugcugcugcugcugcuacuacuacugcugcuacuacuacuacuacuacuacacacacacacacacagugggaugugugacucuacuacuacuacuacuacuacuacuacuacuacuauuacuacacacacacacacacacacacacagugggaugugugaccugagaguuaauaccaacaaagauuagaguaaaagaaccuguguuugcuaaucaucgucuaucaagggaaacgggugacuuuuacaaaugauagacaacaaacugaauguagcuugugaacuuauuguuacuuaauaaacucugacacuguggaaagacagaaacauguccgugucuccgacacagugcacucaaggacugagccagcuaugcagcaguugccuugacucacuccgagcaacagugguuuucugcgcucuuuaucuguuuuccuggucuguccugcugugguauuaccaccagauguuagccuccucaaaaugguagcuaauauacccuggggcauaaggugauccacagucuaauccaguugaauuuaggaagucuaaggagggacuuuuuugaguucagucuuggcugugacccggaggcugucucuuccccggcucucugauaaacuagcucaccugcugcguagccuguugcuccuagagagcuaccagccccuucuuacugauuaccaccuaagcacgcccuauuugcaagaacaucuuuaguuuuuaaccuguuucaaauaaagucaguuccuaccgagacaaugucagaguucaguucuuagggaugccucugccugggcagaaucucugagaugauacuucacagcuggggguggaggcagcagccuccccucagagagacucuuccggcuuuauggguaugacuccgagaggggaccgugguucuguuauccuaagcuugcuuacugagacauugaacuccuagccuauacgcgcuagcugggauagagagaaaugaaggguagcuaauuucucuuaucuuuuaggcgcacuuaauuugaauuuaguuucucauuguguagccauuuccuccaaacuggaaucucuacccuaccccagaaaugaauagaggagggaucauaagucccaggaagcugaaaaaaaaaaaaaaaaaaagucuacagucucacagaacgcgcagaggcuccggagggaaguuacacgguucccagacuccuccgccgggauaaauaagcaacaauagguugcuggcagacagaagagacucuucagagucgccgacugcagguuggacggggagcucugagcaugagcuuucuugaguuccgccccacgcugggguccggguuguggugacgucacucaugugccuguuaagccucacucugguuuauucaccacgcuagauuuggauggaaucguuucuguguccugaugagcugggcccucucugcaguggagaauacaugucucuuuguagcuucucaacauacucuagaggugaugaguuugaccgagagccugucccucccagagaaacaccuaguuguuuauugggcccugaggaugagggagugugggccucuugaccccacuuacagaacugagucucuguugugcuagguugcagagauacugaugcagagauacugaagauguuuuuagccgagguucagcggauuuucuuuaauaacuauuucaguauucacuuugggcgauaucaagagacuucaaaggacuacuuaaaaguuguuuacuuauuuuuauuuuuaaaaauuucauacaguguauuuugaucaugucuuuuccuccccagcucgccccagagccccccccccacuucucaacucacucaguuucaugcccccccaaaauccaaaacaaacaaacagaaaugaaaaucaaaccaaaaaaaaaaaaaaauuaaaugggaugguuuaaacugggaacgaauccauggaagcuuuuccguugcuaguugcuggggauccguuuaaagcuuuguccuuauccugaacuugcucaucaucuagagcagaacaaaucccuacaagcagacaggacaauuuuaguuguaugaugaaagaguuaagcacaaugcguaagugaacaucuaggagagucucgggacucaguucauggagcugaguucugaagaagagacauuaucaaggagucugagaugggaagaguucugcagacagagaagggcaaguuccggauauagagaagauagagcauuaaugagauaggagaguaccaugcccaacgagagaagcuggugaaauagagaacaauauagacccaaggcccggccaagcaagugagggcugauagcuguugagcugguauugagugccgcuggaacgagacaucuagcugucucaaggcauugaagacaagcagaacaaacagaacgaaugguucuugggggucaguucucuaguucaggaauaaucaggaccuugcugggcagcccacaucuagcuuccaugauaaaaccuuagagaaaaagaacaggaucagacuggaugugaugggaaaaagacacugguaguaagagacaucuggggcucugguuucucugaauaaguggggcuguucacuaagagagggauggaggaagagccauuugaaagacaggagaaccuaaguuuacuggucaguuuggcguugucauucucaucauuauuauuauugauaguaguagcaugugucuaugcuuguguguguauacugcaugugugcaugacuguggauguauagaugucauggugcacaugugcaagucagagaacaauuuggguuuuuuguuguuguugcucauuagucaauuugaacaugguugguucauugucaauucauuggcuaguuuuaacaccacgucucuuguuagaaaagccacacagguuugccuugcucacaggcucauguuaaagauaaacagguuucagauguaauguuuuugcuaugccuuuaucugaagaaacucacuuuacagcgcugcucucaaugaucaacugcuugugucucauucaugguaaauaauuggguagaaaaaaaaagcauaaaacuuaugcaaggccugaggauaaaagaggucaaguuaugaagaucuaaaaguauuuuaggggcuaagaaugcgucuuaagguugguaaaugcaagugaaagccuaacaguuauaagaaagccguuuaaggcauacaaaagacugaagacgcuucagauuucuuccccuugcucugcaaccguuguguuucgaaagcuuggaguuguaacauugaucaaugggguucugacaaguuauuagucuaacucugguaaaacuaugauccucuaugcuaaauugcuagacauccagucuucuggagagaggaaagcaaccccucuugucccuucugcuccacagaacguuucugucuucccugagcucaccuuaaaggguccucaugcuuuuaacaacaacaacaaaauugcuuagcaagccuuuacuaugacacauauaugguaccuacuauccuuuucuauaggaccaaaggcacucuuuaauuggcaccucuguagucaaacacauacuauagauuaguuuuucacuagccaaaauuaauuacaccuuggccacuuaguuuuaaaaauggauccuuacuuccuaugaagacauaaauaucaggaguaaugguuaugcugaaagaacuuucuuguuuuuagcaaauuuuggcuuugcacuucacagcaaauugcaaccguaacucugguaaguuuaccagagauuaaauuuaagacccccgagcgcuuccauauucuauaaacucauuucuguuuguccaacauuaucuucucccaaacgauugucaauggugagcauucaacaaaagugguccagggagggauuggguggguagaagggaccaacccaaaccaaauaacauucagccgaacaaaacucaccaccuggggcagcuaaaauucucauauacuuaauuagacauaucacaaaaccacuuauccaaaauaagcuuuaaggggcuguuuaagcaacuaaauuauuuccuuauucucucucucucucucucucucucuuuuuuuuuuugagacaccaucuccaucgauaacucaggcuugccuugaacuccaggaauacucccgccucagcuucuggagggcugagauugggacaguagucacccucgagucccucuggaguucuucggguuuuuuuguuuuuuguuuuuuucuuuucuacauuagauaaagauuuauuuaaaguagcaaagauccaacguguucagagaccuggggaauuucugucccacaaagaacagcugacagcuuuugcuggggacaucccaggcuccaucagaaagcguaccaggaaauaggucccugcaggccgcauggggaccgaggcgcggccaagccccgccagccucgcacaugcacucgaacacguaggcgggagccgcgggcgguccugcgccccgcacacaggcuggccguagcugggcgcugagcccaggcacguaccggggcggggccagcccgacucgggcugcguuuccacccgcagcagguagcaccgcgcccggagcaggaguacuggguuguccgcgggccagagacggucaggcucgcucuaccgcucucaggcaccugccuuucucugcguuccggaaugcggccaagaccgaauaaaggaaauuacauaguaagcggagaucgggugucugagcagcgccuuggaucaaauccacucaugacagguaagcauaaaaaaauauucccaaacggcugaagggugugaacacaaagcuccaggaggcguucagaggaacggguguggugaaaugucgcuuuuaucugaccagagacaauguaggaucauaugcuacagauugcucuaacucgcaaacgauccuggacaacagguucaaagcuacguuaaaggaaagaaauaagcucaaggugggcagacuugaaacaccauaacaguuuuuguuuguuuguucuuacuuuuuuguuuuuuuaaaucccagcuagcaacaugcuuaagguuuuauugaauuaaacuuuaaagaaagagaaucccccaccugccccucauuuuucuuuuccccaacucuuugcuugacauucuugccuuagaacuuuggacuuuucacaccucuuaccgaggcuuagaggaggaaguaagauucggaaugguaauccuaaaguuuaaccgugucuguuaugcuguuaauuccaacagcucugagaaagcugcacgcaucuuuauguaagccucuuauaugucaaaugcuuugucauaccuuacaccuccagucacuucaaugucucuauauucagagaaguaaaguuuuaguucaaacucaaagcccauuaaauagcuuaaaaacacucuuauuuguaucuugccacuccucuuccacaugugucaccucacucuuaagugacacccggcccuccauuuucugcucucauuguguaguccucugugcucuuuaaacagucggcaauggggaaaccaguauguucuguggacugaugguuagggcucuaaagucacugauggccagaaucuagaauguauaaagugauagagagauuaugaauuagccuaacaugcaaaaugcuagcuagcauuaagucuggcauguagaauucagacauccaugucauuuagcuucagacuuuguaaagcacuucagcaagagccagccauugguaaugggucgucauuuucaguucuaugccagugacacagaacaaacaaaauauguuaauuccuuuugccauacuuuggucaagggagaguaauuacuagucacgcagucauagcagcaccagagaacagggcggcauagauauacuugccggagaguaguacuugugguaccagagcagggcuauauauaaaagcacugcagagaaacucaacauggugggcaacacuaggaaggagcagcugacuguauguggagucuaguguacuaggaaggaguggcugacugccuggaauccaggcaacuucuuucuuuucuucccuaaaaguucccuucugaaccacugcucauaagucacuucuauacauauaacagauuuacaaauauuuggaaacuguacauaaacuucaaguuuucaacuaaagcuaauuuguuaaacauaauuuuuaaauuuugugaacugugaauauuauacagccacuuuaaaaugucaccucuagagcugucuauacuuaaauguggaugcacguuggcucaugguguacuuugaauuaauauuacuacacuguuccaaauugcuacauauuuguaaccaaucacugguucauccuaagauuaagaacagcucccuaaguuaaacucacuuggccuaggauuuaaccccaggacuaggcucucacugguuauguaaggaguaaagauagguuucugggcuggaguuuggcacagugauggcaugcuugccucguauccaugugaagccuggguuugauccucauugucacaccaauggguucuaaaagacuguuaucucuagguguagggacacacuaaccuccuucuccaucucuucuuuuacacaaaacacgcaugcagcccccagcggccuggacccacuuugucgccaaagcugggcuggaauuccugauuacccuagcucugcuuccuaagugcacacccaaauuccacauuuuaccuuuauaucuuucuagacugauuuuuuuaaacuuagacuaugaaagcagaacagauauauuacuagaaaaacagagaaaaagaaucaaguaucuaaaaacaaaguuuuuaaaauacuaaaacaaagugauacaugaacuagaaagauaugcauauaagcuggaagguuugugguguuuauuuggaaguuucuaaaauucacaauugcauaagauacuuuuuuaaagcuggcaaaguaaagaaacaucagguaauauaugauuaucuauauaauguaucugcauauuaaugugccauguaccagaaucaaaccaaaccaauaucaaaaccaaacaagguauguucugagaccuaagauucugacaugccacauagcucccugagagcgcggaaaacucuuguuucagcccuagcuuccuucaccugcuaaugggaacagauuagacaugcacgcaggagccugagcccucaaaacaguaugaucauguuucaugaacuguuucacuuacuccauucauacugcaaauacugaagguuuguacuuuauauuuuaauagacucauacauuuauaauggcaaaauucuaaaaaaaaauucucuuuacaaugcaauauuaugaugucauuauuuaacaugacauuuagggacacaucauacauuagaaaauggcaauaaaaugaauguagaaauguacaaucuaauuuuuauaaagaacuuaaauuuuugagaaaucguuuuaugagcuagaaauguugagacaaauguuauuuaaacguaagcgcugacccagggggccugguccacagaagauguuuauuugauauaacaaaacaguacaguuaguguuagacccaaccacaaagagcaagggaacgaaaaauuuauacaguauacauagaaaaaacaagauguuuacuaugacaacucuauauuccuaaaauaaugcuucuaaaauuacucacuuauugaaaucuauaugaaaaaaggauguuaauagcgacaaagugcauaaaaccaaacaucauauuuucaacaaaucaacauacuaggcaauuuuacuaacaaagcaugauuuuuuguuuguuuguuuacaguaugcucaaaaugucuuuauaccaacagggugggcagaacauuuauguuucauaaucaauuacacaauauuagcauaagcuuccacaacuacagagggacuguuuugaguugguaaagucaagaaacaccagauaacuucucugaauugagaauuuuauccaaauaaaugccacauaccuuccagauauaagcauauuucuuuauaucauguaaauggcuuuacccauauaaagaaaccauacaguuuaagaaucauuauaagaucaacagcuucaugauccaggcuuaacaauuccauaggccaaaaaaaauuucuuaaaaacuaguuuuauaaaugcagaauauauugcaugaguaacugcugguuuuuuaaagaaaauauauugugcaauuguggcuaccauguacugcugacaaagcauuauuuucauguaaaacaugaaaaaaaugaguaaaaaguuuucaacugccuaugaucaugaugagaauuuacugcuuucuuaaaaaauuauauuggcauuucauuaaaaauaauucaauaagggacaaacucccucaccaaaaauaaauaaauaaaaaggugcauuuuaaaugacacuacagcaaugcaauggugaaaugcugaggagcugugaaugugcugugaucuggcauuaaaagaacauauuaaaaagagcauuaaugaaaauuaaguagaaaggggaugaaaacuaaacuaucugaguuugugcaguauuguagccaggcuucuaaaauuagauauagaaaauauaaauagacugcugagccaccaguguccaaaaauaaccaacagaaacaaaaacccaacaaacaacaacaacugaacaaaaacauuaacaaucaaaaggaaugagauuaggaaacgcucaguuaacuugauccaaagcucugaguaauucuucacccugcaguagguuucugcugccuuguaugggagcauuaacuucacaaucguaacuggucagcugugguaauccacucucauccauugacugccccagcagucugcaugcuaaaucugaaaaacaaggagaugccuaguaucauuaaauugauuaaacacuuauuaugcaguagguacuggguaaaauaaauuuucuagaagggcuuuaguccccugggcaaacccuaagcuauguaaauaaguaaguguaaucaaguuuaugucugcugucagaauguuaacacaaagugugcucugaaaugccuaaucccugaaugcaggcagcagacaaaaugcaccgcacaucuccuuuccuuuauuucucuuugaggcagcguuuuacuauguauuuguaguccuuguuggucuggaucucacuuuguagaccagcuggccucaaacucagagauccaccugccucuggcucccgagugcugggacuaaaggcacuaaaggcucauccaccacuucacuucuuaaucguucuaaggaaccaaaaccacugucccuuggagaaaaacucgaaaaaaaauuuuuuuauauucaaacuuuucuuuguguuggcuaagagcagaaagaauacacuaaccggaggguauuaaaauaauagucuuuugcuccguuccauucuguucacuagauaugaauccuuucacucguuuccaggaaagugacauaguaggugcacagucaccugguugcugcaauaauguucccuaaaaagaaugaaguuaauauuuaguauguugcauuuucuuuacaauaaaaaacuuuguaaucaguauauauuuaauagcaaccaaaaagccaguuucuuaaacaauccucuaaaaauuuuuucucuuaaauaaucuuucauuuauucuuauaauagcaaugacaaagguuauuucuuacccauuaacaauccuauccauaaaacauauuaagacauuguuaauauguuuuauaauacuuuccacucacucuguucuggcaauaggcuagccucaacuaucucuaaaacacagugcuucuuuuaaaaauacuuuagauuuauuuuuauguauauggguaauuuugccugcauguaugccagcagaggccagaagaacauauuagauuugcugcaacuggcauuacagagagagggcugugauccacauuuugcgaacugggauuugaaccuagagucuucagaagagcaaucagcacucuugccugcugacccaugucuccagccccagugccucuauaaggaggaaaaagaacucacagagaaacgaaugagaguggagggacacugaggguauuuccucuacauuugucugucauguuugguuucuaacaccagaauuuagucauuaaauguaaguuaaaaaagaagcccaaugauagcuuugaaaguagagcuuuauuuuuaguauucauuuggaauacaaugcaccacugauacuuacaauuccugcugcuugaaaaagggagccaucauguuccauuuuucgcuuccucugagcauucugcgaagcuauugucuuuggguuuaauucuuccucaggaacaguauuucuggaaaagaaaaaaauauauaaaaccacuguuguucaguggacuuauauuuuggggacuacugaaauacaagaugauucauuucuguauaguauuuucaacuuauaaauguuucagcuagacacaccuauaaucccuguuugaauccagccuggcuauauuuuaauuuuaaagcuagcuuugacuacauagugagaccuugccucaaaaacaggaacaacaaccaaacaagauuuauguucauuuuaaccucacuuuaccacucagggaugauaugacagguacucuguaaccacuuuauaaaugagaaaucgauggcaguuugguaguuuguucuaagucccaauguuaauucauuuuagcuauggaaauacaagcccagccuucacauucuugucuccucagugaccuuuguaaucugcuacuuugaccucaguacugaucaauaugucuaacugcuguaucugaaauuaauagcaugcaacaaggaaccacuuucugaagucacuaaguuugcuguuuguguuggucuuucaauagaaagccagguaaauggcugagucacagucauacaugauuaacuccucugugaauguggcuuacaagccaugcaguguauagacaagcugguuuuaaauuuuuauacaagcauguuauguucacgaaauaugucaguuuaucauguaaguaucaccucugguuguacaucuauuuauuuugugugugugcacaccacuacaccgagucuugguuuuaagcuuguaauucuccugacuuagcugccugagagccaagacuaaaggaauauauuacuauauccaacugaaaauacuaaauucaucuaaagcccuacuccuuuuuuuuuuuuuuugacucaagaaaaaggcaggccugucccagugcuucaaguaggauaggggaacauggcucccugcaguccuuccuucugcuaucagccacagcuugcucugucuagauauaauacaaaaggaguccuuuuucuucuacucaccaauuagugaaaaggauuuuccuugcuuuaaaacaugucaaauacuauuacauauuauauacagaaauucuaaauauuugcucaagcauugcuucauucuaucaaaacaauacugcaagucacguuaggacucuugguagaucuaauaaaagcuuucuuuuucuucuuacaauuauacacaagauuucagaaagaaggccuacaaauauccauauuuaccaaugagaacucaagaucaccagcugcaaucugggaugaaaaagaaccauguggcugaaggguuuuucuucagguuaauuuacaaaagucccagguuagaaagaucuaagcagggaagacagcuauuucccauucuuaacagcagcaugaagagauuccuggcauuuauagaacuuacuggcuggacuuuauuuuuagagauucaauuuauaaaugacagacagauguuggaaaacaucucugaccuccuauauuuagacaguugauaggauuguuugagagagagaaguuagaccguaacuuagaaacuggcuuuugaguguuuguuuuaauucagacaaugcaugaaaugaacuuuacgauguuccuuaaagcguaugucagaaaguuggcucuauguuuagaaaucauuuaacauugcauauauacuagaacaugcagaauuauguuccauacaaauaccuuugauucaaaguggcagacagguuaaggcuccuuggaugagcuuugucugucuguucuaugacucucuuuccugcucugucuggugaggcuguccgacugugagugccacuguaugcugaugccuuagcaguggucguuucuugagguacuuggguagaagauggagaugcaaucaguauuuuaauaucuucuuuauuguccuucgucucuguuuuugauucaucagugguggcaguugugguggcaguggcagugaugguagguuucuguaacugggucugcuggaacccaguaacugugcucauacuuggagggcuuggagaauugcucucuaauggugacaacugaucaaaggaacguaacuggaaaucaucauccauugggauauagggagccagcaucuccaaaucuaaaucaguguccuuucaaacaauaaauacaagaggcuuuauaaugaccagucuuguaaaaggaauaacaaguuaaacccagucacuuaaaguacaaaacaagcaagguaauaagcauaccugaguugaaaauggauucuuugccucugugucuucagcaaacaguuuuuccaccaguuccaacuugaauacauugaccauaucgcuauccacaucaaagcaauauucacugggacuguuaggcugggaaaaguuaggaguguuuacguuuuccugaagaagucucuguuuguuaagaaguuucagacacacaaauauuacauagaguuuuagcuaacuaaaaauuacaaugaaaaaauguguuuaguugaugugguggugcacaucucuaaucccagcacucgcucaagaagcacaggcauuagaaucucucuaaguuugaggccagccuggucugcagagugagugccaggccuaaaagggugacauagcaaaacccugucucaaaaauaaaauaaaauaaaauagaaccaaaauaagaccagccacaaauguugucuacccucaccccagauuuuuuuauucuacauaauaacauucaccaaacaauucaguucuaacuuuuuuguuuuguuuuguuuuuuuggagauaggguuucucuguguagcccuggcuguccuggaacucacucuguagaccaggcuggccucgaacacagaaauccgccugccucugccucccgagugcugggauuaaaggcgugcgccaccaugcccggcaccaaacaauucagaucccacaaugguacauaaucauccaauuaauuagaugauauuuucaccauaaucuuaaaaugccuauucuacuggauauuuuagaggauacucuauugugcuaggaguucaagaauuucaguaaugaauaugguagcuagacugagcauaaaacuuuacuuuucuucauuuuucacuacauuuacuuuauaaaaucagugacaaaaugaaucacacacuuuugugcugggcaaagcaucagagaaaagaauacauucucaaccuugguuuugagauuccauacuguuuaacuuacacuuggcagcuuuaaucccuaacaguuuaauggagaaucaauacuuauuugugcuucacuaacuuaagaucuaagcuguucugcuccuaaguacagucuuaauaguagaaaguucagagauggaauugcucuguauuuggaaacagcguuuuugacacuuucugcccugguccaaccuagauaugaugaguuuugaguucuaucaauuucaggcauuuauuccuaaccuuuucuuagaucaugguaccaaccucaggugaacuuugucuagugcuuccaucagaaggacuugcuggcugaucuugaaucuggggcaugguaaaagaaagucccagugacucuggacuugauucuaauuuuaaugcaaccucuugauucagugcaggaucagcacuacuucgaaguggcuuuggaguuuccgaugaagguaaaggagacauugccagguuuauauuuaauuuuucauuagaagagggaaacauuacaucauuauauaauggaacaucuucaaguuguugaucuucaguuucugugucugcagaggaaagcguuugucaaucaagaggacaucaggauuuuaacauucauagaugauuuucugauuuuuagaagaguugugauucaaucaguuucuuuacuugaaaguuuauagauauuauacaaugaccacuaaguaaguguaaguuaucuguuauaguccaccacugauaggaguaauacauauaccuucaaccuuuuuauauauaucuuaauuugaaguaacaauuuucauuuuucauguuugcuuugaugguacaguugcuuuguacaaugccuuuaacauuuacccaacuacauguacugcaauuuaacucuacugaauggugcagugagguggcugagaggaaauuaacacggcaucaagaaauaccuucaggauacucugagcuacaauucccaaaaaaaacauaaaaauaaaagcaggaaggcugugauauuucagaaacaaauauuagacacaauacuuuugaggagacuauuaaaaacaaaacaugugagcaucacgugaauggaugagccaagagcugaggcugcggaggcauggagcagcugagcagggacuggagugguggacagaguaacuaagcacugaccaucgcugccaaaauccagagagaugauggugucgccggcagcuggagccagcagagugagagcaucaggcuccuucuuaagcuuaucaaaaaggcagcuuguauccucugauucaacuuuggugaacagcugagucaucuucauaucugaagauucaacugguuugagcacagauucuguuuguugaagggagaaaaucaagucgugcugaauaauaccacugucaaaaaaggagagauuaguauuuauaaacgagcacuagaaacaaugacaguagggggacuauggaaugaccgugucucuuaaaauaugauuuauauaguaaaagcauuuuaacaccccugagaugaauaaucuuucauguauacuugcaacauuucucccccacgcccccagugcugaggauugagcccuaagcaaguguuguacuauugagaaauauuuauuguuuuaaaacaccaauaugaagauaaaaauguaaacaaaauuuacuaacuauucaacuuauuuaaauugaaacaacauugagaagagaggcggugacaagaacaugugcaguuaaagugcaugaaggacauaagcaggaaggacuucugugcugaugcuacaaugaaauaggcacaaaauaacuguucagcauuaauacgcaaggcauggucuauggguaaucuuagauacaauaauggccacagucuuuaugagggguaucauauuuucuugguggaaauaauauagugaugucauuuauaggauagggaagaagaaagagaaaugaugaaaaaccacucagcaucaugucuggcaucaagguacucuagauaacauauuacauauucaauaaaugaaaugcacuaagaguacaaagacaaaagcauaaacucuugucuucaaguaguuuauaauucagugugaaauagauaagcaaacaauuucaauauacuaugaucacugauaaaaugaagaaaggauguuucagagaaaggcuaaugagcaaaacuugggaucaaguaacaaucaugaggaaaacaagaaaaauaguuuuauagaaaggcaaaaaucacaaaagaacucuuuggcauuaagaggauucuuugcaauuagaagugguaaggcauuaaguuugauccuagcacuaaaaauuucccccugaaagaaacaacaaaaacuaaaaguuuuaagaccccaaaaauggccaaaguaggguaaccuggguuugguggcaucuaugaaaguugugcuggagacuucugggcagcccugcaaucccacacaguagguaggcugugaauucaaggcuggacugaucuacagugaguuccaggccagcaaagccuauccagugaggcaggguaaagagcauggaacauaagaaaaugagcuaaccacaguagagagcucugccuggcaagcagauuagaauguuucgguaaugaagaggaacugaacuaaaauaacuuauagaguucauaaacauaaaauaaagucccgggucauaugacacagccugucacaaaggcggucauuuaaacuucauuagaaucuuuuuggccucaagaaacugaacuaggaaaauugauccacagacugauaaauaaaugauauuauuuugugggaucaaugacacaguuggcuucagaagguagguugggguauaaaucauaauccaguagaaaaagaaagguaaaagcaaaacucaguuuuuauuuauuuauuuuucuuuucaagacaggguuccucuguguagcucuggcuauccugaaacuuauucuguuggccaagauggcuuugaacucauggagaucuaccugucucugccuccuccucccaagugcugcgauuaaaggugugcgcuaccccugcuagguaauuuuaucucuucuuaauaaaggcacaguaaauccaaagaguuaccacuuuuccucacaaaagugucuccucccaagcuuaccuuacaacauaauucacacacacaaugcacuguggcugggaguucuucguauuauauaugacaguugcuugaguuucaacccagacauauccaccucuuuuggcaagcauccuguacuguccuguggugacuuguccuuuaguaaacacuggggauaagaaagcaccacaaagaaaauguagcugaauuuucaaucaaguaagugucaaauguagauuguuacauuuuguuuuuuuguuuaaagacaaggucuuucuguguagcccuggcuguucugaacucccuauguagaccaggcuggccucaaacucagagacccaccugcuucugucuuuggagugcugggggugucgggguagguagggguacugguaugugcuaccaugccuggcuggaucacuguuuuguuuuuaaaaaggaaagauuuaaauaaucuuuuauuauuuaaaauaguugugacaguuuaagcugauagagaagcccaaacccaccugaauauaaaccccaaaauaaaaccccuaucuuacuguaaaagaaugaaagccagaaaugaggaacaggguagcugcaguuccuucaaugagguauggucacacugucagacuagagacuaagcacaggacacauucaagaaaaugauacaaccaaaccacucuacagaacuuugacuguaaguggauaucauacuguagccuuccagcaguucaugaagucuaaaucauuuacugauugaggagaaugcuguaaaucaguaaagacgaugcuauugugaguauccaugcucugacuauaauuugggcaacucauacuaauacagugauauucaauacccucagaucauauuuggaagucauuuuuagguccagauuaaacaagcaagugagaaacuaugaacuuuagcuuacuuugagaucucagacuucaucauaugucaagagugucagauauuacauguguguaauacucaucccauucacucacugauucauggaacaaaugcucugacuaccuucuauugaccaaccauugauuucaugacauguguauggagauaaucuauaauauuugacuuuuauuuacuucuguauuuaaaauucuagggaaguuuuauguauuauuaagugaacagcuguaacauaacaguaauuucaugaucaauuugucuuaugaagagucuggagacuggguggcaauuuuagaaaguuagauagaacaguagagacugcaggacuuaagcagugagacuaucuucuugaguucuuuuuuuauuuuuaaauuuaauuuuuaaaaaaaguuuuauuuauuuauuuuaauuauguaugugaguacacuguagcuaucuucagacacaccagaagagggugucagaucuccacuauggaugguuguaagccaccaugugguugcugggauuugaacucagaaccucuggaagagcagucagugcucuuaaccacugagccaucucuccagcccccuccuugaguucuucuauuguacuuacuaucauggugaguuuuggucagaugaucagaauccaaagcaugauaauauucauaaauugagcggcccaaaaguucuuccggcucauaacccaucaacucaguaauucuguuacaaaacaaaacauuauuccucacuuaauaaauuuaaaauucacccuuaacaauucuauauuuaguauaauagccagacuuucugugucauuuagauucauccuugauucuuauccuuucaacucaaaauaaugaccuaucuuuaaaaaauauuuuauuauacauacuguuacuauuaacgcaggauauuauuaaauauugauaaugcuaaaugaaaugacaaaaguuccaaagacagucacaaauacaguuuaaauugcuagcaguauuuuucauagagcuaaauuguuuaccuuacaauuuuuaggcccauuggcaaggccucacuuuaaaagcuccacuaucauuaagccaaggauauucauacuaaguagaaaguaaaggaauaaccuuugucauuuuuuagaggauaaauauuuuuacuuggcuuuaauauuaauuuuaugagaauuuauuucagaugaaagaacagcaucuaaucgaguaugggcuggaaucuaauuccauagccugucuggucccuggcaguuccuuuagggagggcacucaagcugauucugcaugagccugcaggaagccaugaagacacacuuuaugaggaaggcaaagcugugcuugauauacuacgccaacugcaacuguuuuccucuaaagccuuucugggaacaaacaugaagcaagggugagacugcuaggcuuagaauucaagggacuuuuuuuuucuuuuuuaaacugaggugcugguaaaagauacuuacaucuuuuauccaaaauauaagcaaaacagaaaacaccuaaucagagaauaggcauaagcaagguaugcucauacaguuuguuaaauaauauaguuuguuuugucccaguuuaagaucugcuauuuacucuaaaaccaacaaaacagauuuuuuaaaacauaaacuagcacuucuucacaaagggaccaagacacauuaacauagacggcagcacuacaaaugaaaagaaacugcuuuaaaaauauuuguuuuccccucuauucaagaaugguaauaggggcagaaucuagggacucaaaaauacuaaagaaaaucccucccuacccccucccccuugugcugguacugagugauggauccuagggucuucugcaugcuagacuuucugguucaauuuuuucucuuucuuucuaggaacuucuugcauccauaaccccucagaaugaagauauggaaaaaacugccuaauuaugaaaaucuuacaugacauuucuaauaucuagggccagcagguaaaggcaccugcuaccaaaccugacuaguacaggcaaguggagagaaagaauucaagagaugcaggcaagaggaucagauaaaugaagauuuuguauacugagacucaggacguuuugacucaaccacauaucaaccaguauuucucaaacugaggaauguugacuauuaaaggacauugagaaaucaagauagaaauaccagacaguuuccuggcagacugauuucauguauguugggggaagcaagaggaaacagacuaaaguuuagagaacuacauagaaagucaguaccaaaagaggguaagagacccagaaaaugaguuguuuccaugcugaguacugauccccaggccuugcacacucugugagcacuguaccagucgcuucuccaauucuuacaaagguuguucuuauuagauuagaaaacuuguguucuaaagcaacuauauaguauggcauuuguccacaucuuaaggggaagaaucaucauuucuaugaacacaguaaauacucaaaauauaugugccaaaugauuauaucuuacauuacuaaguacaauaaacagcuauuugcggauagucuugauauuagaaguuuagacaucagcucuugguauagacagguggauggaucucugugagcuggaggccaucuuggucuacaggguaaguuucagaacacccagggcuguguagacucugucuuaaaaaaccaaaaacuaaccaaauaaacaaacaggaaagugauaccauaaaaggacugaugugcucaucguuaucuaggugccagugucagaauuucaguuggcuacagaacaucugccucuaauaacaggcuauacugcuugcagaaaaaaggaccaguaagacagcagcagaauaaacacugacagaagcaugugcaagggauguugccuaagaugcucuuaggcauccuuuuacagugugugcaaaggcacaagacauuaaaaaagaacaugaaacucuuuguaaugaguggcuggaaccauauccagaucggugauucucccaacuccugauuaauuuggugaacugagaagggacuagacuguaaauaccuuuccuugacauuuuaauacauuuagauuuaacugcacaagucuguuuuacuuucagcuuuuaaaauauauaccuauuuuaaauuuuauuuauuugagacagacaggcaggcauucauauguaguuuuaggucagcuuugucucaauucccaaguguuaagaucacugacauacaacaccacacccagaauguacagcuaucuuuugacaaauaaaucuucccacuuacaguacuacaagaagcaacugauguauuucuaagagaagggcacaaucugauccucaccuugggaagcccccuuuggauacaguggacguacaaguaaaaagguacaaauccguugguagaaaugcagcuuaggaguuuaugguaacaauucaggccaaagggaaugaaauaaagaauuuaaugacaggagcacaagguagauagaacgaugggagagacagugcauuuauuuuauuuuauauuuugguuuuucgagacaggguuucucuguguagcccugaauguccuggaacucacuuuguagaccauaccggccucgaacucagaaauccaccugccucugccucccgagugcugagauuaaaggcgugcgccaccacgcccagcugacaguacauuuauaauauuuacuacaaacuacuacuaaguguaguauguaguaaaguuacagucagguuucaacagugcugugucaacaacauuagggaucacaagaggugcaguaacuuaggcugucugggagcaguagaguaguuuaguaacaggaguauuuauuucauuauuaagaaaaugguguaggcagaaacaucaaguugacaauuacacacaaguaguaacagauuagggaaauggugacaggaaccaaggguggaguugaugaugcucaagaagaacauguggguuacagaccaaaacuguugccuacucuacauaaacuauuuaucuuuaaaacuuacuuucugaauuuaagcaaaauucccucaaacaaaagaacuucaugacuuuuguguucacugcuugcaguaccacagcaagaagucagugccuuuugcauguaggacaagugauccaccucugacuuggaaauuacccuccuccugucucagucuccucauagcuaagauuacaggaggaugccacuagauguagucaagaauuucaucuuaauagauuuuguauaauagcuaaauacaguauuuauaguauaaaagcuaaucuuacauuuuuggguucuaggaugcaucuucauauuuagcuucauggacauaucaauuaaguuuuuauuauagugauaugaaaaggcuacaaaaaaucuaaauuuuaaaaauauaaaauaguucauuuaccuuucaucacaguaagaaaauuucauaucgaggcugugucgacugagaaaugucuugcuaucuaaaggaauuucaauauuugacggaugaggaauggguucacaaaucagcaccaagcacgucaugggugguuucuuguacccacacugagguugguuacuguugguaucauagacaugaauauggcccgugcagugaagcaccugaauaugaguaagaaaauaaaguuaccuuuuuaaaauagaaagagguaaggggagcuggaaagauggcauagcaguuaagacauuaugagauaaugagguauucuaaaacaaaacaaaacaaaacaaaacaaccccacaacauugugaagguagggugcuagagaugagacagugguuaagcuuacugacugcuuuucccagaggaccuagaucugauuccuagcacucacaaggcagcuuacaaccauuuguaacccuauuuccagaggaucugacaccuucucauuucuucaggcaccaggcaugcaugcccugauauacauggaggcaaaacauucaugcacauaaaauagaaacuagggaucacuuauaauccagaauauggaucaaaugccuucuuuuggccucuguaaacacaugguaugcuuacaugcaaccaacuaaaacacuaaaacacacacgugcacacacacacacacacacacacacaaugaaaaauauuuaagucuuguauuaagucuagacuaucuuuccuucuucacuaaucuggucauuauaguugauuuugcucuggugacuaugguucaacacugaacaaaaaaaggaaacugagauagaaaauuauacuuauauuaggauuuaaauacuaguuggcaaagccaacugauaaguuagcuuaguauagaaauauugugggcuggagagauggcucaguggguaagagcaccgacugcucuuccaaaggucguugaguucaauuuccagcaaccacaugguggcucacaaccacccguaaugagaucugacgcccucuacuggugcauuuggagacagcuacaguguacucacauauaaauaaauaaauaaauguauguauauauuuuuuuaaaaaaaagaaauaucguauuuccaauaauuuguguuuauauaucucaaacugucagauuauuauacugucuuuaauggagauuacauauacugaauauaaaugcaaauaugcaaaagggaauaauuauacuuuucccucguaagucuauuuugaaauugauuuuuauuuuauguggguaagugcucuaucugcauguaugugugugcacuguguguguaccuggugccugaugaggucaggagaggauacuggaugauuuccuggaacuggaguuacaggugacagugaacugacacaugggugcugagcaccaaagccagguacuuggcaagcaagugcucuuaauuacuaagcacuuucuccauuccccucauaacucuaagcaaaacucuuuuguuuguuuuguuuucugagguaaggcuuguguuccccuggcuggccuggaacuugcugugaggacaaggcugccuucaaaucuguagcagaugaucuucugcuucccaagugcuagggucagcugacuuucagcacuccuagugaaagcucuugauacuagcauguauguguauagguuuauuuaucuauaaucaagugcacgcucagcuugcguaccuuccacguugcugacuugauguucaucguccucccccggcuuguuagggugcacuucauucugagaaaaaagcuccgcuguguguuuaguucuuucccuuuucucacugggccuaacgaaagcaagaaaccgaguuuuaagucacagcuaaacauagaaauuuguuaggaugagagcaucaaagcaaggcucucagcauuaacacaaccaugauuugcucccucuucaccuacuccagcaugucaguaggucugacagcuccauccagggagaguguguguaagacggcagugacucccuggacugugggaggagaguccacacuucacaggauuaauuauucaucugugcuggugaguuugguccaaguaaagaaaauaagaaaaugguguaaguguacccuauaaaugucugucaguauacaaguauguccccuucaaaagaacuuguguaaauacuucaugucuuuuaccaacugugauaacucaauuuugaauaagcagcaacguguuuacagaacuuuaaaaaugccaacuuaccuuuuguaaguaaauagcaucugaguaugaaagccagacagaauguucuaucagaaguuacagaaaucagccaugaugguacauaccaauacucucagcacuagggaggcugaaggaggaggauggagauggccgaccugagcuacauaugagaccuguuuacaauuuaaagucacaggaauagggacugggaauguagcucaauggacgaggacucccuuaguacauacauguaggccuggcuuugacacccagaacaacaacaaaaaagccacagaaauaaagcagaggaaaaucaauucacgucuaauuuaaucuuaaugucaaaccucauaacuaaaaaauuagauuacauuuagaugacucugaaacaacaucuugauuuccuuuuuuauugcuuagucugguucaaaacaaauguuuuacuuauuugaaaugcucagagaaaguggauuagauagauauagaacuucuuuuuugaggcaaugacauuuucuaaaauggcugaguguaaugguacaugccucuaaucccagcauuugggaggcagagguagguagcccucuaugaguucaagaacaacuuggucuacuuggaguccuaagccagccaggguuacauagugaaacccugucucaaaacaaacaaacauacaauaaaacaagacaauuuuaaaaaauaaaauuagagguaugauggugguuaggccauuucuaugaauaucuaaaaaaaucauggacauuuaucaaauggauacauuuuaagguauauaaaauggaaguauuagggaaaaaacaaacaaacacaaaauauccauuauuuagaaccgaguguguauacuuagagugaugcagagaucaauaauuagaugcaaugcuauuaagcauguaauacauaauacaguagggucaauagcaauacaaugcaaaguagucaagacuuaauaagacugcuuucaaagaacagagacuagguccugacagagggaauuaagaaagagagaccaguauacucuguuuauaaauuacuauuuuaaaaaaauuaacuguuaagucucuguaauucaacaaguacuucacagaacucucuugcaacuuuuuaaaaaaauuuacuuuuauuuuaugugcagaauuuugcuugcaugucuaugggagugugucagaucuuggaguaacagaccauugugagcugccaugaggaugugaauuugaagugggguccccccucccgaagaacagucaguggcccuaaccacugagccaucucuucagcccuucucuuacuucucuuuuugagacagggucucacucuguagccuuaccuggcuugaaacuaguuacauaaaccaggcuggccuggaaaucaagagaucugccuauaucugccuccuaagugcuaggauuaaagguguguacaaccacaugugguccaacacaacaucauccuuccaauuacagucucaaguuauugaaaacauccuuagaaguuaaagcaucuuugugcucuuaaaaucuuggccaccccccaauccugcuucuuuaggacauuaaaaaagccugaacccaaacugucacuguguauucagucaucaucgaaaaucuuauuaccugucauuuguauuauaacuucuugccuuaauacugcauuucuacuuauaauugucuuggucuuuuaauuaucuuuccuuuuuuucuacucguguauguaauuacuuauuaauucauguaacuacuuauuaauucaaugaguuuuaaaaacuugugaguuuucuaaaauguagaauaacagcuuuaacaaagaacaguauuaacauuaaaugugaaauaacauucucucuuaaaucaguacauuaccaaaaaaauaaaauuagaaacaauaucugacugaaaaucaccugucauauuaaaucaaacaauagacuuucuucucaccauuucuguguguaagcauuucucucauuuccucauggucacauggaugaguaaaaucaaacacacuguguccaguuaguucaaacugcaaacacauuaaaaaaauuagaucuauaucauauaaccauaaaguacccauuagugcucuucauauauggggacuuuaccugaguuaaccccauguauuuguucacguuaucagaaauguaaaccaugucgccgucaucuguuagcaccaucacaaagccaucuagggcuuucagauaaaaacaguccaucugugccuucaucucaucuucacugucuagaccaccugcagggcacacgggaaaagaaacaaagucaggcuuuaucucagauacuuuuaaauuucuauaauacauauauuuauuucuguauacuuuccaguuguuuuauauaauuguuuaaaauaaacaaauuugcaaacaagcaaaucaccaaggguguaaaaaagggugauauuuuuuaaagauagguuaugccuuuauacccaguccuaaggaggaagcagcagaugggucucugugaguucaaggcagccuaguuuacacagcaagguacagaucagccaggguuacauggugagacucuaugggggguggggguggggaggagaaggaggaggaggaagaggagaaggaggagaggaagaaggagagggagagggagacagagagagagagagagagacaaagagauacagguagacaggaggaaaugaauagaugaaaugaagcuuaaaagcuaguaagaaaaaaauugcugucauguggaagaaucgagaacucuucagaaugaaacaaaguaccaggggcuauaaaguuaaugaauuuuauuuauguguuuaaaaaauaaaggauuaaaaaaaaaggguaaaccaaaacaacuuacaguacaaaaaggauuauuccuacaacuaagaaaagcaaagcuugauaaaaggaguaaagaauacggaaagacuuaauuacuuuuaaaaaauacuuuaaaaaaaguauuguguuggggcaguacuggaaagauggcuaagcaguuaagagcacuaguugaucuuuccgaggaccuggauucaauucccagcacugaaaacugucuguaacuucauuuccaaaaaaaauccucuucuggcuucuacaaguacuaggcaugcaaauguugaaggcaaaacacccauacacaugcaauaauaacuuaauucauguuuuuuuuaaagagcggcguuaugggucuagagagauagcuccacauuuaagaaugcuugcugcgcaaccaacaggacuacauuuuggacaccagcacccacaucagguggcucauaaauaccuguaacucuagcuucaagggaucugauacccucuucuggccuccauaggccccuucauaagagcauauuaauaugugcacacaggugcauggacacauacacacaccacucucuuaaaagaaaguauuguagucuccugcuaaaaggaacuucuagauguuuuuaauuucuaauuuucagguccauuauguuuuuguagaacucaccggcauccagaaguuuucucacacguaaauaacugauggugagccucauaacagaagcuuuaucaagaugugagcucacauuguggggaaguggcaacugaugagcaagcucauaaaaaacuucagacucuuugcuucgccgagaucuugcugcaucucuagacuuuucuuuucgacguucagaacucauccuacuuaacaaaaaaaaaaaaagagagacaagaauguacauguuaguuugucuuaacucgaauaaaauuaauuuugcauuucccuguuuacuguauaaagauuagaagaaaccauguaaaauuauuauauaggacuuguauggaacaugaacaaaguuuuauauaagauagcuuuuauauacaaauuuuagaucacugaaaacauaauaaauucuuuuaaaauguccaagcuuuuauuuaacauuuccaaagcagauguuuucauccccaaauuuacaguagcuuauguaucuaaugucucacaaucauuccaaaguaucucaguauagaaaaacccuaaauaaauuugaagaaacuaaaguauauaauaauuugagaauagguaauacauuuaugggcagguuaagacacuaauaguuauacaugauuugauuaguuucuuuugacaucaauaccuucccaccuacucucuuaccaugggcuuuacauuagcugcuguaacaagcuacuacuuccaggugcuuacuuccuuagccacugguuaucuaguacuagaaauaacggauaccaaauaauguaggaauguguuucaaaugaaggugagucagagugcugauccgcaggugggcuaguaaagguaauaaaaguaucuauagaaugauacacaccgagaauucuuuccaaaccagucagauuuguuuaagcuuuaucaaggagagcugucuuccuuugcugagccuccugacucuaaggcuagcccagcugucagcugcuucucuaagccugccauuaucaauauuacuuugcacugggugcuuacucucgcauaacaacccauaaauauauaaacagugcccucauuugaugaaaauaagcugggguuccauagauuaaaaacagcaauuguaugacaaauaggauaggaacaucaguguuuuaagucuuuccuuuucuacagucugcucuauuaauggagaaugcugccucuauuuuacuccuccauuccaaucuuacuagguuagguauuugcuaaauguugaaaacagcucuuagaauuuauuaaacauuuaacaauauaacgggauuuuuuucacucaguucuucuuguauuuuaugaacaaagcacacaauuaucuuuucuuuaagucuccuuccuuuuaauguaaggcugaaagcuacaagcagagaaacaacuuucuuagguaacugucaagaguucucagcaacucucuuauacaguuuucaaaguuuaguaaagaauguguacauuuguuagauucuaaacugugauacaaaaauuucaacucauuuaguggguguguccaacuuuugacaucgcacacagcacugucaucaacugugcaauugaguuacaaaaaauguuucaacaggcauguuuuauguaggcuuacaauuauuuguguuagccauauuugucauauuguggggcauauguggucuguaggucacuggcuguauacaccuaauuauagagcaauuucacucaagaaccuuaagauuuuaaguagggcuauuaagaaacuugucacaaauaggggguuaggucugauacacuguauauaaguguaaaauuuugaaagaauuaaaaaaaaucacuuggagcuccuuauauaaaugaauccguauauucuuaauauccuacaauaaaaaauagaggccauaugagaguaccuuaaugccaacaguuugaaauuuuuuaaguacauuaaaacugcuuucuuuuccucacuauuuucaauuugaacuuuguaaugaaauaguuuugaaacucauuucauuuauauaauacucugaaagggagguaagagagagagcagagaucugcuggguuacaaugaacacuuuauauacacacacacacacauuuugacaggguuuuacuauauaucucuggcuggcuuggaacuugcuauguaguccagacaugccuugaacucacagagcuccaucugccuguuuccaaagucugggauuaaaaauaugaacugucacaccaggcacauuuuucuacuuuuaaauuuuugugcagugguggcugugggaagcagcacacuauuuaaaugauugcuauaucaucuuccuuauuuuguuugcacuaauuuuuacuucuuuacuuuauaaagcaaaacuaaagaaaaaaggcuaaggcuuucuuuuuaaacacaaagcaguucagacuuccuuaagauaauaaacacaauuaauuaaaacauacucucaaaagaaguguauccugagacagguuucuaaguaaggggucuguuguucuaacacugaaaaauaucccuucuaagauuuuuagcuuucauaggaaaacaaaaagaguuuaccaaauuuuugauuuguauuuuacagcacauuugaggagauuuaaaaaaaaaaauaccacuaggccuagaaagauagcucagugguuaagagacagcauugcucuugcagaggaccugaguuugguugucaguacccauggcaggcagcucacaaugcuuuaacuaguacaggauaucugauguuccuaaccaccaagcaucucaccaaaaaggagguuuacagacaaaaggagagagcauagauacugaaacaguuugugaaagagggccaauguauaagaaguuuccuggcuuaaucauuuccacacucugcuuuuugauuuguuuucucagagacaagguccugcuguguugaccaggcuggcuucaaacucuaggacauccugccucagcucuuuaaugcugaaagacacacacauacaauacuuaagucguucacuauuuuguucuuagauaaugugauaaggaaaaaguacaaauuacaauguuaaauuauucaaucaaccgugcguguguguugagcgcauacaugagaaggucacaggauaauacugguguucucaucuaucacucuccugagacagggucucuuacugaacugggagaucuuccuaucucuaccucacaguauugggauugcaggcacgugcagccauacgaggcuuuuaaaguagaugcuaggauuugaacugaggcccucaugccuccacaggcguguuauucacuaagcuauuuccuuagucuacugaaucaaaaaucuuauuauaaauauaacuccucaaccuagcccagaaugauuagauuaacuuuguuuucuacaaucuuuuccaaaaaaguguuuuuaguuuucaguaaaucgauuccauaucaauuuuucacuuuaaaaggggguagagguuacucuuaaacaauauuaaauauuuuauauuuguuauuaagaguacuuuuacuggggcuggagagauugcucagugguuaagagcacugacugcucuuccagaguucaauucccagcaaccaucucuaauaggaucugauguucuguucuuguguaucugaagagagugacaguguacucacaauauaagauaaauaaaucuuugaaaaaaaaaaagaguacuuuuauuauuaauaggcucuuuucaucuguuaauaagacuagaauaucucaaccuaauaucauuuaauaagagaaaaaccacaaacuggaaaagccagaaaaaaauugauauuuuaauauagguacaaauuguaguuuugggacuauaaucuaaaguaccuccuaaagucuaauugauaaacuuaaaaaugaacuuuuagcuggggaugaugguguauaccuuuaauuacacacucucaaggccggcaaguggaucucugggaguuugaggcauagcaaguacuaggucagccaaggguucacagugagacccugucucaaauacaaagaggacuccugacugaguuuauuuuccuccucuaccaccaucaccaucaucaucaccacuaccaccaccaccaccaaggaaaagaaauaaaggaggcuagaaagauaguucagcaguuaagagcuguacuuucagaggacacuagaucugauccuauacucaaaucuagcuucaggggaucagacgcuucaggccccugcacuuacauauagacacacacauacacauacacacacacauacacacacacacacacauacacacacacacacacacacaaaauaacaaaaauaaaucuuaagaaggaagagugagacauuuuagaauacuucuuuaguuacaucaaugugaagguagaagaaucacuuugaguucaagaggugucgagccagccaggugacauagugagacccuuucugaaaaauaaagagaacuaaccuaaccuuuuacaucuuucuagaaagacuagaaacuuaguaauauaaguuuaagaucuugaaauuucuguauuauuuuaaacuaaucucaucaacuauuuaaacgagaaaaaaauaagugguuauauaugccuaacaucaaucacugacuagacuuccaguacuggaaaccgaaagguaaggucuagauaucuuuuuaaagaauuucucaggggauuguggaauauauuaaaauuugguaucuugggcuagugagauggcucagcgguuaagaucacuagcugcuccuugcagaagucccagaguucaaguaccaacacucuaguucaaagggauccaauaacuucuucuggccuccaugagcaacacaugcaugugguacucacacauauacaaggcaaaauaccuauauacauaaaauaaaaauaaauccuaaaaaaauuuggugucuuucacauuauuauaaaaaccauaaacauuuucuauuuacuuagcaaaauaccuuaugauauaccaaggauaaaagauucauugagugauucaauaaccguagaucaagaaacauuuuaugucauuauuuaguaauaaucuaaaaccaaaaauaaucuagcaaaucaaauuucaacaaggauaaaacuaaagaggugauuauuaagccauagaaacuagcagagaaccaucaguagguuuuauaacaaauuuuacaaacauagaacaguaauuuuugaaaaaugacaaaaacauuuuugauuauagcaacuaaauauacuauaaaauacuagguagugugagcuauaauugaugaaaauaaacuauaaaaacacucaacaaaaacaauaauacaugaguaggauucaaagacagucaaaaggauaauuuuuuugcuuccccccacccccuaauuuucuguaacucauguuguguguugguggggauggaagcgagggcuuuacacauaaagaaguuuuuaaaauaauuagaucaccuuuaaauaccuucaugaaucuauaacuaucagaguuaagaaucacugguccaucaguacugguuguguuaauggcuuccccccaaaucauaguaacuacucccaccgaacagugggaguucagagaugcuauucuccccuccucccaauguuucaauuccugguuggcugaaucuauagaugugugcccaagguuacaaaggguuaacuacaacauccccucuaccccccacaccccccauaccccuccgccacauuagucauccuucuguauucuaaggaugcuccccaaagcuccucccaccuccacauucuagauaccaauaucugcagaaguuccugucucauauaaaaugguaauaucuagaugauuuacacuauuuauguguuaaaauacucauguuuaacuaguuguuaaacuguugaagaaagaccaauucugugcuuguucaacagaaaugcuacucaucccccaacaaaauguuucaaucccuaguuggcugauagauauagcacccaagaauauagaaggcaaacaguaucuccuuucaguuugauuauauacuaugaauguaauggauucaaauuuagagcagggaaacuaaacuuuguguauauauucaaaagaguguguccuuuaaaacauuucuuugaauaauauggcugauuagguuuguacaaggucagaauaaaaguauauacacagaaaucauaccuugaagucuuuucccucuuuaguuuuaaaaguuaaccaugaugaagauacuauaaaugauaacaaagaaguucuuguaauuuaagagucucuacucaccgucuauauuaguugcuccuaaccaauguuaacuaauuuugaguaauaacccucugaucuuacuugucugugaaaaagauaauguucucauaaguaguaggucccagacuccauguaagaaaaugccuccauuuuuaucuuuuaaaaaaaaaaaaaaagauuuauuuauguauaugaguacccuauagcugguugcugggaauugaacaagaccucuacucgcucuggcccaaagauuuauuauuauauguaaguacacuguagcugucuucagacacaccagaagagggugucagaucucauuacagaugguugugagccaccaugugguugcugggauuugaacucagaacuuucagaagagcaguuaguguucuuaacugcugagccaucucuccagccccaaugccuccauuuuuaaaaugguuuaugucuuucuauacuucagauacuuaauguguaauuuaaauuaaaaauuaagaaauuauaggacuucucugaacaacaauaagaaacgugaaaguuaccuucagacauuuagaagauagauuuaucauuuaugcaauuucagagaauuguuagcagaaauuauauggaaguuacaucccauucaaagaggucaaagcaguguuaaagguacauuuuaugagaacuguaaagcuuucauguuggugucaaguauauucuagauuauaaaugaucucuauuuuuuuauuuuaugugcauggauguuuugccugcaugcauauauacaugccuguugccugcagagacgagaagguuguguuaagagucccuggaacaggaguuacagauagcugggagucaccauguggacgcugggaaucaaacucaggugcucuggaagagcaguuauuggucuucacugcagagccaucucucuagccugaucccugcauaguuuuauauuccugcuacaagucuguaucugaggugaucauauugguaacaaauaacuacuauaaagguuacucuguagccuaaaguauccuugaacugguggcaauccuuagccucccaaaugcuaggauuacagauacgaccaucuacauccagaguuuuuaagaucguaccaugccauagcccagguuauucugggaucccuacccucauucuuuugaaauaguguccaaguagucaaacuacaauuuguaccuauauuaaaauaucaauucuuuucuggcuuuuccaguuugugguuuuucucuuauuagaugauauuaggucgagauauucuagucuuauuaauagaugaagagagccuauuaauaaaaguacucuuuuuuuucaaagauuuauuuauuuaucuugagcuugauaagucucccagcucagcuuccugagugcuuggacuacagucaugaaccucuggacuacagucaugaaccucuacacucagcucaacauuaccuaucuuuucaaaugcaguauacuuaaacugaagccuuugggcauguaccaaaaauucacaaggauuauuuuucuuccagaggauaccugaacaugggucagaauugauaacaaugggaacaaacuuccuaacaacaguuuccaaaaauaagacugucauauuaggaagcuuuaaauaucuuuaagaaaauaaauucuaauuaaagauucaacaaauuaauaaauaugauuauugacaauuuucuccaagucuguuuguuuaaacuuuuuauggauucuuugcgaauuucacaucaggaacccuaauuccuacacgguugcaaucgccuucgacuccaucuguccuucccuaucucuuccauuggguccccaggcucaguccaaugguuggcugugaguaucugcauaugucuuacucaggugcuggcagagccucucagagggcagcccuacugggcuccugucugcaagcaguuccagcagauaccaaacccugacacuauugcugauuccacuuuauuuauuaagacaaaaucgcagaaaaugcuugauaaauuugccaauaauaaaaaauuuaaaaauggcuacagaaauuucuguagacuauaaacuggcugauuugcaacaaaaaccuaaagccuguuauggcagugccaguauuggucacagucuugcccuaugugugaggugaugauaaucucagagacaaccaaaaaccuggagcgagacacuuaauucauauaaccaaaaaucccauucacaugguuaauaaugaauaacucaagaagggcaaaauggagguauuccaggaaacuaguacccaaauauuagggaauuucuuuuaauguuuuuaaaaucacaaacuauauguaugcagauguuagaaugcuacacucucuaauucuacauagguagucugugaagggcagagugacuguagcauucaaauacagaaguauacaugcuaaguaacaauuagauaaagcuagggauuacauuauuugacgaaauuugagauucucaacuuagcuguugcuuaaaccaaagcuaagcugugugagcuacaacugcauuuuuuccuuacauuagucugagguuucaaauuaaauauuaaagacaauaaaauucaagaaaaugacacucuuggagcuagaaagauggcuccacaguuaagagcagucauuucucuuagagagggccugggauggauuccuaacaccuacaagacagcucauaaucaguuguuaacucaguucuaggggauacaaugcccucuucugaccucugcggacaugguacauuaacauguacacagacaaaacacacauaaaauaaaagguaaagaaagaaaauggcacucugaaauacugggcaaaguauaaaauaauuuaaacuucuccaagguaaauaaucaauaguauuaaaaauacucaaaaauuacaugauuuuaaacccagugauucuacuucuuagaguuaagaaacaugaauuaaaggguauuauuaaucuugccuguguuaauaacagggagcuuuagacuuacuuuaaaugugccaaguaggggaaaguuucuacaauguaaugccauucaugccuuguauucagccuuucaaacagcacuauuuauuggcaauauuuaaauguuuacaauauacaucaagacaaacauuuuuaguuagaccuuuaauaauccccuguaaaaaucacauccuaugcaugaugguauuuugagaauuagcuuugcaauaaaggugaaacugauaagcagaaaaguacacuuggcuacacacucuuguuuaaucuccacuaaccauacacaauucuaaagucgucuccacuuuuaacacuggacaaaauacagauuuuuuuuuaaguagguugaaaacaauagauucacauauauuuuaaacacauacaugaacaaggaucucuagguaguaaaauaauaggugcucauaauuucugcauauguguauacuucucaaaucuuuuucauccaccaaaacuuuuaaguuucauuaagcauuuuuaaaauggcucaaaugauuuugaauauauccagagaauuccuauuuaaaugugaaugaccaaacuccacuguaacuuuuuaaaaaaaauaccuguccccaauguccagaguuuucuauguuuucgugugugcaggugcacacugugggaguauacauguauguagaggccagauuguaaaaucuuaugguucccuaaauaccauccaacuuuuuuuucuuugacacauggucucucacuggccuggaacucauaaguaggccagaggggcugacccagcaagcaucaaggaucucccugucuuuguuucccauugcuacuauuacaaguaugugcuauacuguagccagcuuuuaaaacagggguucuaggaauugaauccaaucuuucuauaaacacuuaguacuaacuaaacuaucugccuaacuguccauuuaaguuaguuuuaauuuuaaaaggcacaguaugacuaggaugacaaauaaguacagccaucuccaugacuaguuuaaaugccuggaacaguuuauuaaacaaaauccugaagccagccaugagaccacugggcaaaagugaugcugaugucugcugugaauaugggaggaggugguugugccagccuugcuacuguuugcuacuguuacccuuaccaagguguaaguaaguuuuguggagaaaauaggaagagaauuuagguaucuaugaagaacaaucaaagaguauuaccuuuuaauuuucuucuuuuuaggcaaagaaaaggaaaaaugacagaaggaaaaaauacaggugacgcgaaacaaagaauuaaaggcaaccaaaaaaggcucagaccaaggagugagaugucugaagaagagauccuccagaaugcaggaacuccagacagggaauagcuuguggacuuuucguggugauagacaaucaaucaaaacaggagaaucguuacacuucagcaguugcugaggccaugugccuucauuuuugucuuuagagaccuacauuacaggucuuaagcaccuaauguucccaaguagaaauauggcacucugauagcauucaaaagaagauuuauauuacuauauacauuuaauggauuuuaaacagacuccauagauuuuaaagcauuuuuucaccauagauuauguuuaccaucuguaauuuauauucaucgauaaaaacuaaucgaucuccaacuaaaggucaucaauuaugcuuuaaauuaaaacuucaacauuaaauucauuguaggacuuaaaagcucaaaauuuaaaggaagcaaaauuucauuagacaucaaaugauauuuauuuguacuacuuaaagcacuaugugcuuuuuaaaaagauauucucaaaauuacaucauauuaauucaagaagagaggaaauucaguggaucaaauacugaauguuaguauuucuuggggguaacucuguucaagaauguauaugcuucaggauaaggccaaugauacauuaaucuccacuaaacaaauuuuguucuauuucauguuuugauuuucugagacaggaccacuauauagcccaggcuagccucagacuuggcaauguucuugccucagcuuccagagugcugaauaauauaggcuuguaccaccacuuccagcuuuuaauaguuuuuuuuuuuuuuuuuacuaauuuucaacuuucucauaucuauaagccaaagucucucuaucacauagauaaauucauaaucaucucaaaggccuucuaaaauuaaaggaagaaaugauuaggggauuaucucaaaccaacuagucuuugcauucuugguaaugaauugcaauuguuaaucaauuaauaacaacaaaaucuaaaaaacaacaccuuacacaaggaacugcuaguaauaccaaauaagaacagcaaaccuauaauacaaauauuaggucacacuagcuaauuaguaguaaagcugaguuuuaaauuuaggcacucuuguuuuguuuuucuuugagacauggucucucaaagcugucuauccuggaacucacuauguagaccaggcuggccucaaauuuccagagaucugccugccuuugccuccuuagugcgaggauuagagcugugcauacuaccugcauaaacccaggcgcucuuaauugaagugauuuuacucauaaaaaagaucaucucuuuagugccccauacacuauaaaagcacgugaucaaaauacaaacaggaaaugaacacagaaugugaaaaaggauaugaaaguauacaaaagaguauaauuuuagcuauagcuagugaaaucuuaucugugugcuaauauuaaaaaccagauuugggggcaagagggagaugguucagucacuaaagugcuugacacauaagcauaaaaccccaauucaaucuccagaaaagucagguuugguauugcacucuugcaaaaucagugcugggaggcagagauaggcagaucccuggagcucacugaacaucuagugagcccuaggucccaagaaggagacccugccucaaaaacauguugcauaguuucugagcuaugacacuggaggauggccucuaaccuucacauacauacauauguauaacagcaccugugcauuuguguacauacacauaaacacacacaaggcaaauauuaaguauuaauaguaaucuuuaagugacaaaauuacaagcauacuuuuuguauacuuuuagguaugacugguaugcuuuugaacaaucauuuuuaagauuacuuaaauucagggcuauuuagugucuuguucauaauagcauauauuaugguaauuaaaaggaaugaaguagcucuuauaacuaccauugaaagacagucaagauaguauuaaaggaaaaaagacugaaugaagaaauacauauaaaacaaggggggcagaacacauagcagucuacuuauguaaauaggaaauuaugugaauuaaaauuaucucagagacacauuaaacuguaggaguaauugcuuucuuaagcuucaguagggaagugaacuuucaguuuuucuuuuauuuauaauucaggauuuuuuuuuuacaaugaaacauaaauuauauaguaacuguguauuuuuguuuguuuguuuguuuuuuaagaaaaguuuaaauauucucugagaaggcuuggauuguagucuggccauaaaaaccuaaaggcuggaucugaaguuuuauccaaauuuuuaaagagauucuggaauguucuuuguuuacuauagcagaaccaaauugguuaccuucuuuaaggcagcaaacagaacccaauagcagccuguaaauucuaagcuugcaacacuaugguugucccaaggaugaccuuuccaguaggugaacuuuuuaaagcaguauuucuauuuuaaucacuguuauuccaucagcaaaaugccuucacaguuaacagcuaucaucaauauuuuauuugauauguaucauauuuucauaaggauacauauauuuaaugcacauaacacaagaaacaaacaugagaaguaauuuacccauuguuacagaguggaaucuuuggcagucagacuucagagaacaugcaguuccccacuugagagagacaggugaaacacacauauucaauaaaugaauaugaaauauaaaaaugaaacaaggaugaauacuuuccacuuguuuaucuagcagaucuuccacagcaauacccagaugcuucauguuuccucaggguucugaacauagaggacugagaggcauuuuuaacauaccuuaaaggauacuaacugacuucccaggccuugcacauauuacacagccauguuuaucaauaaaauauguccucuagucugauucuaauaaauagaaaaaguaucaaaaaggugacagaaauuaaaauuuaagauuaaaaaccuaugagaauuccaaagcauaagaacaguuuuuuaugaaaaaauagccaggggauacaggaaaacuuaaaaaaaaaaaaaagaaaaaaaaagcauccuuuaaaauccucuguauucucuuugcucauccaauuguacaucaguuguuugauuuguucacucgaauacuuagggcucaugugcaucaguauucccuauuagauguucuucaaacucagucuauuuaggacuuugccuauagaaacacauacccaauuuuagaauggaaaacaggagguaucucuuuauagaaacuugcuugauaucuaaauuuauaagaaaaggcccauaagaaccaaaacacuacuuugagacuccaaguuuccccuuaaccucugcuuacuuuuaccaguguuuuuaguugggcaaacuuaucuucacaaacuauccgggggaaaaaaagggcaaauacauaacauuuguaauucaucagugaaaacagcaccauugaagaacacuuacuuugucuaauuaugaugauucuaaacauaagcuauguuccaccacuagcguuuuccuauuaacaaggaaaauaaaauuucaaaaugauaccuuaaaauaaucuuuauauuuaguauuccaaccaaguagaauuuaauaagaaaacacuaauaaaugauaguagaguugggcagaacaacuaaaagggauuuuguuuuauaaaaugauaccauuuuaauuacuaucuuaaaugggguuuuaucuucaauagaccaggcauauauuaguugacacuaaauauuucugagaaaauuuuaagagaccaacucuuuccagguuacuagaaaaauuucacuccuacuuuaaagguauuuaacauucuuuuuuaaagcuuuuacuuauaaacuguucuuugacauuuuguucuguuuguaaaugaaucaucugaggugacuuccacaaaggcaaaaccugccaugauucuaguuacaugagguaucucucuagaguacucagguuuaugauucagagauucagaaugguggcaccacaagcuaaagcuagugggaaacugggagcuguaaaaugcccauagauucuguuuugcaagaagaaaaaguugguuacaugacaaaauuugccacagcuaaaauuuacaccuagaaauggcuagaacagaguagguuguuaguuuuuuaaacaacuaaauaagacaaacacaaucacuuuaaacacuauaaagucauguaguaaucucuuuugauuuuuguuuuacaauuuggaauucuuuauauuacauuugucuaaaagacuaugcuuggcaaacagaugagucuuuuaauuuuuauuggagaaaccaugaacuuuaauaucaaauucaauacacacaacaaguaguucauucuugaaacuucaagagauggaaacaaaauugcuauaauuaaaauuuuaugauuaaacauucucacuauacuuuuaccaaaaaugcugagcaaugacacuuuggcuuguuaaauucuuuuucaaauccuucagagucaagcagaaaacaugcaauaaauaccuauacuacaagcaagaaauggcuagguaaaaccuaccuauugcugucuagucccaaagggagggguacugaaacaaaguaaccuuuuucuuguaaguuaaaaucaguuucuugguaggaagguacuucaacuccacagauauauuuagguuacuuucucuuaaugaggagacagacuuuaaaaaaaaaaugucaugaguguuuuagauauccauuuuuaaccuaaaucuguaauauucaugaauggaaaaauuaucauacaaccaacaucauaaacuguuuuaaauucuugacaacaacaaaagucaagagacuaaucugccuuagccuccuauauaccauccuuggcauacaaaacacuggaauguaagaacaguaucuaaaccuugagccugcacaccaucagaaaguugggacaaucucuagauuucacaaggugcuuuuggaguggacuggaacauguuaaaauauccugacaacuaaauaacacuagauaagaaaguguacuaagcaccauauugcuauuaaauuccugcagacaauacucagaaugugagcaucagaacaagaaaaaaaaaaagcaagcuacuaccaguucuaaaccuacauucccuuagguccuggucucucuugcaugauuagcauaugcuuaugacuagagcccagaguagauucagaaugaccuauuuagggagaaaacacugggauggggaacuaugaugaggugccuagagucuaucauaugcucagucaaacaacugaugcuagaugccaugguccaaggacagggcuucagcaggaaagaacucuuuccagccuuugaauucagagucagucuucuuguuuuuugauaaggaaaaaaaaaaaugcaugaaggcacagaagaaagguuugaagauuaugaaagucugaacuacaacagacuguuauagauguuuuaacaguuaacaucuauuuucaaguauauaaaauguuacaagccucccauuccauaggcuggccuaagggcuuuaaauacauuaucuuauuuucagaaggguaguauuauccucuuggguuggggguggggggggggcauauaauccacaaguauucaguaacuugccaaccaucacaaguggaaaggcuugagacuccaauuuguggguaucaucugcuccugaauuccuacccucuaagucaguagacuacugauuccucaaacaagggggacagcuuaauuuuauuaauaaaugaauuucuugauuuuuagugaucaaaacuaaaaggugaaauuaagaaaugucuuuaagagauuuuacuuuaguggcucaauuuuuugggggggggggggcuucgaaaaguucagcuaggaacaaaacgagcuugacauucuucugcaaucuaagaguccauacacauacuaggucaaucacgcuuagcccuaacagcuaagagucaacagcacauaccuccuauuaaaucuauuaugcauuuucuguucugcuuucuuccaaaucuucaagguuugaguuuucuauacucucuauuuaaaaaagccaaauccuuucccccagguucacuuuggaggcucauuuaagguggaauaauuggagaaagaaaguuuuuacuucucaaucuuucaaugaaauugugauuacaaaaagacauauuuaauaaauggcaccuauaaguguuguugaguggcccaucacucauguuuauuaucuuuuagugauauuaagaaccucuauauuaagaaauauaaucccaucugaucuaaagcugcuaacaucucaaaugagaaaaaaauuaacagauggcucugaggaaagccuaaaaaccauuuagaacugggcccgauacacaacuagcuuacuuauccauuaugaaacuacuuuugauuuaaauuaaaaaaaaaucagcguauaagaaagagaagugauugguguauaacuugguguaguguauuaauauaauuuagcauuuaauaaggacagugaguacacaauggcaaucugccuaagguuuagagaauagcagcccaucauuucaucaaaagcauuguagucaguucugcaaaauuaauugcaacuaauucugguaacucguggaguuaagucuagacuugcaugaacacuuuaaaacauuuccaaagugcuuccuuugggugcacacaaacuaagaccuggaccuuuuauggaauaaagaccaagacaaggaagggguguccagaacagcaggaaaaugaguaaguuuaucucuucugcugauauggauaaggggaauuaaucucuuccagaagacuagaaggacuuaacagcaaauuaagccagccuuguaaccacagcucuuacuacaaaccuucaacuccuuaaacugauuuucucaagguuaaaauaucgaaguagacaaaauugugugcuggcggcaggggucgaucuuaccaccacuagcuguacucaauucuaaaauguucuccuuagacucaaaccacaagauguuucauaaacuuacacugaauucucauggaagauuucacacuucagauguaugguuuuuggaaacaauucuuuucagguguuccaauaaauuuucaguauuuuaaccgacggcuuucaucauauauagcccccacuccaugaaauuaccggccuaaauuuaaccaaaacuauccguaaguuauuuucaggagugaacgaggcagccacauauugauacauaacgucugggcucuccugacaggugaugcaaacacaaguuuguagaaauuggaaguuguuuacaaugaugccauuuuccuaaauucccguuacucugauggaggcaaguuuuuccagauuacaaccaaacccgcacgugcaaacuagaaaguuagcgucuucgggcccccagaagaaacucccuaaccuacaaaggcaacggcggccgcggcgcagcgaggcggcucgggggagccccgggucggccucggagggccucgaccccaggaagcuggcagcgcgcacaggguccgcccggggcccgcugcucgcggcuaacgcggaggacggggagggaaggcgcgggagcuagaggcguacucggcccuggccggcucggccggaugggcgcgcggggcaggcugggcugcgacggcgcggggcggguguccggggcggagaccccagccccgccgagcgcagggcccgcgacucccacccccagcgccaagauggcgacguggaccgcgggggagcccggcgcgugaggcugggggggacggaaggggagcggagacaaaaaaaaaaaaaaaaaaaaagccaguccacggaacgcggcggcccggcuuacuuuuucuucucguucucgccgccggcgcccuccauggcgaaucggugcccgcguugucuucccggccggcggcccccgggcucgcucgggccuaaacgccggcucuguccgcgcgcgcggagaaagagacaaguccagaggcggggugggaggcgggacgccccccgggacggcgaggcgggagcugcaggcugcgcucgcugagcuccggcucggguuccuaggcgcuccuccggcuagcuugucaaggccuggcuagacacugcccgcgacggcggcgaggacaguccucgcguccccucagccgaggaggcucugugcacugaggcgcugaagcagcggcagggggcgggcaagggcggaggcgcgcucgggcgcgcggcgaggggagggaaaagccgaggggugcgcgcgcccgcucagcacccaacgcgcgcgcccgcgggcccgccucaccugagcggaggcggguucccggagagccaauggugaaggacgcaggcggccaggccccaccccagcccacguugcucucagccaaucaggaggaggucagcugagccccagcugggacgagcugccccgcucacgugcuugucugugugcagcuagggagggaagaaaaaggggcgagcgacgggugcggcugagcccaggucugggggugggggggucucugcaccuucaauggaaagcugcgucuggcuuugggaggcgcugcuggagcgagugggcugccaagcuuggguccgagccuggcucgcaccgccccggcucucuauagaguucucugaggcucgcuuacuccuuagcugcguggcuggacccggucgccgcccaucccgcccgaguuuccaguugaaaaaaaaaaagccaacuuugcguucuggcagccagccccccugauguuagaguggggucccuccuucccaggugaccgacaccacucagucuccagucuccgcucuuugcuacacaacaagggaagucuccaagugauuaagauuuucugggccaaaguuugacuacugagcaaaugcagauaaaaauauaaaacaaauccgucuugccaaaccucucaaggggagggaaguugcagggccauuuaaaaauaaacuaucuuaagcauuuacaaauaaacaacagcuucaauaagugagagcacaagccugaauuugacaagacaggaaaaggcauugaauagacuuauuuugcuuucauguugcuuuaaaaacugacaaagaucaucuuaaauggaugcagaaaaggugcaagaauuguuucagacugaguuuaguucacuguuuagacugaaagaagaacaaguccuucaaccuacagaccuugacaggacugcucaccggcuaugcugggagcuauggauuaaagccaucauuuuuagucggucuuuggaagcauaaauguuaggucuguggguaugguguguguuuguuuuaaaaguauuccaagcccaacaaaggaacacuucgugcccguguguguacacacacacacacacacacacacacacacacacacacguguuauagacacaacugagucugaaucuggggucucugaaacugaccugacacuagacuguuuaguaucucuucuuugccuuguuaguacauuguuacaaucuaacuuuggguuguauaauaauguagauaucuaugguacauuuaaauugcauucaaauccaaaaacaaugcccucuagaaauacacauaauguccaggucuaauaagacaauaaacaaugcaugaagcaacucaauacucauaaagauaugauuacagcuggagauuuagcucgguaguagaggaguggucuagcaugcacaaggcccuggcuucaaaaaagaaguuaggacuauauaaauagauuugagcacuauuuuuguuugaaaucuagaacauaccucugaaagagcuacaggguauauauaaaaagaguaaaagaccaaaacuaauuacuuguuuuucauuuuguuuuguuuuuaaucauggaaauauauauacauauacauacauacauauauauauguauauguguguauauauauacauauauuuguguguauauauauauacauauauauauauuacacauauguaguguaacacccugaaaguacaguguuaagaacaauggcugcagaauucagagugagcucgguuguaagcaccagugccagucauuuaaccucucugugccucaguuuauucaucuguaaaauggagaagaugguacuuacgcugcagcacuacugaugguuauaaaacagaaaaaucacuugaaaccacauagggcaauaggaagccaucauuaaaugcuguggaguauuguucuuguuauccccaaauucaugcuaguggcaguuggucaugccucuguagacugaccaguuucaacuguuuaagugccagugguguuagugugaaugcuuacagacucccuuuuuucccgacauuguaacuucccagaauguuugcaucuccauaaaugagggcaguuacugaaagcaccaauuguucuugucuuauaacuuaagcaguucucgcuggucagggaucacagcuguagaauauaauguucuuggaauaaaaauaugagcuuugcguaauagcagguccaacucacuuaaagguuuuuuuuuuuaaagcauuuuggaaaguuuaaacagaaugauaauucaguggacaagauuuuuugaauauguauuacaauuuccucaagcuuccguuucccuuuguaaaaauuuacaauuuaucauauuuugugcauggccauaaauagauaccaccauggagaacaguaauauuuaaccaaguaguuaagauacaaaagugccaaauacuaucuccuaauucugauaauccugcuaacagaucccuaaaaggcaaauauucuuauugaauaaaguuaaaaucacucuuuuuaugagcuaccuauuaacacaugcauuucuguugcuaccaaauaagugcaucugcgugagcagucuucuucccucauuucacaaucugcacaacuguccaagguccacuccaacucacuuugcagaccuuacuaaggaguuuaagagagcauuguaaaaugacuccaaugaccuuugaccuaauuggcagugacucacaagggagucaggguaaaauuugaauuuaaacuacuacaaaaaauauggagcaaugagccuucugaaagcaaaacaugccaagugcacacaguuuaaacgacaucaaacugcagggaagaugaguguuaaaaagugauuccuagcuuagcauucgcaucugcucuuccuuuuccucuaccucguccucuccccaccccuccuccucuucuccuuuuucuuuguauauuuguaacaauaacaaugauaaaagcauauaauuuuggaagaauguguuuagaaaauggaaguauuaaacauguuuuucuuaacaggaguccaaaaaaguaaagaugauugucugaguguaugcaaaauacaaauagaaaauuugaaaguagcacuuucucauucugaaagugacacacccauggagaucagaggacaacuuucaggagucaguuuugccuuccauccagagauggagcucaggccacuggguuggcacggccagugaucuuaccccugcuccaugugaccagccuggacaggcuucuucaaaaagaauucacuaagaaguucuaagggcuuuccuguuuucggccucauaugcaaagaccuguuguuggagguauaacugauugguaaagcuguugccuagcauauccuggguuuaauauucaguaccacccaaaccaaauuacaacacacacacacacacacacacacacacacacacacacauacacgcacacaaaaccccaaaauugucauuuccaucuccauggcaaggcacaagcuaaucaaacugaaaucuauaguuaucuaaucagaauugaagucacagaggaacuacuguccuaaaagugaaagaaagacagauauagacaaccacagcuugacggcuguccuaguugggguuaucauggugauaaaggccagggccagagcaccuugcugggggaaggguuuacuuggcugacgcuuucaaaucagugcucaucacugaaggaagucagggcaggaauucaaacagggagaaaccugaugcagaggccauggaggggugcugcucaguggccugcuccucauggcuugcucugccugcuuucuuacagaaccuagaaccaccagcccagggaugggaccauccacaaugggcuagguccucccccaccaaucacuaauuugccuacagcccacucuuacagagacauuugcuuaacugagguucccuccucacagaugacuugggucaaguugacaaaacuauccagcacaccaggaggucacagugacugggagcagagccagugccacaaccagagcaggagggcuugaaacugcaguccaggacucacacuggucaccgcacagaacaaccugcaaacuuaaaacuccagauccacucuccccuguguacuuuccuugagguuugcuaucuuaagaugucugaauuucccucuaggaacacaaccagcuccugcuaugaaaaucccagaccaauguccuuuugcuuuucucaaagggguaccaugcacaugcauauggggguaguagugaucuuuuagaaaugcucuuagaccaagagaaagaagaaagauuucacgggagucuguaaggagcacugaugggggaacaaagggcaauggaaucuacaacacaacaugaaggcaagaggaggggcuacuggaaagcagggaaaacagcuagguggggacaggggacagcggugaaggcaggaacggcacgugauggcauguauguuuuaugaaagugucacgguagaacccauuacuuuguaugguaacccuuaaaacacaauagaaaagaacugaauacuucuagauuucuccuucuccacuaggcucaacagcccuccaggacaaugaguuauugcugcuaccuuaccaaucggggccuaccaaagucgacugauccaagcaaagggaaacaccaaucgcaaccccguucuaaccucaccauaggaaaagggagauaaucagagcaacaacacaacugagacccaaccacaggacugcagaaugcugcccuacccccucaccugaccaccacaucggaguaccugccucuauaacagcagaacaccacaccuaaaagaacucaggccucucacgcuauugcaggagcgugcagggacacccagagacaaccuagcaaacaaacacauagacaauagaggaaauuuuagucuccaauugcuucagcaaauaauaauagccuaacuccuagucacacugaaguuguauacuauauaggccugucuacaacguuccuaauacaagcucaucuguuuucaaauaagaagugccaaggcgaaauaaaggguggggggagaaaaagaagaaaaacagaggggggguggacagguggcuugguagaucaugugcuuauggcucaagcauggggacuuggguucaaucccacaauccaugcagagaauagagcagcaugcuucuguaaugcuggggagguggaggcaggaggaggcuugggguugauggcuaguaagucuagacaaauuggugagagagagacccugucucaaaaaaaaaaaaaaaaaaaaaaaaaaagagguggaaagugccugaggaagacaccugauaccaaccucaugguuuccacagcacaagcuccccuugcaugugcauccucuucucucucucucucucucucucucucucucucucucucucucucgcacacacacacacacacacacacacacacacacacacaccagccauggcuugaaaugaugagccaaccaccaccagaaucaggcuuaaaugcagaagagaccaggcauuuaaaauagccaguuaacacauaacgagguguccugggaaacguggagagcacagaauaucaggugagcaacgcagguacagcacacaaggcuuaagaaggacugcaagugcuggacauggaaauaggaugccugggcugcucaucagcagagaagaaaugccugaguuggaagauaugucaauacaaacuuugagacuugaaaugccaagcaaaaagagggugggggggaauaauuccuagcaacuaauaaugacaaaagaugaaaucaagcuguaacaggagaagggggauaccggaaaaucacuagcuccggauuuucaaaaauuacugacaaaaaucaagccauagaugcugggauuucagagaagucaaccaaaauacaaaaacaaaaaaacauaaaacaaagaaacaaacuuggcacccaggaauaguguauuuaaaauguagaaucaaagaagacaagcuggaaagaaaagucugggaauaaagagauucgagaggacacaucuuauacagaaacaaagacgagaguugcaucaggcuuuuugccaaagcuuuccuagcaaggagacagaaggauggaauauuuaaaacaccugaagaagagaagacccucccaccaaucuaaaauuggugaaauuauccgucagaagagugaaaaagucaaagcguccuccuuccuucaaagugaagucagaucgacuuucucaggcagaaaaauaaaagcuaguugcugccagcagaccugccugcaagaaacgcugaaagaucuugaaaauagauagaucugaaaccugaaaccugaaaccucauaaaaaaaagaaaaacacagaaggaacgaaguaaagaaaaagaaaacaccuuauucuugcuuaccuuuaauugcucuaacacgguaacaguuugcccagaaaacuggcagagaaaauguauucuggcuccuugcuuacaggagaggggaaugagccacccggcgguagaaauggguggacgggggaaggaugaggaacugguauaagucacuugcacugccagugaggcaagauaauauu

SEQ ID NO: 6694 - RNA, 3716 nt, Mus musculus
aguaaccgaaaguuuguguuugcccagcucccugaguugaucaggcuaaccugugguucacuccacagcugaagggaacccucauuaccuugugucaauuuuaauuagguauaaugaauaccaucuucucagacuaccuuggguauagugaaagacugguaccucugucuguuuaucugucuacuuacgugucuaccuaugucuugagaaaauaccuuaaaaacaaacuuugcacugaaaguuacuuuuauuuuucucagguuagcuuuggaaaauaacuguaguuacuaaugccuuccuuacccuucauucuugaauuaaauuacaguuugaagaaggcuuacuuuuuaaauggcuuagaaagaacucuguggguguuaaaacuauucacauuuucauuuaucuuuugagcgacuauguaguaauuuucauugcacauuuuucuuauucucuguguuaauauaaaugucaaagcccagacuugagguuguauaaucccuuuuaugugauauuuuuaaaugucugaauuauucauucuacugugcuguguauuacaggucugaauuuuuaagagacauucaagcaggcuccuuucaguugcaagaaacaaaagcauacucccacuaucguaaaugcugggagcuuacuggaagauuaugguuaaauaaguaaggcacucaucaaagacagcuuccucaaggguuugggaauuagcuauaggccucucuuaacaccaaaugaugcucuuagcuaggguggagauccaaaucaguugugucccauguaccagagggcauggcagaugacagagaaggacccaucuguggcagcuuuccucagcaaaggugagaaaggucaggccuuuacagucucacggguuucucaguguagucgugguuugacaaaaugcagugucagccuugcaccuucaggauguaguuaaagggacacgcuauucccuucacagguaagucacugcacaguggugaaggaccucagcucuggggcaggcuggguuugcucuggcauuuaauaauuuaugccaucuguaauaauuuggggcugcauauacuguaacacauuaauagacuggcagaggcuucaccagugaauguuuuacacccaguccuuuguuacaguuggcaaguugcccaugcuggacuugggauucacuguguagcccaggcacggcuugaaccuucuauccuccugucucacuuucccaaguaggugggacuacagacugccaccuagcaacaguccuguguuuacucccguaaaucgaacccacugcucuuuauuccucugggaaagccguugggaguagaucucggaugguucguuuucagucugaagaaauuaauacugauuuauuuauauauauaucagcacgguugcagaccaguucuaucauauuuuguuugucugaaaaaauaucuucauuucugaaugaaauuguuuuugcaagauguagaauucuaguuguuucagcucuuucccccuuucugucaacacuugcaagacuuuuuucacuccaucaucaucagccugcuuugucucuggcaggaaauuagaauuuguuccuccagucccucguguaccucaaucuuuuuuucuuuguguuauauuuuugucugucugucugucugucugucugucugucugucugucuauuugauggugggacccauggccuucauauacuaaccacacgcucuaccagaaguuccuccaggcccucccuggcugccugcaggcuuuguuguuuguuauucagucugauacaggucuggugugguuggcuuuucuaacccaugaugcauucugcacucuccucacuugcuucucucucugggacuugagccuuguuugcuaauuacuuuguacucucucuuggguuguauuuuguuuucuccaauaauacuucuuccauugccucagagugccuuuugauuucaaguucaccaucuuuucuucucuuguauccaaucugcucuugauuuucuccgaugacuuuucaucuggaagcaccgauuguugguucugauuucuccuuguccuuuccaucuucauugaaauaguuccuuugucaccuucucuaaccauuugucuuuauguaguuggugggguggggguugagacagggucccucugucugucugucugucugucugucuaaaaaaaaacugcuguucuggaacuugcuggguagaccaggcuauccugaaacagagauccaccuguguccagcucugggauuaaaggugugugccaccacacuccguugucacuuuuuaaaaauauggcacuuuuacuggaacgcagaguauuuguuacaugaauauauccuagcaggauuugaacuuucuacgcaggagccucgugagucugaagcugccgaaaacucugcuugguacuuugugaugucagccacuuauuagcccuagacucacugugugaugccagagagaugaggggaauuuauacucagguuuggggugguguugcugguggcucuuuucagagauuuccaacccagcugauaaucagagaaagaaaacuaguucauaagaugacauaaacccuuucuuccagguugcuuuugaucaugaucauuauugcagugguagaagcaaacugggaagccuuguuaccagagaauuagaguaucauguuagccucagccuuugagagaaggcgaugaaccggaguuguuuauguaaauguaauuuuaagugaugugauuuugcuagagcuucagcaguugcuaaccguuuguuaaaggcuuuagguggcugguuugucuuaguuuccugcaaugugguuggugcauagcaucccuugguagcaucguuaggcuggcaagggcuucaccagugaauguuuuaaaaccauaaagcauaguuagcugagcuuacggucuuuguaaacuucaacuguuuccuuccacuaacagugcaagaagauacuuuguguauuguauuaaaaaaugaaauacccugucuuuuaaaaaacacgguauaucuagaaaaucaucuuguuugcaauuugauaggaaccaaucaaaagauuucauuugucuucaguguguaacaaaaccuuuuauuaccagcgaagugaucuauauguaugugcuaccagugaauaacucuuauuauuuuuuuccaugugcuuucuuagauuuacaaauaugauuuauucccacgacugcagucuacagcgcuagaacaaaugucucuguaauguuucugggucuguguaauuaggauuuaauugcuuuggagaggaaaugggaguguagacugucuccuuggggcuguauuacagaauuucauuuuguuuuauucuuugguggauuuauuuuuucccugauauuaacauuaauaaagugagcagaggauucuaaccaauugugcuggcuggauggcuacaggaaaugagacagggcaggugugggcuuccuguaagaccuugucgagcccagaacuuguggcaccagagggagggucuagguccagcagggucauaguucuagccacuuaguuuuaaauuuauauuuuauguauuuuauauguuaauguaaaauauaaaauuaaaauuuaauuuauauuuaaaauuuuguuuuuauuuuugagagcuuuauuaaugagauaucuuugauaguguucugugaucauuuucuguauuucauuaaaagauucaagcagagguauuuu

SEQ ID NO: 6695 - RNA, 1469 nt, Mus musculus
uaaagccauuuucuucuccagucuuuccuuugccccuccccucauugccucccuucauaguagccugagaucccaaauaaaccuguaacucucccuuuucuggugguguggacaaggacgaaucaaaaguaucacuagaaugauuuuuagcucuccuuucgugggagucacagaacgcccaggcaggagggacucaugguggcauccaggagcuauuuagaugucuagaagauguauccaugcagcaggaauagguacuguauaaugcuuaguuccaaugauucaaaugcuggcuccaagcccccagaccucaccuggggccaucaccagaagcuacaagcagauuccuaaucagcacugggugccucaccauuucuggcuccucucucucucucucucucucucucucucucucucucucucucucucucucucucucucucucucucucuuucuuuccugaaagaguugcauguaucucuggcugguucugaauuuacuauguuugugagaaugacccugaacuucugguuguuucacccccaaaccugguucaugcaguccuggggauuaggcuccuguucaugcuaagccagcaugcuccugagcuacauccucagccuuuuuuuucuggcucuugcuuugggaccuuccugugagucuauuucucuugauacucugaguauccagggaagaugaugucucucucucucucucucucucucucucucucucucucucucucucuuccucagcagccagaacaacuuuauuauuaauaucuuuccuagucaaaacacaagaagagaggcaugcuucuucucccuuguacuugacuccaaguuaauaaaaugagggguggagagguugcagcugccucucuucccuugcaggucccuuuccuuuuggugaugugccauggacucuugcucugccuccacuuuugugcuccuggcaauacggagaucuugacaagugucucucucaccgcugucucaugcuucucucauguuaucaguuucagcucacauguggucagcuuggugcugcacaugaucccagcacucaggaggcagaggcagguggaucucugugaguuugaggccagucuggucuauauaaguuccaggcuauugagggcuguguaauaagaccuugucucaaacccccaaacaaacauuaaaugagcuauaaauuuguggcccuacccaauggucccuuugucaccuauaaauggcaccacaaucgggguauccuugguuuaaagagccuugaucugacugucuucccaguguugucuucuccuagguuugaccauccucccugcguuguccucucauuggucugaucaucuguccucccaguauuguccucuguagucuugucacccacagaucaauucacucaccaaauucucauauuuucauaucucacuuuuuucuuuuuaguuuagacucaaauuguaagca

SEQ ID NO: 6696 - RNA, 146795 nt, Mus musculus
cgggcucugcuagccaggagguucgguugcgccugugccauggacucagccgcccggugauauugacaauaggagagagaaaggggcauugacggggacccugcgcggguagcgaacggcggcucuggcagcggcggcucaggcggcuccaacucuuccucccgacucccgcgcuugcugccgcugcaaauccaggcuuccucccuccucccccuccccgcgucgccgccgccgccgccgccgccaccaccgccgccggguccggugcaacgagcagaggcgccgcccgccgggaaugugaacgaagagccaccggccgcgccgcaaccgggucggugccgauuugaugggacgggcccgcgggggaggcucgugaggccgccgcugccacugccggagcgcugagguuaggggccagccgagaggccuagaaacacugccgcuaccgcggaaccggagggacgucgccccggacggccguaguagcccggggcucuccgccgcugccuggaccuccccccgugcgucccgggccgucgcccgcccccgccgcggccccuagcucgcagcccacuccgcgcagccacagaucaucuuccgauucuuucccaggagcuucaagguaacuucagcuucgggucccgcggcuugccucccggggaacccgcggagcggcgggcucgggaaggccgggcccaggcagcugaggggugcggcgggguggggggagcgggagcaagcgcccggcccacuugucugaucuaccugcagaggcuuuggaggccagcaccucucuucuccucggccucgccggcuccuuuuccucccucuuuugaggcguuuucuugccccccccccggcgggggcgggggagcagggaggaagauuccguggccgcgcagcuucuccagggcuugggguuuaugugaacauaccugcagacaaacaggccacuucccuguuuucauaccucccccuuggaaaagccccaguagugugcucuuuagagaaugcuaacgcuuugggugcaguggcccaggugaaaccuguuucccugggcuuugcagggaccccgcuguuaccaucauuucugcaaugcuuugaguugagauccuugacauuuuauucagagcugcgcgcauaagaggcaaaugaugaaaaagaaagcugccuauagaucaucguuagagaugagagaagagaaauagagacagaaugagggauggggggaacgaggcuuacagaaaucuguguugcuaggguuagagugaaaucuaaauaauucccagaugaaauuguaauauucgucccuaaauuuacagcauaccagugcgauguggaacuucuugcugaggucugacauuuucgauaguauuuauaauuuauuauuccguuuuuuauaugucacauuauauuucaagccaaauuagaguuaaaagaaaauaacuuucuaaugaaagaaucacgaaguccucaaaaucccaaauuaaccuuaauauuguccuccccucuccaaagucuaugcuauuuuaguugaauccagguaaugcagaugacuguuuaaucauaacacauugggaaggcagcuaucuuacucuuuguggaaguuaaaaaaaagcauuugucuuaggugucgguaugacacuugaggaacugagccugagcacugcaucauaugcauucugucgaucuugucugccauuaaucuugcauggagccucaguagcaccugaaugguacuggcgucuguuuaguuuggugaaggagucuaagcucaaugcuugggacuuuuagcaucuguccuuccuuugaauaauuucgaagauuaaauaauugcagaaugauauucagucaguucuguugguuucauguagcacaauauuugaacuuaaacucaacuucaucuugggaggcugugaaguuauguuuucaguucaacuuugcauuggaguuuaucuuaguuuuguuuaucaaacuuuaauaacuuaagauggcuuuauuuaaaaaauuugaaauaguuguaaucgugccuuuugugcguucucauucaaguaaucuagccuguccucaugugcaaggugguggcuuguaacagcaagcacagcauggcacauugcaccaaaaguccugcuuagauggugccaguaggauuauacuuagaguaaucauggugcugucggauacugagguggcuccgcucauuuuuuuuuuuuuuuaccugaggcaggaucuccucccacugugugucccaggguuggagucaagcuguuuaggcuggccuugaacucaugaccuuuccugcuuuugagugcuguuacccgcuacuauaccuggcuucauuuguuuagauucuugaagugcaaaaggguuuuagcccauucauaauauuaaauuugucaggaaaauguuucuguggacuuuuuccagcuucagaaucgcuccaaaaugacuucaggaaucccaagaugggaagagcugugcaauuaaaaugggcagacaauauagagacuugagguccaggaagacauuuuuuuaaugcuaauaauggaguggugauacauuagaguucugauuuuguuuaaugguagccacguuauuuauuuccccuugacaagauuuuucuuuuuuguuuuuuugaaacagguuuguguguguguguguguauguguguguaucccuggcugucuuggaacucacucuguagaccaggcugaccucuaccugccucugccuccugagugcugggauuaaagucgugugucaccacugcccggcagcagcaagacuucucuuaauugauuuuuuuauuuuuugguacauauuccuauuuucacgaauauuguauaugggacuuuuaagauguguauaacucacaugaauacuuucaccaugggcucauguucauguuuccucuuucucuucaguagggauauguccucagcaccaacuacuccuccaucaguggauaaaguagacggauuuucucggaaguccgucagaaaagccagacagaagaggucgcaaagcuccucccaguucaggucucaaggcaagcccauugagcucacgccucugccacugcugaaaggugagacccgugagugggcgccacugucuuaccuuccucacccaccagugucuucagaguguuucacaucugugcacuuauuuacguguuguacugugaaggggagagagagagguuucagacccacaaguuccuggaugugaccaggucuacccaaucuccuuaguaaaggguuuaucugaagagacuuaucauccuauaggugaauucuugaauuaagcuggaaaacuaaauggcagaaaugucguuuuucccccucccaacauugguguuuguguguguguguguguguacuugaacauuaugcacaugugacaaucagaggacaguuggugggaguugguucucuccuuccaccacguggguuucaggaauaacucaggugguucuguuugacagcaagggccuuuaugugcugaacagucucauugacucuaucugguuugaaauucuugauuugcuuauugauauguauuaauugcacuuuggaaaguagacccaguaaaaaagauacuaacuugcauuaaaagaaguggaguuuggaaauacugaauuuuaaauuuuaaagauuuaagaaaguagagcuuauaacuaauaacaugcauauauuuguauuuuuacuuaguacaaauauaagcuuauagugaucauauuugugugagacuuuaauuuuuacaguacauuuagugcaaggguuuucauuuuuuuggacacaguuuuauguagccaagguugcuuugaaccuguggcuuuugccuuaaaacuggcuuugagaugcugcucuuuuugccuuuacuucccaggugcugggauuagagcuaugcacugccaggccugucuaaaagggagguuuggaugugagcgcuaauuuuuuuuuucuuucugaauaauaccuuuuauuuuuuaauuuuguuacgugguuacucuguccauuuuaauuuuaaucuguuugcuucauguuggugaaaaggaauuauuugaaauguaucauaucaauagcugguauaguguagaaauaucuuuuugaagaugacuuuuugucuuaaguauuuaaggauaaggaagaaggaggcacgaacaauauaaaggacuuuaguagcucagaggaaacaagacagcuuggauagugcauacugcccccccccccaccuuccccugugccccugauuuuuccuccugauuuuugagacagucuugaauguaacaggguagccugcaccucacaguauagaccagguuggccuugaauuugcaaugaucuuacugcuccucucuugaaugcugaguucacagaugugugccaucacaccuggccaaaaugcauacuuauuucuguagaaguguguggacucagaacguacaagaacagcugauguggucaucauuuguagcugaggguguuucaggugucugauuuuccuaugggaacacuugccuuaucuuuuucuuuuuucuuuuuucuugagacagaguuucucuguauauauaacccuauauauucugaucauucuguagaccagguuagccucaaacucagguucaccugccucugucucccuaguacugggaucaaaggcguguaccacuggggacacuuucucuuaagaggggaaauucauaaauaagaucccaauguuuguacuugaaaaugguagaaacuauauuaaugcugauuuuuggaaggacggugugugggguuagaaagguacauagugguaggacucuugccuagcgcuccugagaccuuggguuugaucugcagcaccaagaaaggggaaaggcugaucugccggccaaguaggaaagaggagcucuugauagguucugagggagagaacacucccucucuccuucccuccccgguuugugcucccucucuuucucccucucccccccucccccuccccgcccccccuccagggucugacuguagcuggucugaaacucagagagauugccuuugccugucugccuuccaaguauuugucuccacaucuggguagaagauuuuuggcuuaagauuuugcuaguuaaaaauaagaggggcuagagagauggcucagugauuaagagcacugacugcucuuccagaggucccgaguucaguucccagcaaccacauggugacucacaaccaucuguaaugagaucugaugcacucuucuggugugucugaagucagcuacaguauguguauauauauauauauauacauacacacacacacacacacacacacauauauauaaaauaaauguuuuaauaaaaauuagaauaguuuguauaaaguuauaggacaaauaugaagaaaaauucuagggaauaaguacaaagguuaggagacauacucuuaacuuucuuaaucugaaguagauauagaauaguuguugaugucuguguuuacuuccagcaaguccagaucaaacauuuagguuuagagagaaucacuccauucauucuguuaggcucauguagucacuugaauuaacuguacguucauggaaagauggaaagaggcuuaugggagaaaaaucugagcacacgucuuaucuuaccugcuuucuucccgcugugauuaugcacaauugaaauagacacaggauguuccauuaacuagucuugggauuagaaguuugcaccacuaggcuuggcucauuaaccuuuuuuaagguuucaauucaguggcaggaaguccguucccauuguugagucucuauuacaaccauucaucuaccaucuuuucacacucucuaugccccucugucaccucucagcccccaacaacuccaucuuuaguagcucagagggaagcagacaaccuggguacuaguacagauguccauuccucacuuccucccuucaucucuuccucuuacuuuuuccccugguuuuugagacagucuuguuuuauagucuuggcuagccuggaacuaacaguauagaccagacugagcguuuuauucucuuucagaccgagcaauauuucuguuaguuuuuguuuuuguuguuuuuguuuuucgagacaggguuucucuguauagcccuggcuguccuggaacucacuuuguagaccaggcuggccucgaacucagaaauucaccugccucugccucccaagugcugggauuacagaugugcgccaccaccgcccagcucagacugagcaauauuucuauguaucacauacuguuuaucauucauucauucacucacucacucacucacuuacucacucacuccauucauucauucauucguucguucguucauucauucauuuuagcuguugggaauaaugcaagcaugaguguguuaggugucuguuggaagacuccgcuuuucuuuugggcacauacauagagauagaauugcuggcucauguguuuaggguuugaagccuugcuauguaguucucuuuaggagcuguguuuucauucucaguuuacaggaguucugauuuguccacaucucaccagugaauaccgcccccuuuacuagcaucaccagggcugugacacuguucugaugugcauuuaucuucuacuuagugaugucaaguuccuuuaugagauuauuggacaaauacauagguuugguuuuuuuuuuuuuuuuuuuuuucuuuuucauguuggggguugaacccgugcuagguaggugcucuugauacugagcuacauuuacucagcuccuuugucugaauuuuuaaaguuaugucugguagcauuaaaacuuuucuaagaauagguuuuguacacuugcauauuuuaucagcagaggagaauuagagagcaacuggaccagacacuacucacaaauccaguuucggacagcuugacagugauuguugcguaguucaugugaugugggggcauggucuaacaaggguuuuauacguagguucagugucucucuggagaacggcagagaggaguagagucgggugcagaugugagaagugugugccugguuucugcagugacugaggaacuuccguggcuccugugcuccgcacccugcauuggcucacuuuuuugccuuguauguccauuaacuucuuaggaaguaguuuaccuaacagaaaacacauaaagaaaaucuuccuuuucuaguacuuuuuuuaaagcauuauuuuagggaaaaauagaauaugccaaaauuaacuguguauaaauacuaaacaauagagaaggcccuaauuuucuauagcauuucccugacuaauucagaaggcuugcuugaauacaauaugcauugugauuagauuuugugaauuuuguuuuuaaguuguauuuugauuguguguaugugaguguuuugccugaaucaguguauguauaccacauggaaggucugauuacuuggaaaacuauaacagaaaaugaagagaaaguuccugguuugucccucuuguaauacuuggucuuuugaagcuuguguccuugguggcuuuucuuuuuuucuguagaacgcaaaaguagcaugugcgccuaugcgcauguauacaguggccuacuuuuuccucagcugugugaaaugauacgcugaccucuuagacauuugaauuuucucuauuuuuauacuucucgaaguuuuuuggagguugccuaagacuuuuaaaccauaaggacccguuuuacugguaaagaaaucccaguaaaaguuuaaugccuauuuauuuacuugcuuacuuaccuaccuaccuaucuaccuacugauuuaucuauaauaaagucaaaauuugugccaagguuugaacuacaucauuaguggcacacacaugccuauaauugcagcacuugggaggcugaggcagagcugugaauuugagggcaguuuggccuauacugugagacccugcuucaaaaaacuacacaaaaagaggccuccucccacaguugauauggaugcucuuuguacuccugguugggcaaacucagaguuuaggcaaaucggcaguagugguacugcuucaugcuugguuccccucacucaccuguccuguccuguccuguccuguccuguccuguccugucccacaccuuuacugcuuccuuuccuccucgguaggccauuuacaaguuuagauuugaaugacauaguuuugaaaaauucuaccucucugaagaagggauuauaaugaaaguggugucauuauuucuggcuucacaauuguguuuuagagcauuuugcagauacuucagacauuucaagagcuaugguaacuagaggcaccauucuguagaaaagaauucuuugucucugugguagaauauuuucuaaugaaaguauuuuaaauggaacacuuuuuaaauggaacccaggggcuugugcaugcuaggcaagugcuguaucacugagcugugucccagcuucuaaaaauaccccuuuugcuuuuauuuauguguguggcuguuuugccugcauuuaagucugugcaccaugugugugcagugcccacagaaaccaaaagggggcauuggaguuucuuggacugaaauuacaggcaguugugagcugccauguggguguggagaagagaaucuagguccucugucuggaagagcagcuuuuuaacuccucagccaucuuuccaggcccauagaaacacuuauuucugugucugugauguguguaaguuagaucacucucaacuguauauauuaagguagggucuuucauuuaagcucagagcucccugauuuggcuagucuggcuggcuggcuugcuucagggauccccucucucugcuuccugagagccgguagguauuucagguggguuacccacuugccuggcuuuuauaugggugcuggaguucuggcaaguguuuuagucacugagccaucucuuuacccccuaaaaacacuuaagcuucaguaccaaagaugaagcuuccauuuuuauuuuuagagugacagcuuguaagaacuuccaaauuaccaucuagagcuaguuuugugcuuucuaaugacuggauucuuuuaucuucuacaucuaccuuguaaaguauagaguaggauguacaguauaauugcaggucugguaaugggcuggaacacucaagcguuuugugaaaagaacaguuuucuuaaggcugguguccaguauuguggcauuuccauuguacuugcacacuggacagggugcugugcaaaaggcucugcuaggcuuuuguucuguuuuguccuggacaagggaguuccuuaaaccucuccugguuucuaacaugaggauggcacagcucaguggggugcugugucacugaguacuaccuguuagcuccgagcuggcuuuucagaaggcagucugugagcaaugucaauuuuaagaugcuuuucaugcaaaaacuuaaaaucaaguuuuucaaaaugauggaacaagagcauaguuuuacaguuacaaaguuuuuucaaccuaaaaauuuaauuucugaauguuuugaauuuauugaaauagcuauuuugaacgucuuuggacuuuuuacuuuauacuguuauacuggcaucuugccauguuauugagaguaagccuuuuuuuuuuuuaagaagauuuuguuuuuugugcucaugcauguguauguauaugagcguguguaccaugaacuacgugcggaggucagaggacaguuugcgguauuugguuuucucuuucuaccgugauauugcacaggucgaacugugguccucaggcuuggcagcaagcacuuucacccuuuaagccauauugccugccccucuuaccuguuucuaagugggagaauuucagaguauuuccagguuuucaaagggauaucugauagaagauagagugagaaccauuggucuguuugugccauagauugaugauuuguguuauuuacguagcuaaacuuguguguguguuugguuuaaaaaaaaauagcugaguucugcugugagcuaaaagaacauguauaaguuaacacacagaacuaaagcuguucuguaccauuggaggcagcacgguaguguuuuucuuucaggaaaggaaugguaaagauucuguuuaaaccaagugucaaacuguauuuucaugugugaaagauuacacucaauuuauuugcuuuuagguaagaguguuuucuuuuuagguuuauuuuuaauuauaugcauguguguaucucugugaauguauaugcacaaauaucagaagccagaagaggguguucgacucuaugaggcuggaauuugagaaaggagcuacucagugugcguguggggccugaauucagguccucugcaagaacagacagcaaacacucuuaaccagugagcccaaguauuuacuucuguggcauagagaauuaucacucaguuauguaggcuaaaagucaggaaaugaguauccaugauuuauggcuuaaaagagcacuagcuuagauuucuacucauuucuauggugucuggugagcauagguugaauauuccuuuauugagcagaagucuuugagauuguggaguguggaaaguuugugucuauagagucccuugaacacagugauuaaaggguauugucucuugccucccugugcacuugaaaaaucugagcauaacauuuauuuaaaguuuauuuuacccuuuauuaauaggucagcaauuuaauuuuacuuuuuggaaaaguccaguuguaaacuuuuuuuuguuuuguuuuuuuguuuuuguuuuuguuuuuucaagacaagguuucucuguguagcccugacuguccuggaacucacucuguagaccaggcuggccucgaauucagaaauccgccugccucugccucccaagugcugggauuaaaggugugagccaccacugccuggccaguuguaagcuuuuuauuguaaauuaaaaaugaacaugguggugcacacuuuuaauuguagcacuuuuuggucagaggcaggcaggucucugaguuugaggccagccuggucuacaaagugaguuccuggacagccagggcuguuacacagugaaauccugagucaaacaccaaaccaaaccaaaagaaguucuugggcuggagacauggcucaguguuucagcacccaugugguggcucacagccauccauaacucuaauucuaggggauccagugcccucuucugaccaucaugugguccacaugaugcacauauauacaugcaggugaaacacucauauguauaaaauaaaucuaaaaagaaacuuaaaauuuuaacuugguuaaauaggaaacaauuaaaaaaccuuugaaagugaauugagggaaaacaaauuucaaaaugguuacuauuggaaagagacauguuuaaguaaaaauaauuaaaaccuuuugucuugacacuggaaucucauguuuauuuuucuuccuggaugaggggaugguagagauggugauccagcauuucugcggccuugcccuucucagcauccuggcuggauguguucucagcggugggcuguauauuuuugucuauuugcuguuggugguuuaagguuaucagagugucuacguuagaaaugugaugcuagguaauuuuucaggagcuguugacuugggucucaucuuggucuuccuuaucuucuucauuaccaccuucuccaggcugucuuuggcauggaugguccccgcagaauugcagacuauuccccuuuguauauucugucucucugguuuauucguuuuccugcagccugguugucagcuucugccgucaauucucccuucacaagaggcuugggauacugcgguagagagccacagaggcagcuucucugcauacaguaaggugguaaccaucuucuugcauccuuugggacggcucccucauucucucuccuacuuucgucauucuagugcugcuucuggaacccugugcauggguagagucuucagugaggucacuggcuugagcuggacaugugugagggccugauuugcuacauggauaucuucuuacucucagucagugaugggaaacgcuagcacuuuuauggccauauuauuuucugagguuauucuucuacacuggcaguaugguagacacauaccugaagccaaaaagaaagccuuagcuucauucuguugaugaaugcuaaauaucuucuuaaaaaaaauuagguccuaaaaccuuugacccugccagcagguguuaccagcaugaggcuagcaagccgcuguucccgugcugcuguccguggugucaugcucccugugacccagcugagggcugggcugguggcugcuagguuuugguccuguugcucacaguuggaugguggugaauggcuguuucugagaugugacuaugguaggguucagggcucucuggucuacuuuuauuucugauggaacacuguguaacuuucauuccuccaaaauuguucuacuugccugcuguugaucagaaguccuaacauaaauaguugauuauuauacauuuuuuaugaguuguacuuguuuuauagugugaugaaaaggacaugagaaacauaggagaccauaguuuacugccugcuguaauuaaccagaaagcuggacuacuuacugcagaugucacacagcuuuaagcagauacuggcaucucuugaguucauagcaggagcaguaggaggugcauaugaaauuauaguaaugcgguauggacuguggcuaauuuuauguaguuaggauuuaauaaugggcuuucucucucuaaauacaaggucuaauuauuccaguuuuuuuuuuuuuuuuuuuuuuuuuggaauccugacuggccuugaacuugugauccuccauccccuucagcuucuucaguaauugggauuaugugugcacaacugcaucuggguuaaguacuguauuuuuaugugcuuuuauguuucuggaguugugaauggcaucauguauaauuugugcuuauguuccaaauuuugacggauguuaacuuuguaucggauuuauguauauuuuaugguagugagugauaaagaagaugaugcuguauuauauauuuuauguacucaugacauuuuuucguaagucuugguaucucuaggcuaugaauuuuuuugccuauuuuaaaaguguuacaaauuucucccuuuuccuuaaaaacauucuacauguaaaguggacauguauagcuuacauccauguucuucaaggguuagcuguaucugaaugucuagaagauuagaccuaagucuaaacauaaauuucuguuguuucauuuaucuuauagcauaugaauaaucucagauaauacuuagagaauacauguauuuugacugcaaccaaaauguuguauaaagucagguggaauuuccuuugugacaucauguuuuugcccccagauuuguagaauuugcagcaguuugaguuuuagaguguuugggugcugauacuugcucucaguucuucccuugcaguuccaucuaguugggaccuugugcacugugcacaguuucaaaagcuuccuagaauggcaacguucccuugugcagauuuuuauuuugaagaggagaauuuguugcuuuugccagguucucacagacucgucccuucaguucuugcucccuuucauuagacagaugucuuggcuuagacugauaaguugagagcuagccuugguauuuuguuuuugaguguuguguuagugccauuuauguuuacguguaaaacauucuaagcuacaaaaagaauuaauaauugcauggaucuuucuaggcugucacuaagacuggucauauaaauauugaaguaccaagugaaugagccgguuccuuuauauguacaaauuucuuccuugacugcuuaucauucucuaaguuuuagcucaaaugggaaccucuuucaaguuuuuuacccugucuucccccuucucucccauucuuuuuggagucuguagcucagguuggcuuccagcuucuuauguaguugaagaugaccuugaauuucuuaucuauaccuuuuacauacugggauuauauguuuuuccacagacucauguaguucuggccguuguugaaccucuguugauccuauagccauagccuggugcuagaauugcugcugagaggcaccaugcccaccaucuaccuuccuauuccuguauucucuccuccaaggucucucuauguauuccuggcuguccuggaacucacuuuguagaucaggcugaccuugaacucacagggaucugccugccucagccuccugagugcugagauuaaaggugagcaccacuacaggcuuccuaauauuucuuaugauaagaaaauugaucuuuguuaccuuguuuguugucugucuucuuucauaauuaaaauguauaauuuuuguuguagaccacuuauuuccaucaauugcuguuaagagacuuauacauaguugacauucaguaacuauuucuuaguaauaguaaacaugguuaguugaugcauugguugacaaauuguuugauaaaauaauaguaagauugauacuuguuuuuuuuucugaaauagugaaguuuaaaaaaagcuaguuuugccuggcgugguggcgcacgccuuuaaucccagcacuugggaggcagaggcaggcggauuucugaguucaaggccagccuggucuacaaagugaguuccaggacagccagggauacacagagaaacccugucuggaaaagccaaaaaaaaaaaaaaaaaaaaaagcuaguuuuaauauagauaagauuuuaaugcaaauuuuauuuuauucaugauaccaaaacuaaaucuauuugaugaaacuuuuuaggguuuuaaaaaagauuuauaggcagugguggcguaugccuuuaauccuagcacuuaggaggcagaggcaggcagaucucuaaguucgaggccagccuggucuacagagugagcuccaggacagccaagccagagaaacccuguuuggaaaacaaaaaacaaacgacaaaaaaaaguacuuacauauaauaaauaaauaaauaaauaaaucuuaaaaaaauauauuuuacuuuauguauauaaguauuuugccuacauguauguauguauguauaugcaccauguguuuugugcccauggagauccgaagaugguacuccauucuguagaaguggaguuagagaugguugugagcugucaggugguuacugggaccugagccuggguccucugcaacaguucuuaaccauugaaccaccuuucuagccuuggaaccuuuuuauuaauaguuugguuuuuguuguuauuuuauuuguuuguacaaagaggcugguguuugcuagucagaaucaccauacuuuguucuuauggcuuguggagaacagcauagccauaugcuaugaugggcuuuugaaaugauuuccauauggucaaauuuccucauucauaaaacuuacauuuucuauucauacugacauuagaaauuaaaaauuuuaaugcuuauaaaagaccaguaaaaacuuuggaugagccgggcgugguggcgcaugccuuuaaucccagcacuugcgaggcagaggcagguggauuucugaguucgaggccagccuggucuacaaagugaguuccaggacagucagggcuauacagagaaacccugucucgaaaaaccaaaaaaaaaaaaaaaaacuuuggaugauucuaauuaagauuuuguuucaauauuuuaucauugaagauuucuuuuucuuuaugaauuaugagauuuuuuuuuuuuuuuuuuuuuuuuuuuuuuuuuccgagaaacaguuucucuguaucgcccuggcuguccuggaacucacuuuguagaccaggcuggccucaagcucagaaaucugccugccucugccucccgagugcuggaauuaaagacgugcgccaccaugcccggcgaguuaugggaucuuauuuucauguuacaguagaccuaagcaugcaaugaaaaaccuuccuugaaaaaauauaauuuaugugcuuuauuuaaguuaguaagaggcuucccuccaguaagauuguagguaaggggguggcaugcacuuggaaaucugggucuauuucuugcugguauuucaccuuuucuacuuugaaauggaagaguaauaggaccuacuugauagagucugauuaaauauccagaaguauuuggcucaggaagggcugggcauccuguagaaauggaagaauauuaauaguuguaauuaucagaaaaacugcaaugggaaaauacuuuuuaguguuuuuuuaguugacauuuaguccuuuacacauuacacgaauauucccauuuaaggaugggaacaguggaacagguagagcugugagaguuaggcuuaggagcugauucugucggaguaauuguuacuaaugccagcuucagacagacugcggugaggucagcacacagagggggucagaguuaccguccagggcaauuccguuuauacacaggucggaggcggaguuauugaugggcacaugaauuuuaguaauuaguugucuaccagggcagguucucaaacuuaccuugauagucgcuuacucuagucaguaaaguagagcucgcucuguauuuggacuuuuagacgaauuuauagacgugcaaguacacagacacaggccuuuaggaagaggggauacuugaagacucacacaccuacgaauuuagcagcacuuaagcuuugcacuccucugucucuggccuguccgccaucgugaacuuggcuggaacacugcuuugucaacuuguuagagagggggcgguuaguucugggaguccaggcuucucaggcuccaaugccuucucuauuauagccauuaauaaaugaagccaggugagaccuggggcuaauaagauguugcuuguacuguuuucagggauuacaggagcaggaaaagcagggcuuggccagcuuuagcacuuuagagugguggggaagccuaggucaggaauucaggaguuggaagaaggccaaguaggaaaccaaggugaguugcucuguuuuagagaagguguguuggccauagggaggaaggcuuggcacacuaggaguaguuugcucuaacacucaacuucgcuuucuuuggguaacaaccugauuguaggaaagggcuuggguucaagucuagaugguaauuuaguuugcugaaauaaguuauuggaacuugaaauuuugaacuuuuguggaacacaaugcauuuuucaguguuuucagggcugaccauuugguacuagacaaccaauuacuuccuucgggaagaucaccucucucagcuuuccucaguuucuuccacuuccuuguaggguugaggccuccuggauuaauuagugcuaaaaaaagaaaaaagaaagaaaaagaaaaaaaaauugugcuuuuccccagggcgcagugacacauuguuguaaguacuuucagcacuugggaggaugaggcugaagaacuaggaggucaaggccacucuuugcuacaaagugaauuccuguccauccugaacugcaggacaggagacucugaagagucaaagaauaaguggcuggagagauggcuccaagcacacuugcuguucuuggagaggaucuaagucugggucccagcauccacauugucuuacagucaucugguguucucugcuggccucugcaguaaauaaaagaaaaaagcaaaucuuaaaaaaguucaccgugaucuguccugucaacaugaauuuagaauacguuuguucaugucguuuuaauuaauuaaacuuuuaauuauuuauuuagaguuugguggaguuuguguccucaccaugucuauggaggugagaggugagugguguggagcugagcuucgcccuccaccuuuaugcuggauugaacucaggcgauuaggcuggcaagugcuuuccuucugagccaucucauuggcuuucuuuuguuugcuucuugagauguuuuauucuacaucgcagucuggccuuacagacuuagugcugagauggcaggcauguagcaccaugccugauuauuauguccuauggauuuuagugcucaccuuccagcuuugggguugugcugguuaguucuggcaaccugacacaagcuagagucaucuggggagagggaaccuuaauugagaaaauaccuccaucagacuguccuguagaguaagucugugugucacugugggcacugccacaucugggcagguggcccuggguuguauaagaaagcagauugagcaagccaugaagagcaaccagcaaauauguucuuccauggauucugcuucagcuccugccucccaguuucagccucgaguuucuguccugacuucuucucucagugaugcguuagauagagccugcaagccaaguaagcucucuguccucacaaguugcuuuugguuauggugcuuuaucccagcaacagaacaaacuaggauagggacucaguuuuagguuuuagauagcucuaacgcugugcuguuuguggugccgugguggcccggcaucuuacacacaugccugguaagcacccugcccuggagcuuucuaccgucuccgcaucaucaugugcucagagucauucaaaacucauccuaacagacccauccaaaaguccugcugguuguccugauggcuuaucacuuagagcuaauaugugacaguggcuucuagacaggacacaaccguaguacuugcaggcucacugaacauguugucugugugugaccuguacaagauugggcuugucaacauuccauuauaugcggggaggagcuccugaggggccucccuaguggguuaugggcaguuaguuagugguuguugggaggggcgugucaguggugaagccacugauaaaguugcuggagcucuaguaaaaugccccacggauguucaugcaaacagccaaaacaucuguaacuuuuccaguguguagauagaucccuauuguagcacuuggcugcugagaaaauacgacuuagaguuaguucuguaagacuguuguauggagcuauacauauacauauauauauguauuguauuuagauuaggauuugugguguucaagcaaguucagcuaaacuggaauuuaagguuuucugguuuaguggaggauucuuggaaugggaugcucuagacacuuuaagaguauuuaaauuuuuacccauguuguucacuuguugugugcauacacaugccaugacacacauguagaaaugagaugacaauuuguaggaguagauuucucucuuuucacuuuguguguucuggcuguuuggguggucaggcuugguagcaugugcuuuugcccacuaagacauucugcucacuacauacguuugucuuagcaaugcuagacuguacuuagauucuugaacugaggugaggcuucccugaagcagguuuuaaaaguuuugucaaaauacaugcuugccauacugccagaguuugcauagugaccucacuaacucacuucuuucugagaccuuaccuucucauugaaauacuuuaauggacuguggaauucaacucauucauuuaaaauauuguguugaguccuaugauggacuggacauuguucuggaaaugcagugguaagcaaaacagcacgggucuuugcucuugcaagugaucuauaaugauuaguucaaacagaacucugacagugaugaguucuauuggaaaacaaaggggcuucuuggaggaaguaaaguuuaugccgagcuuuaaagauggagguagauuuugagauucuuuuccuuugagauaggaucucauaauuuacaaugaugcagaagcuggucuugaacuucgauccucuugccuccacuccuaacuguugggauuauagucauauauuaccacaccaggcugggauuuuucuucugaaaaugccauuaggaacagaaaucacauuggcgaaauuauuaaaggugucaggagccaagucaucuagacuacagaguuuguccuuuuccucaagguaguuguaugcccacaaaauacauaauucaccuauagaccugucucuguagacagaagaauaauguuuuccuucacuuuuguuuguccuugugugaugugugaguauguguguguguguguguguguguguguaguugauugaugggauguucaguaauacaauggaauauuucuucgagauagucuuauugcuggguagagauuuauuaaacucuauuuucucuuuuuuaaaauggugcaggggaucaaaccaaaccuauggauuugacugguagguaguugcucuaccuuggagcuacauccuuagucuagauuugggguuuaaacaguugucaugguaacauuguauuugucauuuuuuauacuauugagguuucuuugaaaacuagucaguuaauaguuguuugcuuuucaaaaguauugcaguuuucagucugaaaacauaaacaaaucaugccuuucuaaaauuagauccaaucuauaguuuuaauuuuauacuguguugaugcucucggaugcuggcuacaaguccuuagaguauauacucucauguggcuguuuuguaguuuuguuuuguguuugagaaagggucuuauugugggcuguccucacuggcaauuuuccuacuucagcuucucaaguacugaacuauagacaaaagccaccacacugccuuuacagucuuuaauucacuauuugaugagccacuucuuggaacgauggacaugauauaguaauuaaaugggaaagcaaagguuuagaggauuagaacuagacuuacuuuuuguuuuaagaacuagaauuucuguuagcaucugucuuaauuaggguuucuauugcugcaguaaaacaccauuaucaaaaagcaaguugaggagaaagggacucaagcaggaaccuggaagcagaggccauggaggagggcuguguauuggcuuguuccucauggcuugcucagccugcuuucuuagagaacccaggaccaccaggccagggaugcuaccaccgagaauugccuggacccuccacauuaaucacuaauuaagaaaaugacuuacguacuugcuuacaaccuggucucauggaggcauuuucucaguugagggucucuccucucaggugacucuagcuuauaucaagaugacauaaaaccagcuugagcagcauccacagaaauguauucagugagacuuuaagcagcaauaaaccuuaacuagguaaggcaggagacauuugugcuguaagauuauuguucagauuagaaauaaauaauugaaagauuuuaaauaugacagauugaaaauaaguuaacugaauucaucuugccacuugcuaauuuaacaucuuccuguccuagcuggguggcacauagcuuuagucucagcucuugagaagcagaggcagacagguaucugugacuucugggcuauccuggucuauaauagagaguuccaggcuagcuaagggugcauagugagacccugucuccuuaccuccugaaguuuuuuucuuucucuuauaacaaaaaauuaucaagacuuuucuguguauagucuguauuugagugcuuuccugguggaaagggaacuggauuuuugacacuuuacccaaggaaaagagaucgucugaaaucauuucaggcucuaaccuuuagaagagucuagucagguaaauaaaaggaccauagagcuuuuggagcucuugacagccagugucuaaaugaccacuuuugggccuaaauuauuagcauauuucagaaugauuuuagucagacagcauaccugggagugugacucuauacuugauaauuaucuauuuuucaaucaauuaauucauuuauuaaaguaaucuuuaaaauuuccuuuacuuuacaugucauacauaaagcaagcaugugagugagugugggugugugguuaucaugguguucauguggauaucagcagacaaugcuuugagaaucucuucucuucuuccacauuguugaagcaggguguuugagguuguugacuguauccacucguguggauucuacacuagcaggucuguaggcagaucugccuuugccuuccaucuuguguagaagugcugagaguggccuuuuaucuuguuuccagggauuaaguuaggucauugggcuuucacagugagaggguuaccuacugagcucuguauguuucugaauuuggaugacauaugucuuaagaauuuuaguuaaugauuauucuuuuucauuuaugcuaauguauauccccucccucccucccucccucccucccucccucccucuuucuugcaagguugcuuauaugcucccccccccccgcccccagaauguaauuucuccacgagagaguauuugauauuacuuuuuguccauaaaugugacgauacugaguaguuaucugucucuuguggucggguagucaugagguuuugucugauucauuuggagaagauuagugguuaauaacuuucccccagaguauggucaguugugaggacuguugugaguuaguauaguucacacuaggaauacuggugaacguuauauguaaauauuguauuuauauauaauaugcauuauauauaaauauuagcuguuauuguuuuuguugcuauuuauuuauagaugcuauuucugaccugaucuuaugacuugguuuucaguugggguuugugaauagugucuuuuugugugcuguguucagaaaugugggcguuugcuuuuuaaaaucuauuuagucuuauugauuacauccaguaaaaugauaauucacuauauaacauuugcuuagugugcuuuacaaagcaguuaaaaagaauuuuuggguaacauuuggaagcugucaaaaugaguacaugacugaaccuaaggagucgucuagccaagugugaguucgcuguuacaccagauguuaaaacguguucaccugccuucuccagcuggccuggcaaguuggaguggguggagacuagggaauuagaugugugucaugacacugguuaucaucauugugaaaugucagggggcacuguuggugguugccaauuauaguuaagugguuagugggugcuaccuggauagaaaggaaauagcuauuauccuaacaguuuauguuaaguaggaacauugaagcagauuuuuaaaaaguuuuuagaaguugugcaaaaguaucuuuguagcagguggccuagaauauguauuuuaaacuuucucaucaucugugaauuuuuacuuagagcuauuuuuaugagaaagaggauuugagcacauuguaauuuugauuaguguugaaaccugcaucuaguugaauguacauagauguuuuuucuucccucugagaaguugcaguuauuacaaugucugcuuguaaugagaauuauaaaauaaacuuguccuugaccugccuucaguuccugccaagcugagaaaaggcauucacuuuuguucauuuugcccuuucuucuggacaaauaaccacagagccugagugcccaccugugaagugguggagcagccaccuugcaggacucauguaagggggaugugugugcagagugaccugccuucagcagaacugacagccagcaggugcuugguaauggacaguugucaugauucuguccucggggucagggucaaggccacucuugucaguguauucuugguaucugggaaagauccccacuccguccuugcuaaggcagaagagcagcuccuccucugagugcaucagugcugacuacugcaguaucucuuuguucauguuuaugccuguagugcuucacagcgcccucugggggggggugccauaagcuugagugucacuuaaaagacuuaccauuaugaucuaugcuggguagcugagaggugauauuuuggcagagugcagucucugaaaggccucugauucuuaaagguugucaagcacagcguaagguccugggucugaguuuccuuuucugguguuguuauccaucucuucagcugugucugaggcugacaugugggagaugugggauaagcacuuauugaaugaauaaguguggcaauguguauauaucaagauuuguggggucuuuacuagcuaacauuuauuugauuuccuugaggagcagauacaggauacaagccuuaaguaaccucauagcagccuuggcaauaaauccaauuccauuuccugucacauuugugguuuaagcugggcacagauuugcuguugcacagaauugcuacugggacuaaccuggaaccuuucagcugcuuuccuugaaaugugcuagaggaaaacagggauuaggacccaggccuguaaggcaugggcuucauguggucucuugggcuauguagaccagggcagccuagaagucauggagauccaccugcuccugucucuugcuaggguuaaagacgagugccaccaugaagcuuggcgucccuuuuccuauucuggccucucaguuguaccaugaaaguugagaaucuaaaagguuccacucuuuuaugaguaagcguuugucuacagaucuguauaugcccacaugugucccugguguccacagaggucagaagaaaacacuggaucucuuagaaguacaguugcagaugguuugugaacugccaucuaggugcugggaauugaacccagguccuuugcaagaauagccagugcuuuuaaucccagcucagaaaaauuuaaaaacugcuuuaauuuuugauuuaaacagguucaauuaaaaaggaaaaguuugaguuugugauuauaggaauccuuucuucugccuucugcugaugcauaaucauuacacuuuuuaauauauagaaagaguuuuaaguugaucauuccuuuguuuuuauaagacuagguagaaggauuugauggaguuucaaauuuuuuguuugcuuaauuuuuuucuuugagauuuauuuauuuuucauuuuaugugucuggguauuuguuugcauguaugucugguacaaaauaagcaugaagaaccugaagaaaucauaagggugugucacucuacuggagcugaaguuacagagcuguaugugcugaggacugagcccagguucuuuggaagagcagucagugcuuuaaccacggagucacugucucguccccucguccacauuuugggaagggcucugcucuaucccagacuagcuuggaauuugccacucuguaggccagauuggucaugaacacaauacugccucaucucucuacgcauagccaccauggauagguguaaguuuuccauauuuuugggcaacagagacacauuuauuugcuuauauuuuuaaaagauuguacagcauuuagggagauuuucuuuaacuaggaaauucauuuucaaaguucuuuaguuucugggagcuuaauuucauaagcuucagucuauccuuguccucugcaccaggaggugacaguguguguaugugaacggacccugaagggccauucuucagagaguguaccuguagaaucggugcuggucagcaucuggcuccagggauuuucuuuuuuccuggauacccacuuucacaagucagauaaacuggucucugaacuuugggauggcuacuuucauucaaugauccaacaauuccuguuuugguuccaaaaaggcaguuuucucccagccauuaaauagcuagguuuccuuuuccucuguucuuuguuuuuaaagagaaaguggggucuuucacagcuguugauuucucuuuggugauaaugagugagcucuuuuagaaacuaacccauuauaauacugcuuuaacucaauaguuuaccuuaggucauuuugggauuuggaaauggauggccgucuucacaggcuuaugauuguggcauguucugguuagcaggagauuuggugcuuugggcacagcaggcacaaaaagauccuugauaaggauugugaugcaaucuauguaaguggcugccaaacaacuuaauauggaaggagaauucuucuugguuuauaaugauggcuuggaagaggaugcuuuguucuguggggcuggagcucaaacccagcugguaggcaagaacuccagugcagagcacccuuccagccccccagacaaacagaugaauauauuugugcacaugcauucucacauaugaauggacaccccacucccaccccugggcauaaagcugaaaguguggcauuguacagcuuugaaaagagcuggucugaaggaaacaguaacagugaucacauuuggggagugggaacagaagaaggauucccagguuaguugacaccauuggucuuccuaagggguugcugucuccuucaauccuucugcuaauucuuccauaggggucccagaccuccauccagugcuuggcugugaguaucugcaucugucucaacuacugguagcgccuuucagaggacagccaugcuaagcuccugucugcaagcacaacguagcaucauuaguagugucaaggauuggugccugcccaugggauagaucccaaguuagggcagucacugguuggccauuccuucagucuuuguuccaguuuuguuccuacauuuuuuuuuuuuuuuuaauuuuagauaggagcaauuuuggguugaaagauccuaaggagcucccagagacugagccacuaaccaaagagcguacaggcugguccaagccccuccaccccagcacauauguauguagcagagggcugccuggucuggccucagugggagaagauauaccuaauccuguagagacuugaugcccuggcauggggggauaccugggaggcacccucucagaggugaaggaggugggaggcaacauuugggauguaaauaauuaauaaaaaggguucccuuuuuaccuugacacuaaaauauuaauuaaaauguaguguaguaauguaccuuagaucugacuaguuuccagcuaauagaaggcagacaaagaguagggauaaaaaugguaucuaugaguguugaugggacacuaucaaucacacugucuuuguagcuacucuccacgcucauaacacagcacuucaguguaguuaagugcuuaguucuguuguagagguuuguguguucuguccuaucuuuucuauccugcaaacaccugucacccaucuacucauauguuugugucaucuaaguagagugaagccuacuuauauuauaauaauauaauuauuauaauauaauauaauugcuuccuuuuccauaagacuuuaguugauuaucccucuagauaauacaguuagagaagcauuaucuauuuauuauuauugucauuaguuugagauagaaucucacuggaacuugcucuguagaccaggcugacccugagcucccaaagaucuccccuugucugucaccuaugugcuaggcuuacaggcgugugccaccaugccuaucugagaggcauuauuuuugguguucacugggagggcaaaguacuuaguuauuuucagaaaugguguggaacauugaaaaaauaaauucucuugguguuaaaauuuugauucuccuugcuucuugagauucuuaaguuagugauuuuacuucauaaagugcucaguucugcuccacuugagugaacugagcagugauuugugcauuaugcugcuuugcauuucucauugcuucaucaacaccauugcccuccgugccagcuuacuuugcucuugcagcuugguguuugucuggugcuuagugguuugcauuagguuggggcauguugaguuuuuggguuacuuaaugcuuaacaaaucccucaaaacuugguuuaaaauggcagcuauuccuuuaguucaccauuuaggggcuugguaguuggggcugggcccagcugugugaugguguucuuguucccucugaaucccuccugcaacagucagcuggcaguugacggucuugcccaaauaugaugggugggugacuguuggucagcugucacuccaggcauuccugggccuucagagucaccuugucgaguugaugagccuagucuuuucuacuugguagacuguaugcagcgugagauggcuguacacauuuuuaaccacuuuacacguuuuugcauguauaauguuuggcauugucuuugggccaaaguaaggugcaagggcuuuggaaauucaagggugaaaaaggacuccuuuuugcagggggaacucucuacugcaauggcaugaauucaagcaaggaacgaaacuggccccuucucuauccaugaaggaauguugaugggcucagucuugugcagauaaccacagcuggugugaguucaugaguucaacagccguauuauguccagaagacagugugaagcaauaguuuaauuugaugacuuuucuugguaaauauuuaucuucuuagaauugggcacguaauuauuagaugccucuagcugauguaagugcguggcugugcaucuguuguauguuuuagagaagguggcucaugggcagacgcucuuaagucagacuugcaguaacaaugccuucucggacuugucacauucccacaggcuccuaagucaccuuuucuaugucugugugccaacucgccuaggucacacugggcaagacuucuuuugggcuuuagcuagcuuaggcauaagguacuguuuuucaaauguaauuucucagauuguuuucccauugcugccugucagguuucaagucugaauuguguuaauucccaggcaguuaccacuugcaggcaugugcuuauaauauauagccagagucucauuuggaacaauaagagaggaugagaaugaauaguaagaaggccaucuuggucuugugacauacuugaaucacagaauauuaaaacauaaagacauuuauuugcaucuuuucauuuuuaagacaaggucauccugugcaucccagauuagccuugaacauacuauguagucaggcuagucuugaaaucaaagcauuccuuuugccucguugccacaaguguugagauuauaggcauauagccaaugcuauguugugguuuuguguguguguguguaugguuuauuucuguguacucacuagugccuagagguucaugacaggcuguuuuccuuaguugcuuuuucacauuuuuugaagcaggaucugucauugaaacuggaguuuacugacuagacuagcuggcuaguagguuccuugaauaucucucuucuucagcaauggagaaauuuuugaauuuuaaaguuaaauuuguuugauaaaacuagaauauaaugaaccauguaaaccacuguaucagaacuguucacagugggaugaucuaaagauuuuaggcaggaucuguguaagucaguggaagggcuauuuguuugagaauuggaagguuaauauaaagaagcagaggaauuuuuucuuuagaucuuugauuuggaaacacugcugauuuuauauuacauuucucuaauauguaagaauaugcaaaugcaaaggugcauauuagauucuucuugauuagagccacauucaggucuuaaguguaacuucgaagagcugagacaugaaguguugcugcuguggcuugcuugcuuccuugucguucuaguuucccucucuguagaggacuccguccagaggugaguguguggauacucuacucugcuauguugucccaaggcugauuggcaucgaaagcugagaacaaaaacuggagauuguucaagauauuuguugauaaggacaacaggaaccagcagcauccuagauuccauauuacagggagaacgcuaagacccaguguacuuuugagggcagacaagccaggcuguacucugaugucauuaugauuuagugaucuuagagaaguuaguuggcccuucuuugugucuggucuguaaaauggggaguguucauaaggcuccaacuauagaguggucauaaggaauaagcaaagggggacguauuuguaaaaugucugaaaggaagaagaaugcagugcaaacaugauaaguagcaccauagugcaguggcaucaccucuggccuauaggaaggaagggcucagucauggaugaccacaaacuggaccaaagcucugagauagauuuuugauggguuuuaguaagcuuccauauagagagcagugagccgucgagacaagcccuuaguauccaagauuaagcagauuucagaacuaugacaguaggaugcugcuguacagggauuacugauacagugcugggcaucagaaauucaugugcagauugagguugaagcucugggcccagggcuguauccacugucuugccagcaggcaccucugagcuggacgcuugacaguuggcuacuguacucaguucaaagggacauugucuaagacucgucugcuaguugauagguagugauguggggaagauggauccaggguggauaaugaggcuguguugggaucuugggaucuauggguugaauuucuaggcuggguauuagcauuuuuggcacuuaaugauugcagccccgauaacaacuggguguuguagaucucauuguuuguggccauaggaagaaaggguuugugaccuggugaaacaggaaaugcccuaggcccaucagagccuuguuggauguaugaaggucuugucuuguggguagcaucugccuggaaggugucaugggcuccagauaguccacagcugucuacucuguuugcacagcucauguguuugguugcaggaugcacaugaagacagcuguggagaaacugacccuggccuggcagcuucacugaaucuacuuugccagucaugugccucaggauggggaaauugauggccugugugcaguugaugacaugguugaagccagcauagauaccauagggaauugucuucauggacuccccagcuuccugaaucacaugacuagagccauggcgggugagaacaguggagugagaaggcccagcagccaagggugcugucugggaaaacucccugggcagguauucuugguacagccagugcucugcggguucugaggcacaggcauguaguagaggcaggguagcugacauuuagaggagcaugguuucuuuaggaugugaugacucccuaagggcucagugggcaguacagagugcagucuuaggugacucuuuaggcccuagggcagugguucucaaccuuccuaaugcugcaacccuuuaauacaguuccucauguuguggugauacccagccaaaaaauuauuuuaguugcuacuucguaacuacaguuuuucuacuguuaugaaucauaauauaaauagguuuucugauggucuuaggugaccccugagaaagguuauucaaaacuggucaugacccacagguugagaacuacugcccuagaagaagguggaauacuguggugucugaggguggcacugugaaugguaccagacagaggcaagaggcuacaacauuuauagcuaugauaaaaaaccauagccaaaaguuaguuaugggagaguuuacuauggcuuuugguuccagagagugucaguaaugggggguggggagacauggcagcaguguguguugguuugauaugcaugcuucaaggaguggcacuauuagcagguguggccuuguuguaguaaaugugucauuguaagcuuuaagacucguguucuagcuuccuggaagccaguuuucuaguggccuuuagaugaagauguagaacucucagcuccuccuacaccaugucugucuggaugcugcccuacuccagccuugaugauaauggacugagucucugaaucuguaaaccagccucaauuaaauguuguccuuauaagaguugccuuggucacagugucugcucacagcaguaaaacccuaagacagggugguuguaguaggaagcugagagaucaugucuuuuaaccacaaacagagcagagaacaaaugaaguggggcaggcuacauacucucagagcucacucccagggauguuucuucuccagcaaggcuccaccucauaaagguuccauaaccucuccaaauaguaccaccaacugguaaccaagugucuuaaugccugagagcacagggacaucuuucauucaaacaaccacaugugguaacagaggccuagaagggaaagaaaaccaugguggaguacaggggcaguggugagggaguagagcgaguaccugcagccuugggcaaggacaaccaggagcuacucaagcuaggauucuccaugcuucagugccccuaggcacaagagacucauaugugccacaguaauccucuuguuuguuugaagacuuauuuuuauuuagaaaauucagagacuucugaauuuccuaaucuagugcagaucgaguauccuuuauucagaaugcuuggggcuagaaguguuucugauuuaauauucuuuuggaguucugguaugcucccuucccugauuuuggaauauuuguauauacauaaugagauaccugagggugggacuugagucuaaacaggaaauccacuucuguuauacauauaccuuauauacacaaaagaugauuucauauacauacuacuccuuauauaugcacaaaagaugauuuuuuugugcccuuacuuuagauuaguaccugucauaagauuguacagaauucaguauuuaauaaacagucaccuuggcgugcagagacuugacuuccauuguccaguaugggggcacaugcuuguaauccuaggguucaggagacugacugcuauguaguggaaccuguuuuacaaaaaaaccuuagacuugcaaguuggauucucaaccuguagcuucuuuucauucuaagaccugguucagucaguaaacugauugccccagcaggaggugccuuaguuuguccucuggcuucugaaaguauuccugcagguaacuggccaaaaggaaagagccuguggagggaagcagagccccuugcuucuucucuguaaugcacugggaacuuuuugaaaguagcccugcaguguccaccacugcuugcuccucugagcugcugagauauuuccucccagccugcagugagggacaugaaacaggaagugauggaccuguccugcuuugggcaguguguuuccuuuuggccacucccucugcuccuuuuucauccucuagcauucauugucuaaaguacucaacccuuuaugugcaguggugugugugugugugugugugugugugugugugugugugugagggugggggaggaggaaggaaagagggaggacaaccugaagaaguugguucucuucuuucacucuguggguccugcgaauccaacucaggauauuagacuugguaagcaucuuuuugcugagccaucuugcaggccuccagccucuuuuuugcugcuuuuuaacauucuuuuguuacaacuuuauuagcacacaauauuccuguuucaaguauauucuuuguucagaguuuucgcaggguuguagaacuaucacaacuacucaauuugaaagcauuuucaucucuucuaaaauucuauagccuccuucugcuaucuccaucacagccacuccaaaauguggguuugccuguugugcaugugacacaggcuuaauaauguaaaauguuuguguguguguguguguguguguguguauguguguaugugauugacuuacuucacuuagcacuguaaauccaagguucccccauagaccaguuuuuauuccuuuuuauguuugaguaauauuccauuguagcacucuuuaaauuaggaacaguugguguccuaguuaggguuuuacugcugugaacagacaccaugaccaaggcaacgcucauaaggacaacaugcaauuggggcuggccuauagguucagagguucagucuguuaucaucaaggcaucaaggaauauggcagcauccagucaggcauggugcaggaggagcugagaguucuacaucuucaucugaaggcugcuaggagaauacuggcuuccagguagcuaggaugagggucuuaaagcccauacccacagugacacacccacuccaacaaggccacacugccaaauaguguuacucccugggccaagcauguuaaaaccaugacaguuggugaacauuuguuucuacuuuuugacucuuaugaagaauucuguuaggaacauucauauauaagcuuuuaugcacauaguuucaguuuuggagaguaaauacccagaaauggaauuccuggauaacuuuaacccuuugaggacaugcaaggcaggucaaaguggcuauacuaccugacaguaccacuaggaauguaggggauucuaucucuacauucuuacuaauccuuucuagccaucguguugggauaacucccugaggaugcugaguaucuucucauguguuucuugguuaccuguaucaccuggauaucuaucuucuuggaagaaauagcuguucugaucuuauguguuuguggguuauugaauuuuuaucaagggucaggauucuuuuuauguuuggcuacaggucccuaauaagaauagauuuuuguaaauauuccauuuaucaggccgcccauuuggguuuuuuauuuuuuguuuuuacuuuuuauuuugcugauuuuuuuuuuuuuucucacugguuuuacauuuuuaacuuuuguagaauucuggcgaaaaaucagaauaucuaauaucaugguuagugauuuuuauggauuuuugacgguuucauauauuuuuauaaggacuuuuaauuauuuuuacacacauuccccucuuuauccuccacugucuccugcuggaaccaaguccccuccuacuuuagugucuucuuuuuguguguagcuacugaguuuaauuuaccgucuugcuagagcuuggguagcaggguguagagcaaaggcaacuaauuuaacaguggcuacaccugugaagacagggcacaauuaacaacugguaauuguaaguacuccuguagggaggcgugagccccucuugggccucucagccauccaugcuggaauguuggugggcccagucuguguaggacuucagauagccacagcuguagugacuugaugaugcaauggcucuguagagucuuccugucccaucuugcuugauguucccugagcccuggagugggcugaugacucugaucucacuuauucugggcacucuggguaguuguggguuguguuguaauccaugccugcagccuaagaaaccccuuugaugaaggccuacugaacacuaauuucaaacagugauuuugaacuggacccugaugguuaguacagaucaucagcuuggcaggaucuggaaucacuuugguggcaagccuggauagacuagguuagauuaguugaggcaaaaagagccaccugaagcaugguggcacgauucucugggcuggaguaccccauugcagggaaagaagaaagccagcugagcauuccucccucucugcuuucugaguguggcugcagugcagucacccccccccaggcgccugcugccaugguggccuuccacagcggccuguuacaucuaacaggaagaggaauuaaaaauaccuggguuugucucuuaucccaugaggguacuguugacaguaggcaagucacugucacacucugucacaccaguucccaaaaucuaaguguggcucuucuuuacaaauauccacccaucuccucucuguaaaggaugaguuugaaacacuuugacuuuuaaaacuugcacaggaggcccucucuaucuccuccuuuuuccuuuccucuuuuucuugcucuuccuucucuccccccuccucucuuuuuuugggacaggguccugcuauguggcccaggcuggccuuacacuguggauccucuuucugucucagccuucugugugcugggauuguaggugugcaccaccaugccuaccuacaguguuuuagcacguccuccuugacuuagcuuucacaugcugaaugucacucagguuugagaccuguaacuuccugauuuugccuguguauccugcacugcaacaccuucuuuacuucuuggcucucauaacccucuucagguaguaauuuccuccuuggguuugaguccagagaaguguuuauugugcuguacggcgccuaauagcaaguacaugcuuagugacacacgugugaguauagauguguaugugccacaacgggcacaucaaagauucaucuguggugagucccagggaaugaacaagugcuuuugccaucucacuagcccagcaauauaucccucccucccucucuccuucccucucuccuuccuucucucucuccuuccuucuccccccucccccccucuuucuuucuuucuuucuuucuuucuuucuuucuuuuuauuuucucuuuacuuuccuucaaagacaggguaucuuuguguaguccuggcuguccuagaaccagugcuauaggccagauugaccuugaacucagagauccaccugcaucucccuccugagugcugggaucuaaggagugcaccacuaugcuguuccuccccuucccccccaguuuuuuuuuucuuacagaguuuccuguuuuagauucuaaagguauauagucuuuucacguuauaauauuccugucuucuaaaguuuugagucagucuccuuagccuugaacucaccauucuccuuccucaucuuccuggguuuuauaauccuuccuccaccuuuagugcaaggcugaguuucuggcauguacaggauaguggcugaguguaaaguggcagugcauggauuucuuuguggcuauugucacgugaaaggggaggcauuugaucuagaguguuguagagcugcaguguguacucagcaguccuagggagcugaacaguuaucagugauuggagcugggcuggcuccaggaacacaguucccuuggguggcugcuugaguguggaaaagggguuggggagcugagguaagagcaaagcauuccauuuacagucagguuauuguuaucuagcgcugugcaugcuacaauuuauucaguaguguguguguguguuugcuaauacuuguguguaugccauuccucauuuucaggcaguuaucauuaauuucagucaccuuuuagagcuguaaacucuaaaggcuucuugaaaaacuuccuugggaguuacccagugagaugaucuuaguaacacuguaagauuucaugucuucccucugaaguacuuccugauuacuuuaguucuuaaucuuuccagcuuccugacauuaguuacauuuaugugaagaaucugguaucacuuguucauccugguaaccuguauuggggauuugcugaaugcagaagguaugaauuacuagaguaccuaaguaacaaugauaugugaggaucaacaguaaauguacacacacacacacacacacacacacucacacacucacucauauauaucucccaagcaccuuacauggagagucaauaguucucaaggguuacuugaugaacuucuuggauggagaauuuuuaaaguuggugccaagggaaaacuuuuggcaggaaaagcuaaggggcauuauuuagggaaaucagaacuuugaaguagacucuucuguacaguauaggucugcucagguaguaugcugggaacagucuaccugugguagguucuucauuugggaggagcuuggagaguuauucuugaagcccuuccaaaagaccucauuccugaguaacgaccugagguauucagaucugggcucggaggacucggaagugaauuuggagcugcaagcuuaaucagaacuucgaagcgcuuguuauguuuuggccuuacuuggcaaagcagccuuggggugcuggggggggggugcugcuugaguuaguugggauuuccccaaaugucugccucagauucugcugcuuggaccucuuaaauaagggccuuaccuaacucucaucauuccacuaggagccacguuauuuaugcagagaugaaguucacuauaguauacaguaaguacacugaagugcuuuugggccaggggcuucugcaguauucacauggaauuuaaauguccugcuuuugcccauuccuuaugccacuccuuugcccagugaccguuguugguaaaugacugugugacuaaguuuccugggaaugaaucucagaugcucuuggucugcacucuccuguggcucucauuuggggaucucaccuggggaugugcaggccagauggcuuggcugggagccacagaccagacauggauuuggaugugucccagugcuuucuuuuuaauccugcauggaccagcuggccuguccccagcuagcugccacgcacucugauggcuucagugucuuugcccugcucauuucccucaagaaggaacucccucuucugucucuguagggcucaguuuaagagauagguuuccugaaagcuuucuuugucuagucuagcugaugccuuccuguaaacccuacugugugugugcuagcauauugccagcuuuucuguguggugcuuguagguauuuacugugcaguucuuguuuuauggucuguucgugcauuggacuaucuccauguauugcucuguuuuacuaguaaaacccaacaucgaaggauuaugcauuguagauagcacguguugacccucugcuauuuuuguguguuuugaggcugaggucucagaauauuguuuggguuagucuugaacuuguaaguucaaagucuacuuuccuuagcguacugacugucugggacuucagguacacacaacuguucuacccuuuuauuuuguuuugcuuuuagauaagggucucugcguaucccuggcucuccuggaccuccuuauguagucccacagauauucaucugccuugccuuccgagugcugggauuaaaggugcacacagugcccagcuagccuuuguuuuccaagacaauauuuugaggcaagggcuccuggggcuuauucuuacugaauauuagcagaaugaccuugagcuucuuacauccugucaaccuuaccagugcugggaugauaggugugugccaccuuaccuggcucauuugugcucuuuuuuguuguugauuuuuuucugcuuuuugaaauaggauuugacuauguaucccagguugguuuggaacuuccuguauuccuauauaucucaggcuaccuuuuucuacuuuuuuuuuuuuuuuuuuuuuaaagaaacucucuguaguuuugguuguccuggagcucaguguguagaccagaccaggcuggccuuccagccuguucuuaaaauugcuguucuucucccuuagugccugagaacugggauuacagguguuugcugccauaccuaacuuuguuacaaggaauguuggaaggggcuagagagaugcuaagauugcuugccuuuauccugaggaccuaagguugguucuuaggcggcucauaacugucuguaguaacuccagcuucaggggaucugacacugccagcuuccucagacaccugcugcauucccaugcauauacccacaacaggcacauaauuaaaaaauaaaacuuuaaaacuauaaguaauauuuuaagacccacugacauaaaaaugcuauugguugaaaguugucuuaugaaaaggaaguacaccuuucaguuagaaccuuacuuuucuaaauuauauuuugcuugcauuuugugugcuuacaugugcaucuugcggugcuuagacaaaaguuagaggacaaccguucuuucuaccauguuggcagcagguguugagccauuuccuaggccucccaguuagaaccuuugagcuaaguuuuucugaauguugcauuccuaaagagaguacagaaaaguacaaauuaaaacaauauguuaugucuaagguggggcagaggacgguguguugucuauauuugugugagcuccugaucuugaaaguaauucugaaaacaguuuucuccuuucagugcuggggucagacccagggcuucauggaugcuaggccuaugcucuuaucuuuaagcuaucccucagccuccaaauuuauuuggaauagacagaguguggacuguuguauuacuuuucugugucugugaugaaacaccaaggccagaaagcaauuuagagaaggaaggguuuguuuggacguagaacuccacuggacaagaaucaguccuguuggggaggccuggcaguaaauggcaggcauggcagcagcaggaggaaucugccaucucacauccucaaauguaagcuugaguguagugggcuagaaguaaggcaggguuauaaacucucaaagcccaguccauucuaagaugcccccagcaaagccaagccucagaaaccuuccugagauaggaucgccagcuggagacuaagcauucagauaccucagccuuugggggacuuuuccuauucaaaucaccacaacugucuuacccagcuuagugauuaguagccuggugagaccuaacagcaggucaucauugugagcaacugauggugaggccacacugagugaucacucaccuagccagcuccugccuuguugaucuccaggacagggaacucuuggucugaagcaauaagucuaaaucauauaucuauuuugagaacucuucagguguucugcuuuuuuuuuuuuuuuuuuuaauuuuuguguguguuguuuaugggaaaauuaaaagaauuaagcccaaaauguuucuuugcugucguuugaggaaaguguuuaaguucaaccccugcauuuuagagaaugguguauuguacacauuuuccaguugccagguucucaucccuucuggcuuccaagcaagaauccauauaacugcugacugaugucagcacacaaaaugacacaggaguuugcugcuuucuaccugugugagaccuucggcaggaacccagacccuuugagucaaauucgucuagcaauaagauggggcuagauccaacaagaaaacaucacuuugauggguaaaauuuacagucuugccucauuuccuuccuuccuuuucucuguucccuggcagggacuuaccuuguugaguaaauuaaucuccaguucugaguccuggauuuuucugcugccucugauuccugcucuauuagucaccucuuuuguuuuugucugguaaauucuuacccgauaacagcuuugaguauccuuuggaggugccacuuuucuguaaccuuacagcagcagccuaaggguuuguuuguuugucugucucuuucuuucuuucuuucuuucuuucuuucuuucuuucuuucuuucuuucuuucuuucuuucuuucuaaacaaacaaaccuuacagcagcagccuaaggguuucuuucuuucuaaaccaaccaaccacccacccacccacccaccccagaacacuggguuuaaaauuuaucaucuuccuguaucagcuucccuggugcugggguuguaggugugugccaucacacagagagcacugggagcuggagauggugguaccaaucugugaucccagcauuugagacgaugauguaaaaggaugacgaguuuacguuagucugggccacguugaaaauuaaaggcuggccugggguacagaaugagaccugucucagaaacuauaucaacaauuucuuuugcaucuuuggcaaccccugcccuccccuguguguguacauguauguguguguauguuguauguauacauacacacacauguucauacgugcgugugugggaaagucagaggucaacuauggcugucauuuuacagggccauucuacuuuucgagacagggucuaucauuggucuggagcuuguguaguggcuagguuugguggccagugaacuccagggaucugcuaguuucagcccuacccagggcugggauuacuaguucauauaucaugcuugcaauuuuaaguggauucugggggucaaaccaugguccucauaguugcauagcaaacauuuuauugacugagcuaucucuuuaggcucauucucaucccuucucacucauacgacauagauggaugcaaacaugaggccccccaccccccagcugcagagaugauuuuaccauuucaagcauucuaguguauugucuuuaaguuccuuacaccugugguggugguaguggcuauauucauaugugcucaugaucuuguaaauaacucuaaauauuugaauuuauuucauuauuauauaucuauuauaaaaaugugaaaaaguauaauuugcagugcugggaucaacuccagagccuugcacaugugagacaagcacucuaccaauaagcuacauccacagccuaucauuaucauuuugauuuauuauuaccuuauuuaauugggauauuguucacauacauuuuagucauuuaacauguacaguucuuuaguuuuucuugagugcucagagaguguaaccaucaucauggcccaaauuuaggauguuuuuaucaucucaaaaugaaauugucuuccuggcuuagugguagacauauagauauauaaggcucuaauguuauacugagcgaagggagggacacacacacacacacacacacacacacacacacacacacacagagacacagagagagacagagagagacagagaggcagagagacagagacacauacacagucaguccguuuaccaggguuuaucaggugcuacccauuccuggccucugcaguuaccaccuuacucucugcauccuuagguuuauguguucugcaccuucuguauaaaagugucaccauucuuugugacuuguaagcauuuucucugcagacuguagggcugcagugacuagguuuauaucuuggcuuuccucuugcaagugucacuggugcaugugucuucuaacuugacucugccucuaauuuguaaagugggagggagaugaucguagugugugugguggauaagugaguuaacauggagagugugcagggcugcucauacccuaguaaggacuccauaauuucuaacugauucauuucuuggucuucuguguuuauguuuauucugucuguguugcugccaauuacccucaaguacauaaaaacaguuacuuagaccaguuccuuuguaguccuaaauccugagguaagaauuuagucauuaucgaacucuguucuuucacaaugacuuaagcuggagaaaaaagcuacagcauuuuggcaguauaauuauguguccucauuuggcaccucaguguauuuauuuguaugagagaugaugcucucaucugauuuaguuaaaguaaaucuaggucauuuguuuuuaaaagccauguuuaaauuucauuaaagugaguuuguuuccucaaaaguugcuuuugagaguaauuucaaaauaaaacaaaauguauuuuuccuuucauauuuuuuccaagaucaaagaugucuuauauucuuuaagaaaaauucaugguguccaaaacguucauaucaucaucgccuucaacacagucaagguuucacuugagugauugaugggacuucaaagaaacuguugaaaauagcaauucauuuuaaaaauaaaguucaauguaaauacugaucacaucuagauuaaagcauauaagagagauuacagaucaccagacaaaaaacuggaaucacugaccuccgaaccagaacucugagaucaggacuuaacagggcucugcugagcuuucucugaagaacaaguguaagugguauuuacucuuucugggucacaguuuccacaucuguaacuggaggcaguuggccuagacuaccuguggcgcucauccagagggagagcugcuuagcccauuucucacggugacaagaagcagcugaguggcaugugcuggagucuggcuauuuugggaggcuugcaugagcuagagugagcuuaggccagcuuguggaacucaauugagacccugucucaaaagauuggugaugguagggauacaguuagucacuuuaguggaagaguaucugccuagaauaugcaagacccuagguucuaucuccagcuuccagacagauggacagacaggcaggcauggacacaugcauuguccuacaaccacaugugccaguagggaaggcugcggacuagccaucuaagugucugcuguacucuuuuccauuguugaugccauagcccuucaaguuaucuacugaaguguguuuuuacauuucugacaucuuguguauucucuucuucagauaacuuuauuuucaacaccuucaaaauuuuuaaccauucuguguccugaggcguuuuuaacugagugguuccuucucuguaaaaauuacuuauaaaaggcagguaugguggcacacagcuguaaugcugacacuugggaaguguagaccgguguaaggguuaagaggugaagggcauucucaagcaccagucaggguuguauuagagccagccccacuuccacuccccuauuacuccucgugcuccccgcacuccccaugcucccagugccaaauugucuagaaaguaagugccuguauauaaguuauuuuuugugacauaauaggauuguagucuuaugggagaaaagcuuuugcgauugacacaauaaguuuucccuuaagauuucaauuauuuuaagagguuuugcuuguaauuaggugguuuucuaucucauauugugacaugguagucaguuaugggccauaaaagguggagagguguagggaauuuuuauaaggguccaucauccauccaaaacauguccuuaaguuacagacuuaaauaaaugauaggugucaaguaugaauguauuagaauuauuuaaauguacauagugacuugggauuaauaaagauuuauuuaaaaauauuuuaacguuuauaaagcucuugaaauuuauaagauguuuauaaucuacgguucuaaggucuucuaaaaucuucucaagauucacauuuggaaagauagaucaagaaacacccucuucucaaaaacacagcaagaaaucagugacaugcucucguaccuuugucuucaggugugcguggauggaucacuuacuggaagcagcgcugagagaacuuaagcagccucugcuuguucacagaauguagcugcuguaagaguuaagacaaaacgaaagucaugggaaaacgcucuugaguccuguauuaguuacuuuuuuuguugcugugauaaaacacaaggcuugacuaaggcaacuuuuagagagccuuacaguuuauuugggccuuacaauuucagagggguaagauuccaucaccaccauaguggggagcagcugaguacucauaucccaagccacaaaaaggaagccuagaaaauguacuggggauggaaggaggcuuugaaaccuaagaccaccccagugacacaccuucucuaacaaggcuacaucuccugaucccucccaagcagccaucaaccaaggcuuccagugcccaagaccuuguguguuuggggagucuucucaaggaaccacagcagguccuuucauccuacuuaaaaaugcuguuagaaaagauuauagcuuuguuucugaugauuaguuuugcuuacuaaguugucagagucaaugguugcccaaaguuuuaccaaacaacaaauacguuaucuucuaaguauauaggaaaauaacauuuacuaaaguuuaugucagaggaaguauugagcaguaccggaaugcuucuggccguuugcugaguguguccugugauagcuuguguugaccuuugguuuaccauuacagucuccuaguaaacucagcagauuuguuauauuuaaguuacuuacccaauauucucuagguccccuguuuuuuauuuaauauuuuaaaguuggcauggguccugaguuccauaaggaugguuucauagguguauguaaauacaugugaacauguuccccagucccucuuucuccuuucccaucccauuagccuccaucauucccuuagagagauuuuacuucuaugucauauauacuuacauaaauuuauguauaacaucaguguuuaagccagucacagaaggacaaugcuuguauguauguauguauguauguauguauguauguguauguguguguauguauguauuguuuguuuuuguuuagacaaaauuuccuguggucaggcuggccuugaauuucugguccccugccucugccucccagauucugggguuccugguguacgccacuaggugugauuguuccugguguaugccacucggugucggugugauuguuagcuccuuuggguuugugugccuacuccagagaucgugcucagagucaaggaagagaagaacccucugggauuguuggggcaccaguuuuauaaagucucuuggagccagccuggaaccagggcucugagugggugaaguguucagaguucuuugccucacucucucaauggagaaggaagauguucauauuuauguauuucuauaaaaugccuugaaaugguaucagauggacaguguuuguuugugaugauaguagccgaauaaaggucaaaaugucauggaaaacaacaaaacaagcaggagagagagugauuaguucauugucagcagcuuagaauguugcacuuagaagcaguuaaacuggcuagagguggggcaagggagagagcugggcaguuuaaaggccccagcuaccauggugagugcuugacuguuuugaaauguguauuuuaaaaccagaaaacccaacuggaguacuguuuuuacugugugccucgauaaaaugauuauuucaaaucuagucuugagauuuaaauuuuuguugucagguuugucagucuuuuggacuuuuggcuuugauuauucuuucaagauuuaagugggagaaggagaaauauaucaguuucgauccuuuugguuaauaaauugagcaagaaggaaucaugcgaaucuaaguucauaugcaaagauucgauuaacaugaaguauaacuaauuuauugaacauuuauuaaagucagacauuguacuuacuccuccuccuccucccauccgcugggaacugagcccggggugaaggcaugccaugccagcucuccaccaccgagcugcauuccucaccgugggguccauuugguaaagccugaugcucaggcagcccaagcuggccucgcagcgcccagcuauguagccaggcccaaguucuguauguauucugagcuggugguugguuaagauuaagaggacagcuaggaaggguucuugauucuuggagguugacucaguauauaauuacaccgucagaggcuuucuuuugagagcccaucgcugucaucauauugauauuagugauaucacaucccaguguguggcauaauaaaaaccaaugggaguuugagacaaauuugaauagugaagauaguuugaaguuuaaaguuugggucuuagaaaaaacaaaugucuuaaacauaugcuuguccaaacucaguaaauuaacauccauuuuaggauuuuuuucuuuguccauauauauguauauuuauguuuauauuuuacaaaaauaugaugguagucauauacucacuauaaauacuccuaggggauaauuuuaaucucaauuaaagauuuguguuuuuuucuuguuaaguggcuauacaguuuuuccaugugggaacauacugaaaaccauuugguuauuucuaauuuguuucuguuuaaagaacaucgggagggaugguuuaguguguauuucaguguaugcaugggugaaaaagcuguaggauaaauuucuagaaaaguaaucuggugugugcguguugacaaauacccgggagugguuccauuguucgcaggguguuugagcauguuuucaccucaucucuccagccuguugagguuuguggacugaaagguuagaaaguggcuucuaauuuuuguuaugaaaaaaaaaaaucuuuaaaaagcaguuacuauuaucuugugcagauauuuauuacugugugaguguauaguguaugggugugggcuugugugcugcacgugcauguggagguaaaugagaacuuugugggaucaccacucuguccuuccacgucuuuguggguucugggauugcagucaggcccccaagacugaguaacaaauaccuuuaccugaggcaucuugaugaccacuuuuuccuuaaauaaauuuagugugcaacuuucuauguagagcagguuaccagaucucaaacuugcagcaguccugccucugacuccuaagugcuagguaccaggugugcaccaacaugucuuacaaguguucacacucacgcaugcacgaacaagcaauuuuuuucauaagguuucauguaauguaagcuagccugaaacuugcugagccagugagugaggaugauaccucuuuaagcacagggauacaggaauuugcuagcaaacaugguuuaugcagugcaagggauugaacccagagcuuuaugcaugucaggcaaguacucuuccaacugagauacgucucuaaccccaaaacacauuuucaaaaggguagccuuuaucuuaugucuucugaguaauugacugucauuauugguuaaugagauuugaaagaaguuuauagaaagaaugaguaacuaaggcagguagcacuguuuccagugcggauggagacccaagccauuuggagcuugccuggcaaguaacccagaaugcuuugcucauguucugcaauaucacauguucugugagaaauaguuucuuaucggacaacguacugggaugcaguuugucacuuagacacaggcaggcugcuuuugauuggcugcugauauagaccuguuauuaucaggugcuuucuauuuuuucccugucaguguuuuuuauuuauuuuuuuuuuguuugguuugucuuuugagauggucuuguauaccuuggcugagacugguuauguagaucaagcuggucucaaacucagaaaucucugccuuugcauuccaugugugugccacuauauccugggaaaauguuuuaaaaaauuacauuuauaucuggcacauguggaggucagaggacaguuuauggaaauugauccucuccccggaccauguggcucccaggauugaucucaguugaucagugcugugucagaugccuuuacugcugagccaucucaucuagccccaaaccgcuuuuuuuuuuaauuauuaaaaaaaaaaaaaaaagggugcgguggggguggggcggcccuggagagaugguucagugguuaagagcucugauugaucuuccagaaguuccugguucaauaucuagcaucuacaugguggcucacaacuauucauaaauccuauaccaggggauacaaggaccucuuguggcuuccacagacaugucacacgugugguggauagacaaaauauagcaagcaaaauaucuaaauauauaaaaaucaauuccuaaaacuccauguguguguguguauguguaagucaaggggcaaccuccgggagucaguucucucuguuacuggacauuuuggggaguacuuuuuugguugucaaaugauaacugggaaaaucagaaacccuucgugagguuuuuaauaucauuaauaagauauuuaagaauggacucauagaagcucaaggacaaguuuauuagcauuuauaaaaacaaaacaaaaccaaaaauaacccagggcaagcaagccauaaaucucagcagcugccugaaggagacuaggaaagagaugggguacgggguggggagucaugcuuguuaaguuggcauggaggauaacccacuacagggcagacaagcaaccacaugagagggacaagagcuuuagagaaagaauaaggaauccccaagugccagagaaagcacgcuucggggaugggggugggggagggaaggaaacaugcuuuucugagugauucagaaaaguaggcagacguaagcugugugguuuugcgaggagguuggaauucugggauggaggagcacaucauuucaaucaggagauaauuacucuaucugucucuuagcaugacuuaagguaaacccagcaucugaggguuggucccuuagccaggucacugaccugcccaacuggaguauuuaccaaggccagagaucucaauucuuuugaccagaaggaaauaguuaucucuuaauggguccacuguggcacuucugcuguaucguuucuacuuuaugagucagggaccaaacucaagccaucaggcuugguugugagccaucuugcuggcggaauugguagggaugcccugaccuguaaaggacguuuguggaagucuagcugguuguaauaccugguaggagagcagguggaagguggggcaggagggaaugcuauuggcaucuacuauagacaggcaagagccggcucccaccguuuacaaugggucagguugagauuauugcuagugcuugcaguugagaagccuugugcugugguuugcaucuuaaacaugucccaaagaucucuauguuaaaggcuuuucuuucucagaacuggacaacugggagggagguggaaguuuuaagauggagucuuuggaacauuggggugugcccucugagcggauugugggguuccagugccuuccuuucuuccauuuuugccuacuugccaaaggugagugcuuuugcugccuugugcauuuuggcacgaugccucuccacaugccccacagcaauguggucaaugaguuauggaaugaaacuugcaaaacuuugaggcaaauuuacuuuauuacuauuuuuuuuuuaauaaauggugucuuguguugguuauagugauggaaagaaggaguuaggguacucugcauuagagcugucugcugcuuuuacuugaacauagccuaucacauuuuguuuggcuauuuacuagauuuaccuuuuacuaugucaggcuaccauaucuacagcaguugaccgcccauggcuacuucuggagauuggugcuauuuccagcuacuucccuugguuuuuggcucucauauaggcaaggcuagguagaguuuaauauaaugaaccuuacuuaguauuuucucugaggcuauagaaacaguuuaaagauuuaacuuuuggguuuugguaaggcuucugguaauuucuaggcuggaaaaaauggcuguuaguacuuagccaauaaauacuuuucugcccaauuguggaaguaaaacaaacacuuagccccauucuuuucuccauaucuaaaauaaagcaaaauacucuccaacaaaacaaaacaaaacaacacaaaaauaaagcacuuagugauucaagggggccuacauugcuguuccugcuguacuuuucacgucugccacuggccugggcuggcugagaaaagcccacaaccauggccgucugauugcauuuccaacagggaggcuuggggaguccaaagaaggcuugagucaucagaugguuuuagaaagccagauucuuuccaugaggucaacuuaaaccugcuaugacuuuuaaaccuuuagaggaggcuugagagccacauagcaugggacucugcuuguuuagugguuacuucuaaagggcauuuuauauuccugcaaaagaaacagcaauuuuuuaagcucuaaacuggaaguagcagcugcuuagggcggcuucucaugaaauuaauuuccaacuggaaaauaaaauacccuauccuuuuuccaaaucaauguagguuuagguuaucauguaaagacugcauugaaagaauacauaaauauuaggugcacaguucauauagacaugcccuuagguccuguagugcagugcucagaacugugagucaugccacagagcagcagacaacggcugagcuuacaguuucagagcagaaaguuucugcaugagugcaggucuagacuagaaguuucccucuugcuacugugucugucuuuguuucuuugauugccuugcuccaugguaagaauaugauggaagccacaacauaagccacacauguaguuuacacguuucuaaaccagccuaaugucaggugcuugggaggcagaggcaagaggaugauaaauucaaggccagcuuugauaguuuagugagaccagucucaaaauaaaaaguauauaguuuuaggaaggauucuuggacauaauaaauaauauguaauuugauuggauuuagaacuguguuuaaagauguuugaaagcugaaagaccaguuugugaaguaugaagcaauaaaauuaaaaacuuaaaaaucaaaaccuuaaacauaaucugggcauggugacccauccuuuuaaguucucacuugagaggcugaggugagaggaugguggcuaguucaagaccagucugggcaacacagugacuccacuguuggauaggacuacccucucugaaccaaacaaugaccaucucugggaguucagcugugucugcuugcaaaaagaccacuccuaagcugaguauaguggcacacacccuuaaucccagcaccugggaagcagaaggagguagaucucugacuuugagaccaguguggucuacagagugaguucuaggacagccaggucuacaaggagggaccuauucuccauccacucauccacccauccaacccacaaaaccaaacagaaacccaagacaaguaaacacaaaaagaucauccaugcugaaccugucuguugacauccccucauagggugagaguggggaggguccuauaacucuggugugcaugcacuccacacugccuguuguaccgguucugcccuuauuuuauauggcccagaggaggggcuagagcauaggggggacauggguagguauguagggcuccauuuguguggcuaugagaaagacugcuggguaaagacugcagagaggccuuugcggguuacccauucuccuggaaguaguccuuuauuagugcauccgccuaugggauaguagggagggaggaggcaggaaacaggagugccccagaaagaaaacaguaggggaaaggagagggaggagggcagguggagugcugugaaucuuuuguaguuuucugcucuaauaacccuagcagugcuguugguaaacacuagauaggcuuucacaguguguguuugcaugcauguguguguuacagcaugcaacccauaauaugaauagugguccagcuacauaauagauuuuucugcauggacauguuuguguguguaacuuuagaacagaaugguuuuuuuuuaaggauuuguuagauaacuuacuauuuguauaaauguuucuacucaugagcacaauuuaaaaaauaguuuccuaguagaaauguuuuuaagaaucugugaaaagugggggagaggagaggaaaguugaguggguuuaggaagagaagugcuauaacugacugucauuaggacacuuccucaagaaaauaccuuugaggauauucuccaucagaaaugcgguccaugugugcacagucacacagacaguaacacguuacuucucaaaugguacagaauggaacaacucuuaccauuuguuugcauauaaacaaguaaggaggguauucucauugcauagcuuuuaguaugcuuuuuuaaaguguguguauauggcugggcaguggugguggcagcacuugggaggcagaggcagagguauuucugaguucgaggccaaucuggucuacagagcgaguuccaggacagcuagggcuauacagagaaacucugucucaacaaacaaacaaacaaacaaacaaacaaacaaacaaacaaacgugugugugugugugugugugaaagagagagagagagagagagagagagagagagagagagagagagaggaagagagaacgcgcgagcgagacagagacagacagaaacagaaagagagagaacacauauguauggaaaagucuuuauagaguucucuccccuuucaucuuuacauggaaucugggagagaaacaauagaccaucaggcuugugaaccaagugucuuuacccacugagccaucuugcuggcccuaguguacuuuuaucugaacaacauaauaguccagaccuucugugaacugaguaacaucuaggccaaaauuacacaaaagagauagaaacuguaagcaagguauggguaacacaccuuuguaauccuaccacuuaggaaguggaggcaggaggaucagcauacagaauuauuuuuggucuacauagugaguuguaggccagccgaggcuacaugagauccugcugucaaauccaaaccaggcaggacuagaagugugaccucuaaggugaggugacaagauuguuguggguagcucuuuuuugcugcuuagauuucuuuuacauucaaaagaaauuauuagcacaaauauguuuguuguggcuuacugaaauauuaaaaaugaaggcugugauucccacagugccuuucuaguuggagaaaauggugaagggauuccaaauaguccaugugagaagagggggcauuaaagaagcugccgacauggccacuccauuggacguuuaaggcuguuauugugaauaauagagagcagagagagagagcagcagaauggacaugcccauggcugucugcgugcgagugagaggaggacagggaacugugaggcagcaggagauagagggauagagggagugcuagagacuggagguuauacugaaggugaggagcuguggggcuugggaauguacaacaagcacuugugaauagggccuaagggagccugguggccgcauggccuuugaugugcaagcauaggugccugucuuuggagagcuguaugucucuucugccagagguaaucgguuccugaggaaugcuggcuuuugcccuaccacccuguaguccagcuugagcucauuucuggaucauagucuggauaggccgaaccuaacagucuggaucuagauuuacacccgaggucugaccugcccagucuuuggaauacauuugcacuacuuuugaauuauagcgguguuucugaaaauaaucuguaaaugcaccauucuuguaauugccucauucuuaaacuguuugaauauuucugggugauugacucaauauaugcuuaaggcagaugaacauaaaaauaguaguguuaauauaagcaagcucuuuauggaaaaggaaaugacuacagguucuuuugcucuuuauaacugguauaguucagagaugggucgggaagggaagugcccaugcauuuugauacucuugacuuccgcucauagagucuugagucuacaucuccagguuuagcuuuucuucaguccagguuuccauuucuggcuacugcuaaggcacuucaaauuuagcaugccccgaauuucucuaggaucucuucuuuuaggguugcccauuuuagggaaagacucugucuuuucuuuuguggcacaaaugccaucugucuggccugaugcguccucccuuccugcccugcucucucauuccccaccccgcucugcuccugcccuuuccuuccaggaguccccaggaggucuuucccccagccugguacuuuuauaguuaccuuucacugaagcugguggaaugugccuucaguuuccucuguguggguuuccugccauucucaaggauacugacuaugacucccuuccuaagcuagauccacuagacacugggcuuugcuccucuugguucccuugcagggccuagaaagcccuucuuccccaugugcuucuggccagguuggcugucugucugcacagucagcgaggauaucaccucucugcuacagaugagugucucuucguucccacugagcguucuccucauccagcacuuucugcacugcuguguuguuagguauugugagccugcaccugucuucccauauugcuuugccuuuucucuucucuacugcucuugucuccuuuugacauucugcaguguugcucuugacacuuagcugucugaacucgaccaggacagaacucuuuaucacuuuuguucauugcugauuuauugguacuguuaacagugcauaggccauagaaaauaccaagaaagauguaggggcaguacguaauuguaaguucaggacccagcucaguaagggaagagaugauaacaggguuuuucucagucucuguagggcccuuuguguccguguugguccuuauaguaaauacaguuaaacauguuuuauucauccagaucaauccccccccccuuuuuuuuagagucaguucuucucucugcuuucuuguuucagauguccuuguuuuuaauuuguguuucauaucacuccaguuaucccccaacccccuuucuuuaguaaucaaaccccaacaguuaaauuacuuagccacuucucaaaguuagcgcguuuauagaauuugguauaugcagagucccaacccacuuauggcuacgugacagcaauuuucaagcaguuuugcucaaauaagcuugauuuuguauaacaagguuagucccuuucuuccacccccuuuguguugaauacaauuuuuucuuucauguuuagguaguguccguauuguuuuugcgagcuugacacaagcuggaguuaucugagaagagguaaucagagauugagaaaauacaucaauaagauuagccuauagacaagccugugggauauuuucuuaauuagugauugauaugggaggccccacugugggugguaccaucccuggguagguggacugggggguauuuaaggagcaaaccaugagaagcaauccaguaagcagcaccccuccauggcuucugccuccuuucaugccgugauuuccucagugauggacuuugacaugugaguucuaagcugaaauaaacccuuucuucccgaaguugcguuuguucaugguguuuaucacagcaguaggaacucuaauaagacagguguugcauaacaugguguuuuugucuguuauaaauauugaacuguaacaauuaagcuguuucauuacucuugaauauugaaccaauugaauuuacagacagcauguguuuccugguaccaugcuauagcagugaacacauuguuuuuuuuuccuuucuuuuucugugguggauuuacuucuauuuuccucugcaagauuuauuauaaucuguuuuauuuuuaauagguucauugcuauuuaauauuuaaaaauaauaaaaauagagggcuagaguuggcguagugguugagagcaccuuuuguucuugcaaaggauaugaguuugauuuuucagcacccacaugaagguccaccuucuugggcagcaggcacacaugugcugcauagacauacauguaggcgaaacacucaugcacauaaaauaauaagaauaaaucuaaaaagauaaaauaaagauaauuugaaguuaaagauuuaaaagaaucacuaauuuuuauuacauuuauuuaguguauauguguaucucugugucuaugucucuguauauuugugcaugugggguguguguguguguguguguauguguguaguguaaaagucagaggacaaguugugugaguugguuuucuccaaucagguuggcucugccugucacacuuaggccauuaagcuuguuaguaagugcccuuuauacacugaucuuacugccccaaacauaaaguucagccucaacacaugauccacuugucucuauugcuuuagcauaaucuaugcauguguaccaccauaaccagcaaggcacuagaaauaaacaaaauuuaucuucauuaccauauaacucagacggauuuaaugauacuaaacauuuugauaaaaaugguaaaauauugacuagaauugcuucuacuauuuuguugugaauggggcuuugccuuaaaauaagaguucuuuguugauggauggguuuugaugauuggcagaggacaguucacaaugaacucucccuauuugaaucuuguauugcacugugcuaaggcacuugcagaccuuacucagauaauugagagacaggaaugggaagaguucugcuauugcagugacacucaggccuugaacuuagguuaaaaaaaaaaucuauugccaaaaucguuuuuugauuacagcuggacccuguaguuguuaacuuuuccuauugcuggggagaaauacuuggccaaggcagccuaagggaggagaagguuauuuguuuccccauuuagagcaguggcucucaaccucaggaaugccgcaaccccauuaauauggcuccucaugguguggugaccccagccauaacauuauugcugcugcuaguucauaacuguaauuauuuugcuacuguuacgaaucauaguguaaacaucuuguaugagacaccuauaaaaggauuauuuaaccccagagagauugugaccccagguugaguaccucuguuuuaggaggucccacucaucaugguggggagggcauuguaguggaagcuuauaguagcuggucagagccugcugucagacagacgggagcgcuggggaagaagggcgccugccucucaaggccucaguggccucugucugucagcuacaucucaaaaguugcagaacuuucugcaauagugucaccaacugggaaacacaaggggugugugugugugugugugugugugugugugugugugugagagagagagagagagagagacagacagacagacagacccagacauagacagagacccuucagauuuaaccacaacagacauuccuuucaauguuguugaaagcagagaaacuaccagauuugcaaaauaauugguuuucuaguuguaagcaucuucuuagcauuuauaccgggauguccgcuggcccuaucuuuggugagcgaggggaggggaggaagugagcuaugcugagguuggggauuagugagcauuaagucuuucuuggugugugucuccuuuguaaaguuggguagggaggauuuugaaaaguuaacugaaaaaagagggcucaguucagagguaagcaggguucaggcugacgggagaaggaaauuagugcuuuggagaugaauuuccugaaaguuaucuguggaacaguauugucaaagcgugauaauugcuggagcugggcugugggcgugucaggguucacugugggguucuuuucugccuaucgaguauaaacauuuacacaacaaaguaacauaaggcacauuuguggaacacaagcccauggaaagugcugucugugucuuccaguuugagggucauugucuuuuggcaguauuaucacuccuaguuccaguacccuuaacaaaauaaaacauuauguuaaaaagaaaguaccaaaaucugacgauuuuugacuaucaaauuggaaguuucauacaguucagccuaauccuggagcacauguacgccugcccuccgccaguuccauuuugcuacugugaguguaauccgcaggcccagggaagccacuucaggcuucuguucucuggggcugucgucucugguaugauuuaucaggaagaauuuacaugugcuaacaguacugugcugggugcugcccacacagaguuaaguagacagccauuucuagguuuuauuguaccagccuuggacgucaacauugugcucagucucuguguucuaagggugggccaacaaaccagucgguucauuuagcaaaaugccgagugaacagaugagcauguuugaggguagacauguggagcugccaccuguguaauacucaggagcuucccuuaaagagaaguuaauuucccaaagagcccugagugcaagucugugcaguuucuauauuaugaaaccagggagugauggacaggagacagaugcuuuuuucugcccuuuggugagauaauuaggaccuagagaagugaagggauuuacuuuguuauagaggcaaaguagaaguggaggcagaucuugugcauucucaguguauauuccagagcccaaaccaaguauugucaaaauaugcucgggaaggccagggcacagcucuguaauccaguggagcauagcccaaggcucuggauucacuccccaaugcuguaagauguccaguguguguugggccuccuggaggucccugagaugauucagcagacugugaagucacauuuuuuauaacaauacugacaauacaugcuuuuauucucacaugagcaaacuguggaguuuucuagaagcuauucaauacagcaaaaaauuaagccagagugggcuuaagauuuuggauacuuguucuaagugaacauuaaacagcuuuacaaaagcguugaguugaucugacuacucuuacuaauugguuuugaaaauacuguuccuaugaaacuuauauggucuguggauauggcuaaguggcauauuugccucauggguguagggucuuggcuucaacuccuagcacuacuuaauuaauuaauuaauuauuauuuuuuuaaacuuuuggcggauaguauuaacuguauagugcuggcuggccuggaacucaaagaguucuuacucugacuucugagugcugggauuaagggcauggccuaugacacccaguacgcaccauggucguguuaaauguauguguggauagcuauuaauuuggaucuggaguaguuccaaaggcuuuauguauuugcuuuguuuuucaugcugguuauuuaauaucuggguguugagggcuugguuggcauccuguggaaauucugggagaggauggagccuuuaggaggaaggaagggucuccuuucagggagcuaggucauugccuguauacucugggagaggauauuaggaucgccuguguucuuugguucucaguugcuaugaagagaauagauuucuuccaccacacccucccacucgguacacuauuuugccacagcccaaagcacaagggcuaaguagcucagacaaccucuuuucuucuauuauuucugauaauaagaaaaaaaauuacuuuuuaagagcugagagccaaacccaaggcuuugcucuugcuaggcaaguaugcuacuacugaguuaaaucuucaaccucuaaaauaauucuugaaauuauuauuauuuuuuuauuuugugugcauauguguguauuauaugugugcuuccaugcuguagugugaauguggaagucagaagauaaguuauuggcauugauucuuccuuuuugcacacgugucuuggagauagaaguaaggugguuagguuuggcaguaggccccuuucccauugaaccaucacauccccaucugaggaauguuguaaaauuauccaguacaaaacuuacaugaugcuuucuuuacuuucuggauauguguuuccagcucucuacuuuguggguaccaugauuguaguuuuccuaauaaguaagauauagucugguaaacaauuguuaugauuuuugauacacuccugucuaaaucauuuaguuaauguauuuuaucuuuauugccaaaagccaaagaacacaaaaaugggaauaacucucuuagaaaauuugugaugguauuuuauuuuuaguaaagaauugauuuuaccuucuauaccugugugcacaucaugcacgcgugcaugugcacaugcacucacacacacagaaguguaaaucagugugacagugaaaugaagcagagcuuacuccuacuguguugaauguauucauuucuguucugcuuuauuuuaaaaacuaugguguugcaacuuacuuaaucgaauucuaaaaaugauacaagacaugcucuuacaguacacagggcaaaaagugccuuauaaaaggaguuuggggaacuggguugagcauuaauccucccauugauuacaagugcugucuuucacuguuauuuuauuuuauuuuuuugcuugcaauauuuaccaguggcucagcucaacuccacacaaaugcccaagucaggucaaguaugcugacagaaaggaguguugauaagaauguuaaccauaccuagggagucacuuugaaggauagcauauuaacauuaauaccaaggccucccacauaggaaugcaugcaugcuuccuacuaagugcuguauauauucuccuuguuucuugccacaguuggcucugaaauuuguguucuuuguuucuuggcugaguccagugaggcagccuauagucaggcaguggaggaaaccauggucuccggcucagacucaagcuguaugugcuugcuuucuccugaauuguuucccucacugaugcauguaacacaucugggcuucauuugccaaggagcugaaguugucauuugauguauaucuuaguccaaaauagucuucauucuacagggcagggcuauauacaucauuaagacuuuuuauuuggcccccuuauuaguggguucaguagaugaccaaguacuaagugaagcaguuuaugguuuuuuucagaauagucauuuucccauuuaaggugcgagaauagucucaaguggcuugucauguuuugcugagaauuuuugggacccacuguuagucuuauguggauuuguggauuucuaauucuuuauuauuuagaaacagugucucacaauguagcccugguuugucuaaaccucccuguguagaucaggcuggccuugaacacacagauaucuuccugccucuugcuuccugaguacugagauugacagaggcccaauacauuuuaccaagagcauuuccagugagauacuguauuauacagacaaaagaccuguaacuugcugcugcucaccuguacacuugauuugaaaggaccucccuucaauugaguuuaugcauuuauuuggcaguuaaauuacauaaauaagguaucuguagugguuugaauaagauuggcccccauaggcucauauauuugaauguuugguucccaguugguggauuguuuaggaaggauuaggagguguggccuugauggaggaaguguguuuuuggggaugggcucucaaguuucagaggcccaccccagguucagucucacuuccuuucucugacugcaacuuguggaucagaugugaucugucagcuacugcuccagagcuaugcuuucuguugccauguucucugcuauguggucauaagcucacccucugaaacuguuagcaagccccuaauaaaaugcuuucuuuuauaaguugacuuggucaugcuaucucuccaccauguuagaauaguaacuaagacagugucuaagucccuuuucccgccuuucucuaauucacucucuuucucuaccucugcugcuuuacuugguguuuucccuuccucccuucaaaaugaaucaguaaaacaauagauuaaacuaaaauaaaaucuuugauagggauuauuuaacuugguuguucuuuuuaauuuauucuuuuuaauuuaaauuuauuuuuauuauuauuucauuuaaaauuuaugaguauggguguuuuauauauauauauauauaugucuguauacuaugugggugcuuggugccuaaggaagaggguguuggaucugcugggacuagaguuacagacauuugugcauuaccaugcaggagcuggggaacaaacguagguccucugcaagacaacgaggccucuuaaccacaaaccuuucucuccagccucuacuuuggcuauuucuuuucaaagcuuauacauucuguuuuuauuauggaaguauuuauuggucuucucccucccucccucccucccucccucccucccucccucccucccucccucccucccucccucccuccuuuuucuuuuuugguuuuucaagacagaguuucacuguguagcccuggcuguccuggaacuuuauagaccaggcugaccucgaacucacagagcuccaccugccuuugccuccugagugcuaggauuaaaggcgugugccaccacccccugacuccuagcuuucuuuuguuuuuuguuuuguuuuguuuuuuuuaaauaugauuauugugaaaauugagugguacugguaguauuaguuucuuauagaauauuuuucaugugcuugagguggcuucuagguauuuaguccauuucaccugccgauggugagaacagaggcuuugguggugugucuccaucuaacugcugcugggaccuuggguaacaugcuugcucucuguguaccuuacuuucuccauauguaaauggauuuuaugaaguaauuucuguaaaugcugacucauuguaaaggcuuacuguaugccagcugcuguuagcuuuuguuauuaaagcagguuugcaguuucugacucguauugagaguacucaggaaaugcuaguuauuaauuaauaguacugcaguuaacauuuucuuuuagauaguauauugaguggcuuugccugaggcggaugugccugcuucccuccucccauuuugcacacaggguuuuguuuugcaguauggcuauguagcccaggcugaccucacacuuguaacccccuucccucagcuuccagaauagugggcuuguaggugacuacauggccagcuuucauuguuagucuuauaggguuggcacuagguaacugugugagcuuggucauuuacauuuccaucucugggguuuuagucuaaccagguauaaaacaggguuguggagcuguuguuugauuuauuuguugacauuuauuuaucauuuguuuggggugcacaugcacugaggcaugugugucagaggauaacuuucuuccuuccgcucuuugggucccauuaauagagccaaaguuugcaggcuugguagcaagcagcuuuacccgcugagucauuucuacccuggucuagguguguauucaccuauaugcucucuuaauuuaaauggcaaugauugcguuuuugcuuuucuuuuaaaaauuguuuuuguaguguuagagauucaggguagggcucaugcacaagaggcaaacacuuuacugcugagcuaaaauccaugucccccagcagugauuuccuuaugaaugcuauugauaguggcuaguccaugucugugaucugcauauuuaguaguuaaugucccuucauaaacuguacuccugagaguagcccauuagauuaaaugggaguugauagaagaguuaguccuuguaaauagccauuuuaauuuaaaaugaagauguauuggauaugugcauauucaaauaauaagacuaauauuuuaauaguaaaugauucauccuguucuuuaagcauuguggacaguggucagauaucauaauguaacuucuuauucaauuauuuugcuuuaaauaugaucuuccacaugacuuaucagugucuuauggauuacuuuaugaauauuaguuguuaguagguuggaaaacauuugaaauuuuaaggaaaguuaaaaguaccaugagugacaacuacuguaaucaucuguuuucuuuaagguaaacaguguauuaugauaaaugaacuucaaaaaaugacuuucaaguaaaacugacauauaauagggaauaagaugcuucugaacuagccaugugcuuggcuaaucguugaaucugguuuagaagucuuaguaugugaaccaacucuagcagggaauccuguuauuuaggaauauaauaaugugcauuugcaugggaggagcagugaccuucauguaacccguaagauaauaucuugaauguaucccaguuacgauuucgaguaaaucacacauccuugcugaaauguacauuucuccacugcagagaaucaaaccuagcuagccuuguuacaugguuauuaggacuaugaaguggcacaauccaguuugggaaagcuuacaaagcuugcaggucuucucucguggucccuguaauguggucccugucugcuaaugucuucucucccugucuuguucaugcuuucccuaacucccauuuccaccugggcaugcuaaccuauguagcuuuucuagaccucaggcuuugcuggugcuaacacagacuugaacacucagaaucaugucaccagaacuuagguggagcugacaugucagguguuccaggacaaagugaaauaagaccuuacccuucucugagaagugaauaaauggaaacaaagacuggaugucuuugaaagcaagccaguguuggugcaaagggaaugcuggcaggcagggaggacuuggguuaucguuugauaacaucguagugagaucuuuuaaacaucaagaaguagcaagccagcuggggauucuggucagccuugcauuuugucuuuuugugugguucagagaagagcuagaugacugcacugaagucuuuaaaaacauuaacucucacagaugcucccacccccacuccuacuguaugcuguagauuuuagaauuaaaacauaauccuccgaggccagccuggucuacagagugaguuccaggacagccagggcuacacagagaaacccugucuuggaaaaaacaaaacaaaaccaaccccccccccaaaaaaacccaaacaaacaaaaaacaaaaauacaaaacaaaacaaaacaaaaacacaauccucaaaacugguuagaauuauucacaugacucucuuggcagagguaguauagcguguaugggugccuuuccagcuguguguugguagggaaauaauugaacuucuuugugaccuuguuuccuauaugcagagugucuccuauaugcaguguggagugaguuaaggaguuaauacaucugaacugcuuagacugugccugcagcagaguaaaugcuuacuaaguuuuuacuauuauuacauacacaugaaauggcugggaaagaaugacucauuccggacuuucagaaacuauucugaaccaggaaauggcuauuuagaaugugaauuuuuuuuucccuguccucuguaccugaccuguccucagugacccuuacuuauuuuggugucucauucaguagcaaaugccuuugacacuguuuguagcguuaaagauauaccaguuucagugaugagcaguuuucuuuucacaggcuguucugaccccucuggauccaugagcccuccgugcacaaggcaucuugcugcaucacaaguuugaagcacacauucuuaugugcuuugcauuuccuagugagccaggugccugcugcacagauuuaagcuaugggaacuuuuaaaauguagaagugucacugagaacagucucucugagcuuguugaacuuacgaccauuuucaagggacuuugucaucugugugcaugcagcuugguagcuugagugcuuuaacugcauggugggacaagaaguggcucagaagauacugcacgguugacuugugcaugccugacugcuggguuagcucauaugccucaucauggcugcccuuucucuagccaaguuauuauuucauuuugaaguaaucucaguggauugcagugacuaagcucaacauuauuuuauuucacuguggcuugaaaaacuacauacaacaaaaagggaaguaaaacucuaccaacagguuagaaauguucacuugucgguuuucuuuuugugguccugagaauccauguuuacagguacucugccacuaagccacucccucagaacacacauuuaaaguuuuuuguguuugaguacuguaugaaauauuuuguguguuguaucaucuuucaugaaauccuugaacuguuaagauaauuucuuuuuuagauuaauuuucuuuaucaaugauaauuuugauguuaaaaagucuauugagcauuauauguauucuagauggcuuccauaugucccuuuguucacugccaucuuuauaaauagucuuagugcaguaucauucauguaugagcgcauagagacagaggcuuagcuaagcaaagccagcuuuggaaucuuggcagucugaacugucacccugcagugcucacaguugaucagcagguacaugugagaccuauuugagcccaggucuucuaauuucagacuguugggaagaaugcagaauugguuuguuucccucaaguucucagccuaacuuuccugaaaucauaaacauuuccaugaugcuuuuccagaauuacaacuggcagauuucugagauagugaacuuaguugcccauuuuugcuuuaguugacuuuguuuaauaaaacuagcucguauuuuucauaccucauuuggcuccucaauggacgaugcaguuauaaacaauaaguuauuugaaagggaaagugguuuuaagggaaaaagaagaggaaauguuugaacuacccaguggcauguuuagcuagguccuaccuaggguccaacauugaacauagaaacccugaguuuagggaaaacugggucuuagaaugcagcaucagcauguguagcucuagacuugagugcuguguguguccucaggaagcaguagcaaagaagggacguggcuguguauauccgagccacagcuaagaucacucucaucuuacugcugcauauaauaagaugccucucugcucugcaagugcuuuccaggugcucucuuuuuauuacugcucuccauguuucuauuuuggaguuguacagucacauaguuuacauauauauuaaaauacauauacuuaauuucucuuucauguucaaaugauauuguuuuuaugcauacugguauuucaagugguuacugcuucuccuugcaugauauuucaaauuguacuuuuggauuuagucaacuacuaucuggcuuuaccuuguauuuaguauauauuaaguaauagcuauacuguggagcacaggguagcaccauaauuagugucuguacuacaugcugucacuggguuucauugcucagcuuaugacuuuaauuauaaauguaagcuuugguacuuuugggauuagaggucauuccacucuucuuaguccuguucccuuucaagagcuuaaggucuaauguuuaaccuccagcugaugaguaucucuaagcuggcauuguaacauuagauugaugcuuguuuucuuuugguauuuuaucgauuuuuaaaauuuuauggugucuauaaguggccuggacuauuagguuauaaauuaacagcucaauugaugguaauuugguaucugcuugacacccauccaucuucucauccauccacccacuugucugucugucugucugucugucugucugucugucugucuauccacccucucccuucccauuguuuuuagccucauauuguuaaaacagcuacagguucaucucauucugagaugauucuaaauaauguuaauccucaaaacaaaugggaaugcuuaggccauuuuuauccuuuguagaaauaaucucccgagaaaagauccucaaucaauggaaaugguugaaaauaaugcauuacuucauuggggaauuauuuuguguggguugugcuauguaacugaauaagugcuuccugcaaaccuuuaauuuuggccauuuuucucccucuacuuuacaguugugacauuuguuaaagaaaucuuuaaaguuuuuauuguuuauacuuuugggugaaggaucaggcuucagugacagacacucaagaaauguauugugcuuauucccuuuuauuauaauugcuuaugaucacuacuugucuuaaggccagcuacagaagagaagacagguugugcuuguguauguguucaaauggguagcuuuuguuguuugguguuacuggaaucugauauuaacaacauuuuaauguuucuagaaauucuuaagaguuuauuugaaaagugcuuuuaaaauaaauuugaagcuauguuaaaauauaagaaauucccuacagaaaucaucauaaaagauauaaauauaaaguaaaaaauuugcugucuuguauccaguggauacuugauaagcuugcuugccucccuucccuccccuccccuccccuccccuccccuccccuccccuccccuccccuccccuccccuuccccuuccccuuccccuuccccuuccccuuccccuuccuccuccuccuccuccuccuccuccucuucucaaaaaagcacgucuacuuucacacauagccuuuuauuuaauacauacucaaccuuauaaacuacauuuuguccuguuuuacagauagggaagcuaagcccagguuaguugguaagcagugaggcccagugugcugugcagcugucuguccaucaucuccccacuucccacugcagcuccauccacacucaugggcuugguuuccccuggcuccccugccuuccuucccgcuagaggacccuugcauugacuguccucugagugggauguucucuugcagguaucuuugcugacccccuccucuaccuccuuugaauauuuucuuaaaucuuuucuuucagaugaaugcuauacucaaaacuguaccuucuagcuccagcauauguagccugcuuugcccuguacauuauuuucccuagaacauauauguauaauacaauagacuuacuuaauauuuuuaauucccccacccccuaacccccuggaacauacaggguaagauuucugcaaaccucuguauagccuagguggccuugaauuugcagagauguaccuggcucugccuccucgguguguggaauaaagccauguaugaggucaguucacgugugucuuugugcugucucucaguggguguucagugacuaccuggugagugagugaaugaaugaguacaaagcuccugucccuuaugcaggucuugugcggucaggcccagccuuuuccauggucccuggagacagaacuugugucuucacacuuguauagcaagcacucuuacugagacagccauuuccuuagcucauggcuuagucuuuuuuaaaauuuaaaaaauucuucuuuuuauuuuugguguauauuguuuuacaccaugugcaugcuuggugucugaggagucuagaagaaagcaucaggucccacagaacugcgguuacagauaauuaugagccaccaugugggugcugggaaucaaacuuggucccuuggaagagcaggaaaugcucauaacuccugagauaucucuccagcauucccacugauuaaucuuuaaaagcaccaguuuuuuacuuuuugaaugcaguuuuaaaaaaugagacaguaucuuauuggauguuaauaggaagagaugguucaaagagacacacacacacacauacauuuuucauguaagcuggucucuacuuuuuacauucauaaauguuguaucauuaaaaauuaacauagugccggugguggugcaccacgccuuuaaucccagcacuugggaggcagaggcaggcggauuucugaguucgaggccagccugaucuacaaagugaguuccaggacaaccaguacuacacagagaaaccaugucucgaaaaaccaaaaauaaauaaauaaaaaaaauuaacauaguuuuaaaauuuguacaucacuaaaauaguguuuuuguauuaaauauguuguuuauguuucuucuauuaauauaaguuuuuaaaagaggcauaagauuuucauuuaaaauugauuuacacagggaaauaaaauucggugugagugcacguguggccacagacuuagauuuguaucuauuuguuuucuguuuauuuucuugcaaguauaguguuagaacaacacgaaagccucaaaugagaauuuugcugcucaagccacuguaguguauucuuacaguagugaccuuuggguuuuguuuauaaauuagacaacauguguuuauuggcuuugggaaaggaaacugaagagguccacaaaagaauaauaauaacaccuggugauuaucuaacugggaggaauaauaauaucauuauuuaaaaacuaaguuuagccaccuguauuauucauuuguuuaagacaaguuguaugcuuuucaguuuuaaaacauacugguauuuuuuagauuacucuucuuaagaauucacuagucaugacaguggacaaaucuguuuuuaguuacuguuauuuaucacagucggugucguuaucaccaccaccaccaccauguuuuucuuugaggcccugugauaauacuguuuuguggggcaggaagucaggaacuaaggucuuauuagcauggcauguuggacaggugacuugacuguucuggacaugaauuucuucaacugaaaccgugguacuggacauugagaguuaagaugggaauguguguuagaaucuuagugcaugcuugcaaaaguaagaguucuuuauuaccgugcuacuccuuccuugugacugggcauuucaguuucuugcggcugauugaugaccuugugcucaggguuuggauaguguugcauuugugcuagcuguucugugagcucugcuuuggaacgauauagaaaagugggcacuaauaaccaacagaguauuugcaggcuucccacuagauuggcaagaguucugaaagcauuuaccucuauauucagccuuuaugaccaagaccaagaagaaacgcuuucacuguuguagauguuccucaggguccucccucagcuacgaggcugaaaguuuucccugguggcuauaagcaacagaaagagaagggauuucagaaguggaaggauuuaaacaaggauuuuaaaguucuugcuuuaaaaacggugguuucagccuugaccacacaaugaaagcaucugaaaugcuuuuuuauagaauaaaaaugccuagcaguagaaaugauguagugccucucaccauccccauugaaacagcaagugagaagagggaagcagggagaaugugggccagguuucauggccauccugagugucacuucaacagcacagcccaucagcgucagccgcuuacuucaucuucaaaacaaacuaaaauugauuguaacugcaaaaaaaaaccaaaaaaccaaaccaaaccaaacaaacaaaaaacaaaaaaacaaaaaccccccagcaaguuugaauauacaaauacauuagaggugaagaaaugaguacuuuaguuaacaaucugaauuuggguuagucuuucuuaccuuguaccuugaaguauucuggaucacauuacauuuugcucuaguucuuaaggcugaagucuaauuuuuauuauuuuauucauuuaaaaaacugguaguugucuucuuagguuuugcuuugugugcuuguuuuguuuuuuguuuuuguuuuuggguuuuuuuggagacaaauuuccccguguagcuuugacuguucugaaacucacucuguauaccaggcuggccuugaacucgagggcugaaauuaaaggcuugugucaccauagccuggcugucuucuuguucugaugaaauauuauuagcuguuucugacuuauuaggucaaaaguaauuccuaauggaaagagagugcugauugggucuaaguucagagguagcauuguugaaaaugguuuggacagaccccagggucaaauagcuaagcauuuuacuagguauguagugcauuucuguauuagacuuucagggcuaaauauacuuaauaauuuauaugaagcaucuucuuggauuugagacauuauuucuagguuucucuaaguguagacucaugccuuagacaaggaaaauuccugcugauuuuguugaagaucaucaaggguuaccagagaaauugauaguauccaagaucaggguuagcucauuuuaagacaaaguuuaagagguagggcgcaggggucagagacuauagauaguauuaugcuuguucugugcuggauauuauuauuuauuuuaucaucucucugcccuuccaucuaucaguugauucaagacaggguauccuguguacaaggcgggccuggaacuuguuaugucacuguguuugaccuugaacuccucaugccuuugccucuguagguuaggauaaggagagugacuggcugcuguaaccauagauauccuauggaacccucuguauacaaagagaaacauuauccuucaucugaacuuguucucucuugaauauuguggucacuuuuccauuacaugucauuucuguagguuucuaaauuauuugugugugcauaccuuaggagaauugacauuuuuugugggucuccccacucuuguagaucaucagcugauuaaauccacaaaggcagugggagcagagacccugugaguguguacagugaauaaccacacgggaccagcuaucaggagguagaucaacuuuacuuaggaugacucaauucuuacaagguuuagggggacuaagaguaggaagauccaggaugagcaaagguauacagaccuagcugcucacugcauguccuucuucaguaggauguguuuaacucuuaccucaccacacuguguuaaccggaucgguuuauucuccccuuuaagcccuggcauugguugggagaaucauugugcuaaugaccuucaugcuauuacacaacuauguauuaauuucuuguuauuucugggugugauuccguggggcucuucugugggcaggauggauggauuuugcaggucaaacaauaccauuggauagacuauugauugccugcuuggaguuauuugaugaccuuauauuguaaugauuuacauuuauuucuaaaugucuaacauuuucauucaguuuuaagcuacuugagaaguguuuagauguucaggugauuugguuuugggauccauugugaucagaauguacugacugucugcugucuucuuguaauuuaugagauuuuccucuuuucaugugcaggagggcaggguaccuaguccuucuuaccuuucuuuucuuuuuuuaaaaauuuauuuuauuuauguacauugauguuuugucuguauguaugccugugugaagguaucagauccccuggaacuaggguuacagauaguugugaguuacugugugggugcugggagccacugcuccuaaccauuuagccauuucuccaguccccaucccacucccucccuuucaaauaaauauuucuugaaagaguuuauuugaaucccagcacuugggaggcagagacagucggauuucugaguuugaggccagccuggucuacaaagugaguuccaggacagccaggguuacacagagaaaaccugucucgaaaaaccaaaaaaaaaaaaaaaaaaaaaaaaaaagaaagaaagaaagaaagaaagaaagaaagaaagaaaagaaagaguauauuugcuuuugggaguggucccauagauauuaaacuucuacuuuguugaaaucuggacuacacagcacuccuuugguccuugcucaguccuaucuuuuuacaacccuugagggcuagggagaugaggacauggagacuggggcaucauagcucaggagugcaguuccagggccaguccauacaggacgagcuccuuccuuggaccauuccuggucccacccugacccaggaaagugagaugggagagggaugggagggggagagagaaagggaggcaaauagacugacuuaguccauguuucccaggcuguugugaaugcuugaguucauguuacccuccuuauccuuccuguaguuagaagcaguccuugaucuucaacugauuuuauagcuuaacauucaguugugauaggaaaaauuuuuuuuuucagucuguuacuauacaaauuguuuaaaggacucccccgcauccugugguuuguccugacugcuagagcucuuuaauugaagggaggcccugcuagaagaauuuaaucugugauaaaggauaaagaauagaaagcaaagcuuugcuaugcugggaagcuccagaggcagcuaaaggagggaggggcucagugugcuaguccaugaaggggggcguguugggaaugcaucugugauucucucugcuucuccugcugcugcaucuuacacugacuuuucugugugcaugaaugcugcaugguguagaagaauccaggcucuggagccagacauccuggguuugaauugugucuccacuguuuauuagcuguaugauucugagcaagauacugaacauuuuugucgugauuuacucaucuauuaaguugaaaauaguaccuauuuauguacuuuguuguagaaaguaaaugagaauuagugugucuaagugcuuagacuagagcacaaagaauguacccagcacauccaauaaguauaagcuauuaugucucauccaguagguggauagucugcuucagauuuguaugugauguaucaguuugcaugaauaaagaauggauuccaacugcuuaccauuaaaaagcuucuaaaugccaacugccugaauguuuugaauuguuaaauauguaaaucuauugagugaccacccaacuuuguuuaugcuugaaugaggguuugcccuuuaaaaagcugucuuucaaugaugcuuuagacuuccuguguacuugugagcauucuucaugucuaguuugggggcuuuguuaaaucugugguaguaaaauuuggauuaauuaaaacacccagaagauuuuaacuuuuuuuuuuuuuuuuuuuuuugguuuuucaagacaggguuucucugugugguccugccuguccuggaacucacucuguagaccaggcuggccucgaacucagaaauccgccugccucugccucccaaguguugagauuaaaggcgugugccgccacgcccagcagauuuuaacuuuuaacuaauguuacaugagugugcccuuucccuguucccuuuccagcaucaaaacucccauucagauucauagugugggguuaacugguguggaguccuuggguagcugaggccuugugaauguggcuagagaccuaagugcuguuccuagcuacauaacucgaucugaaaucucaauaaucagcucucucuccuuuuuuuuuuuuuuuuaauagaagagaaugccaccuugcuuaccuguaaauguagucucaguauuaaggaguccuucacuuggaugguagcaguugagccuauccugagugugucaguuacuuaucacaugcuugauaacaccaugacuaaggcagcuuauaaaggaaaguguguauagggcguacagucuucgaggguggcagggagucaggcuguaggcaagcaggcaggcaggcaggcaggcacuggagcuaugagcuuacaucuuuuuuguuguuguuaaguaggaggcagagagaaagaacuaacugagaguaguuuuggcuuuugaaaccucaacgcccaccuucagugacaucuguccuccaacucuucccaaacgcuuccaccaccagggacuaaacauucaaauagaugaaguucuucuggggccauccgcauuuaaaccaccauacugauuauaguuuucuguauggggguggguguguguggauaaaauaguagaaagaaaugggggagggaaguaaacuagccaacuguagaucauauuucuuccuagcuagagauauuuuuaauacuuuuuauugauucuuugugaaccucauaucauacauccuaauugcauucaucugucugucccuucauaucuacccucuguccuugcaguguccccccccccccccaauaaaauaggguagaaaaaaaucuugucacggaagcuguugugugucucacaguacacccuuuuguccacacaucuuuacuugcaaauguucauugcgguuagucauugguuuguuucaaggccuuuggcuucuggcuucucuauacucucuauacuguuuccucauggauauccuguuguugcccugugucauggauauccugcagcuuuggaucuucauggcuggcccuuuuauuugcucaucauagaugagguggaaauuggggugggccaauucaaagccuuggauuugggccugggagguagcugaguuggucagcccaccagcuuuucugugucugcaucgucagggccaguucuccaacacagucccagcugguucacccaaugcuacagauagcaaggggcaggggucggcucuccucauguccuuggcuggcucccccaugccuuugccaccagggccagcuacacuguacuguccaggcaaggugcagggucugcuuucccaagugcugcagucagcgaaggguggggcuaguuguuccacucucaugaucugagucagguggagaggggcuggaagagcaucucucccuaucaccccagauaccccaaggcagacaaggggcaggacuaguucucccaacucuacaaccagugaggggcaggguuuagcuggagauuuucaacccaaaauuucugcuucauuuuuagaaacaacacugagccaaaugucugagcuguuuguuuguuuuggaugauguaggguuuuuguuguuauuguuuguuuaguuuuguuugaggcaggaucucuucaaagccccacaggucucagaacucauuauguagaccagguuggccuugaacucauagagaccugcuuaccucugcuuccccagugcugggacuaaaggugugugucacuauucccaucuauccuauguaguuugaaaacauuuuuauuaauugagauuuucaugacauauauuuugauaaauucauaccucauucuucccucaaccccuuccucuuuaccgaucccucaacuucaggcucucuuugaaaauguucuuaucaacuucaguuuguacugccccaauacuccuggguguagggccauccucuugaucaccuaccagaaaccgcauccuuaaagaaaaucaacuuuuccuccccuagaagcuaucagcugucguuaacuccucuguuaggguuuugaacuacuccuuacuccauguagacuuuuaccuggcuugguuuugugcagacauccauagcugcucugaguuucucagugcauggucuugccauguccagaagacaauuuugcucuggucuucccugaugaugcuuuuuagaaucuuucugcccucccuucuuccugaaugaccccugguccuugggggaaggagguugauaaagguauuccauuuguaguugaacaccccacaaauacucucuguacuucugacaguuuuuucauuaacaaaaccaaaaccaaaaguguguguucaugcucaugcauuccauauaacaccuguggaugucagaggauuauuuuuuggagucaguuuucuccuuccuccguguggauacuggaguucccacucagauagucaggcuugguaauaagcaucuuuagcugcuuaacucucuugccaccacccccaggccccuuuuaaagagucucauguaguccaugcuggguucaaacuugaggaugcucuugaagucuuggucucuacugcucacacuuccuaaguguagggaugaugagccagugccaccccuuguuguuuuaugcacuguugaagauuaggagcaaggacccagugaguguuaggcaagugcucuaccaacugagcuguaucccugggcccuaaucugcucuuuguuugaaaagagaacagaugccuauucugagaacauuuaacaauuuuaaaguuauguuuauuaauuuuuugugcaugcaugcauguauggauacaugcauuucauagcacacauguagaggucagaagacaaauuagagagccacgugggcuccaagguugccaggcuuguggcauaugccuuuccaugacuauccaauuugcuggcccucugagagcauuuuaauaaagauguuaguagguuuuucucacuucuaaagaagaauaugggucaaaagauguagauccaaguauaauugguucuucuacuacuucucauuugugauuuuugugugcaugugugugugcaugcaugugugcgugugugcaugaacaugcaugcaugugcaggccagaggucaacuuuggguaugguuuuuuuucaccuuguuauuugagacagaaucucucacaaggccccagggccuagcagcaaaccagaguggcuggcuggcuagaaggccuuuggaauucuccugccuuuuugccuccccagcacuggguuacagaugaguauucucauggcuggcucuucuuugguggggauggaacuugggauuguguggaaagcacuuucccagcugagcugucuccccagaauugcugaacugguuggcguuauuucauuugguugguuuuccaaguuuccuugacuaagcaacuuuauggggcccaaaccaaaauaaauucaaaacagaacaaauaaaaaacaaaacccacaagcagcuaugcuuuaaacaccaaggaugucaacaugaaauaaauagacugacauuucuguuuugaaaucuuucaguaaaugaauuuaaacuaacugaaaauguguggcuucacuuuguaaggacaaguuuggccuuucucagugguuuuggauauuaaggauacaguggggugcuuuggacuaaauguugcuuuaaccugcagauggcucuugggauuuagucagucuucagcaaaugaagucacuugcguugugcuuucagacaugaucucugauguggugcuuaccgugucuccuaccuauaugugaugguaacaagaacacuguugucuuguucuuuuggguuugcuuuugaaguaacuuucacagagaauuccuguugccuagaaauugaugacagacuuacaccauuuccucuuuuuuccuuagacguuccaaccucagagcagccugaacuguuccuaaagaaacuucagcagugcugugucauuuuugacuucauggacacgcuaucugaucuuaaaaugaaagaauacaagcgcuccacucuuaaugaacugguggacuacauuacaauaagcagaggcugucugacagagcagacuuacccugaaguaguuagaauggugaguuuccuuuuucgccgcugacacuuuaagcaucuuccauagccacucauggguguauugauugcagugaggucaccgaggucuccuccacaaacaaaaaccagccuccugagagcuagaugccagcagucagcgcagcacuaggauuugaagagcacgauuucaugacgaagaaacccagaccaccccaccgacugcagcauugaaggaguggccucagagcaugaagcugagggccagggugccauggauuucugcaaagacacaagagaaucaaccaguuuuagaucugagugaaacgauucaagccuguugaguaucuuaaccgcaccaccuguacauuguggcauauuagaaauggcaucguauuuaauaaaauuaugacgcagaggaucugguuaaggucucucuuggcuuuauaaugaaucuuucucuuuguaauuuccuugaaauuaggaguaaugccuuuuaugguguuagaacaauagcacugugugugguccuuaggaauugcaggaagaaacauuauuuguuuaaugcaagcaauuauguucgugcugugucaauaauuacauuagcuuuuuaaaaauugagcugaaaucugaccauuaggcuucugugaugugguugccuuccuuagcauccuagaagauuauagauugagaggcuguuguuuugggaaggacgucaggaggaauggaggaggcaaugcaacuacagagguuuaaggggcugagcauuuaaggggcugaccaucauugagagcccauuagaggaacaggcacaaggaaugccugcucaccaucugcaaggacuuugagagaugagcuuguaagcaauugguauaugacauccauauguacaucugaaggggaaugaaaaugcacgcgcgcgcgcgcgcgcacacacacacacacacacacacacacacacuacauauauauauguauuggauuuguuuuauuuugcaggaauguauuaucgaguguuuuguaaguuagcuguuaccauuguugcuucugaguagugguuuucaacaaacagcauuuaugccucacaggacauuuggcaaugguaguugcgacuaugggaagagagcauguccaacaucuacuggguagagacuacagguauaaugcuaagcauguuaaaagaggacaagaaagcuacacaagaaaagcugaucuagucccagauauuagcaguuagacuguuggaaaauccugcuucugaguguagguccuuucuaaaucucccagcuaggcaucuccucuugcccgucugugcucugcagagcaugcucuuuggguguuagcuuaccuguguauucagagauacccaguuuauagcuuucuuccuugaccuucugugagaauagaagcauauacugauauauuugcauuauuuuuguaaacauacuaauggugucugcacacacuuucuguauauuuuauuuuuuagcaguuuucaguauauagaaagcugcauuguuuuuuuuuuaaagauuuauuuauuauuauacauaaguacacuguaguugucuucagaugcaccagaagaaggcaucagaucucauuaugggugguugugagccaccaugugguugcugggauuugaacucaggaccuucggaagaguagucggugcucuuacccacugagccaucucaccagcccgaaagcugcauuguuuauagcuacucaguauuuuauuguguuuaaccggcuuccuauagauggccuuguaagcccauuuauccuuuuauaagaacaucuguauguuuaaugauuuuuuuuuuaaaauuaugggcuuuuacucuucacaacaaaauuaagaggaaaguacagagcuuucccauuugccucaguccccagucauguguggccucugcuaucaccauuccaaauggaacauuuucaaaauugaccaacuacacuggaacacuguaaucacccagaaucuguaguuuacuucaguguucauguuugaugcuauguguucuuuggauuugcauaaaaguccaaugacaaaaugcaucaugcaguaucacacaaaggagcuucaugcuguccuucucucuuaaggaccaaugaccuugucccugacuuuauagagauguuuuaagacacgguagcugcccucuuuacauuggcuuccuuaaugucuuuucauucuugucuucauuuucaaucauuaagaugagauugaauauaguagcacagguuagccuggaaaauuguuauguagcccaggcugaucuucagcucucagcacuccugcaucagugucccuagugcugggauuacagaugugaacugugauacucagccaguucaauauuauuagugcucaguaauauuccauugugugaauuugcugcugccuuuuuauuuaccuucaaaguaaguuguacccacauuuuggcuaaagugccucuggaaaucuucacauugugugaggcauacauuuucaacuacuuaggauagauagucuaaccuuaaguauuuuguaagucacugacaaacuuaauguccagaguggcugugcuauuuggcuuccugcuagaagugagcguucuguugccccauaucuuugucagcauuugcucucccuuccuucccauuucgccccuucauguagggucuggucccuaauuuuuauucuuguuuuccccaaugggcugccuuacagggccacuguuucugacaaacccagggcuuucuccuuccuuaguuucucugcuucuugguaguccauuuguauggaauaugcugcuuuuauucucccacacaugcauauacuuuuuccacguaagagcugaguauccuagagaggaauuguccugcauaucuuaguagguucugaaaugccucuuagcugagccuaacugauuucaggcucugaaauuaugaugaagauagucuaucauucaauuaugucaagucauuaaaccuaguauuuaacauaauguaaaaaauucucccauuauccuaaaccagcuuuaguuuccuaagagaguccaucguuuuguggccuacauuccccuuugccuuuaagccauuauauuuguuuuaagacauucuugagcccugcuuuaggcagcuuugaauauguagcauccuuacuugaaagucagcuuuauguagaguucucagauguauauuuauuuuuauauguaauuuauaaauuuguuagugacucauuugcugugguacuuauguaaucuggacuauuuauagaauuuauguuagacuagaagguaaacccuccugggcucaguggacauuuuggccauacucacuugcuuuaucacugugaauuacuuauuuuugggguccucaguuucauaugaugccgagagcccuuucuaaauaaauggcuguucuguguguacauugguauucugaauacuugagcauguguguacaggcuaacugugcuuacugcuuuauaagaaggcuuagaaccaagggccauuuuaguacuccccacaacccccaggccacccuauuuugccaccucuaagguccucaugugcacaaauucugguccugcuuaucuccuugugaaauaacucucuugagggggggagggcugugaacauagcauuaaugcacguaaaugucccagaauagucucuagcacauggcagauguuuagugaacagcaguguuaugcuuugcucuuagaugcuugaauuugcaugguccauguuuguagauuuguacauucuuuaucagcuagauguauucuguuucguugcuucaguuucucucaaauucuguagcucaaggaugauccugccuggugaguagucacugucccuacccgcuccucuuucuuguuagugugacaugaaacuacuucaccagaaugaggaagugguaguguuuucaaugaaaugcuaauggaauaugcuaguugguucugaaaacaaggaugaggaaugaaucagaaugacaugauauggugucagccuuaauaccaaaagcuuagguaacuuguggagaguuguuuuucuugugaggggcagugaaguagaagagaaaguaagagaugaguuugggaagccauuuuuaccaucuaaucuaagucuggguacuacccacaggcuacuagaaugaaggagaaacauuuuauguguaaauacauucaacaguauaacauacaguuuaccuucaggagcagaaauguuuauaggggaaagagccauagggaaagcucguguaaguuacuguccuuauuacucaucuuaacuaguaaugggacuuuggcaacucauuuuucuuucuagcuucaguuuuuccuauuguuaacggagggagcugacgauaucuuagauccuuuucugaaauggauggcuuuugaucaacauuguccaaguuauuuagaauggcuuucucaaggcuuacuaaucauuuuccaaagcaguugcuuacuuaaguuuguuuuguaauuuugugguaucuucucuuauggaccuuaacuugcuuugggucuugcuguauucuguucuguacugucucuagggucaagcuuuugucuuuaugauauauacauauauauaucauacuaauauuaauccaucuuuuuaguacuguugcauuuuuccauuugaaauauuucuuagaauuuguugaucuucaaaucuauuuauuuuuuauguauaaauuugaacuuuguuuauuuuauauucuuuguauauuugcaugucuuuucuaaagaagaauucauuugaggguacuccaaaugugggauguagucuuauugcugaaagcauuggcuucauuaauucuagguaguauuuauugaauuacuuaaugucaugcuuuuacuuuaaaagaaaaaaauggugguguugagugucaaucccaggucauuaugagugcuaggugaacauuccagcacugaccuauauucccagccuuuaguuagcuuguuugagacaggaccuuuguguguguggugcaggcuggccaagagcuuucucuguaaccgaagccagucucaguuuauguucuccaugcuguaacuucuucucaagugccaagauuaugugcauaugacaccguaucuaguuuacaugcuuauuuuuugaugauuaaaaagaugguuguuuucugccaaccguaaaaaguguaauguggacaaauuaaaggugacacagugauuucucagacugcagcgggaccuaggauaugauggcuucauuugaguauacucuuacuauuuucuguaaaaaaaaaaaaaaaacaauuauuauuuuuauauuuuguguuuaugacuuggugagucuugguuucuagcuuuguuguucccagugugugauuaaaucucuggauacugcagauugaggauauauaaguuucagaauuaauguagccuuaguauaaauuauauuaaagagucuuuuauuucuauugagaucuuuccuugaguccuucauauuauuucuuggccacugcuaaguuuucuucugcuuucacauuauaucaugucacuggguuaucuaagucuucuucuucuucuucuucuucuucuucuucuucuucuucuucuucuucuucuucuuauuauuauuauuauuauuguuuuucgagacaggguuucucuguguagcccuggcuguccuggaacucacucuguagaccaggcuggccucgaacucagaaauccaccugccucugccuccuaagugcuggaauuaaaggugugcgccaccauucccguugaccuaaguguucauuuuuaaaauauauucuuugauuuaauugaaaaaucauagcucugauuaucuucuuaacagaauaauaugguuuuguggagaauuagaaauucucaguuaaggucuucaaagucugccuauacauaaguuaggaugcuuugcuaacuuuacuguguauccuguugacugaaugacagaggauuuuuuguuauuaauguaucauugacuaaauguagcauugggaaugguaagaaacaugggaauauaagaacuugucuuuugccauguucuugcauuugauaagagaauguacuuauaucuuggcugguguuugcuuuggagguauaugaaaaagguguuugcugacugaaauuacugggaaauuuugagaauggguaaguucaagauauuuguguugaaguaccucagaaggaagaccucagaagcagguuagaaauguacaaauucuuggcacauaggugagagcuuacgguuauaauauugaagaugaucagaagacauuuuuagaaagaucaggcagaauugaguaggcaaggccaggggcagauguuaguguuugucgcuugucagaagaacagaaacuaauagguacuuugucuuuuccuaaaucugucauccugugcuucucugguuaguguuccuuaaguaauauuuguugucuuggagaacacauggucaugaggucacugagcucucugauauugacugcaguguguguguguguguguguguguguguguguguguguguguguguguggaaagaaucuuaaauagcuuaaauuugaauuugucauauguacauuaaccauuacauuagaugccuacgugagaacaucuacauaugaacuuugggaggagcugucucuuucagcuuauaucaucaaguaaagcuguuaagugcaguugucagaauaacuucacgguagaaucaccugggucuggcccugcucugugaggaggucuuucucuuugccuuugcuggggauugaaccuaggaccuugugcauguuaaacauguacuuucuccacugaaauuguaccuccagcucacaugggaagacuuuuggucauguauucaauauuguaaacacacacacacacacacacacacacacacacacagagcccacauauguauaguucagauuuucuauuugaguaauuuuauuagcaugcaucaauucaguuucauuauggcauuuucacacauuuaccuaucguaaucaugaucauuccugcuuucuguuauucuccccuguuccccuuucugccaauccucuucccaccuugccuucaugucuuuuuccuuuugcugggcauggggauccagggaauuucaggugagaugugacaggagaguggacagggauguagggguuuguuugcagguuccugggcaucucaccuuuggugcaccacugaaggaaaugccuucuuccuccaucaacuguuacuuccuauuucuucuuugauguccccugaaccuuggaggaggugauucagauguccuguuuauagcugaauguauucagcagucauuuauccuuuuaaaaaauaugguugcugaaaagauggcucagugguuaagagcacugacugcuuacacacgguguaagaggacauggugucugacaaucuucuguaacucuaguccugggaguuaccgucuucugaccucugagggcaacugcacauacauggggcacagaugcauaugaaagcaaaauacccauauauauaaaaauaaauaauaaaucuucaguuuuaaagguguguguguguguguguguguguguguguguguguguguauguguauguaugugugucugucuguguagagcuuuguauauauaaaaugaaguuaucugucugucugucugucugucuguguagagcuuuguauauauaaaaugaagaugucugaggaggucagaagauagcauuagauccucuggagcugaaguuacaguagaguaagcugccugacacaggugcugggaaucaaacuuggaucuuuuauaagagcagaacaaacuauuaauugcugagccaucaucucucuagcccuagucauuuauucuuuucucuuauauucuucccuuuccuuuucuucccuuuuuaaagauuuauauguuuguauacauaguuugugccuggugucugcagaagucagaaaaggguguugggugcccugauauuggaguuauagaugguuauaagucaccguacagaugcuagguacugaacccagcaagugcucuuaacuacugagcugucucuucagcccuuagucauuuaaucuuuuuuuuguuuuguuuuuuguuuuuuguuuuuuugagacaggguuucucuguguagcccuggcuauccuggaacucacucuguagaccaggcuguccuugaacucagaaauccgccugccucuaccucccgagugcugggauuaaaggcaugcccaccacgcccggcuuagucauuucuucuuaaugcuugacuccuuagucucuuuacuuaacuacuuaucacugcagaaggaaacgucggugaccaaagcuucugguggcacuauucuaggagcauaaagaguuguuuugaaggcaauuugacaggcauaucaugucaauuuuucaaaacagcaauaauauuuucccacuagugccuaugacuucuccagcuauagccuuugacuggaauuuauggcaccagauauggauuccaugcuguagagcaggcgacagauccaaccagaaagagguugguuaccauuaugacagacuugccacuguugcauuaaaaucuucuccugugggcuggacggucuugcugcacacggggccuacagcugagcaagaccacuguugccuacuguccccugguauccugcauaguacccucugauacuaugacaauagguaauagggagggaauuuccaggccagaucaguuuacuuucuuuguggucuacuagaugggcaaccggcagcaauuauaauugcguagauuguuuugggggccacaggugccucccagaccaacagcuucuaggcucauagccuacccuuggcacuggaaguuccauuuaaaaaccucuugcuucuggaagcaacuuuaccaucgugucaguuuggguauauauauagaggugugugcgcugccucuauacuauguuuuccucuugagcuuuucuuucuuguuuuauuuauuuauuucugggacaagguuuuucuauauagccuuggcuguccuggaacuuacuuuguagaucaggcuggucccaaacucagagauccaccuaccugucucuguuuacugagugcuaggauuaaagguaugugccacugugccuguccccuugaacuuuucuaaaucuaaagauuauuuuuuuuaagauuuauuuauguauauggcuauuuugucugcauauaugcacaccagaagaggacauugaaucacaggggauuacagucauaggccauugugagccguaaugugaaugcugggaauugaacucaggaccucuggaggagcaggcaaccagugcucuaaaccacugagcuaucucuccaaccuugaaucuaaagauucugaagucuuuucuuguaucuuugguugcuucugacaaaggcagaugauauguggauugugcaacugaguguucacuuuuuaauaggaaaaacuuuuacucguuuuuuaaaaaaaucauaguuagaaugucuugauuauauugaauucuuacuuccucuucuagcuucccccuaagucaccuaaauaauauuucuuaauauaauuguauauuugugccuuuccugucuuaauuuauuaccccucaagaauucuuaagggguuugagagggauuuuaacuguguuuaauuuuaauuuuuuuaauuaaaaaaaguuuuuacuuaggaaauaacuguuugcuuaguuuucaagcugcauuccuucuggccugcuuuaaauuaaggugguucaggguuuucaauauacuuaauauucuuugagaggugugacuugucaaucacugauauccaauaaaaucaucccacuguacugaguguccuccucuucugucuccagcccuccuuuguaaaacuggcagcagagcugugcagaguaaaaauacugcauucaagguuguuaugucuuuuuuucccaacuuuuuaauuuaaucuugaaagugaacauguaguuuacagguauagcaauggccaucaagaagaugggacguugcagcaugcaauaagaggaucuuaaacgaagagugucuuuaacagcucuagcuuuuggcauuucuacaguguaguuauuucuuugcugggagaugggagagaggcuggaagaagggagagaaaaggaggggaggguugguuggacaagaagaaagcugcuugcacacagcugauuagcaggaagagaaaacacguguccucuggaguagaguucucagagacuguaauguugguggaggggaggggaggggagggggggggcaagaauuuggcagguaaacaaugagcagguauaucgaggaggaaauuggcuauuggcuauggaccaauauuuaaagccaaaccugauuuauaaacuaaaacaagaugaaaugugcuacccagugacuucugagguuucccuacaguguggcgagaagauaagggacuuugagagugaaagcacagucccaguguucaccgagagcuagaggcaacaggggugagaaaagaggguguguccucccucacuugaggccagugaugaaugggcacaggaccacacaugcaacaagaaagaugcuuuugagcaaaaaugggaaugcuaugaauauugauaagcuggagagcaaguagacuucaguaaaauggcugagcaagccacaguagagaagguaguucuaggcccuugauaacaaaagaguguuuuaaagaacaguuuugaaauauugugaauuguucugcaugcagaaguugggccuuguaggagggcgaggucgaacacugucuggacgaauguauuuccuuuugauguccugugccccuuuccuuuaaagaaagcuuuuuguugagauuagaugauagagaugcugcaaaauggagcucgcuugcuuuuuuaaauuuaaauuugugaugcucuuaauagcagaguaggaaauaagaaaaaguauaagguagugauguugaaauaaugugugagcccuagaaccuucucuggguuuccuucagaggagcuaauaucuaucuauauccccucugucuucuacugaugaagccagcaucagcucuaccuagucugucuaggcaguaguuuuaggggaaggaggacugucaucugcaggcaggagcuggguggucacauuuaagucugguguguaucaaugaccccuaagcuaguuuaauuguuuuacuaaugaaaggucacagagccuaugaaacaggcgcacaggcauagaggggagauggagacgguuugguaguguuucuucauuagcauauugguuuccccucccucccucccuccuucccucccucccucccucccucccucccucccuuuuuugauuuauauauuuuaauuugauguauaugacuaugcaggcauguuguaccccacagaggccaucaaauccucuggagcuggaguuacaaaugguuaugagccaccaugugggugcuugcaguugaacccaggugcucuggaggagcagccauugagucaucucuccagcacaacacaguauuuucaagugggagcaaguaccauggcuagaaauguacaucagaaguaguguguguuuugugugugcuuuuuaaaauuauaaaguucagagaccuuuuuuuuaaauuuaaaauuuuucuuauaguguuagcugauuuugaaccucauuguucaaagcagucguucagcauuuauggucucaaaaaagccucauguuuaagccaaaguguuguucugucuguaaguuuggcucucagaaaucaccagguugaauaaagccuaucuuacggcuugccugccaagguggagcaaaggaaaugcggaugggacuugucugcagacaccacggugcaagggucugugcuguguuuauacacagugagcacugacugcugaagugugcacccucuauuuuuggauucugagauuuaauaucaacaggcuucacuuugggauuuacugcuacauuuccaguuuuggcaagagugcaauauagucaucuccgugagauugauuuuccugugauguuuuugugugaggaucucaucccagauaauuaauucaaucucccuguaaccauuucaucagguaaacagaugcccuguguuuggaaugaaguuuaaucuugaaauagaaggcgaccauaguagaggguuugugguuggacuuguggguaguaggaaagucugggugggucuagguuucagagagcagagcaagcuaggaagacagacuugggcaagaggucacagguacucuugaauagcaugugagauagaaguauguucuuacauuuuccagucucugaaggagggcuuugcucuucuaaggaggggugaggcaagccgguuagcaccugggggaggguaguuguugucuugauuuugucagauggguacagagagaaaggaaauggagaagagcacuuaugaaaagugucucccuauauuuguuugcuuaugcucagagcaucauuguuuaacucuggauacucaucacuuuuuuuuuuuuuaaaaaccaauuucaucucagucuuuacuuuucccuuuaaaaccucaaacuuaaacauacuuaacauuuuagguagugaaggucugaugaauuuaauaauuguauaaaaucagggauaccugccaaaagaauagcaacccacugaaagaguaaaaagguaggaguggugccucucaguguaagugcgggccagugagacagauugguucugagcagacccaguuugagaugaugucagagcucuucuggacuggaaauggaguaacuaaggauauccacaggccaaggugggaacggugacagaaagccgaggaggaaggaagccuucucugcuugacuucuggugcugauuuuccccuuaagacguguguacuuucucauuuaaugaaaggguggcuugaguccauucauuugaauucuguguuuaucugcagacucugaaugaucuuuaguguucuacuuugcuccauacugacauuggugcacuugggaggcaggagcuuaugugggucucucauuuugccuuggcuaagauuagggcagcugucauuuuagguuucucgcuguuuuauugaauccuuucccaauaaaaaagggauugauguauaaagaaauuaaauuauugaauuagcagaaauuauuagaggauggaagaaauaauuugauaggaaauuaguugcugacucuuuaguaaaaagauugaugugcguaguuuauuuccuuuaccacuuagagucgcaacuagauuuaugaaaauaaagacaugaggacauggaaaauugggagagaucauagaaucaucguuuuggaagcuggguagcugaugaaguucuuucacuaccuugauugaucagagaaaggugacucuaaagccauggcaaaggugccccagaaauguucuaagucacacgcuuuaacaaggggucugcacaaagacaccucaaagaaaggaugccuaggggcagaaccaggugcucuggagcaaaacuuauauaagaagccaugauuccugguucuaccucacucucucugaaccagguagugaauugauuuucccucagaacaagguugccuucccagagaugcuagaacuggagagaaccauuacuuggggacuguaggcgcugcugagagaagugggucuucugcggacuacuuugaauaaggaaaucccuaagcgucuuucccagcuuccagauuaccuuguucucuggagcaucagucagcgccagagagaagauucaaaggggcauucccagggcauugggguagaaagaaaucagcccagccagucucaguugagacaaacccacgaaccucagaggcccuauuuaaaguaaagcuguauguaguuaugugguauggagaggguuagaguacaaguauggaucugacaauaaugcagauaguuaccaacguuauuuaaaugguauacacacacauauacacacgcaaacauacauacacauauuggugggucugcuuucauucaguauauaaauaacaugcaucuaagaucauaagaauagcuguagacuuuuucaguuucaugagaguauuuuauuauuacauauguuauauuuuucuuuuuuacuguuuaugcucuuguccaaauuugugugcauguuucccugcccugugcuagagaugagauuauccacuauuaaaugagugcuuggguuucuuuauuucugcuauguaaaugcugcugcccuccaugaacuuugauagaguaggcauuggaaaucacugcauguggacaaggucuugccaaaauguuaucuucucucuuuuccccuuuucaucucaucucuuuuccugucuuaggggcuucuuguuguugucuuugcucaguuuuuccccuuggucguuuauaaugaaauguugacauguuucucagaacucccuuugugcuuacauuugauaucuauucuggguguuuagcuuuuuguucuugguccuugaggacaugaguccuuuccuuuuuaaucgacaggacucuauccuucugauugauacccagaauauaaagggggcuaaauuauuugcagaaauaaucaauuauaugcuuaaucuaauuguacugauuuacuauaaggaccgcuaaacauuuccagaaggaaugguagcaaugaaaacacauuuuuguuucuuuuuaaauuuuguagaaauauguacaaguuacauaacaauauagucagaaauaaccuuuaaaaauuagcuuuuugaaaguagggucucacuguaguccagauuaucuauaauauauauucuagguaucuggcaaaaugaaacaguuggcaacagaaauauaaguaaaaauagauuucuucauuguaaagcuaggaaaauagaagauuccuaagcauuguuuuuguuuguuugcuuaaaaaaugucauucauauucuuuuggaaaugucuauauauuaaaauuuucuggcuaggaaauauuuuaaaguuuuuuaaauuguuguuuuaucaaaugucucuuuugaguuuuugaaaaaaucauuaagaauguucuuucugccuccucagaagguauaacagaguaguacuguguucuacaaagucuguaauauagauuugaaguguggugcugaauauaccacaagaucuuuagaaaucuuuuuagucuacauacagauuuguggguguuguaaaagauuuuaugaauguauguguaucugucacauaagccaugcaguauccuuagucagggaagcuuuccucaaaggcauagaauuuuguccacaaauguaguuuuauacuaaaaauugugaugugaccacacccauauucacaguguaucagaccgucauuggugcuggugagacuuguacuugggauaagcaagaguguuggcagacacuuaggaaguccuguuugauucaaguuaacaugguuggaacaguagcuucuuaaaauucuugucuugaaaauuaaaaguauauugguaauauuacuuaacauugauauuauaauauuuagcuuucugauaauucuuuaaacaguauuauaauaugcuuugggauuuuuauccuaguuuuuacuauuuauccauaauuaguuaaaagggcagaauacaaaggagguuuuaccauuauuauugugccauuaacagcucuuaaccuugguguuacuguaacuugaaacuuuauauuuuuguauauuuucuguaaacauuuuuaugugcauguauauuauuuugauguuagaaaauuuguuagaauuuuaguucuuagaucaauauuaguauuuauuauguuugaaaauaguuuuauguguccagauaaaucugauuuagauuuaaaucauguuuauauucauauuuuuuucuucugauacaauuacuuuuuaaaaugccaucuaugaaaaaugcugaugaacugcuuauagauuuucccauuuucucccugguggugguggugcacacuuucaaguccagcaugugggaggcagagacaggggcaucucucugugaguucgaggccagccuguucuacagaaugaguuccaggacagccagggcuacacagagagacccugacuugacaaagauuuuccagguuuuucuuucuagauacauuauuacuguauuuauuuggauuaugauacaagguuaugagaauaauguguuaguugagcuucaacuuuauaauuacuggguucucacuuggauuguuaauguuugacuaaguaaaucuuuuaguggcuuuucaaaauaugcuagauuauuagcagaauaaucacguaagugaauaaauuaagugaaaaaacuccaggauauugaacuggucacuuguggggucuuacugugagcaaugccagaacuaguaaugucucuuaauuaugugaauacucacuagaugacaccauuugcauggguuuucuguuugaaauuuaauuuuuuuagauguaauccuaggaauucucucugugcuucuugugguauuaccuuuugcuuugacaauugauaugcgugaguuuuacauaguuguuugaaaugauggccgugcagauucaagugggaagaauguucugaguucauccgcuuuuacucaguaauucugggacucagcuauauagaaaacacauuauagagcacagagaaaugauuuagguuaguuuauuauaaugugauacagugaugucuccagauuaugucacaugcuuaguuuaguagaaccaaccauaaauauuaauggggcuaauaauguaacuaaaagaaauccaguauuuauuuauuuuuuuaaagauuguuacuaugcauuguccuuccuuucuguucuacauucagguuggugaaugcuuagggaguaguuacuuccugccagccacaauacuuuuuaucaugugcaagacacaacaguaacaaaauaacaaccaaaaucauguaaaaauagagguuucuauggugauaaaagggcggggacagugagaauggagggcaauaaaucaaauaacuuuaaacaguaacaguuguaguuugcuauuuaaaucucagaguaauauauuauuuaaucaaaaaaugauuuuaaaaugcuaaggaauggccucauuugcuaauuaggccacgaguaggaguuuuguagucuugucucucacaugacuuagacauuggcuuugcucauagugaucagcaguagccuaaguuucggaagaauuaauggagaggcagguccucacagcaguccuuagauccaagccuuuaccugcaggggcucucuucuuuugcacaggcucuuauuagcuagcaucaguguaauuuuacauuugucaaauuuagcaacugcagauauaaggcaucugguuaaauuugaauuucagauaauuuuuuaaaaacaagauuguccuaaauauuacacagagucaacuuuaaaaaugucguaugagauuuagauuuagcuaauugucugcuuauauuugucaagcuuaguuauuucaguuuauuaggugccaagcauucagaaaccaguaaggaguccuuaagggucucagugugaacagaagaacaaacaagggacuuaagggaggcagcauuagcugagagguuuggagaugcuugaugccaaggaucugagucaggaguggggaguuuguucaggcagggaugcuauugccugugagugccuuggagugucacugguaggccaaaaaggccaagaaggagcuaaaugauggacaggugaaauggggaaaugagacaguaaugaaaaugagagaauguaauagaggcaggacaaguuagaggaaagggaaggaaugagucaggcacagccuuggucuccagggguggaggaggauaucagggugucaggggguggaacccuaagaacuagacucuuguuaccucgaggaccuccaugcucaacccacuuggucuccauacugcaauggaagagucuggaaaagaguugcuaacugcacuuuaauuccuaacccugcucucucucccuuugagagaguugaacagguuuuuauacugcuuccuuccacccuuucucuaacuuagccuugcucuccuuuacugcuacucuuuggggguuggcggucaggccagugcuuucaagccuuuaguuugauuacaguauccaguguuuauuauaucuuugggacaaaagugaguuagacuuccucaaagauaucuuugucuuauacuuuucauucauucuaaugccagccuaaauuaaaauaaaauagcugagaaagccuaguaugggauuugugugcucucucucucucucucucucucucucuuuauacacacacacacacacacacacacacacucucucucucucucuuuauacacacacacacacacacacacacacacacacacauaugucuugccuguauacauguguguguacugcauacauaccugaugcucauagaggccagaauaagagagugucagaacccauagguuuagaguuauggauggcuaugagccaccgcgugcgugcugggaaucacacccaggcucucugcaagagcaaguacucugacccccuaacugucuuuauagcucccucauauacauuggaaguuucuguuguucuuuuugguaauucauuccugaauuaacaaaagagagggcuuacuaacgccucugguggcucauauaucuuaauauagaggacauuugugugaacguuuggaaauacguagucuauuuucaucuagccacaucagcucucuguagaacugcugugcuauugggcaugauccuggcaguugcuggugguugugaucugcuuguguauacaugcuaagacucuaagcugggcuguuagucacuguaaucaugagugcuuuaauggaagcaaguuuaugucuuucacuauuuuggggcuggaauuaucaguugcccuugucccacauugggccccacauacaaacuguugcagauaagucaaguaauuuaaaggagaucucucauccccaucuaggaaugacucgacuucauguucaaauaguugucaaacucaacuauacacuuagaccgacccacuuaacuaucagucaacuauuaccaguuaacucacccacucacucacucagucuugaguugucacuucugagcagagacuuugcuuuuugacucuuuugaugacaguauucuuuuuacacauuuuuauucuuggagccccagugguacagucaguuagcaugagguacucaacuaaauccuuauuaggaacuuuugucccuaauuuuuaguguuucccuauagccacaguauuuaaaguuucacacuauuucugugauguuuguuccuaggugacugguuuauacuuuggagaauauugaagaugacagcuuuauguaguccuuucagccuugucuuagauugguuucuuagcauccauggcauacauagugaacuccaggcugggccaaagcugggcccauucauugcugcucuucccuuugcuggagagcuacucacucagacugucacacuccccuggagaauauguagaaguaagcuaauaaacaaaugacuguacgccaugauguucuuuugauguagcagaaaugaccaaacaggagacuuugaacacuguacagucauuaaacacgaauguguguaagucaccuggaaacuuacauugaaauuagguuaaagcaaaaccacaucccauaacuuuauaaauacaucuaaacuuuuuuuuuucuuauggaguuccuugcaggucuuagaaauacauguguauuacaaguguuuuagcucugggacugggcagagacagaugagagaacagaugguugcuaaagcaagugcccugcaagagaguuggcaugucccaggccagguacgaguuucagugucugcucgguguugucuagauagcuagcuguuuucucccuuuuccugacucaaaugugaagaaaaagggaaaaagauagucaguguggcuaauaacugagaagaguauugacugaccuuuguucuaaaguucccccaaagcauuuuacguauaaaugacuuaggucagaugaaaaugugauuuugaaaaaaaaaaaaaucacuggcaguaauugagauugaauaagggaccuugugaacugggauaugcauggcugguugaccgaggagcguucuagauguacagguaucuagucacuaguuucuaggugacuacuccuauuucuaccccugcuuuaaauuuacaccucuugguguacuucauuucuaaguguggcugugcacagcagcucuuccaaagugauccagucaaacugucgcacugaguauccauacacauaaccccaaacuguccauucacaaggccagcuucauaugucuuguugccuuuaguacaucuuuagcugaaccucugagucuuucuaccaaaacaauuaaacaaagcaaaccaaaacaugucuugcuucccaaucuucaucuugggaaaccuuccuuuauuuguuucuuuguaaaagauuuauguauuuaauauuauggguaggugugugugugucugcauguacuuauguguauaugccuggugccugugaaguucagaagaggaugucagguccucuggaacuggaguuacggaaaguugugaaccaccacguggguacugggaauugaaccuggguccuuuggaagagcagucaguuugcuuaaccacugagcuaucauuucagugcuuguccuuuauccuuucugucucuccacacauccuguuuucucugucauccccuugucugagccaccucuguccuuaucauacuaccuaaucauacuacuacucuaucauacuacucucugaagcuacuggacugacuuaaaaggaaaaaucaagucauguggcuucccugugugcuguccauuuccacuuccuguuguacuucaaguaacaucauucaguccccuuucauagcuuaugcaucuguguugaguguucguaacugcgaaguggggcauugcugcuuuaacuagaauagaauuuucacaaaggguggacuuuucuuuguucacuguuauuuuuucagugucuauaacagcguauacucauauaaguacuaauaagagcuuggacagauaaacacaccaacccagugggacuucuaaagccuuuuuccuuucuuuuuccaaccagcacagcagccaggcauaguacuuuaaccucagugcucuggaggcagaggcaggcagguggaucucugagcuugcagccaguccugguuacauagugaaacaaaacaacaaaacucaaagcagcacagcauagcucuguaguuucuacccuguguagaaaguccugcguggcuucugauguucuccccuucuauccauuucccugcuguucuaucugagucagaggauauguucguuacaagguuaggugaguauggagaagagcuagcaaggaaaugaaaaaggaacccuagaauagcauuaacaguauuuaagaaauacgugcuuugugaugaaucuuguaauaugcacagucggagauacguugagucuucuucggccaucuucaacaguuuccagccuuacagcguuuuaacagcauuuaauuuagauauugccuuuggcaaagaaauggugaguuuguagaauaagacauacauacaucuagcucaucaugggccuccauaguaauuuguaaacaauuuggggcaagaauagguuugauuuuaaagaauguuaagaagguucuuaaauuucuuuucugguucuuuuuuuuuuuuuuuuuuaaucugugugaauaucagaaauuucacuaugaguuuaacaauaaauguguaaauugugaaugagccaggaaaaggaagugcuugcaggccauuaguaguucuuuguguauuaguguaaauggauuuguuagaggcacacuugagggggcucugaugggacacguccagucacggggcuugagugagacuucagcuaggacaagaaguccugcuguggagacugccagguggacgccuugagcuuuccagcuuugucuugaggugguccugccuggagccuguggagagaggucccuauucaguuccguggcauucccuaacgcacuguguccccagagcaccuaccugccagagguacguggagcugauugcugcuuguuuauuuuuagguaucuugcaauauauucagaacucucccuccuagugacagcaaugaauucgacccagaagaagaugaaccuacccucgaggcaucauggccccacuuacagguacuucaacuuuucauuuguguuagaaaagaaaacuccauuaacucuuccucugguuaaaguggggaucccugggaugaagggaccagauuagaauacacaguggcaaggacugcuuuuguguuucuugugcuugauaauuagcaagaugacccacugggucucaguguugcagguccauccaguaggucuuacuccugucucucccuuaucugaaccauuuaaccauccugcccauggaauuucaaacaggaacagaacucuucauguuugcauuaucugguugugauuaggucacagaguacauaccuugguuuguuuauauuuuagcaguaggugcucggggacauuuuaugccugucuuugcaauaucaguuaguguauuuccuuaguuuaugcaaagggcaaagccaaauggcagugagaaagagaagagcagagaaagcuaucagggcaccagugccaggcugccuacuuaguuuacuuacacaucagcuccuuauuuuuuuguguguccuuucuugaggccagcauuccuuaaaagaagaaaacagagaugcuugaaugugucggcccccuaaagccaucuuucuauugaguuggaaugucuugagaagacagugaaaaauaacaggaaggagaggaaggguggaagagaggggguguagcccuguccaucagcaugccacuguagguguggugcucacucgcugagcauggggaaaggcccagagggaucuaauguagguuuuccccacauuaagaguuccuuuuuauguagauuugcaacuuggcuagucccuuuuagcaccuauagauuacuguggguacauuguguacaguucugguuacagggcucuuuccagggcuauuuuucacaaccuguccuuaggcuugugauacuguguguccucuuagagguaaguuugggcgaauuacauuaguuuuaauauuugauuucuuagguuagaugguucuuuaaucaucuggugaauuacauguacuguaagauuuauaagccugggcuggugagauggcucaguggguaagagcaccugacugcucuucugaagguccgaaguucaaaucucagcaaccacaugguggcucacaaccauccguaaugagaucuuacucccucuucugcagugucugaagacagcuacaguguacuuacauauaauaaaaauaaauaaaucuuaaaaacaaaacaaaacaacagcaacaacaaaaagauuuauaggccuauugugcuuuucauauauauuuuuaagauaauacaaaauuaaaaaaaaaacccuuucgaugguggaaaucuugucauauuuuauucuuaaaaauauuuuuaaugacuuauuguaugagcauaacaaacuuuugucauuuccccucccuacccugucacuccuucucugucacugaaacuucuuuucagcaaggcuacauccuacucugauuuguuuuuccaguuucuuuucaguuuuggagaaagacucuuacuauguagcucagagaucugcugggcucugccuccugcuugcugggauuaaggcgugugccaccaugccugguuugauuuuuuuuuuuuuuuuuuuuuuuaauuaaaccugcugaguugaauuaggguugcuugcaugagcaugggucagggguuauuuccuaggcaagggcagcuuauuaguggcugcacauggaaggaaaugugucuugucuuauuuguaaugcuugauacuagccaauugggguugaaaguuagucugagagaaaauacaguuuuuuaaaaaaaaugcucaucuuucugagaaugcccugcaucuugugguguacaucccagugaagauucaggccauucucaucugcaaagcauuuccuacacuugcuuuaguuccguucaaauucagcaaagacuuaaaauucaauuuaucuuccugaacuuaaaaaauuaagacgucauuauaaagaaucugcaauaaaaaauguauacuuaaugauagaagguagaaggcuaaauuaauuccuaagcuauugcaguaauaugaggacugcauccuagcuccccugaccuugcugugggaauauuaacggcuggcucauaggaagccacagcuguagugagggcuggcguaugagacuuuugcccuuuuagauauaaagucagaaauguuuauaaaaugggcaggcuuuaugagaacugaccucuuguucaagccuauaguccuucugguccuuuguuagcucugggggaaauaggccugacuaagguugggucaugugaaggaaacuuacuuucuuuguggcagaugauagccuuguuguaacaucaguggcaggagaggccuuugggccugaggguguucggugccccaguguaggagaaugccagagggaagacgggagugggugggugggugggggaacacucucguagaggcagguggaagagggaugggauaagggguuuccgaagggagggaccuggaaaggggaaaacauuugaaauguaaauaaagaaaauauccaauaaaaaaaaaacaaucacagaaacagcagacgugguggcccaugccaucccagcucuuggaagagagaggcugggcaaucaggggcucaagguaacccucagcuguacaguaugcucaggcccuguuaaggcuaagugagguccugucuaaaaagauaaaacaacaaagagaacaauaugaggugaaacucccaccaucccacagcuaggagagcgcuugcuugcugagcuccguucucaccugcugugugggcauccaggcgcaggcuccagacuuuuaccaagaguccucgguuuccuuugggcagccuuacuucacucaucagucacuuuuucauuucucaagaauguggcuuaaacugacaagaugaucuguguuuaagaagucucuucaggcugacaagauggcucaaugugaaagugcuugcugcgccugucuugaaauccagguugcuccuuggaauucauguggaagcagagaaaugacucuucuguuuucauguacaacccguacaauauauguaucauagucacaaaagauagaaaucauaacuuuuaucucuaugauagauuauugaugucauuauagcauaucacuaaauuuaguauuuuuaguuauuguacuucuagggaugaaccuaaggucuugacacaugcugggagcuggugugcuuggccuacaucuccugccccccccccuuuuuuuuugagauaggaucuccccaugauuuuugagcuagccuuaaagcucacaguguagcccaggcagucuucugacugggucucuuagucaggguuucuauuccugcacaaacaucaggaccaagaaacaaguuggagaggaaaggguuuauucagcuuacacuuccauacugcuguucaucaccaaaggaagucaggacuggaacucaagcagaucaggaagcaggagcugaugcagaggccauggagggaugugacuuacuggcuugcuuccccuggcuugaucagcuugcucucucauagaaccaagacuaccagcccagagauggucccacccacaaggggcccucccccuugaucacuaauugagaaaaugccuuacaguucgaucucauggaggcauuuccucaacugaagcuccuuucucuguaauaacuccagcugugucaaguugacacaaaacuagccaguacaguguccauccugucucugcuucccgagugcuagagcuguguaccacuccacuugucuaacugguagcuuuguaaugguuauaccagcugaggccuuuucugaccaaaacauagugugaaguuacauccuuucacuuugucaguucugugauugacaacgugcugcugcuucuggaccacauuuuagagaaagcaaagugugacuguuggagaacaguagagaagaagagaaucacaagauugguuaguguauaguuggccaguuuuacuguccagcuagcugacuguucugcaaaauuuguggcccauacagaaauacuaagcugacugucuguucucucuuuguggaucuuuggaaauaccuagaacuagacaacagaauauuaaguccacaagguguuugaucaaguaaugucagaggucuguuuauacauguuauuuaauuuuuuuuuaaugcuucuguugguauauuugaagcuaguaugauacaguugcuaugguuaucauuuacggguuuucugagauuagaucugacuuuccaguagaauacuauuuugcaagacuucuguuuacaauuaaggauugcuuucggugccuuacagugagacuugaagcucguaagguuagcuuuuuguucauagaccuuccuuaugagaccugcaauaguaacuuauuuucccaccccaguuuucccuuuaaaaacucaagggagauuuuuuuuuuaauuccaaggccaguuuguuucuuaagugcagaacaacuuugugcuuauuucuaaaugugucuaaagaguuuccaccaaguuacuuucuauuacaacugcuuucaagggaccagaauagagaaaucagauuguuaguucagguagaaagccugcuggcugagucaggccuggaagauggagcuuuuugaccuuguguggaauucaggacaaggggcuguuuaaauaagucuggaauucuuacaagaguuggaaaacaaguguguugaaagagaacaguugugugaggagugaagauuuaagaagagaacccucacacaucacuggcaaagacuuuuccccuugaauuuagaaaguuuucaagaggaaaaaaauaccaccuaguuuuguuaguugacuuccccaccaucccccauuuagacacgagguaucucugaguccccccuucaugaaaauaugaagugcuacugggggaaggggcagugagaggguucagcaggcacagcuaccacccaagcuucacccuggaacaauguggcagucagagagaaugaauuccacaaguugcccuccacucauauguacauacugaaaaaugcucgcaggaauaccaaaugcagccuggcagugaugacacacgccuuuaaucccaguacaugggaggcagaggcaggcggauuucugagucuuggggugggggcagugugugugggggaggaaggaauaccaaauguaaguguuagagucuaaagcuaucaggcuuauaugggaauauuuguuaguuguauuucugggcccuuaaagguccuucaguuaauuuucaauggccuacaagccuagcacauuuuuaaauaaguuuuuaauuauauuuauuuguguguaagugugugugugugugugugagagagagagagagagagagagagagagagagagagagagagagagaggagggucaggaagacaacuuuugggaguugcuucucucucucugagaauugaauucccucauuagguuuggcagcaagcaguuauucgcuaagccauuucaccagccccuauuaugucuuuuuaucauaguugugugauaugugcccuuguccuuauguugacuagucacuguaguguuuauacuguuuauuguaaaaagugguggauuuugaugcuggguuugguguuuugagacagggucucacuauguagcucugguucuucuggaacucccuguguaguccaggcuggccuggaacucagagaucugucugccucucacuccccagugccaggauuaaaggugcaugcucccacucuguccaacagugguguuuaaaaaugcuguugacuuagcacaaauaaugacaggugucagacuagucauguauucacuugcauuccccgccuguacuugaaauuuaaaggugcccguuucacuuaaaacugaauuugaagaacauccaaagugacugauucuauuaaauuuugaccccugagcauauauuuaaaaauauugugcguggugacaugaaaaguaugcaugagucaaaguacugcauggugcggugccauggugauccuguggaaggaugcugugguggcuuugagacuagcugcuugacaaaacagcagacugguuaaaaagacguagguauuuguuagauaguucucuaaaacaaugaagguaaacugauaacacuucuuaucguugguaggauuugaauacuagaagcauauagaaucugagcuuuggaaagucuguaucuguuauauaguauagcauauaucaucuuauaguguguguauauauaccaagcucuagacuguucuugggagaaaauaaaaaugugauuuaaacaaaaaugauauugugaaauggaaugugucaauauuugagucagugagccaauauuucccaacuggaaaauaacucaugcuaggagcacacaugaucaaaguccauccagacugugguauugugaauagcucauuggcaucauuucagauucuguauuacaagccuuuuuuuuuuuuuuuuuuuacuuuuuauguucucucucucucccccccccacccccacagauguguauaugugcacauacauauauauguacauauguaugaacauaagugcauaaagccccucagucagacagagcucagcggugcaccuugucuugcuagccagccugcucccagaugccuucugccuucugagguuggagcuccaggagccauuguacccaccuauccuggcccgagcuagucccuggagcuaggcuccaguucuccugcucacgcacugcacucuuguuucagaaauaacagacugauuugauguuuguauuaaagaagaauaucuauauuucugugacaagacccuaaauuacuuuuuucccaaaccuugauuuaaaaaaaaaaaaaacuauaacaauaacaauaaaucucaacagcuugaauagugaagugguuauaaaucugacuuuugauauaccagguauuaaagaguguuacccaaaauguaaacaaugaaauucuauauuaucuuauuaucuuaagucaggguuuucccaagaugauagccuagccuugaacucacagcccuccuacccacucuguuagugcuggaauuucaggcauguaccagcauaaguauuucaguuccuuucuuuauaauaaagauuuacaagaacauuuguuuuauauauauauauauauauguauguauauacacacacauauauuaacauguaauacauuuuauuauaaaaugaaaugauacauauuuuaaaauuucucagccuuuccuuauaaauacauaugaaacaugaauuaaacauuuauacacauauaugaaaugaauaauuuuggguauguuugcuaauuuuauguguguaagaaaagcaaaccaucaauguuguuuuaggcagaugauggugacuauguugcacugagugcaauauuacauuuaaucgcauuauuacuuccauugcagaaugaaaggagcagaauucagaaaaugaacauccuuagauucauacagucaggaagaaacagagcugggcuuugagcccaggguuccucucuuaagaguuucgccucaguaaugcugcuuuguagucugcuguggucuguaacauagauuuauugugcagagaaagagaauaaaaauaaacauggcucuuguacuguuuaucugagaaguugagaucaacucugccugugagacuaugcugcuuccagaagagaauauugugucacacauagugcuuagaagacuguaagcugacaacacacuuucuuuuaaagauuauuuuuuauuuuaugucuaugaguauacuguugcugucuucagacacaccaggagagggcaucagacccuguuacagaugguugugagccaccaugugguugcugggaauugaacucaggaccuuuggaagaguagccaguguucuucaacgcugagccaucucuccagucccugacagcacacuuucuuaaagagagagauauuuuaacugagguucccuguaaaugguaagaauauggauuuuuauuugcuuugccuggcuauauuucuugcuuuuaaucuuaaaaguuaaaaauuauaacaauaacuaugagucacaaggaaggcccacgcgauucauggauugauaggauaauuaaacaugauguccuaaacccuggaaacuuuaccguaauacaguuuuugugacuuucaauauucuuagugaauucuaauuugaaguuaacuguaaucuuuuuguugcagcuuguauaugaauuuuucauaagauuuuuggaaagccaagaauuccaacccagcauugccaaaaaauacauagaucagaaauuuguauuacagguaagcauuuuuuuggugguuguaugcauguaauuuacuuacucuuuauuucauuuucuuggauauuguuaaaaacaacagaaaucuugcuggugagauuguguugccuccuaaguaaauauguuuaugugagguaguuucuguuauugccuauuaaaagugacaauaccuuuaaaaauuauuugugguggaauuuaguuccaugcuaaacaucaggagucuauuccuaaaucuuccuaagcuuucauuuuuaaaaguuuaauuacagaagaauuucauuuauauguccaguguguacaaaccuuuaaaaauuaaauuuauuuauuuuguguguauguguauuuguaugggcaugugcgugucacaacucuaguggagaugucaaaggacagcucuucuggcgucauuucucucuuugccuuguggguucugugauuggaacuuagcucagcaggcuugggaacaagugccuuuacugcuaaggugucuuucaggcccagugugugagucuuuauguuacuuucaaacuuacuauuuaggaaagguuucuuaaaacacuuaaggauauaucuauaaaaaaaaugagcagguaugcucgugggugcagaacacacagguaaucaaagugugagguagcugucacugcuaggaaauggcucaguuuaacacuuuaacauuuucuuacagagauuaauucuagccuaucuauuuggggcauccuagagaaccuguuuuuccugguuucucaucuuacaucuugaaagugcccuacaucuucccuucugccugagauuugggauaguuugcugaaacugaauuuuaaugagcaccuccuugauccuguuguauuuacucauguguacgcuggacacgucaguauauaguauuuguguauacacugugaucauacaguguacaguggauacugaaguggagagugcuguaugcaugguugcuccuuugauugacauaugggaugccucacguagggaagaaaauaccuaucucccacugagauguucauauaagcagaacuuaagaaaaaccauaauuauggcagauagcugaucucauaugccuccacaggguaaaaaccacuaauucucauagugagcucauguccugcccuaauuagauuaaauucagaauucaggauauccuaauugagccacagccaacaacuuguacaaaguguaguaggaucauagaauccaauccaacagaguaccaggagcaggcaggcugcugagagcugaggcuuuauggggacuccuggauacucugagauuccagcuggggacacggaaggagaguucggguucuuuaaaaugugggguucuuuagugcuuauacaccucuuucucuggguacacaggcagguacacugaguuuugcugagcacuacguugcuguguccugugcaaugguguguccuauacagcuguucuugugcacucucuaucguggauugaguccucaauuuuaucauccuuuucucauuugucgaaguuuggauccuaaaauagauaauagaaguccuuuggucuuaaaguaugaacuauaacugugaacaccgugccuagagcuugaucaggccgguucagcuugguguuccauuuccuugugugacucugauuuccuaacauuucuugagguuggaugacuuugcucacuuauguugaacuucuggucuugacugacuuuaauagaaugcacuuugcuuuaaagccauaguguuuuuuuuuuuuuuuuuuuuuuuugguccuuguuauauagcuuacaaucuaauugugaaacaugaugugcauucuguggaguaucaucucucuucaguguggagacuuuuauggaucuuuauuguuaucacuuuauccacagccuugcaucuuuaugucauuuaugaccuuaaauauacuugacuuugaccucauuuaagucauugauuagaauuguaauauuugucaagaccgguagaggcuuguaacagguuuuuagaaguguccucuucauagcagauucauguaucaguaaugacuggaaaucaguuuuguuuauaacuacagcagagagacaggcuacaugccugugcuuguagcacuccccucauucuugagcgguguaacuuuaucauuuaaagaagugccacaccccugcagccucgcccuugggaggucuucccaggcugaaguauggugguuugaaugagaaauguuccccauagccucugguauucuaauacuugguucccaguugguggagcaguuuggggaccuuugguagguguggcuuugcugggagaaguagguuaccagggacaggcuuugagauuuauaaccuccccaauuucuaguucuuucuugcuuguaguuuuggaugugaccucucagcuuccugcgucuguuucccugccugccacuuguuuucacaccccuccuugcugucauggacucuuaucccuuugcaacuagaaccagaacaaacuuuuucaucuacgaguugcuuuuggucaugguauuuuaucacagcaauagaaaaguaauacucaaggagagucugucucaggaaaaugggaggaaaggggaguuggggccgugaaauacuguuccucagccaugugacauaaaauaguagacuuguagggccgcuguuugauccuggccuggguguuuguaaacuaugggcauggucaacuauccuaggguuauuuccuagacagaaggaugaaguacaaacagcaaaucuaucagugucugguagguuuuggccacuuuauuuuucuggccuuggccacccugaucugaucuacuugucuuuucuccagucugcagaugcacaccuuucaucucuguuuaucucugagcuccuuggugguuuguucccagcuugggcuucaagagcucccucugauaauugcuguucccucaucccgaccacacccgucuugcucugcugugccuuagcugucccucagcacgcaggagcuucccacuggugacuacuguccagucuucucuccacccuccucuguuccugcacaccuuccccacacccagacaaugucuaacccuucugugcuuugugccucaggucacgagaaguccucauacucagauuuucuuaccacauagauugcaggcuaguaguaggcaaacuagacacaacccaagugcuuuguuuauuuggaaguauggaucacagaguucuugccuucaauguaaaacacauugucgaugcuucugacucagugucuuaagucacaaguaggcgucuucuguaaugacuugcuguacaggucacuugcugguucuaucugggagccucauugcuauucgaugcucacccucucagacccuuuucaucucaccaugucugcuugguccuaauauuaauuaaaagaucuucauccuuuggaguacucuucuagugcugugaguuuaaccacaggccuuguauaggcaaagcauauguuucacugcuaaacuguauuccuaguuuuuaaacaaaauuuaagcauaugugaaauuuaacaguaaaauuuuacagagcauugaaugaauguuagaaugcaauauauugcuagauuaaaguaaauuauccaucauaaauauauucauauaaugugaguucauuuguauguuugguauaguucuuuguuuuguuuucccccuuugagacaguguuuucucuguguaguuuugguuguccuagaacucacucuguagaccagaauggccucuaacucaaagaggccugccucuuacuuccugagugcugggacuaaaaucauacaccaugaugcccagcuaguauauaguucuaauuaaaauucugauuuuuuaaaaaaaaauuagaaucuuuauaauucaugggauacguuuuuugaggaagauauuuaauaggguacuuuacauaguuaaauaguucucaguacugcaagaaaaaaaagaauauuuagguacauuaaacugugggguugggacaggagaagggauauaacagaaguuuggguggaggggacucuucugagaaaguaaaaaaaggccaucagaagaucuguaccugugagugacagacaaguacacauggcaucuguuccuuaaaguggucauuucugaagagaaaaucucauaguguucugucaaauguugacccagcaguuucauguaacacaaccaaaugugccuacagagauaccaaaggcuucaguguugaugauuacaggauuagaaaaaacuuaauacaucuucgucagaaguugauggagaaacuauagacauucaugugguaaaacauaguuaguaaaaagaaugagaacggugguaccuaugaucuguuucgaagugguacgugcacauuauagaauccuuuagcuuuugagucuggaucgguuauuuuaggggaaaggcaugucugugguuuucuuagcccauucucaagaccuucucuccuguacgugagagaugugccucaagcucccgguggaucuugaagccacaggcagcccugacccuggcaccccugcuguaugcaagugcugcgauacaguggugggcgugagauggccacugaggacccaacauggacacaguugacucaugcuugagguagggugcugagggguacugaggcuuucucgugcuacucggaacgacuauuuaaaacguuggaauuauuucuggaauuuucccuuuacugguuuugguuuguggugcaaaacagagaagauaugugguugaggcagaaaccugagcuuuaccugagauaggcaauuccuaaugagcagaaacucccuucucacaaaucuggaaaucagacaguccaaaauccgugugcugacaucuggcaagcguccuguggcuguguucucacaucgcaaggguacaagguacagggugcaaauggggcgcucuugaagucacuuucuuaucguggugggacuccuuucguggguacuguugugaucugaacaccucgcaaaugguuccaccuuugugggauuggaaaacaaguuuccaaaacaugaguuugggggcacguuuagacuauagcauuaugcaucaacaguucuggaagggacuauaucagguuguugguaauuguggagaggauaugauuuucuuuuuccuguuuugugaucugucuaccucauuuugcaucuaaaagaaccauauaugccauacaaacacaacaaagguuucugcugcgaguacauucuuauuuccuuugcaucuucauaaaccacagguuauuugcacauuagccuuccugaaacucuauuucuauaguccuuuuaugaccgguauucauuguauuuccguccuuucagcaucuggguaugccccuuuaaaaccuggagcuugcuuccugugaugucucgagugccuguucaguacuugacuucuucccugccgugaagcagaguggggagguguuuaaguguagaggcugguuuggcuucaggcugacuuguuauuuguuuuaggauagagucucacuaugucaccugcuggccugagacuugguggauauaccagggugcccucaguccugcgaccauccuccugccuuugccucuugagugcugagcauacaugcacgugucaccaaguccaacucuacuaguuuucacuguguaaccuugggcacguugcacuacugugcugucugucacuuuauucaucuggaaaguagcugucagauauccacagucccucagcaagucccucguaaugucaggauguaaugacugaagcuccugacaaggccgggaaugcugcuuaucugcugucuccuaccacuguuuucacuaaagaucaacuuucguuuugauagcauuuuacauuguauuuucuuuucuuuucuuuugguuuuucgagacagggucucucuguguagcccaggcuguccuggaacucacucuguagaccagacuggccucgaacucagaaauccuccugccucugccucccuagugcuguauuuucuuuuauggcuccagguugcgaaguuauccauuauuagccuguaauauuugccaagcaucuuaauauuauuugacaucugaccuuuacucuaaauuucuuggguaccucauggcuuagauggcucaucuuuuucuucuuuuagaugccauguguaguuuccuguaucucuaaauucuuuaucaguuccacuuugccaacugauuucucugaccaguguuguguuugaauguguauuuggagcagaaauggaugcuuagauguuuacagaggacgggccgcacagaggcagaguggauguaauggcagagugugcuaacucuucuguccacucccacaagccugcaucaucuaggcuagccagugagugagcagaccacgugucugaccuccuugggcuuuuaaagaaaaacuagagucuggauuaugaaugaauuuccagacagaacagccugucuguuggguuuugcuccagaguuuuugaguguuucuauuugaagggccuuguuauucauccaggaaaauucugacugcacuacuugagcaacauugugauuuuuaugaagcugagauuuacagaaccucuaucauuuuuaaaauguaaucauuuaaucuuuguuaaagauguguguagcauaccauauauguggccaugcagcuuuuagauuuauguaaccugcaggcccgccucagcucauggaacaacguuuguuauccauuaagaucaucuucauuugcuuacagggucuugggaaaugguuucuucugacugcuguuccuggcccuccuuuuagaaacaggcugauugccaaccuuggauuauuucuuugggugaaucacuguggcucuuuagcagcauguuucuaaagauugccuucaaccguucucuagauccgaaacagucagugguugcuaagagacacaagucaagaaucccuauaacauaccuacugcuggagauagcuauuuaguaauuuguacuucacauuugcaguuauauuuagaccaaaguggcauaauuauuaugcaaauuauacaaaucauuaaguuugaccucaaaagugaucuuuugauguuauguauuuaaagccucaaaauaaaacuggacguggcccaaagcacgcugugaaugacuuuuggcuucuugucugaaguaaguaagguccuugagacuuugaauccccacucuaacacaaagauauuuuccaaauaaguucccugaauaucucagagugugcacaguugucucccagaggcuacagcagauacaaccagaaaauuuauuucugccugggguguuagccucaccagcugacagaacaccucauuuccugcucauccuuaguccagcauuuaacuccagagcucuauacggggccagugagguuugcugucaagccucaugauucccagaacccacacuugaaguagaaacuuaagugcucuuuggaaaguuguuugggugauguuuugcuggggcaaacauaugaagggauauugagcugaggcagacacaggagaaagcguguucugcuaaagcaagcacaugaaaggacaugugaugagggauucuuugcuaacuaugcaaauguauuuguucugccuuacugcauaguugagcuuuacuugucaggacucccuagagagaagcaugccaaaaaacuucuagugauaugcuucaguuucuugcugcuuccuuggacuccaggagauuggcagagugaugucagcugagacagacacaugugcugaggcaagaccuguggaagaaggcacaugauguuuggaagguauauagaaaagaauugauggacagggauggaggcugaccuuggcuuguuaauagagcuagcugugcaaugcuuguuggucucaugugugcaucaugugguccagggacugccaagggacucagcuuuucauuucagaauagcuguucccagcagagccagaagcauggagcuugaauuguagugcugugucaguuuggacgaagacauuuagaacauccaguuuuauucauugucugcuugaacaugucuucuguaaaguagugcauagaaaacacguaguucgugucugcauauggugguacauggugucagaggauaacaugcaggaaucaguucucuccuuccugccagaucgagccuggggauuggauucaggaguuuaggcuuggcagcaagcaccuuuacccacugagccaucuugccugcaacuaacucagcaccacaaccccuccaccccaucucaccuuugccuugacuuuggaucuucuugcuuuuaccuuccaagugcuagaauuauaaagcacauacaauuacacuuagauuucuugaaaaauuucugcuguucuuaaaaaugcugcuuuauauggagaaguauauaguugugacauacauauaauuaaaucaaaguauacuguguguauuuguauggcuguguguguggucauggacauaccucaggaacuguaacugccuuucuuuauuauggaguaauuuguuguguuugcuuuagggugaaguuaacuuuuuuuaaagacaggucuuguuauggaggccuguauguauggccuggaacucacuuuguagauccuccugucucugccucccgaauacugggauuaaaggccugugucaucacaaccagcuccuguuucuuuuuaaaaaauguuauuaguuuguugagaauuuuguuugugcuuugaucauauuccuacccauuuccucacagaucccuuccccacccaccuaacuuuauauucuuguaagaaauauuuaaaaugauuuuaaaauacagauuuauuuuacuauuucuuuguguauauuuguguaaguaugugaauauguuugugggcccaugcacaggcaguagaggacuuacuuggauauuaagaucaaacuuguguccucuugaggagugcagggcuuuaaccauaagccauuucuccagcucccugccccaccuuuuuauguguacugcccacauauucugggauguguggucuuccacagagcaugguugcuccccgcugagagaacucuuucuucccgcauggagcuuuuuuaacccuaaaguuaacaauggccaggugguucaccugguucuuuccucugcuggucagcuguuccucccuuauugcuccaaggacagacagacagacagacagacauacagacagacagacagacauacacacacacacacacacagugugugugugugugagagagagagagagagagagagagagagagagagggagggaggcagggagggagggagggagaggggaggggagggggagggagagagggagagagggagagagggagagagagagagagacuugugcaugcacauacgcacacaggcacauaugcgugcuugcacauagacauacacagucacaggcgcacacacacaugcccaugccagucugucugcugucuuuucucuuuagaguccuucuuccuugaaguccugcucauccuguucucaucuauauuggaugcuuucccagucucaucccgagcuccuuuugccuuucugugggacaugcauuuguucaccuaacuuucucucauuugcuacaccuuaccucuugauguuucauaggaaaacaugaaugagaugcaaauucuuggagaugacuugacugauaacauuuuuacuauuuacauauacuucuccucacauauacuuaacuauucacauacauugcuuugguaaucuuugguaauguaucuugagguauuuaaggacuuguuucauugacguacaacuuccaggauugguauugagaaaaugagcauaguacagcuuguugucuuuuuagagaucuggaagcuuuugagaccuucauuucuugugaaugagcuauguuuauagaggagcauaugccuuccccaccucacagugccuugggagaauugcauugaguucuuucucagaucauuugccuucuuuacguuguuuuccuguccucgugucuuucuggauugauuggcugguugucucugcucugcuucuggcccuguugucuagcuguucuucuccaugugcccuggugacugguaagcugcaaguuuugccaccuaaugcuaugguucuucugccaagaugcguauuuucuucucauuuugacuucccaaagcuagcucgcucucucucucucucucucucucucucucucucucucucucucucucucauuaucacuuguuacagcaucuucucuugauucaggaaccuaauagaguaggagcucugagaauguugagguguuuuuuuguuuuuuuguuuuuuuuuugguuguuauuuuuugcaaguuuucccuacuccuugcauucucuuuuucuuuggaguugcucauuugguagacugucuacugguucuucguaauaaccgucauuaccugcucaucuaccuagacccacuuaaagcuugugcuugugggucaugugcauguguacaugcuguauuuacagcugugguacucuguagguggccacaguaggauaauugagcaggacccugccaacccacugagaaccccuagauuauuauuaugccauagaucuuuccucagacuccgagugucccucaaaggagaccuccuggucuucugccuuaccuccaaacugggagcuuagagaagaguacugcugagaccucacuaaaguaugcaggguuucagucaguccuguuacuucgguaaugcuucauuuagcaguguuugauaucugagacuggacacuugucauguucucuagccuuagaccauaacucguuagaacacugaaaugcucaggggugcaaaggguauugacgauacaaacguggaagcugcucuggcggaugcuucucaucccaggacaucaaaucuagcucaugccuucauucuuacaccucugaagcuucucugggggcgcgggggagggaacuggcaccuucuuagcuuuccucucugcugggaggauggaaagacccuuagcacaaugagcaagaggaaacugggguugcuacuuuuuguccauuuuccaaguugggaaacccacacaaagucugacagucugcucuguucuccaggccccacugcugaggguuggggguaugguagguaagguaggaggugugggggugaggugggagggcaugguggauguuuauauuuucauucuaaauccuaacacaguuuaccucuguuaaaacucagggaggcuuuuuuucuuuuaaguuggagucagcauguuaacauaucuaucuuugcccuguaaucaauuuguaaacuccagguuuucuuugacaaguugcuugugguaugauggaugacauaaucuauggauguggagaauuuguuguggaaaucagaacucaucuugcuucuccccuuuggacuauaugccaugaucccuuuguuuuugccagucccauuauaauauugucagaaguguguuggacaggccagcagggagcagcggaaucucgaaguucaucuuucuuuguuggagaaggacagugcauuuagcaggacccugcacagguccucacuaagauagcuuuuucguucuuguuguuuguuugcuuuuugaaaaccuaaugaaguauuuaguuaaauaaucuuuguuuaauuauauagcuguuaaacuucagauuagcacuacagaagcccaguugacucaaguuuugcuaacauuccaccccacaaaccuccucuuauguuaguugcacauuauucauuaagcucauucccuuaaaguagaaacccaauuaaaaauagaacuuaaaaugguuaauaauuuccauagacaaggacuggaaugcaguagauggaugucuuguguaauuuugaguaucucuuacauaaacccuuccucuccuuucuggccuguuaaagccacgugcccuuuuuccuaaguagaaugcuuaccugugcaaguaaauuguuaacuugaugguugcaucccuuaguuagcuggaaguuuguccagcacucugugugcccagcagcaaggacaucuauggcaugaggaaagaccucaguacauacuuguuuauuuuauugcuaaauaggcagcgaugugacaguuauugcuaagugucaucugucaguuaagcugcugccuugccucuuccauauuccuugggaacauuguacuaguuuggguguuauuuaaaugacaacccucuaacccacccaccucccacccaccaggggucuuuugcauuuggacacuugguagucaaggugauaguuuggagaagugacuaagaagugaccauuuaagauguggagaugagugggaggucccuaaggcauuuggggcacacucuugguagcguuucuaggacacuagucucucucuuucuauguuccuggcuggaguuguaauguauucacuuccuucuuguuguauaauugauuacccaccugucggugcggucuaggguagcccuugcuguggaguuauauauucuaugccauuuggacagucagccuucagauuugagauugaaaaaagucaugcuuuuucauaaguaguucguuauaguggcagaaagcugauaaauaucaacacuugucccgguucuuguguguguguguguguguguguguguguguguguguguguguguguguguguauguaucaccauauguaucacuuucccuggaagccuucuuuauuacuauccuucuuccaaguggagucgauagauccauuauacauuuguacaacaucuugaacuacuugugcucuuuguuuauuuuuauccaccauuagacuagacugugaaagcagaguauagcugacuugcacaucaccauaucccuggcacccccuugcccauuggcugaccuucaguauacaccaauaaauauuuacucaaaauacucaauguagaacaaacagauagaaaagaugaugaaugcgagcauugugaagccaaacuugugcacugguucccuguccaggcuuuucuuuaauuuuaacuuccugccguauuugaaguuucuuuauuuuuaguuaauauauuuugcccaggacugucuuucaucaaacaaaauacgaaacaaaaugaugucuguuugauuacuguccucucuuuguugucagcucagccucacagcuucauugcuuggacucacuuauauauaaauauauauaaucauguaugcauaaacacacauauguauagccuuuugugagaaugaagguaggcagcuuuuacuugcaugcugaguugguuauuuuauuguaauuguuguucuucacucugagaaauuuucccaguaucauuuuuacaaaauagcagauuuguuaaauuauaauuuauguaacauaaagucacccuuuugaaguuuauaauuuaguagucugcaucuauaugucuaaauguauguaugggguucaggaguguguacacaugcacguguguauguggaggcaggugaucacucauucuuggguucuggucaccuuuguugaagaugguaccugucacugaccuggcgcuuacugcuugccugcccagugagccccauguagcuuucugucuucuccucccagugcugagaucauaagcauguaccauccagcuuuuuacaugggcucuggagauugacccuguaccucccaccucccuagcccuccaguugaguaauuuuaaacacacuuucaggacugugcaaccauccccaggguuuucaguucaguuaacuuuguuuaguuuuguucauuucuugucagaguuuaaaaaaaaaaucccuugauuuggagaugugaagauuauucuucugucuucuuuaucauuuacucuugucuuuagguugauuauccauuuugaguccauuugaauuuguaguaugagcucgaggucugacuuagcauuuuauaggugucuaucugcuugucccagcaccuucgcuuaaggaccuucuugugcucaagugucuuggcaucccauggaaccaguugaccaugaauuugaaaguuuuuguggacuccacucuguucugcugacuuauauauuuuuaucacaugucaguagcauacucuuguuuacuagcuuuauauugaauuuuaaaacugagauuaugaguccucguauuaccaaaacugcuuuggcccuucuaggugauuuauauaaauuuuagaaccaacugauuuuguuguuguugauugccugguaaucaguucuuaauuuagcuaucuuugaacuccaagauguuuuaguuucaccuuccugagugcugggauuauaauaccuauaaucauauauauauauauauauauauauauauauauauauauauacacauauauauauauauguguguauauguauauauaugcauauauguauauauacacacacauauaaauauggagagagagagagagagagagagagagagagagagagagagagagaacacacaagaacucugucguugagcucuauuccaucucuucaacaaguguuacaaaacaagaaccuaaggauuucuugcaggaauuagguuggauccaaaguggcccugcuacuuuccuuaagacugagcugguguucucucuuauggcuuaagacuuggaaccauguuaugagaauucuguggcuuaaauuguaaaugauccaaaccuagauccugccauucacauaacauaguacauguuuacuuugaugagaauucugcccugcgcacaacuuguguaacaacauugcugggcuggggucauugggaauuucagugucugcuuuggguuagguuguuucaucuucuugggccuucugguagagcugagggguuuaacuuaaaucuguguuucuguuuguacugaaaagcccaggaguugguggcauacaguguugaaggccaaggacuuuaagcacucaguggguucacaucccugugcugcugcuucucacuguggcaucaccagcaaucggcucucugggccccagugugcucaucugcaaggcaaggguaaacugccgccccgagggccuggccugugugauugcgggagcgcugcauuggcugccacuguuacugguacugcagcacgagcuuuccccuggguuuaaaaccuucuucucaguguagcugccuuccuuccccaaagacuacuccugugcuggguguaacuuuuauuuaguagcuuucugaagagggaaaaaagggacagagggaucguaaauaaugaacaauagaauuucucaguucuugccuaaaagugucucuaaccgccuucuguucuacugucauuuacaacagcuuuuggagcuauuugacagugaagacccucgagaacgggacuauuuaaaaacagucuugcacaggauuuauggcaaguuucucgggcuuagagcauuuauccgaaaacaaauuaacaauauuuuucuaagguaaguugauguuuuugcagaagcauuaaacaagccuucaguaguugaagauaaagugcuaacuccuccuucccuucccuauuccuucacccuucccaucuccuuucuucucuccucuuucuccucucagguuuguuuaugaaacagaacacuucaaugguguagcugaacugcuggaaauauuaggaaggugaguauuuacuaugcauuguugguuuccggugagccucauucugcaggucguguucagggggcagaaggggugcugguugaccuggagcucuugcuccauauccccuggccucuuauuugugcuuagccuguuucccaagugacucucaagggcuaacuuuguucuuuguuccauaauuacauaucguuaacucccccacaaugaccugaaggagcucacagcuuacucagugauggugucugauugggugacaggccagugacagcaaagcaccuuauucucugggccuagcauguaggccaccuguccuuucucacaucugcugaaagcagguuuguuauguauuggaaagacugcauagccagauguggagcuguaggcagcugcugcccucggagguagagccaagcagcagauguagcugggcagagugauugcuuauucuuuccuucuaauaagaugaggaaaaggugggaucucccugcuuccucccaguggccucccaagacuggcagagguuucaggaaugaagagaaguggugucaggagguggcaaggguguugaaagagcagguuagcaaggugaucuggagacagacagcuccugcuuuaagagaauguuagccgauaggcuacagaggaacagagggaggacaaaacauggguuugauaagaagcuuuggggcacaucugccuguuugcuggauguucauaaucaaauuuacuucuguuaaaauuccugccuaauaagugaucucuguugaaguaacuaaaaaaagucuuaaaugucauuggugggagggguuggcuauguuuuuuggacaaauauaaauuaagaguuagccagcuccuaacaagaccuugucuggguucaguguguggguuaacauugcuaacccucucucuucuuuuccccaguauuaucaauggcuuugcuuuaccacucaaggcagaacacaaacaguuccuggugaaaguguugaucccucuacacacugucaggagcuugucacucuuucaugcacagguagagcuuucuguucaaacugguuuugauguagagucucuccccugugccaggguuggcuguaaauuuguagucuucugccucuuccuccugagugcugggauucaggggugagccgccacacauaguuuuaaauacaccuucugaagcaaaaugaaaaauuuguggauuuccuguuucuuaggauauuauuuuucuuuccuuuuuuuuuuuuuaaaguaaagguguguuaaacuuaaaaauacuccccaagaaaaguaugaaaguaugucguuccccccccccccaguagaauuauggaacuauuuuaaagguaggaauaggcuuugcucuguguuauuucauagcagacuuccguguucacgagguucccugcuguagauuguccauaguaggauguauguaaauguagagcggguaagagugugcuagggcgaggcaucguugggccuugccuaagaagcagaauguucuugaauacuuagcccugucucacuuugcccugggcugucagcugugcccucugcccccuucugcuucuucacagcacugcacucuuucagaagcagucaaaccuaucaauauuuucacaucguccuuuugauaagccccucauuacuuacaaaucagaucuuuugggguguggccuccugcagcuguaaucucagcaccuaacagguugaggcagaaggauugccuuggcuguauagcguguugucucagaacagauacacaccuacaaggaguagugcugauaaucagcuccuguguugcccgcgcuguagcaucugugcugagcugcacucauugcacggugagcaugucacuggaaggcguaauugauggagugguauuuuuacguucaguguucuaaaacucuugcucccuucucuuuugaguuugcauuaaaacguaacacauuuuucuaagcaguguuccuucuuaaaugugaaacucuguauuuugaggaaagaauuaguccauauguuccagauuuagcacaccaucaaaauuuugguuuuuaagagaaucgguuuccuguucaggaauuuuuccuagcccuuuagaaaacuucuuuagucugugcagcaggauauagcauuucauaguuauuugaaagcguuccuguugagacuggggacacuccucggauucugacuuuggcaaguguaaccuuugaucgcuucaggaagccucuuuuuuuuuuuuuuuccccuucaggcucucccauaggcacuugccuggguuuuuacaaacugcuuccccacaaaagcugaagcccagagcuugagggguagcccggacuugaaugucugagaucuuuucaggcugcccugcuuuucaguagccuccaaaaucuagucucagugcucuuuaaaaacagaauuccucuggagccuugucacguugucacugacuugaaaagcauagcuuuagcugcagucucugcuauucaggaaacugagguaggagaaucauguucaacuuaggaguucgagacuagccugggcaacacagcuggguuccaguucuuucaugaggguucaaacgaagugauugugagguuaaaccagagucuggaugcuuuggagaagugaugcugugugcuuccaccuuucauuggaucaaauuaaugcucuguccuuugcucuuccuuccuguuuagcuggcguauuguauaguacaguuucuggagaaagacccuucccuuacagaaccaguaagcuuuuuuuuuuucccuuucuauaaugugaaaaaaaauuaagcaaaaaccaucuucauuaaaaugucaaacauuaaaugccucaauuuuuuuuuuccuuuuccuuuuagguuauuagggggcuaaugaaauuuuggccuaaaacaugcagucaaaaagagguaaguacuuaaccuuggagagugccagugguaaaggagugcuuugccaagcccugugaggcuaagcacgcaugaggggacgccucaucuaaacuuggcuuuguaguucucggucuuacuagcgcuaaacugaggcuucgaguugaguagcacauccaggcacacugagugagagcaugccaauagacuagagccugccuccugaacucugaacccuggccaauccccaccguguguccagcuagcuccacugaggccacuuuguagugacucuguagauagaucccugagcauucugcuccaguccccauguuaaacuauacuaugggugagggcuuacaguguauagucucacaauauacaccagaccauuagcuugacauucccggaaaugaggcacauacagucaccaaggcauguguguuuguagggaguccccaagcaggagcuugaauggauccuaacugucaccaccccagaucugaagcccucucuuagccuggaaacagaggccaccuguuaucuuuaugucacaagaggauguaugugucuuaaugaaggaugggguauaggaagagccccuuccucacaucagugauucuaaccucaguccauacagcgucagcaaauuaccucguuccuuaacaauaggaguuuaagggaaucugcuguucuuuguaccuugagacacaaaagaagugucuuccuucauauuuuaauugcucguuuagcuugccuaacguuauuuuuagugaguaaauagucuuuauuuauuauuuuucauucuauuuauacaacugucuaaaucuguuuaucuugcuccauugugugaucuucaagcuuucuuuugcauacagccccgaggccaugagauucacugugcuauagagagaggggagagggagagggagagugugugcacgagugcucguauaagcauaggagacaggucagugugugcugaugcgguuacugugccuccauaacaugaauuuguuugcuagugggaugcagcugccuguugagugacuguguguucuguuguggugcuguggacuaaugcacauuuguucaggagugucagccauuauuuuaaaaacuggggauggguaggguguuaaauaucuugguugcuagcagugggcagaguuccaaaggccugaagacggagaggccaguaauuugcuuuaacagaagacccuguccugaguucuuugagaaacggguauguucuuuguguauauggcaguagguaggguacgcacacggaggccugagaagaacucuuaacacagugacuugccauagaauuuggagcuaggcuggcagccaggaaacccuggagaugcuccugucucaacaccccauaacacuugggguugcaggcaugucuauggccugcucugucuuuuuauguggaugcuggggauuugaacucaggucuucaugcuuucauagcaagcacucuuacccgcugagccgccaucccaggcuaagacaacuagacugaugucugggcccuugcuuuuguucuguugcuuugugugcacccuuuccuuaagauacugaguaagcugagcauguggggauuuucgugguugaucucauguuuugugcuuuguucuuauuuauaggucauguuccucggggagcuggaagaaaucuuggaugugauugaaccgucacaauuuguuaaaauccaagaaccuuuguuuaaacaaauugccaaguguguuucuagcccccauuuucagguuaguaggaaagagaacacgagucagagugaugugugccaugugaacucauuaggcuaaacuucauuuguguugggaaaaaaaccgaucauggacacuagcuacuuuaaaaauauuauuuauuuauuuuuauuuuuaauucugugucuguuggagugcaaugcccacagaggccagcggcaccucagcuccccugcugcuggacuuagagguggcugugagcuggcuggugcgggugcaggcaggguaccgagccuggcuccucugcagaaggcagucaguacucucauagggacucagccaucucuccagccccugcugcuuguuaacaaauuguuaccggaugcugagcaucugccucuaacaggcucugucuuuuaacuucaguucccauaauacccugcaagaagacaggaugugaauaccaaagcuggaagcuguaaaauaacugaacuuggcuaaauuagaugacgugggcugcugggguuucuucacuguaugagaaggaguaaucaguaauccuuaggaggagggaagagaagcugggugcuguccuccggacaagaucccaagugggaaugucaauggguuuuuauuuuuaagguggcuuauuguaaaaaaggcuuaaagcccaugaccuucccacagccugcucugccuccuuguggcuguuuggugagaacacagggaaggugcacuugguguuuucaaggagguccuggcugcagugcuuugaaaccaauacaggagagaacgggaccagaguugaacauagugcuuuaacuuacgugguggcugucuuaccaaaaguccaucuuacaaaucuagcaggcucaucauacugccccucguuugaagacccuguucaacagcacaaaagcacacuugaaauuugauggugaacuauccuuuaagcuggcagauugaggccuugacuauuccuguuuuuaaaucuaaagacauacuaguguauuaagcuagugcuuaggccacacagaacaaaaggagggacaguucugugagguguacagacuagacacaaauagaaaaguucagagcagugcacacgacacuaagucuguaauguucaaaacauauggacuguuuaguuuucugguuucauuugacucuuugguauaguggaggccaagggucuuucacaaagaacaaggcagagaaacuuacuggauacucagugcucaggaaggaagguaauuugucauacugagaaugacguuccguagaugagcauugcguagcacuugcagggccuuggguuuuuuuguuaacaaagaagaaggagguaggaaagaguguaugguaggcucagguugcuaugacaaaugcuccagaccaaguagcuuuaacagcagagauugacuuccccacaguccuggaggccaggagucugcagucaugcaugugacuguucgccaugaucuuaaguagcuccuguguauguauguacagguuguucguucugcucuguagcccccaucacaguuuacaucaaacaacugcaggugcuucauucccaccaguuauccgaucuuaagggacagcagggaagaguuaagagaaggcuacuguaugugccacuugcuagccaugugaccuugagccaaugacuuacaccuagcucuucaagucucaucuauaaagcuggaauaaugacaccacuuacaagguuuaagagcagugacaugugagugugcacagcacauggcuucugugugcuagcguuccuugaaggcuguuucuaagcguucagggaccaguaagucagcaguguuuugaaccugccaagugauggagauggaaaggcucuaauuucucagucugucagggugugaaaucuuguuucuuuucguucuaaaucaugaucuuucaauuuacauaaauaaaaaaagccauuugaguucaucaaguccaaggugagaaacuuuuaggcccagcagaugaaguuagaguauuguggacagaggacagaaucuaaaccaauaaguaaaugacauccuccuccagcuagaccccacagcuuuccaaguagcaucacagguuguagacaaagcauuuaaacauaagccuuuggggacauuuaagacccaaaguguaacaagacaagcggacuagcagcucugaaagcugagcucaugacaguguguguaaggaagaguguggaaauagaggagauguguagauagaccuaaagagaggauaaauuaacagauagggaaaagccccaaaaaccaagaaaacuuuuccuccccaaacugaugaaccaccuggcaacuucuuggaagaucauaaaucuuacaaaauguaaagaguuauuaauauuuaaucauacuuuugauugaaugauuuuaaaaauagccuuuuaaaauacuuuuguuugaaaagauuauaacuuguauuauaauuguucuguuucuuuccucaagguggcagaaagggcacucuauuauuggaauaaugaauacaucaugaguuugauagaagaaaacucuaacgucauccuucccaucauguucuccagccuuuauaggauuucaaaagagcauuggaauccguaugucuucaguuuccuucgauccuuuccuuuccuucuacucccguuuggucuuaugucccuuucccuucuucuuuucacuaguaaaaugucucucagcucacugugcaccagaugcuguggccauugauaaaggugcacacaugacaaaauaaaaaucccucaggagaugugcuggaugggggacuaaaaagcaaacaaauauuuuaauaaaguagugcuguuuaguuaaaagaucuuuuuacuugagaggcuuucugaccugucugaagguagccagauguguuuuggggauguguuggagccccggaggauguguaucgacuggcagggcucaaaguaaacgugcuaauuuuucuaggcaggaucuuacuguacauacaggccauacugaccugaaacucauugauccuccugccucagccuccugagugcuggggaaugguugcacuuggcuucagauagauucuuaguggaguuugguagauggcaguaauagggaacaccccuucagacaggggucaauuuuuccuccauguaaaaagacacagguguuaaaagugccugucaaguuuggaagccugcaggcuccggagggcaaaggccuuugggggagcagugcuagaaacaaggcuagaaaaggaacugaggcucacaagagccuucaccagggccagcuucaggaaguucugaggggcugugaagaaguggucugaagagauuuacauuugauaggaagacccauuucccagcagccagcucaguuguuagauuuuuguaguggggacuaaauuuuauaaucuucaaggacaaguuaaauuuagcccuaggaguguuaaaguauuuuauauugacaugcuuuugcauguuucucuaugcaauaaagggaaguuuuauguggcauugaagaauugcuaaguacaauucaguauugucuuuuaauuuuuuucauggaguuguaaaauaacauuuuuuuucaauuuucuaacuauaauacuuuguauauuaauagagcuuugaaauagagcuauauuuagccccgcuguagagacuuucucucaggggucuggagagcagcuccaggcagugucaagaagugcccagagccaguaagaaggccauucuugagccauagcucaaguuucccuuuuuuggggcaccaagcagaagcuggacaacagacacugaaccucccgcuaacaugagcccucccacuaccaugagcucucacacuaacacggacccucccacuaacaugagcucucacacuaacaugagcucucccacuaacauggacccucccacuaacaugagcucucauuuuuuagagaugucuucuuaguaagauuggggaguuuguugcaaaauggaagcaaccuuaaaaguuuugaaaagagaccuuuuuuuuugccuagucugaaucuuucaaguccgccacagcagucuucacauuguccagaguguauucugcucgauaagaauagcccagcagcuuggcgguuuagcuguggcguagugcuccauagccaagagcauauggcagcagcuugccaguuuucagcgugaauauuaggucagcaggaagggugagcaggaacagacugacacaaccacacaggaaagcagcuuagagggugugguagccugucuuugagcacaacugacuuagguacucauuuccacagggacagcuucugauuuuaaauuauuacuuugaaaguaauuuuucuaaaccacugguacuuguuuauaggguaugacuacucugucugaaugucugucugucucuuuguuuuaagauaguauccauauguagcccacagugcucuuaaguucucagugcucuuaucucuaccucccacguucugggauuaugggugcacaccaccaucugcacacacacacacacacacacacacacacacacacacacacacacacacacacacaccugccugagcugucuccccaccuuaaagcagcuuuaucuuauacuugccuuuguuaggcauuagccauaagcacaucugcucuggguagcaaugauuugggagaacaaagcuggguuuuaacuuugccauuucucaggaagguugaauaguaaagaacucaagucucuugaugaggaaaugaacuguguagaagggaaugggaagccaggugugcuaauacaugcccauaaucucagcacuagauggguggaggcaggagaaucaggacuucagaguuauccucagcuacacaccaaguuugaggcuggccugugcuacauguaugugggaaagggauuuguaggggacaguaaggguaauaggcugggagagaggguggguaguggguuaugaugaucugaaugcacuuuagaagugaguggccuugucaaagaaaacaguaguaacaguuugugcacuagaggaggccugacucaugccagaguuguccuucggccuuccuagccagcacccccuugugaagacuacuaaccggucuguucuccuucucugccucacagggccauuguggcauugguguacaacguguugaaggcauuuauggaaaugaacagcacuauguuugaugagcugacagccacauacaagucagaucgucagcgguaacuuuuuaaagcucuuuugucugcugugcagaaagcuaugaguccuacccagcugcacaucagaucauaaacagcaguuucuuuauuuaccucuucucucugcaugcuccuuagcugugccccauuaaugcaccacuaaguaagaagggguuguaauggugugguuuugaugaagccugcuaccuuucucucuucauuuucuguucuaccacaagguuaagagccuggcguauaacuaguccuucaggcucacuucagggaaccaugagguaguuaggccugugggcugacuccugcugcuaacacaccaaaacucagauuggacugaugggcuugacuccagcucaggagaggccaggcacuauuuaauccagaacuucuugucuagucuagaaaccaacaaagucaucacaacuuaagagagaagugaagagaauauaggcucuaauggucuaguauuauaaaauacuaaaguguuuaagguuauauuuuuauuuacaugguucucccauuuuguuuuuauauuauaauuauuauuauuauuugauuguuuuuguuuuucaagacaggguuucucuguguagcccuggcuaucucagaacucauuuuacaguuuagggugggcucaaacucagagaucugccugccuccgccucccaagugcugggauuaaaagugugagccucuaugucuggcccaaguuuuauuuuuuauccaguauauucaacuucccaagagaggguuucuguugcugugaagaggcaccaaaguaacucagaaguaaccaaaguagcucuuacaaaggaaagcauuucacugggggacucgcucagauugcagaggcuuagcccauugucaucaugucaggaagcacugcacugcacaggccgacgccaugcuggagaugagagucuguaucuggauuaccaagcaguaggcagagagggacacugggacuguuuugagcauuugaaacucaaagcccauccuccaacaagaccacaccuccuaauagugccacucccuggugauugcaccuucagaucuaugagccuaagaaggccauuccuauucaaaccaccagagagauaaugcagagauuaaggaaagcacaaagagcucuuuggaguuggcucucuggcuugacugugaucacaugaauguaggucauaaagcauggacuuaaagagccccagagucggugugugcguguacguguucaugccuugggcuuguugaaccccauggaaggauggugucugugauuuucuugcuucuuugcuuccccuuauuuagaauguguuaguuguguuuuacugaggaaaggggcaaugaauaggacaguuuggggacagaggaccaaggacuguggccgagauauguggguuacacggaacaguuuaaucacagaauaugguuuuaauuauaguauuauuuugagguaauauuaauucuguauuauacuugaaaccuaaauaacuguuaauacaucacguuuucaaguauuuaaaauuacuaaguuuguaauggcccuccucacucuacaauuguuaaaaaucuugaaaaaaauuguuauuauuauuauuauuuuaaaaagggggcuaagggagacuagaaagaugguucagcuguuaagaacacuugguguucuuccagaagacccagguucaaguccagcacccuuaacagcuuccaaaaguuguaacuccaguuccagaggcuuugauaugcucuuguggccuccuugaggaucacgcaugcacacaacacucagacguacaugcaggcaaaauacucaagcauuaagaacaaaaacaaacacuuaaaaagguagggauuugcuaagggaauauuggaauaccaugauaaaccauuaaauagugcuuagcauuuguuagggcaaaagaaauuucuguaacuguuacuauucuaguuaaacagagauuaaaucuaggcaaaaucuuauuaagaauauugaaggagcuucaguguaauuagugguaggauguguuuggcuggcauaugcaaaggcccugugcuugauuuccaguaucaagugugugugaguaucaguaugguguguguguguguguguguguguagauauacacacacauaaacacauaaaaccugauuucaaauuaacugauuucuucaaugaauuucuacaaugaagcuguuuuguaaucuuuuaauaucuaagcucacuugaaaguuaaauggauuuaccuaaagagcaaagaacagacagaaacaugaaguugauuugguaugcuagaauguuaaggugguucuuagugaauggacuuucuucauggaaguuguuuuugcuuguuuguuuguuuuguuuuuaaaaagcagggaugauaauuuuaccaaacaaacaagcauacaagauugaaccaagcagauaaaguauggguuucuccauagaaaugacaguaacuguuaauuaguaauugaacaugaauguuuggggcugugacgagagagccaaaugugagcuuauaguuguugaugacaggaagcuauggcuucaguucaaaucagauuuuaaaguaucacaaaucagaauggugggcggggugagcuucuaaggguggggaaggcagcgcuggagcugugugagggagacgggaagaguucgacaaggucccagcacuguggugugcugaggucuuaagauucccaccgacagagagagaccgggagaaauccaucagggcucugcagacucuuagcagccaggcacacacauguguaaucccagcacuugggagguaggaggaguagaggcaggaguagagcaggagcaucauuaaugaguucaaggacagucugggcuaccggagacccuugucucaaaaaaucacacaaaacaaaaaucagccaaaacaagagaaauaucuaaaucacuauauaauuccauguauaugaaaggccaguagaggaauauucauagaaauagcagagcaguggcugccaggggcuggcagagcaugugggcagcaugauuucuucucuggggaggaugagaaugucugaagcugagacuguaaguuugaaagcagcaugguaacccagccauauauucaucuggagaaggacagggugcacaggacaggucauccuccccccuagauccgaugagcuugagggagcagcuuccgugagaagaugaugaugccagcuagauuagggcagugcgaacugccaugggaugcgcugcuuuucagaugaaaaaguucccaaggaagucauuuaaacauugcuugagccauguucuucaaucaguguucucggagaacauuauuuagacuaauaacaucuccagauuguacugucaagcaaaugguaauuccccagcagcuugcugacaaccgaguguccagagucuagaggccagcaggccccuuccuagacgcucguauacagucugcagcuuaggcuagccuugaacuucaagugauccuccugagucagcucugggaguuugggaucacaugcuuaaaucuuuuuaaaaaguauuuauuuuuuauguguaugaauguuuuguguguguguauguguguguguauguauguauguauguguguauauauauguguguguguguguguguguauguguguguguguguguguauguguguguguauguauguauguauguguguauguguguguguguguguguguguguaugugcguguguauguauguguguauauguguguguguguguguguguauguguguguguauguauguguguguguguguguauguguguguguguauguguauguguguguguguguguguguauguguguguauguguguguguguguauauauguguguguguguguauguguguguguguguguauguguaugugugugugaguguguguguguguguguguguguguguguguguguguguguauguggcuaguaccugcagaggccagaggaggacuuuggagacuccuggaacuggaguuauagacauuugugagccaccauguaggugcuaggaacugaacccugguccuuuggaagagcagcacuaggcucuuaacugcagagcagucucuccagugccuauaauaguuguuugaauaaauuucaacuuuauuuuuuaaaaauaaaaacuaaucuauaaggauuggagacuuuucuaaucuugcccaguaugccuauaaaugcaguuguuuuagaucaaaauuauuacauaaaggaauguuugaaaaccuuugugcuugcugaaguucacacuguguagauuacauuuaagauaaccaaacauuaaagaaguucuaaauugcuagauuauuaauuaugaaguaaagcuacagaugacuuuguugaaugauucaaugacccugcaagugaaaugggaaugucagauuauuuggguuucuuuaauuaaaaaaaaauuaucuuaauucaaggaagacgauaauuacuuuuuauuggcucaaggcuuuucuuuuuaaauguugauauauuuuucuuuuauguauaugaauguuugucuuccugcauguuugugugccacgugccugccuggaacugaaguuacaguugugagcugccaugugggugcuaggaauugaacccagguccucuggaggaacagccagugcucuuaaccacugagccaucucaccaguuucuucuuccuauuguuagauaauuuaauauaacuuugcaaaguauuggugauuacuaaaauaguguuuagcauuggaauuccaugcaaaguugacauuauccuuaugaauuucucuaaguaaaaaacauacuguuguugaauaagauacgcgagggccaguuccuugagucugaggcuacaaaacuccugugcuuaggaguuguuugaauuugugaauucacaguguucucuuuucaccaguucauugcaguaagcuagagguaaugaaaugaauuauguuaguagaugagaauucaugugaugaaauauuuuuaauaagugugaauguuuuuaauuuauuauauaguuuuguguucuuuguguacuuucuacuucauugauauuaaaacuuuuuuuuuuuuauaaaaaauacuguaguuucaaaaugccuuuggcaaauuuaaauuguuugaacccauuuuggcuuauccauugugguaaacuuugccaaacaaugcagucugaaguucuggaggucacugguauuaaccacauauugguauuuaauaaccacauuuuaaacuaaaauuguuauuuaaccaaguuugaaggcuugcucacuuaaaaauuuuaauauuugauaauaccaguguccaaagguuuuaugcagaucauuaauauauuuuuauaauuuauaaauauauaacauagauguucugaucguguguuuucagaaaugacgaguuucuguauguacugcaugggaaguagacacaaguaaagaagagaauauguuuucuggauuuugccuauugucugucagugucauuuucagccucucucucagaguuuauuugggaacaaauagaagguuggguucuaacaaggcccugagcauuuaaaagucacuaagugcacaguguuaagauauaugauacuagaaaucuucucuaguuuuguuuuguacacuggguuauaauuuauacuguaucacauguagaggguguuaauguaaaccuuaaagcagacuuguuuugcacucuguuuguuacugcugcuucuguaucagggagugucaggaaacggcaagaagcugucugccaacugcuccagagcugcauccaggcgucugugagggaaaggcuguuucuguuggguacucucaucaaccccucaguugcuuacaguguuuucuguuucuuccccuagugagaaaaagaaagaaaaggagcgagaagaacuguggaaaaaauuggaggaucuggaguuaaagagaggucuuagacgcgaugggauaauuccaacuuaacaacagccugacagcgacacacuaacccgugggucacacgcuuauguaguagaaggauggagcaacaguuuucuguauugugcaacuuuacaguagauuucacauuugucucauuauuacagcagcacuguauauaccugucucuaaguaaaggaaaacauaaggacuucaaaguguggacaguagauggacucucagaacuuugcaaacauaaucauuguucuaacccucuuuaaaaacaaacaaacaaacaaaaggucuacagagaucugucggggaaauugcuauguuaaaauuccauuaucaggaguuccuuauuuaucacuagcagagaguaugauacaauuuucaaaugugaacaaucuuaaauuuagcuugucuuucugcuaagcuguuaaauguauuuauaguaaaggaagaaaagauugucauuucuuuauaaguuuguauagcgcccuccucuggacaugacuguaacgugauauccuuuccuuuugcacaucuucaugagucaaguguccacauggaccggggcugugagucagaggucucugaggaaagguugucugcuggaugaacaucuucccagcugccagguccugguacuccuuuaguuuucagauuaggaguaaaaagaagaggugauaagcaugguagcgaagggaauguuggacuucauaucagauauggugaguccaaaucagugucuugaauccuuugaaaacaggcagugggacgcgcaggcuucagcaccugcagcauuagcugcagacauaagugugcauccagaccagagacaacuuagaaaugucagagaacauccuuucggauccuguggaguaagagagagagcacuaagcgauagaaccgugaagccgagcaccaggaccgcgcauccacuugggaaccgaguugagcaaacagcaugaacuguuugcaguugaugccuuacuuccuaauguguacuuacaaaguauuucagcagaagaggaugcagggugcagccucugggaggaacauccuccuucucuagcucaccacagcgccagcccuguuuuuagccagaaaggauucaggaucaacauuaugcguucugaauuggaugcauauuccuaacuacuguauuuguuaccaaaagugguucuacaaaugcuacugaaaaaaaucuggaaauuccuaauguccugaguauuaauaauaaaguuuaaaaaaugcuuuuauaucaaaggugcaucgugaccaaauuguuuaaguuaaaaacaaaacaaaaccaaaccaacccgagggcugugcucuagcugggcuuacugucucuguacugggucccccuggguagguaaguugcugauguacaggugugcaguauguauucacccgauguguugcaucgcuguguauuggcaaguguguguugugggguuuguuuccaggaagcuuuuucuuguuagagacaggacaguggugagcccauaaccccgagccaucacauccagcaguguucauggcauagagccgacucuguguucauauguugaguugugauuauagcuaacaugaacacacaugagcuauuguugcucuuaguagaaauacaguauaaauaugggcuuguauauuuucuuccuuccuuuuaaauguaaaguagaauauauagagcuuuguuguuuccaaggaaaaggaggggaaaagccacugaccuauuucacuuaugaaguauuuccagauugucagucacaauguguacauaaauguaagcuaauuauggauauuuucauuuagguaccuuuguucucuuguuuuuuaaagguaugcguaccaccaaguccaagaugguucaguggaauaaauaggacucuuaaagagcguuaaggaggguuccaucugaggaccuggaaagugugagcagagcugcauguucacauauugaugcuaagaagcaaaccauagcacaucucccuuagcugucuuagccguuuccaucuucauuacacauaucuuugauaguguagaccuugcuugcuguggucccucuggggaugacaugugcucauuugacaugaggaaggucaggaccucuuucugcaccguguccuguccucagagcuaagggucaguguugucuguuggucauucccaacugagaggaaugaagcuaagcuuuagacuauuuaaagaugugaugagagcugaaugucagaacucacagggcaaucucugagaagaaacacucauuucccuuuuaaccaaaagugacaaugugaccucugucauguuguguguggugaggagaagcuagcccaggugacuugauuguugcacuaugugacauauuuaaggacauacuugcugcauuugcagcagccccccugucugaccucccugggcaauccugcugucacucaaugugaguuaacugugacaaacucagcucuguguuauauuuuguuugcuucauaguuuccagaacuauauauaaauauauuuuuucaauagcaaauauuguaguuagugaguggugaccacuucaaccuuaucccuaccauauugguuucagggaugggacuaagaauguccuuggaauaaaaaaauuaaaauauaacccugugauuuagaaugaugccgagguugcagguugcagccugcagcagcugugugagcgaagugaccgucuccucuggaucaagcguccacuccucauugugcccaggccccagugcuccuucaucacuguuuaguuauuguccgcugugguuuugauuauauuuugcucuuccugacauugacuguuuuuuuuuaauaaaagaaaauaaaaaguaaaugaauaaccccugaaugugacuggaugcagggauaagccccucccuccuccuugggcucuuucccuaaguggcaggaucgcgcuggcucuguaucucccgugcgugcggcaguccaaggugcagaccuagggagcacuugucaucacaccuccuauacugaacacauaacccuaggcucaaucacuuuauggaaagggaaauaaaguagacuuuauuuuagggauggagccggggagugguguguggaugggaggcugguaucaacaucacuaaguauuccgaaggucuucuugcuuuguuuuuccauuuuaauugauacacugaccuggcccaggaaaggaagagccgcucuccuuugauguuauuagccaacauucccacaaagugacggucaccugucucagaaaggcaacaggagauaugauccgugacauuuuauuugcacaugaauauuuuauuuuuguauucuggcucagcugcuucucuucguggaguuagggaggagccauaaaggacuuuuguaauaaguaauauuggcaacgcauuuuauacuccucuauguuuacuuuugagaaccugaaagaaggggugugcguccgagaggagggugagcggagcuugagccagcggaauguuccauuugucugccgcuugugcacgagagcggccagcuguagcgucuccuggaaaccaacgccccgugcuaugacgucugugagccuagguuuccuuuccuccccucccuucccccauccucuccuccauuuucuuucuuucucaacccaucccuuuuuuuuuuuaaaucacuuacuguaaauaaguuguaaucuaaaccucauguaucaauggggaaauuucaaauauaaauauuaccaacacguuuucuuguugucuggcuuuugauuggaguguaaugagaauggcaugcccaucuccucaggccugaggguuucaucucagcuccagccucuccucucccucauuucauuguuguggcaggagagggcagcacacguucauuuuuccccccgcuaggaagccacaguguuagcuguggaugaguguuuuucuuaaguuuucaaaacauccguuggugcauagaugugaaaaugaaacaauaugaaaaguugcauaugaaaaaugacagacugguuuagccaggcagggaagccuucugauccacuucaaaguaaaaaauuacccaagacacuuccagccccuguugaaccagacuucuuccguuucaaacagcaggaugcagguggcagcuuacacacuuggaaauaagcguucaucuuugaaaauaauauacucucucaaaagugguuacagacuaagcagaggugcuccccaaagcaauguaauccucccguugacagcuaugugagauucuguacugugggugucccuaauaaauaagcacugaagggugc

SEQ ID NO: 6697 - RNA, 48070 nt, Mus musculus
auuuuuuaguugaaauguugcaauuuuauucacaauguagcuauuuucugggugcuguaggaaacagcuguguauaacuucuuaaccgcauauagagguagaucuugcucacuuggccugaccaggcucacagugagaagccaucuuugaucuuuuagaaauuucauaaauuuggacgacaagcuucagccgauuaaugacauccuugucugcuguuuucauguuaaaucccagcaucuucaugauggcuucccggaagucagcaagcugaaaagaaccaccacacagaucaguaugcgacugcugagccgcccacucaucuuguacgaugcaauugguauacucugcaauuuagcuuuaugaaaauuuccuuaaugcaauaugucuaagguaguaaaggguccugcugugcagcuaagcuagccuugaacccaccuucuuccucccagucucccaagcacugcaauuacaaccuggcuucacgccaugugguauuuucaagguagaaaaauccuuucuauuuacaagaauucuuuaaaauuuccugugcauuuuuaucucuuuuucucauuuuucccaauuuuauuacuacuuauuauauuuugcucauaauguaauuacuuucuuuuacauuuauuuguacauacauacaugcauguggaggucagaggccaucauauuuauuuauuuauuuauuuauuguauuguauuguauuugaguacaauguagcugucuucagacacaccagaagagggcaucagauuccauuacagaugguugugagccaccaugugguugcugggaauugaacucaggaccucugcaagaccagucagugcucuuaaccacagagccaucucuccagcccccagagggcaucuuucagaagucaguucucuccuucuaccaugugucuucccaggauugaacacaggcuggcaggguuaauagcaagcaagcaucuuuacccacugagccaucuuggcagcauguuuuuguagccauacuuuuuguguucuguuacucagcuuagccuuauaauuccugggcuggagggacucaugagccucagucucccaaacuggggacugucagcaugugcuacuggguuaacaaacugccuuuugagcuacuaauuuguuuaaugauaauggccuuccucaaugcauauuucucaauccauucaaggccaaagagaucaacaaggacagcaaauaagaaaacagccgcaaagcuaacagaaaacuacagcuuucaccaugcccgugaggggggauauggauaucccaagccagcagaggcagcaccagagggccauaaacucgauuuccacugguguagaacacagucacaaugccaagaacaagucugagccccgcaggaucagcacacugaccuguggggaaugaaaagguuugagaccaguaauagugacucuagaaaacagaguuucugcggggaggcugcagagugcuugcaagggagaggcagcuagcagaaaagaggaacgauggaacuaagggauaauauaaaaagaguguuacagaaggaaaugucauacacacccucugccuucaaauaaagacuuguaauacuugccccuguaauaccagccacaguucaaagucuuccugggcuacaaaaggaguuccaggccagcucugacaacugagugagacccugucucaggagggaaagguuaaggacuggguucagaggucagaggcagugagcuuuccuagcaucugcaaggcccccugcagauaccucaaaaaccagaaaaguaaagagcacccuugcuuuaacaacagaagagggcagugcucagcuggaaauaaccacguaucuuaguggaaccaaccguggaaggugcucuaaaccagaaauguggagagagcugggcaacugcaaggguuugaaugugaauggggguagagaggcugcucagcgcuuaagagcacauauuccucuucuagaggaccggaguucaagucuaagcauacaugccagguccugaguucaauucccagcagccacaugauggcucacaaucaucugugauggauaggugacucuggccucagcgagaguaccacacauacauggcguaugcucacacagacauuacacgugauuaagaauaaaguaaauccuuugaaaauauaaagugauagacaaugguaaguuauauggaacugcuuuaggacagaaaugaaaagacagcaccauucuaaccuguucaggugauaaaaugcaucccaauacaaacacauacacacacauguacacacaaguacacacauacacgcacacauauacacacaugcauaugugcacacacauauacgcaugcaugcaugggcacacacacaacacccauggaccaugacacccauguucagaugcagcacuuuggcagaaugaaauuaucaauuaagaaauuucagacacggagaggauauuuuaagacugaaguguauuuggaauagaguuggcuaaagacuaugaccaaggggucucuuggauagggauggcugagucaagaaauagcugcaggaaaucgccucagagaugaagcauaaaagagcaugcccaagaaggagagaugugacugacgguccugaggggacaugugggagcaaaagcaagcuagaaaacacacaugcagaaaagagaaaacaguaaagagaaaaugccagcauggcuaccugccaguguauccuacaacaauggcucaauuucuaauuacuuaagcaacuacuauggaaauacaacauauacuuaaucgccccaaacuaucacgaggcccccuggguuugacccccaauacuaccaaaaauguuuauauguuuugcuuuauaaauaaagugauguuaauagaaacucucagaaaaaaaaaaaagccauaccuauguuaaacauuguacaaggcugacucuugcaggugcagagacaaauuauccuugcugucuuguucucuccaguaacauuuacuguccaucuuuuugugacuauuagggaaacucuuuuagaauguacaagaggccccuugcucccaccaaugcagaggcuaagaauggcaucaaauagcaucugagacggaaagcagugauuuccgacuucacuguacaacaugccuaccugaaacaaacacgugccugugguagaaccacuugaagcuuaucucugacuagguuacaaauaaaugagacucagacuaugguuauuuuauuuggcuuugacaauuacugaggggccaccccaaucuacuuuucuaacugcuggccuggccaccucccccaucgggguaccccagaugcuugcuguuucuccugaccacaugcucacgguccaucuccccucauggcagccuccucucuccuccccucguucuuccuccuucuccuccuggucuccuaacuccucugcuucuccacucccaaccagguaacucaaaacccaccuauuccccccagugauuggcuguaaccaauuuuacuuagccaauaguuuuaaaucaaggaauaagguuugcacagcaaaagcuuguaaacuugagaagucacucuaugguuaucuagaccuuuggguauggacuuuagcauuacaacauauagcaacagaacaaaccucaacauguaccgauguauuuuaacagugggggcuggagagauggcucagugcucaagcacccauauggcaauucacaacaaccugugacuccaguuccaggggaucugacaccuucuguccuccucaggcaucaggcacacaugugguaugcagaauaagugcaugcaaaacacucauuagauagauagauagauagauagauagauagauagauagauagauagauagauaggcaggcugcagagacgaaucagugguuaagagcccuauccaucuccucuuccagaggacccagguucaauucccaacacccacaacuaucuguagcucuaguugcagaggcucuaauacccacuucugggcuccaaaggcaacagguacauacacacaugguguauauguauacauacaggcaaaacacacacacauagaaaaauaaauaaaauauaauguuuaaaaaggucuugucaggcaaguggcauaugccuuuuguuggcauuuugucuaagcucgaccccacaguuaccuggcaauagccaggugugccugacucacuauaaaagggcugcuugcccccuccucucucuuuugcccuccugcuccccauuccccucccccccuccacaugcucaugccuggccucuacuucucuccuuucucucucuccucucucucucucucucucucucucucucucucucucucucucucucucucucucucucucuuucugccuuuacuacccucucaacuccucucuccaugcccugaauaaacucuacucuauucuauacugucauguggcuggacccucaggaggaagggaugccucagcaagggcccucagaggcacccccuucccccacaccggacugcacauccaccaaacauauuuccucuuuccuuaucucuuuauaaaacacaacaccuuuaaucccaacacuugggaggcagaggcaggaagaucucugugaggucagggcuagccuugucuaaauagagagcugaggccaacuaagguuauauagugagacacugucucaaaacaaacaguaauuuaauaaauaauaacaauaaaugugucuuugauuuauaauguucuuuguucuguuacuauaaaaacuucaugaaacugcuagcgcgugggaacaugguauuugggguaggcuaagccauggucacuugugucugccuucagaauauguugugucucuuauccccuuugaggugacagccauggguuuuaucucaaaacagaaaaucuaggcauguuuggaugugcuagcccaaggacugugauauagaacauaaaacacgguuuccuaucugauaugcuucgaccauccuaguuagagauuguguacccaaaccuaagcuaaaauaagcauauauuccuggcccuagccauguuguauuaacauggagacgcacuugacccaaccugggguuauggcuccugucacagacccuaaacauaaaacuacaugcuucucaguggccauguuuccugucacaugggaaagacagcuguuauugaaacagacaagcugucucacagacacgaagaagagaaggacaaaggccuugucauauauuaagugcuguugcugguguaugaggacacaucuacccuuccgagaggcucaguaguucaaaccaucuauaaugccauuagcuaauaaauccuuuauugucaaaguuaggugaagucuaaauugagguaaguguugaucacgucaaugaaauuaguuuuuagcuucauaagaaagagaccucuugcucucguccugagagcccuuucagcacagcccugacuguggaagggucuggaaggcucugggcuggcgucuggugggcccucuccuuuucuggucuugcucccugcuccgcaggaucugaugggguuuucaaguugucuguuuuggcugcugucuucucuuucaagguuucaacuuuuguuacagauugccugagccucucaauuguuuuguccuguguaaggauaaaagguaaggggaagaaaaugugcuuagauuuucuggaaauaacagacaugacaacucaucuuucuuuuuucugaggcagggucucacuguguagcccugacuggucuggaacuugauauguggaccaggauggccuugaguuucuagagcuccucagcccucugucucugagugacgggauuaaauaguugggauauaacuccuggcucacaugacuuaaacacaaaacaaaacacgggaaccgggagguggugccuuuaaucccagcacccaggaagcacaggcaggcggaucucugugaguucgaggccagccuggucuacagagcaaguuccaggacagcuagcacuauuagagaaacuuugucuuaaauacaaacaaacaaaagcaagauacacauccccccccccaaaaauaccaaacaaacaaacagacaaacagaaaaaaagaaucaaucuaggguuggagagauggcucagcaguuaaaagcacugccugcuuuuccagaagccugggguucaauucccaagcaagcacauggcagcucacaacucuccauaacucugagaucaaaagcccucacacagauauacaggcaggcaaaacaccaauauacauaaaauaaaauaaauuacuuuuaaaaaauacauaggaaaaaaaccucaucagcuucugaguuaaaagaauauuucuucauuauaguauucauuaauaaccuaucuuauccuagcaauucuauauccuagacauauagaauuuaaagaggcuucgcacauuuucuguguucucaaugauauuauacucuacauuaaauaucaaaaccgaaaauaacugauuuugcaguagagaaauauugaugaacggcacacuaguuggucaauuauuuagugcauguuugacuuuagaugcaacuaacucuaaaacaguauauagcucaaaaggcuagaaggcugaaaacagaaagaaagaaaaaaaaagaauuaauuaaaaagaaucuuuugacccaauaaaauacuauaguaaaagccaagugugcauacuugugaccucagcaauuuauaggcugaggcagggggaucgggaguuucagaccagccugagcuauugggugagcuccuuucucaaacacuucauuaaacaaaccaagagaaagggcuggagagagagcacagcccuugggagugcucacuucucuugcagaagaccuggguuugguuccucuaacccacauuacggagcucacacccuccucucacucugguuccaagggaucuuggaaugcccucuucugccucugugggcauuugggugcauauagccaacaaagucacguaggugcaugcccauuaaauaaaaauacauauaaauaaaccuuuaaaaccgaaaacagagagcuaaugguuucuaguccugacaguuugaauacuaguuacuuuuaagaaguagugagcuaugcuugggcuucaauaggaaaaacagcauuuuaucugguagcuucacagaugcccaauuuaugaucacuuagcagcgguucucaaccucuggguugugacccccgugggggucaaaugaugcguucucaggugauguuauuacaguuaugaaguagcaaugaaaauaauuuuaugguuggggucaccacagcaugaagaacuguguuggaagggacgagaaccccugucuuauaggcuuuaauauuauuuuacauguaugcaaaaucacuauaagauuacagauuuuagacauuccuaguguguauaugcauguguguguguguguguguauucaugugugugcaugcaugugugcaugcauaugugugugcauucauguaucugugugucuaugacacaguaagugaccuagaagaaaugaagguguucaaaggagacacugugucucucaaucugacuaugagacuaucccaacaacaauuccaaagaaaugggaauuuccaaagaaaucucaugucuccuaggaggaaagguuauagaauucuaacagccggucagaccagugagacagagauccagacaaugaugggucuccucaaguggggaggaccaugccuugaccaagaaugugcacauuaaauaugcauauuuaaacucuauuuaaacugagaucucacuucaagaccccaaagauggacuuggggugagggcagucacuagaucucuuuguccuuuuucgugauguggccaaaccgaguaagucuuuagcuuuccacucuuaguuucccucuuuuaacucaacacuauuagccuggcucuuuuccaccauaguagucccuuucaccuacccuggucccucaagagcgcccccacuuuauucugcaagccacacuuuauaaugaacuaaccaaguaggaaguguaaaagcucacggggagacacaggugaaaacaggaggacaccaaagcucgggcgggugagcauuugaaaucccagccccugcacuuacuuuaaggacauuuauucucguuaguugagucuucauguuuuuguuugacaauuucaaaucacuaagcugcuucugaagucucuggauuuucuccuccauccuuggggcugcagccaucuuggaauucugcucaauauccaauaacaucucuaacuuuuugaacuugcuguguuuaucuaugugggcaguccggguccuggaguuuuccuuugagaaauuaacaguauugaaauugaaaacugugcuuuaagauguuguucugggugagaccuaaugauaauugcauagguaaaguaucugccagcauaaauauaaacuaauaaaauaaucaggaaaaucaaauguguuagcauagauguguccaucuuuucugggaaaguauuaauauauguuaaggauuuggauaaagagucacauauaucuugauacucaucauaauuuguaauagaaaaaauagaaauuguguaaaugucauaugagaauauuuaaaauaugcauaauauauauauguauauucccuacaaguuauuuuuaaaacaucuauuaaacaaaaauaauagagauauagcuaaauaaaaaauauauaaaagaaacugugcuuauuuuaauuauguuaagauauucagggggcuggugagauggcucagcggguaagagcacugacugcucuuccaaaggcccugaguucaaaucccagcaaccacauggugguucacaaccaucugcaaugauauccgaugcuccgaugcccucuucuggugugucugaagacagcuacaguguaccuacauauaacaauaaauaaaucuuuaaaaaaaaaaaaagauauucauagaauaccaggugaauaugugaaauaugugguggcacaugccuuuaaucccagcacucuggaagcagaggcaggcauaucucucugaauuugaggcuagccuggucuacauaguaaguuucaggacagccaggguuacccagaaaacccugucucaaaaaaaaaaaaaaaaaaaaaagaaagaaagaaaaaaaagaaaaaaccauagcuacauauagaaacucugucucaaaaguaugugugugauauauacaaauguauacauagaagaaaaucaaaagaaacuauuuccauaaaauacugguugucucaaaucuuggaauuuauuggugucuuggagguagguuuguuagacaggagcucacguauucauuccugacuggcccggaacucaucgucaggauagcccugaacuucugagccugcagccucugccucagcauguuggaauugcaggcaugugccgccaugccugguugauguguugcuggagaugggacccagggcuuccuuuaugcuaagcaagcacuuuaccaccugagcuucucaguacauguguuuauauuuuuauuaauuauauaccaccuuccuggagugucacauugagaccaauaguuuucuuucuugguauucugagaauguuggcuauuuuagaucugacuuugucucauuauacuguucauaauaauguauuucuuguagaugcccuccucucccucaucuuuuucuucccucuucuccucuccccuuucucuccucuuaucuccucuuugcccucucaccaucccuacuuuggaggaaaucaaacuaagguguguauguguguguguguuaaagacuuauuuauuucauuuauaugaguacacuguagcugucuucagacacaccagaaaagggcauuggauuccauuacagaugguugugagucaccauaugguugcugggaauugaacucaggaccucuggaagagcaagcagccagugcucuuaaccgcugagccaucuguccagcccccaaaccaggguuuuuaaacaugcaaugcacguguucuacugcugagguccaucaagagucccuagauguguagauuuauugccucuagauggcaaaauauccuuuuauaguuucuuucucuauuuauacaaauugucuuaguuacuguucuauuguugcaaagagacuucacgaucaagacaacuugugaaagaaagcauuuaguugggggcuugcugacaguuucugagggucaguuaugaccauuaugguggggaucguggcagcaggcaggcacuucaucagaacaguagcuaagagcuucuaucuuauucacgagcugaaggcagagagagacagggucuaggcccagugacaacuacacaacuagaaaauaaucauucaaauauaugcacccaugggggccauucucauucaaaccacuauacaaauauuauauauuuucaccuuccauaagugguuugccuaacugucuauuuuaucuuccaaaagaacaguuuacuaguuugacauauauauauuacagauaauuagaacauaauagacuacaauauaaugucauuacaauuuuuauaugccugagaaacaacaaaaaaaaagucaccaggcucaauugguugugauguucacuuacugcggugguaaggcaucacaacaucccugaaagaugcaagccuaaguaauuggauccugggagggcagaggcagaaagaagggugggaugauuauuacuguuuuccugggaccuuuuaaagggauggagaaaaggauugcuauuuguguuuucuuaaaauuuaauaaaugguuuaaaugucuugcauagacaugaaucauuacuguucaagagcagauguagaagguuugcucugagaaggcuaggcugacuccaugacagacuuaaaaauggcagaucagaagacaagguguuuacaagaacugggcaaauccaggcaaguccaguccucagaagcugcccugccaccuggccugaggcaaggacaauugggucagcagcaguuuccagauuuccucgggaacaguuuccagaccucccgagcaacaguuuccagaccccacugccugguaacgguucuggaaagucccuagaaauggagcaaaugaaggucaccuacccuggaauuccccuaaugugcuuuaaaucuggccugugagcucacuugguugucucucuaucuugguaaugagagaccccagcauacuggacuucugcagaauaaaacacucuuugcguuuauauacuauuugagucugggguaucauuguuccucaagcuuaaaugcuaugagguuaaaugucauuucagaguggagcguggaaugguggcacaugccucuaauggcugcagaggcaggcagaugucugaguaagagaccagcuuggucuguguaucaaauugcgagguuacauagugagguccugucucaaaaacaaaaacaaaugucauuucauaauauggagggguuuguuagauuuacuuaaucuucuauguaugaguacuuugcuaguauucaugaaugugccuaguaccugagaaggccagaauagggcaguggauccccuaaaacuguuguuccagauaguuaugagccaugauguggguuccaggaaucaaacccaagucuucuucgagagcaacagugaucuaaauuguugagcuaccucuccagacccagugaaagagagguugauugguugguugguugguugguugguugguugguugguugguuuuuaaaaaaaacaaaacaaaaaacaaaacucuucaagcaacaaaacaaacccaaacaaacaaaaaagaaggaagaaggaaaaaaaaaaacaaaaacugaaugaaaaaaaaaaacucccagcucuugggaggcaaagguggguggaucuccgugagaccaaguugguagcaaguuccagaucagccaaggucacaugauaagauucugauuccuggcaugccaagggaaaacagcuaaaacacacacugacagacaggcugagaccaacuuagucaacaguaagugaucaagagagauugcacucugagccauuaucauucuagaauuguguggaguagguuagcacacggcacauaauucaaugaacaauguugcucucccuuccuuccuuccuuccuuccuuccuuccuuccuuccuuccuuccuuccuuccucccucccucccucccucccucccucucucccucccucccucccuuccuuccuuucuucucucuucucccuuucucuaugcauaugcuuucucuccuucccuuccccuucccccugucucucuccccauagggacaucccuagcccugguuccuuaggaccagugaccucucccaccaucaguuucccaauaaaccugcguguauauacucuaaucuguugugaauugacucauuucaucagcuuauaaauaacuuuuuaaaaaaggcuaaaaacaaacaaacaaacaaacaaaaaaaccaaaacaaaacaaaaacaaaaaaacccggaaacuccuggaaauaaacuguagccauucccauucuuucuguuugccucuucccucacagauacauagaagcaggaggcagaggucagugguuuacacaggaaugagugaggaauaucuucagugcccccucagauacccaucaagucuacuugucacaauaccuugaauuccaccacuagggcauucauuugagugucuuuccugaucaucaucauuuaaaagugaauccagagaugucuuagccaggggaguugguacacaucucuaaucacagcuagacuaugaagacagaggcagggggauuauaaauauaaugucauccuagucuaccuugagagcuucagucuagcuuggguuauguuauacuguuaaacaucuguccaaaaauauauuaaaaaugagauucauauuaacaagugccaucauaaugcuuaucaaauauacacacaauagagaaaaagagaggaaagaagagaggauuuuaaaagaaaaucauaagcaauaaggauuugaagccgauuccccuuuggccauucucaaaaacauguguaagucagaugugguucacaucugugaucccagugcuuaggaggcugagguagggaugcuaagaguuugaguacauccaggacuauacaguuacaugcuaacacacacacacacaccauacacacacaccauacacacacacacaccauacacauauaacacaucauacauauaccauacacacacacacaugccauacacacaccacaucauaacacacauaccauacauacacacauacacaccauacacacacacauaucauacacacacaacacaucauacauacaucauacacacacacaugccauacacacaccacaucauacacacacacauaccauacauacacacauacacaccauacacacacacauaucauacacacacaacacaucauacauacaucauacacacacacaugccauacacacaccacaucauacacacacacauaccauacauacacacauacacaccauacacacacauacaccauacacccacacacacacacacacaccauacacacacacacacacacacacacacacacacacacacacgaaauauauaacuaguacaagcagcuuuaguaauguuaaagcuauugagaacacaacccaaaaugugauccuucucagagaaacaugcggccuucgggaagaaucucuuacuuucuuccugcccacaucuaaguuccucagagagcagcugacagcaaccuuuccuuccaggggucccaagggucuuuccuguuccguguaauuuucuucagucugggcuucuucauaaaggcgguagagcugcucaagucucuuggugagcgucuggauuuccugcugcagggcuucagccuucugcaacacacgacauuaaguaaaugcuucccaacgugccauucacgcuucccucaccaucacuggguagaugaguagagcugacauguacuuuuuuauuggguguguggguguuugccuacauguaugucuguguaccaccgucacauacaugcccaguguccaaggagaccagaagagacaucggaucccuuggaauuggaguuacagauaguaacuaccaugugggugcuagaaaucgaaacuggguccucugcaagagcagaaagugcucuuaaucacugagccaucucuauagcauuggcuguuuagauuuuugagccaacagcuuguucuguuagcuaggauaguccuugaacucacagcauuucuccugccucagcuucccaaauacuaguuaaggaucauacaucuggauauauuugucauuuuaagaaauaaguaggggcuggagagauggcucagcgguuaagaacacugacugcuuuuccagaaguccugaguucaauucccagcaaccacaugguggcucacaaccaucuguaaugggaucugauucccucuucuggugugucugaagacagccacaguguacuuauauauauauauaauaaaucagccuuuuagaaaacagaaaagaaauaaguagaaaaaaucuuagcacacaaggauaagauauauucauaacaugaaauaaaguuguuuaacaauuuuguuguuguucuuugugacagggucuucauauguagcccaggcuacccuacaacucauacucuuauccucaccuuggauuauaggcaugugcuaucaugccuaacuaauauagugcuaauuagguuaauauuuauugaauguauacuaaacuguacuaagcauuuaucaugugcuagcccauuuaagcuuugcaaccaugcuaaaaaguaggagugacaucucuuaacuccaguuuacaaaugcaacuaacacaguggacauaaauaaccuucccaagaacacacagcuugcagaugguggagccauucucuggacucuguaggcaugcacacaaguagcauauauucacauagacacaugcacauaaacaaaaauaaaauaauaaaaacaaucuuuaaaaaauuacaaaugacgagucaggcagugguggcacacaccuuuaaucccagcacucaggaggcagaggcaggcggauuucugaguucgaggccagcuuggucuacaaagugaauuucaggacagcuggagcuccgcauaggaaucuugucuuggaaaaauuacaaaugaagccaaagagcuuacuaguuggcuaaugucaaaaucuacauauuaaacuaauaaaacugggguucugagaagacucacaggguaaaaugugcaggcauaaggauccaaguggcaauacucaucucucauaugaaaagcucguguacaucugcaaaucagguacuagaggcaggcagaucccuagaccccacuggucaggaacaagcccagguccgccucugacccccacaugcacugguacacauauguaugcauaugcacauguuuaggugcacucccacaagcacauacauuuuuuaaaaaaauauucagccagacaauagugguguguguccucaauaccagcagaaggagcucugugagucugaggccagccugguccacagagcaaguugcaggacagccagggcuaccuagagaaacccugucuugaaaaaaaaaaaaaaaaaaaaaccaaaaaaacagagagagacagacagagacagagaggaagagaagaaaaaagaaaggaacaaaaaaggaaaaagaaaaagagaauuaaauuggaaaggauaauuuuucggagcacacucacgcauuuccacgacuguucauuugcacccauuuccuggauccucucuuucaccgcuuccucuguggcuaguauagggccgaugcugucacucaggagaguggccaacugaccgaggaaauccuggugaugggauugcucaggugugguuucccagccgcaggaaaacggagcucuguccaacucagacguuagcuuuucuugguggaucaaaucuugcugacauuuaucaccaguaguuugcccaucaauuggucccucagaguaaacaacacugccucucuucaaauuguagacuucaucauuguccugaauguaccaacacaaggauuaaacuucccgcuugaaacaauauggaaagaucuaugucacuucuuaugaacugugaacucaguaugaacucaccaccucaggagaaaggguccuaacuugaaacauuagcaucucauaagaaacaagggcacugacuuaaaacggcaagaaggaggaaccaaaacagcccucgugagagcaaacgcuacagaacacucaaggaauuuuaaaaguuaucauuguauuuuauuaugucuaauuaucuuuguuauugucgugagggaggcggccugugccacuguaaacauauggagaucagagacaaccugcaggaaucucuucucuccuuuuaucaaucagacuuccacaaaaugugccuuuaccugcugagccugcacacuggcucuuuguguguguguguguguguguuuugauuuggguuugguuuugguuuuguuuuuuagccgggguggaggggaguaaggaggggugagagagguguuugguuuagguccaaucagaggacugaagcacauauuuuacauaucaaagcagaccuggacuccagguucucccagcaucccucagucccuauuuggcauacccugcccccaaucuugacuuuccgguccaggggcugggcuacccuucccccagagacuccucuucucucucugcguguauccccuuuuuuucucucucucucccuccccacccuuuuccccauggugacuucccuggccugugaacucggcugccuaagagcagcuucccgaugaaccuggcuuuaaucuaaucuaacugggcuugaacuggcuuauuucacuggugguguugaaauaaucuaucaagagggucuugcuguauaguccaagcuagaaauucuucccuagggcuggaauuacagccauaugccaccaugcccagcuggaaaugauuauuuuguaauuccuaaugaaauaacugauuugggcaaggaucaucagugaauauugaagccauuagguaaagagcugucaaggaaacauguuuucaugaagacuuauacucauguagggcugaaacuguagcucagugguagugugggugcuuaccuaaccuucuagaggcccuaaauucaaccccuaauacuacaagaaagaaagaaucaaugcuuaacaaauguaacaaccucaauaauauaagcgaaagaagucacaucucuuccucuuggccuauuucuguugcaaagaguccagccccaaugcccagauaaugguuuuggaaugucucuuaggagauagaacaggauaaggucaccaagcccgaaaucccccuaaugugcuuuaaauugagccugugagcucacuugagggucucucuaucuugcuaaugggagaccccaacaugcuggacuucugcagaauaaaacacccuuuguguuuacacacuauuugagacugggguauguuuaugcagaugugcauggcugugugugugugugugugugugccagaaggugacaggugugcuucgcuaacacucucugcuuuacuccuuugagaaaggauauacacugaaucugggagccagaaaaccaccagacuuagccuuuucugugcuggggaucuaggcaugccugaccaugccugcuuguuacacggaaguuaggauccccacacuggucuccugcuuacacggcaagcuuucuuaacugcuggaccaucucuuuagcccuuggggauuuguuguuguuguuguuguuguuguuguuuuuccaaauaggaucucccacauuaacugagccacacagguccugguuuuacauaguaacuugugauaaucugaggagcucacaauaaacuuucacagcuccacugcuaauggucugccuucuccccagugcacuuccuucuggaagauccacagagcuagacaucaauggccagagcugaugacuggucaagucuggucuacauccagggacaggaagcccgguguguucagcagcagaagccagucuggacaagaagacuccaaccucucacuuccucaacacaccuccccguaguccgcucauggccucauuccuugccuccaaaccuuccuguaaaaucacggagacccugcaguucuccuggcagucccgauggcuuccuccacgcuuuggaucuuccauccacaagaggacuggcacccuaccggauacuagccuuuuccugggggggaggggacggacacacagucuaaacugacucucaccuucacugggaaaauauccaaggaaucuuccgguccuuucagauucauauagggcgagaagcugcuggggcaggaccgccucuucuccagaagcuccgccuuaaucuccucucuucccaccagauguucccuggguagaacaacaauggucaacaacauaaagaagccaacucaaccgauuuuuaauaugacuaaaauaauuacuuuuugagacaggcuuucucuguguaacaucccugucuauuaccgaacuuauuuuugcaguccuggaagaccucaaacucaaaaauaucucccugccucaguuucucgaguacuggguucaaagcccaucucuacuuuuuuuuuuaaauuucauauuuaaaauacauuaaaaauauagccacaucacagucaagcugcuaccaauuaaaaacagcaagaagacaggcaugaguuagcuucaaagagcagagaggcaguuggcuugcuuuccuacagaaauaauaaaugucagaugagaacgccuaucauuccccuucuauugcuaaaggcuacaaccaaaagcaaauggggagaaagggcuuuucugacuuacauuuccaugucagaggguaucaucaaggcaaggcagggaggaaccaaggcaggaaccuagaggcagggccugaaaccgaggcccuagaggagugcugcuugcuuacuggcuugcucuccauggcuugcuuagcuugcuuucuuauccccaagacugguggcccaggggugugaaacugcccacagugggccgugcacucccacgucaaucaucaaugaagaaaaugccccacaggcuugccuacaggcccaucugaugaagguauuuucucaauuaagauucccucuucccagauacaucuaaguuuaugucaaguugacaagcaguucaauauuuuaaacugcugagagaugggcuaauggaccucuauugacuucaaggccagccuggucuacauggcaacuuccuaggcuauauagugagacccuauauaaaauggggagagggccagagaguuugagagggagcucgguggcuauacuuaacgcucuggcagaggacugggcccaauucacagcacccacauuggguggcucacaaccaucugaaacuggcuggcuccaggagauccaacuuccucauguugguaagacuaugcguacacugugacccugcuugaggauguaaaaagugcagcugccucuguuggaaagcaauuuggaaaugccuuaaaaauaacuucaaagaaacuagauguggauacauguaaucccagcaugugggagguaagagaauuacaguacaaagccacauuccaggagacaggauuagaggccaaccugaacuauaaugagaucccaucucaaugcaaaccaacaaagcaaguaacaucaaaaaaauuaaacaauugcuauauagcccaacaauaccugaggggaagaauuauguagaagucuguacaaggaugcuuauagcaggauaugucauaaagcagaaaggccccuagaacuaaaccacaugucuuucaaugcccaagacauauaguucaguguaagaggagcuaggguacugauuaaugcuacaauccaggagaguccugagaacauugugguguaaggguccaaaaauugcugaaggaagaccccagacucagauaauauggaaaauaaagaacauuuauucugcaggaacaaccagcaugcaggggucaaccagucuuugaaauggcaaccccagauaaaggcauacaaguccuucuuauagggaaccaggggaacugucuggaaggauuagguaaucuaaaauuucacugguggguacaagagggucacaguugaccaguggucuacacuacuaugucaugaacguucaaccaugggaugagauagggcugcccagagcaaaugucccauucugagauaagauagauauuuuccaauuuuugugauuauccuuagacuguucuugggagaggguuuuaugaucuuuuucuggauuuuaugucuguucacagagcuuaugaucuaguuucugggacuuauggucuauuccugaagcugguacaauacggucacuuuugaaaucaggccugguccucaaaauacaaacaaauggggcccuuaaauggggacaaaugggguuuauauuguccuuucagugguaagggaaaggaaaggaaaccaagaggucacauauuuuauacucacacuggaugucuagaauuggagcgucuauggggaagggggagcagugguuuccagaugcuggagaagcauggcuuccauggguguggaaucuccauuggaggugauggaaggguucuaaaacuagguagugcugaugguuggucaaccacuagugugucuaugcuuuaagguggcuaguauacugcuuaggaaaaaggguguguguguguguguguguguguguguguguguguguacguacacacagagguuaaccuacaauagcauucuucaagaguccucugucaggggcuggagagauggcucagugguuaagagcacugacugcucuuccagagguccugaguucaauucccagcaaccauaugguugcucacaaccaucuguaaugggaucagaugcucucuucuggugugucagaagacagguauaguguacucauuauauauauaugguuaaaagaagauuugggccagcagugaguaaacccuguaagaauggggggcaaggucaugguaaaacguguuuguuuauguguuuagaguuaugcuaaaaucuagagaggugaagauaauucucauagaugcuuuuagucuuuggacccugacuagcgauaguuuacacccgagacacaagagaaugggcuugagaaaagcaguccuacgcgacuaucaagggaugcuuuggagaaagagagggaaaaugacuguaaacuguuucagggcucuccuggggcaggaggaggucgggagacguccugccuccucccuggcuccuccuggagaaaugcuuaguucugguucugggucccuuuuugucuauugucugccguuggugcaccaguuugucuaugucugucaguuuaugucugugcuuuuguuucguugcuugaauguuguucuguguuuuauguucaaaagaaaaaaaaaugguuaaaacuuuaucugcuggucguuuaccccuugauuuaguuuuaacucauuucaaaaaaguaaaaauuaaaaagcagcgucaauuggccuuuggagcccugcaccuguagcuaggagucuagcacagcuggagaaguccugccaggggcugauugucugcacaaggugcucuuaaaggggccagcagcuucuuggcuucuaugauaagggagcugauggcuguuucuccuacaaaaaucucugugacugugauuauuggguuuagcaggugacaaggugcuccuuucuugacaaaguguggagcagagacugaaggaaaggccauccagagacugccccaccuggggauccaucccauauacaguuaccaaacccuauuguggaugcugggaagugcuugcugaagagagccugauauggcugucuccugagaggcucugccagagccugacaaauacagaggcgguugcucgaagccaaccauuggcucaggguccugauggaggaguucgagaaugaacugaaggagcaacaauguaagcuggccagacccccacccccaaccccagcuccaggggacuagaccaacaaccaaagaguacacauggaggggcccauggcucagaccacauauguagcagaggauggccuuguuggacaucagugggaggaguggcccuugagccugaggguguucgaugccccaguguaggggaaugccaggguggaaagacaggagugggugggugggugggugggugggggagcauccucauagagacggggcggggggguguuggggguuuccguggggagaccugaaaaggugaaaacauuugaaauguaaauaaagaaaaaaaagaagagagagagaaagagagagagagagagagaacgagaacccugaccaaacuauccuggggagggaaagguuucuuuagcuuauaggucacaguuuuucacugaggcaagucagggcaagaauucaagauagaaaccuggagacagaaacugaggucaugaaggaguucugcuugcuccccauggcuugcguagccugauuucuuauauaacccaagaccccaugcccuccuauaucaaucaaucaagaaaaugccccaacagacuugccuauggcccaggcuuacggagguauucucucaauugagguccccucuucccaaacuguccuugcuuguaucaaguuaacagaaaacaaaaauaaaaaacaaaacauacacacagacacacacacacagagacacacacagacacacacacacacauagacacacagacacacagacacagacacacacacauacacacacacacacacacacacacacacacacaccauccuaccuuaaacgguucucuagaucuagaacucucucaguuagaucccaguugugucuuccaaaauucugagaauuuguguuuuucaaaaucuucaucuucauuagagaaucaauaagguccugaaggcucuugaugucaucucucagggauauuaucuguagcuccugcugggcauuccuuucuuuguaacucucuaacucagccuucaccucuugcaaagacguuucuuucacauagagcuugcuuugaagauuucucagcuaaggaguaggggaaagaaaguuaaaguaaauucuugcuuuaaaaucauguuaacucacuguggauauaaguuacacauugcuagagaauaaaaugaagccuuucaaaucuacuucuuaacagcaucucuuaauguuuaaaagcccuuuaauauaaaacacaauggcacaguaagcuugaaauaaauaguuuauuaacauuaaaacugugugagucuuuaguacuuccauaacuauuaaauuacaggaauaauggauuugggguuucugccaaaagugaugcuauagccuuagauaucuugcuuucugguguguggcucacacacaggcaauguucauagaucugucuuauuugugcuggugggaaaaagaaaagggggagaauccaaaggaagaacaaaggcuuaaauggcucucuguagccaggugugguggcaccugcuuuuaaucccagcacgugggaggcagaggcaggaagaucucucugaaaucauaggccagucuggucuacauggugaguucuaggacaaccagggcuauguaaagagacugucacaaaaaagggggugggucuagcugugugauaaaggagagagguggcuugguguagucuccccuccccuagccugaaaccugcuugcucgggguggagcuuccugcucauucguucugccacgcccacugcuggaaccugaggagccacacacgugcaccuuucuacuggaccagagauuauucggcgggaaucggguccccucccccuuccuucauaacuagugucgcaacaauaaaauuugagccuugaucagaguaacugucuuggcuacauuuuuucuuccgccccgucuagauuccucucuuacagcucgagcggccuucucagucgaaccguucacguugcgagcugcuggcggccgcaacauuuuggcgccagaacugggaccugaagaauggcagagagaugcuaagaggaacgcugcauuggagcuccacaggaaaggaucuucguaucggacaucggagcaacggacagguacacaugcuagcgcuagcuuaaaauuucaguuuuguaaaguguugcugaggaugcgguaggauacgaauuaagcuugaaucagugcuaacccaacgcugguucugcuugggucagcagcguguuaaucggaacuagaaacggaaacaggcagguuagccgcagcuuuuuaggaagcugcuuagguggaagaagaaaggguuuaaagucauggaucaggcgguaggccguagcucuccgaagcuacaugaggugugagaaaagaaaggguuuauuaaaaggaauaggcggauugccccaguuaauaaaaaaugcaucauaagggaggaaaaugucccaaaaagcagagagaaauaucucucugggccuuauagcaggaguacucuguuaccuuuugugucuugucuaauguccggugcaccaaucuguucucguguucgauucauguauguucguguccagucuguaugaaugaauguucuauguuuuguguuggauaauaaagaugguauaaaaaacuuuaucugcaaagccgagagcugccacauguuucagccaggaaucagacacguggcaagagggccccugcuggaaaaacuguucguuuuaggaaauaagggcgagugcacagccucuaaguuucagaguaaaaaagcuaauaaaugguucaugauuaauguguuugacaaugguaaaguguuuuuuauuuuaugauuguagcuacaaaaauuauuauucucugauuggucuaaauguaacugcuucauuugguucuuuuuuauugguaaugugcucuaaguguuuucacaaucagcucauaaguuguugguuaagauuaauaauuguuacauugcuacagaugguuaguguuaaauuugauaacucaaguuuagaguccuuccgacacauggcauaaggcagcccaagaggcugggucucuaaagauauuucuaguuuagguaauaauuaaugugguucguauccuaaauaguaaaauuuaaaauaagauuuaaagcaaugucucuuuauuaaagcauuaaagcuugcuuuaauagguauucauagguauuaauugacauccaaacuucguaauaugauaguaaugcuucuaauauugauuuuaaagauaauaaauuguuuuaaacuuggguuuuacuuucccaagguuauagguauuauccuaaccuugcacaaaaaacuuaaaaauuaugguuaaaacugcuauuguuccauugacugcagcuugcaguuugacuucaaauuuaagaucuuuaauucaccuguauacuguaauuaagauaauuacaagaguaaucaucuuaugagagcgcucauacagcucacuucauacaaaacugugacagaguuaucuaguuauguuugucuuugugaauagauuagacaaacaguuugguuauaguugcugccuggcaggaaacuguaguacaggcaauuuuuucacaacacuaaaguugugaagaacguuuuaacuguaagucaucuuaagaaagaguaucauaauuuagaggcguagacaguuauauuguuucucuaaaaucgguccuuauuacaggagggccaagaugcucagauuaaaaaguauuucacguuugagucaaugcagggcucugggcagccccagagcggcuuguggccuuucuuuuguuuugcaaacagugccugaaaaaaaaaaauuuuucccuguguucaagagaaauucuuuuuaacaguguugcagaucuauucagauguuuaaaauaagacuuaaauucaaagaguuuugcuucuagugaacuguaaucacuagaaaauuuugccucuaaguauggcuaauguaacuuuacauuauguaagaaaaaauuuuauuguuucugcuucuauacaagaagcaaagaguuuuaaucuuucaguguauauuguuuccuaagugaaaaguauuuuauuaacuaaugcuucuuaaaguuuaccuuaaauccuugcucucacccaaaagauucagagacaauauccuuuuauuacuuaggguuuuaguuuacuacaaaaguuucuacaaaaaauaaagcuuuuauaauuguuauuaauugguaauuaaaaauugguugugcccaaaacaauucuuuggccaaaaagaaaacauuauuguaaagucauuuuucucauccucccagccaaucguuggcccacgugggcccaacuagcuucuguggggcggagucuuaagacacaguuuccccuguuccagcacagaugaucuaguugugugcuguagaugguguuuuaaaaugcugaacaaucaaaccuuaauuuguauauuaauagucaaugccauaucucugagcucgcaauugcuuaaauuguucaucccucagauacuauuaauucucaaauuuacaauugcuuaugcauauuucuaguuaauaaauaaauuaugcacauguaacucuuaauaacuuuacaagccuucuaguuacaacugcuccuuaagaaaauugauugaaagugcaauuagucacugccccuuuacagccauguauuuaaaauauuuugucaacuaguuauuaauucaaaaguagguauuguaaaauuuuaaaacuuuaacuucuuaaaagacaaaaaagagagaaauuguauccccgugcauacuauuuagugcauucccaugcacacuauuaaagucuuaccuuuauuuucaaaaucuaauauuuuaaugucaaagaguuuaauaaaggcuuuauaguaucuuaaagggaucuacuuauuggcuuauagauugauccuaaaacagcuaccuuauuagaaaagggaaaaacagguuuucuccacagaacgcuucagaaacauauuaauucgugugacgagcugguagguaaguugacucauguccugauugaauugacuaaaaaacuaaauuaaauucauguuuuagauccauccuuacuugucauuuuuccaguuuagacuagcuucuagccuuuuaacuuuauggcaauaguacaucagagacuguauauucagacuuaguaaaauuagucauuuaauagagucauaaugauuuuucucuuuucuucagugugaccagccauucuaacucaaucucagacuggucuaauauucaguccaauguuagagauuccuauauucuaaauuaccuagcaaaguuaauucagggcacaucccccacuuccccuagaucccuaaccucagaaggauuacuggccuuacagcuaguggaaaaggcuauugaagaacaguuugucacuuacauagauuacucccugccgcugcaccuguuaauuuuuaauacgacucaugugccuacgggauugcuauggcaaaaauuuccuauaauguggauacauucgaggauuucucccaaacguaauaucuugccauaucacgaagcaguggcucagaugauuaucacuggaagaaggcaggcauugacuuauuuuggaaaggagccagauaucauuguccagccuuacagcgugagucaggacacuuggcugaaacagcauaguacagauugguugcuugcgcaauuaggguuugaaggaacucuagauagccacuacccccaagauagguugauaaaauucuuaaaugugcaugauaugauauuuccuaagaugacuuccuuacagccuuuaaauaaugcucuauugauuuuuacugauggcuccucuaaagggcgagcuggauaucuuauuaguaaucaacagguuaucguagagacuccuggucucucggcucagcucgccgaauuaacagcaguacugaagguuuuucagucugugcaugaggcuuuuaauauuuuuacugacaguuuauauguugcucagucaguacccuuacuggaaaccugugguacguuuaacuucaauacgccgucaggaucuuuauuuucagaauuacaaaacaucauucucgcccggaaaaauccguuuuauauuggccacauacggucucacucuggucuuccuggaccucuggcagaggguaaugaucgcauugacagagcucuaauaggagaagccuuaguuucagaucggguugcuuuggcccaacgugaucacgaaagguuucaucuuucuagccauacccuaagacuccgacauaagaucacaaaggagcaagcgagaaugaucguaaaacaauguccuaaauguauuacuuuaucuccagugccgcaucuaggaguuaauccuagaggccuuaugccuaaucauauuuggcaaauggauauaacccauuaugcagaauuuggaaaacuaaaauauauacauguuugcauugauacuuguucaggauuucuuuuugcuucucugcauacaggagaagcuucaaaaaacguaauugaucauugccuacaagcauuuaaugccaugggauugccuaaacuuauuaagacagacaaugggccaucuuauuccaguaaaaacuuuauuucauucuguaaagaauucgguauuaaacauaaaacuggaauuccuuacaaccccaugggacaaggaauaguugaacgugcucaucgcaccuuaaagaauuggcuuuuuaagacaaaagagggucagcuauaucccccaaggucaccaaaggcccaccuugccuucacuuuauuuguccuaaauuucuugcacaccgauaucaagggccagucugcagcggaucgccacuggcauccaguuacuucuaauucuuauacauugguaaaauggaaggacccccugacuaaugaauggauggguccagauccaguucuaauuugggguaggggcucaguuuguguuuuuucaugagaugaagauggagcgcgguggcugccagagagauuaauucgucagaugaacacagauucugacucuucugguaaguaucauucuaaagacuaaaauuccuuuugugcuuaaaauucagcugagagcaacagcucucaaagcuguuugugucuccagcuacucucugaaccagcucccgacaggaggcaggagacuagccucagcuuuacaauuugcauuugaauaaaguaccuagacuuccccgaaagaaguucugcuuuccuacuuucucacugucuuucaagauuuugucuuucaagcagguaaaucaacauucccgaggcggaccaguggaugugcaucccugccccccuagagcacacagguggcagcuguuacccccagucucaggacauuuccagcacgugguuuucagucugaguuaaaaauuuagguuuaccuagagggcuagaagaguagauauuuccauauuaauaaagauugguuuuuauuuugauagacaggcuuagccccuuagcugaccucuggcuuuucacccuugcuguuacugcaagguguccuuagcucaauaggcuguggaaaaaacagggaugaggaggaacgacuuccagcuccuauuuuagccacaaaucgugguguuacuaacgacauaauucuugcuuaggcuuugcuaauucugagguugauaauucuccuuuaggagcugcacagcacucagaacugugcauacugguuugugauuguacaaauucaguaugggcaccgcuuggugcagagauacuuacugcaagggaagguccggcuugaccauuucugaguuuccugugagauaaacccgguuugaaagagguugguaccaaauuuugguuaaaaauaaaaaauauucuccggcucuaccucgccuccccaaaagguaccaagagccacauguguggguuuuacccacgggaggaaucggguccauguccacccaagccaagguuaaaagcccacucaucuacggaugagaaaaucauuugaucaccucaguuaagcguugccuuauuuaacuuaauuaauaggggggagagagauuggagacguacuauugaaagggcaagcccuucacugccucccacccaaauaaaaaagccaauuggccuuguacuacaagagccggucacuccuucucccuguuucccaccuaucuuccaaaaauguggaggaauucaacuuaguguuauuuucacaucguucagucaaacuuagccagucaaacuuagccagaguuccaacgcccuacuuaaaauucaacuagaaaguuaccuaccaaguacuaauuagcauuauaaagucagagucugcagcuccaggccuuucaguuaguuguuuacuagaaaggacagucuuaagccagauacaguuuaccauaagaaaaguuaaagaaucccagugaagcaaguuuuuucuuuagcccuagauuccaggcagaacuauugagcauagauaauuuuccccccucaggccagcuuuuucuuuuuuuuuauuuuguuaauaauagggaggagauguagucuccccuccccuagccugaaaccugcuugcucgggguggagcuuccugcucauucguucugccacgcccacugcuggaaccugaggagccacacacgugcaccuuucuacuggaccagagauuauucggcgggaaucggguccccucccccuuccuucauaacuagugucccaacaauaaaauuugagccuugaucagaguaacugucuuggcuacauuuuuucuuccgccccgucuagauuccucucuuacagcucgagcggccuucucagucgaaccguucacguugcgagcugcuggcggccgcaacagcuuggcaguugagagaacuguuuauaugucugagaacccagguuccauucuaagcacccacaugcuaccucacaaccaucucuaacacuagucccagggggagcucacacccucuucuggccuccgugggcaccagauuggcaugcagagcacagauacagaugaauauuauuauuaaaauguuaaauagagccacagugacaguuuuaagcaugaaaaaugucucauaccuuuaacacaucagucacccaaucucagggguugaaagccaagugugucucauuuuguuuccaagcauucauuuugcgcuugauuucacugguucaccugccuguuuucagggcucuuuuugugaggugcaucagcccgacagagcauggcacaugcugcugaccaguccuaagaagcucaccccaccaggguccagaaucacagacaacccagaagacagucacagcacagucuucguggcguuagacagcaggcugacuccuccaucaucucuccucucuuccaugacaggucaggcccuggcucuaguaaauagccacugguucacacccacgcaaccacugagaugcaccagcccuagcuggucagagcuccugcaagugcgugagaaaggaucacggccauaaggcuuuaugaagcaacugcaacuuugucuuucuggcuguuuacugcaugagaggccacuccucuagauaccaccgauggagaccagccaauuucuccccagcgcugcaccuaauaagcacacugagguuucggaucacugugauaguaagugcggcuccauaguguacgcccgaccuccugaucccugcuuuucuguacaaacgcgucugggcgucagucaugccuucauuccuaguggggguuguaguaccaagccaugggggagaggugcuugugcaacaucucuguuugcuaguaaauaaaauacacgcuucauuucugaucuacagugaaugccuaagcauucuguggaauuucacaccuaggcggggccagcaucuguaaaagcagcuagaagagugugcaucucguccagucacaucaagcuuacuuaugcagguaaagggagggcaagcacuagacucaacaauaauuucauuacaacuucagggcaauucuaccgaaguagacaguagacagugaagaaaagccugggacaccacacacacacacacacacacacacacacacacacacacacacacacacacacgcuccccgggguccagaugcacuuccuugcugccuugugcugcacucuggaaccucagugggcagcugcagucuuucugacagacaguccugaggggcugaaggagugugggaagaugggcuuagccacucauuauagucaccucccuuacucaggaagucucuggcacagguuaaaagcacccacuaggggcuggagaggugacucagcgguuaagagcacuggcugccauuccagagguccugaguucaauucccaguaacucauccuuaaugggaucugauucccucugcugcuggggacagcauaccaugacaaguccugcccgcagcaggccgggauagagacaucucaguagccugcgacagcucuuuguaaaaaacaguuguuuccauuucuccuaaccuauuccuggacaacggcuguauagauuucauuugugcgugacugcuuuucaguugaccuuggugugcauaauuauucuauuauaucugacuauccuucuucuucugcugcucugguaaauucuaugaaacuagauguuccuugauguaaugauucuuaaacaauuaaaaauugaggcauaggggcacagcacagcacagcacaguccucauagcccagguguaugcuguguguucucaucuuggaaacaauguaacaauugcacaaugguaguuccggauuaauguuugacuugcaaagaaaguuugaagaaauuauuagaaaaugaaauagagccaacauugggacccugagaaaggaaaaaguuauugaaguuaugaaauaaguuuugcacaacauuugagaguggucccuggauaagcaaggauagaaugcauaaaauuauauacuaggaaaacuaagucaaaacacugggacucuuaggagagucauugugugcaaugugcagaaacagaaagcuagcagaacuacugaguuaaggguuaacuugauucuuucuggccacuaccuggcagcuuugcccaugucauacaucauuagggcuucacaggaaaaugcaaauagcuggccuaggagcucugagcucugaaguaugauaaguuaaaguuuaaauaacgauaaguuuacaauuauuauuauuauuuuggcuacaggccugggaguaggggaagcuuggaacuuuggggaacaauuauaauucuugauuuuuugugggacgugguuguucuuuugaauuugauuuggcaaagauuauacaaugucuuuuuuuuuuuuuuucuaccugcuuuuggaguaacaauaaaagacuggggcaagaaaaaggcgagagagaauauggugagugaggugagcaugagguguguguaaggugagccugauaugacuguggagugaguggagagagugugaggagaguguggggagagugaguggagagugugaggagaguguggggagagugagugaagagugugugugugagugaaaggagagugcauguggugugugugaagaaagugugugugugaugaaaggggagcacacagagguguuaagagugugggaguucgagaaaagaaaagcacacaggagaaaagcagagugcagaagaauacagagugcgagcagccucaagcuucgagcaagaaagcaagagaagagagagagagagagaacaaguuuaagccuugaaaaauugccuguuaguuuauacccaaaaaguugucugugucuguuuuuuaugugccuuccagauaucccugcuuucaguugagaauucuaauccugugucaagguuggaccccaacacucuucuagugugucugaagacagcuacaguguguauauauguaugugugaauaauguguguguguguauauauauauauauguguguguguguguguaaauacauauauauguauauauguguguguauauauauaaauauauguguguaauaacaguauguaaaaaaauaaaucuuaaaaauaaauaaaaguaccuacuaaucuuacaaaagacagagguuuuuuaaaaaaauauauguauauauauauuuuuuaaagauuuauuuauuuauuauauguaaguacacuguagcugucuucagacacuccagagggggcaucagauuucguuacagauggucgugagccaccaugugguugcugggauuugaacucugguccuucggaagagcagucagcgcucuuaaccacugaacuaucucgccagcccccaaaaccaagguucuauuuuuagcauccagcacccacaugguggucuacaacauucuguaacugcaguuccagaggaucugacaucuucuuucagccauguauauauacaugcagucaaacacucauacagauaaaauaaagauaaaucuuuaaaaugcacugaauuuguauuugacuuauaauauccaacuuuaugugugauuuaacuuauuauuccugcagcccgccuaugcaagaguuuuaucucaaugccauauucccuaagcuagugcacacaaccagcaacugaacaggcucacauuuauucuuucuauaucuggccuuacccaaauauagcuuccuugcaccugugucuccauuauaggguagaaacacauugcaauuauuuuuguauguuacacaaagagauaaguuuaauuauaaccaaaaaaaaaaugaaaugcaugccaugaaaaagaaaaccaccuuaucaagacaauugagucccugcgggacuaaaugguagguugccugggaagcaagaaaugacucaugccgggcucagguauccugcugcaaucgcuaagcucccuuuuauaacaugaacaugaggauaccauguaaucauaaccgucacuaaauuuuuauuuuuugagacaaggucucauuaagcaauccaagcugaucuuaaacucaauaucuuauuuacucaggcucccaaguacuggacucucuaggagugugcaaccacgccuggcuugaacauuuuuauuuuuaaaauuauauuuauuuggggggguaguggugguggugguguguguauguguguguauguguguguguguauguguguguauguguguguguguguauguguguguauguguguguguguguauguguguguguguauguguguauguguguguguauauguguguauguguauguguguguguguguguguguguguguguggauguguguggauguguguggauguguguggauguggauguggauguugcaccucgguacaggguuguaaucuaccaugucaggacagcuuucuuuagcuuggugcaaaaugaaggaggacucccuuuucuuagagaggcuuccucuucucugccugaucuggggagccuagccccaaucuuuuaccuaagcaauaucacauaaucuuuggcaaaauuacaaguucaacuuccuggaaugccucuccaugcaaaugaggugcccccagaaaccuaaaccucagccagugaaacuuuacccuaagaaccccuucccacuuuccaggguuaaugugucugugucugugucugugucggugucggugucugugucugugucggugucugugucaguguuuguauauauccccugauuugcccugaauaaaguuuaugcauauaagcuguuuuguugaaauuuuuggggggcgggggggguguauuucaagacaggguuucucuguguagcccuggcuguccuggaacucacucuguagaccaggcuggccucgaacucagaaauccaccugccucugccucccaagugcugggauucaaggcgugcacccccgcugcccggcgccgaaauucauuuuuaaaagcugcuucauugaauagcgucuaagagagcuguaacacuaauguccucuaagaaggccuucucccuccagcacucacuggcagaacuggauccugcuaacccaccaauuuuggacuucgcuucacccuucccugucuggugugugcugguguguagcagugucugggcauccugaaggaagaagcagaaaacggaaccgaguguguguguguguguguguguguguguguguguguguguguguuacauccaacagcacacaugcagaggucugaggacaaccugagggacuuuguucucuccaucauguguugaagacaaagcucggguugucagccuuggcgacagacuuuuacucucacugagccauuuccccggcucugacuuugucauuuuuauuagauuagaagaugccaguagaggcuauggaguauggccugaaggaggagguguaguuggagaccaaaccuagauaugcgugcauugcuaagcaugccccucacugcugaguuacauucccaggcucucuguagacuaggcuggccucugagauaaucccccuuccacaguuuccuuccugagcacggggucuccaggugcgcaccaccuugccuggcuggaaugguuuucaaauguauauaguauccaaaccaugucaaaauggugagaacuuuucagaugucuaugugcacacagaggguagcuucaaaaaauacuuugaaagccaagcaugauagugcagugagcugggcacuguggcucacggcuguagccugagcuaacugggaucccagagaggagacucaguggaguccaugagguuaaggcuagccgggacaccccagcgagacuccauccaaaaccgggaaccgaagaaaaucuuugaaaugcuugaaaauagucuacauauuucuuucaagcaagacaccugaaaccuuucuugacaguuugguuuaaaagcuuuuuuuuuuuuuuuuuaagggccaggaaggugacuuagcagauaagggcuuugucaacaaccuaagcaucagccccaagacccacagggugaaaggcgagaagugacucucagagcauagacccggacuacaguucaguggguagaguguuugucuuacaaaugacaaugugugaauacacacacuagacauacuauuacuaccaccaccaccaccaccaccaccaccaccaccaccaccaccaccacuacuacuacuaauugcauccaacuccagcuuaacaagaccauagacuuuccaaucacagagacauacuggagacaagaagacugacaggcaugacgugguguccccauguccuugucacuacagucugugccauggccugguagguggagaggaguagggccuggauccugcaggcagaacugugcuauuuacuaauguuucuuccuacaagcauucugcccugcccccuccccucacccccaucucucugcucccucucuccucaucccaagccuguguuggcuuuaggcacuucaggucaagaacaaaugaguacucugacccuacauuauaggaaauuggaucucucaggaaaccuacuuccuggcuccuuaucaaauaugacuaauagguuauauuuuauuaacuuaggucuugaaaacccauuuacuguguuauuaauuacaauaauaagaaacugauaguucugguuaguuuuauuugucaacuuggguacaaacuaggguccccugggaagggguaaccucaacugagaaaauguccccauuagauugcccaaaggcaagugggguggcauuuucuugauggauaguugauguggggagacccagcucacuggggcagugccgcuccuguauaagaaagcaggcugagggggcuggugagauggcucaguggguaagagcacccgacugcucuucugaaaguccugaguucaaaucccagcaaccacaugguggcucacaaccauccauaacaagaucugacucccucuucuggagugucugaagacagcuacagcguacuuacauauaauaaauaaauaaauaaauaaauaaauaaaucuuuaaaaaaaaaaaagaaagaaagaaagcaggcugagcaagccauggagaacaagucaguaagcaguacuccuccauggucuccacuuugauucccaccuugacuuuuaugauggacucaugaucucuaaacugaaauaaaccucuuccuccucaaguugaucuuggccaugguguuuaucacagcaaucaaaagcagacuaggacaacauauauucuguucuguuucgguuugugggucuguguuguacaugugcaugugugccacgaucauguguuugcagugggauaugcccaaguguguguacugcaagaagccagaggccaauguuagcugccuuucucaccucgcaugcucugcacuuuagguuuuaaaucuguauuagugaugcuacugcugcuaucguguguguacacaugcguacauaugcaggguauauguuuauguagaggucagagggcaacucugugaagucuuucuucuccaccuuuacacaguacugugguuugaaugagaagugucuccuaaggcucacauaucugaacgcuuggucccccuaucagcaguguugcuggggagccuauggaacccucgggagguagagccuugcuaguauguuauugagggcaggcuuugagaguuuacagcuucaccccaaguccaguuugaugucugagucccauaugcugcugggaugugaucucuuagccuccugucccugccacaaugucucccccaucacuguagacauuuagcccccuggaacuguaaacuaaaacaaauucuuaaguagcguuuggccauggcauuuuuaucgcagcaauguagaagugacuaauacacauggauucuggagaucagacguaagccaucaggcuucccuuguuaggcagaugccuuugcuagcugagccauuucaccugccccuccaccuuaacguuugacacaggucucucacugaaccuggaucucacagguucagccagcaaaccuaagggguccugucucuaccucacagcauuuggacuacgguguacuucacagcaccuggguuuuuaaagggguucuagggauccaaacucaguucuucauacuuucaugacaaacauuuggccaauuaagccaucuucccagucccuauuuuuguuuuguuuguuuguuuauuggagacaaggucucauguaacucaaggcugcucucaaauucaacuguccuuccucagccuucugauacugggauggcaaguaugaaccaucccacauagaggcaaauauaccuuuaaauguaaaauauaaaauaaaaugaaaagaaauacaaaguucacauagaagcgcacgcacaaacacacacacacacacacacacacuuuagcaugcagauggccaucagaagacaacauguagagccaguuuucucuucuauuauguggguccuggggauugaacucagguugucaacccuggaagcaagugcuuuacccacuaagucaucgcgucagcucugugacuaguguccucguaagaagggaaacuuggagcuggagagaugacugcucaguuaagagcccuugaugccuuuguagagaacugguacucaguucccagcacccacaucaggucauucgcagucaccuguaaccucagcuccgggagaucuagcgucuaccaacccccugggaugaccuucccacaaguucacagacacauacaaagacacacagacgcacacagauauaaauaaaauaaaucuucagaaaggaaggaggugaagggauaggaggguggcgggagggagcuugaacacacaugcugaaggggggcugcaggagaagauuaccaucuacaacccaagaagaaacaucucgggaggaaccacccccauggacaccuugccccagacuucuagcugcuaugaccacuggagaacacugcuguuuaagcacccagucugauacuuugcuacaguagccuuaggaagcaaacacagccacagggagagcugcuuacccagagcuggccucugcuuguaagcauucagaaggauucuacuuggagguagccauagagaggcagagcagacauaagcagcuacagugcagugcccuucacaguaacaaagaccagugagccucuaaaaggccaucacagucagcaaacccugaggacagucaggcucaauuagagaaucucuacaagcucuccccaggacucaucacugggaguaaaagucaaggcacucccuauaaacguggguugugugaugcacuccgauauuaucgaguaguaaauaagauuaguggauauuugcuaucuggugaaguauuggacaugggaacucauccuuuccauuaaaaauauuuuggacuggaaagcagagguaggcugaucacacacacacagaggggagggggucggggagggagacagacagagaugcuuauaguuauuauuaugccacaauauuuuuuuacuuuaacuuuuuaaaaauuuuaugcauguggguguuuggucugcaucuaugucugugugccugaugccugcagagagcagaacagggcaucagauccucuggaacuggaguugcagagcuaccauguggauguuaggaauuaaaccuugguccucuggaagcacacucaaagcucuuaacugcagagccaacucucuggccccugugucauaaauuuugagcaugguauuccguuagcaauauucugacuucuaaaagcacugaaugaggcaccaucuucaguaggaguguuaaaggcagacaggaaucuaaacuccucaguaaggagagaguucggcgugggguggggacaaaacuagguuaagauaacgccucuaaccguuagcagaacucccucucucucuccuaaccuuucagaagaucuaauucccacuuucaguuuuuguaaaagcuauauaccucagcuaaaagagucuuguuuuucaccaacaugcuggcaaggucaggauggacugggucggcugccuuuuuguuguguaugauuggguucccgguaggauccauuucaagagguggaucaaaacaagccuauaaagagaaauagccaguuaauuaacgaaauaugugcccuguggaucaaaacccacaaaaccacccaaaugcuuacaauagguaguugcaaacaggacucagcuuugagcuauuuauccuaagauaccaucccagcaaacccaaccgucuccaggaaaacagcaaguaccaugcugcccugcuuuaucuucuccuagacugaacacuuaccuaacaguuucuaccugcaggaagcaaaugcagcccgucugaauucugugcugugaucucugagaguacaggaaucaaggcaacguacauaaaccaucccgagacauuuccauguguagcuaacucuaaacagggcaagggggauggcuaagcaggcaagcauaugaggucaagaguucagauugcagcaucccuauaaaaagcaaaucaugguccugagcaggccuguagacugcgcugggcaggccaggguggagacgggaggauuucugaggcuugguggcugcuagucuagacagagaaaaacuacaagcuccaaguucagggagugacucugccuucgaggaauagaauaagggaugagagugguggacacccuacaugcucuucugaccugcaagccuguucacacaugcacacaauuauacacauauguguacauacaccacacacacacacacacacacacacacacacacacacacacacacacacacaaaugcaugcucaguaagaauuuuaacaguaaguccuggagagaugacucaacaguuuagagcacauguagcucuugcagaagaccuggguucaaugcccagcccccacauggcaacucacaaccaucuguaacuccagcuccaggcgaccaaauguccucuucugacuucccaggacaucaggcagguacgugguacagauacaugccugacagcaaaacaaucauguacacagguaaaucuaaaaaagaaagauaguuucuaggggcuagagagauguuaagagcacuugcuauucuuccagaggacacaaaguugggugguuuacaaccacuuguaauucuaguccaagagaucugacuuccuccuuuggcaucugagggcacucauacgcacaaaccauacacaccuacuuauauauaaaauaaacucauuuuucuuaaaaaauaaauaaauaaaagaagcaguuucuaaaaagaaaaggggggaaaaaagguagcuacuggaaaaccaggcacgguggcauaugucugugaucuaagcacucaggaggcagagguagagggaugagccaccaugacaaacauuuucauauuuuccuuucccuuuuuucuuuuugguguguguggggguggagguguguauguggugugugugugcgugugagaguguauguuagugggugugguuggugugugugugguguguauucugugaguguguguuugugugguuaguguguaugugaguauauguuaguguguaugguguguauugugugagugugugugugugugugugugugugugugugugugugugugugugguuuccuuaugcgcuguccaccuuguuuucugagauguuuuucacuggcucuuuccucaucuaccugggucugcuucucuagugacagaauuacaggcacauuugguugugccucugggcuucuuguggaugccagaaacugaucucagauccucaguuuaugauauaagcaguuuaccaagugaacuaucucuccagccucccacauuuucuuaucucagcagcugggauggcagauaaaguaaagacaguucguauuguucauacuuagcuggaaacguacuuccaaauuaccauagugcauaaaauaaguguuuccuaaaauucaguggaacaccagaacugucaucuaguauaacauacggauuaaauuauguuugaguguuuguuugagacaggguuuagacauacagcccaaacuggagucaaacugugaaacuccuguaucccaagcacuuggaauacacgcccaguuuauguuuuaagauuuaagaacagaauaaagacauuuuauggaaacaaagcaaguuuacuacaauguauucuuacuuuagaaagcuucuaauaaugaauucugcaaagaaagaaaacaaacauaucgggugugagauauaagaaaaaauagggaguagacaugcuggauacugugucgagugccuaugaucccagcacucgggaggcuaaggaggaagauugaugugagucugagaucaaccuggaccacagagaauuaccaaaacgguggagagggaguaggaggaggaaaaggacgaggaggaggaggggggggggaggaggaggaggaggaggaggaggagauaauaguaaagguucgaguacuaaguuauaucuuugguagaaaauaaagauucugagaaagagagagagaguagugggggugggggugugccacaagguugggcuggagggauggcucagucguuaucuccagggcuaguagaggcagagucaggaauucugagguugcugguuucuagccuagcgcaggcuuguaugcucacagguacauguguguguacaccauauacaauuacauacagcacacacacacacacacacacacacacacacacaccaugaaagcagugugguagcuugaacaaggaacgcuccuccaacccuguuggguccaggcaucugaacacuugguccccaguuguugguguuguuugggaagguuauggggagguggagcuggaagaagaacgccagugugugagggcuuugugaguuuaaagccucuugccacuuccagcaggaccucugcuccucauuuguggcugagaugugaucucucagcuuccugcuccuggcaucccaccuguuacccccacccccaugacagacucuuacccucugaaucauaagccgaagugaacucucauaaguuacuuucugcuauuguguuuuagcauagcaauagaaaagcaacuaauacaagcaguugcuuuucuuucuuuuuaaaauuuuuuuuauuuuuuauuuuggguguucauuuaucuauuuagagacugggucucacuauggagcccuggauguccugaaacucacagagaucuguagagcaggcugaccuuuagcucacagagaucugccugccucugccuccccaguugcugggguuaagguuccaccucccuugacacaagaaguugcuucucugucuuugucagucuguuggcuggcugguuuuguuguuuugugugguuguuuguuuuugcuuuuuguuuuuguuuuuuuguuuuuguuuuugagaugggauuuuucuguguagccuugccuguccuggaacucacuuuguagaccagguuagccucaaacucagagaucugccugccucuucguccuagguauugggauuaaaggcaugugccaucauggucugcagcaguuucuuuuuuuaaagggacauccauuaagaacagaaaaauaaguuaaaaaauuacaaaaguuuaguacuaaagaauucaaacaaccaauaaagauugagugaacuaugacauauguguguguguguguauacauacauacauauauacauauauauguuaauauaauacuuuauuguuugagaauuucauacaagcauaaaauguguuuugaucaaauccacccaaauaauaaaagguucauagcugugaaaauaauguuauguguuauauaacuucuaagcaaauagaaaagggggaaggcaugcaaaaaauaaaacaagcacaacacacacacacaguuucucaugcugaaaugggauguaauaaacaaaccacauguaauaagauuguagaaauguggccaauuuuuuuuuuuuuuuuuuuggagacagagucucuuguaucucaggcuugcaucaaacuccauauguagccaagaaugaccuugguauccugcauaucagguauuuacauugcaauugguuacaaaauuacaauaugaagaacuguauuaaaggguugcagcauuaagaagguugagaaccacugcucuggugguaauaagauaaaguguuagguagauauuucuagugcucuuaaaaugucaauggagggccaucuuuugcuccaggaagauauuuaaauuccagaaaaauccccauuaaggucaugaaagaagucuguaaaccccguaguaguagagugcaccugaggggguuggaccacccacuuugcuacuaaaucaccauggcugcucccuggugggguuuccucaucuacaaaauaguaagaucagagagccucugcugggugcugacugggagaaaugggcacuaauaaaucgaacuaccaaaaaaggucaagcaaacccaaacuucugcagguuguguuagauccagaugucucaagucuuguucugaggaaaucagcagugggaggguuuaccagauggcucggcaguuaaaggcguuugcugcuaagccugaagaccugaguucugcucuuggaaggagagaauggacucucauagguuguucucugaucucagcacacacacaauagguagguaaguagguagguagguagguagguagguagaucauuuaaaaauuuuuaaaaauguaaguggagacugguaugaucuaucuguauuccuagcacaagggaaacugaggcaggaggauaaaagugugaggcuugccugacuacauagugucaggccagucauguauacagucucaaaaaaaaaaaaaucagagagcuaaguauggugacucacaccugcaauccuagaacucuggaggcugauguaggaguagacauaaaugugaggcuagccugggcuauagggugagaugaugucucaaaaaaaaaaaacaaacaaaaaagugggauaucauuuagccucuguuuuucuuucuuuuuuuaaagauuuacuuauguauuuuauguauguaauuuacacuggcacucucuucagacacaccagaaaagggcaucagaucccaugguugugagauaccaugugguugcugggaauugaacucaggaccucuggaagagcagucagugcucuuaaccacugagccaucucuccagcccccuuucccuuugaagcauuuguuuuuguguguaugaucgagugugugccccagcuugcaugucagagaacaacuuuugggacuuguuucucucacugucuaccucguagaacccaggaaucaaacucgggccaucaggaacaccuuuaucugcugaguucugugagcaggccugaguucaucuucuguauccuucucuagcaaagaagcgcuaagcacaccagcaaaugggcagucagaggcgaaccuucccuuucuuagacuagcuuuuaaugguacacaacaauaucuuacuuuugaaaaugaggacaaaguaccagaguccaacucaccacugggacauuuucccgagccgauagaugugauaggugccuggcuucugguggcuuagccucacaggccucuuugguuuggcuauuggcaagccucccuggguccgagugacuuacaggcuggaguggccuugacauguuggaggcacaggaagcauacaacagauccaccaacggugacccacagugccucuacgggaaguuucuguauagcgcucaggacgagaggucgaggucuuucagggccaacaacaaagauuuccagaaacuucuaggagugucuccagugcuuaggccccaaaaggagcugccugcugaauuuguuucuuguagaaaauguggaccuaguuucuaaagagaguguaaaauaguugaaaugucauuauaucauacauuuaaauuuuaauuauauauuucuaauauauguguguguauauauguauguauauguauagguguauguauguauauauauguacacauauauauacauauauauguuauauaucaguccuugcuauauaugucauagcuuuaugaccugugaauuucucucauucaaaaguuuucaacuaucauaaaugcuaucuauaguacuuaagaaacaaccaaaccacaaaaauucaaauguaaauugauaaugugcguacaauaguuuagagagcucuuuauaccccagaagaaaguauaaaugcaaccccauauuacuuuccuuucagucuuaagggucaacaccaagguccuugaguguccuaguguuacuggaggucugggucugggcugagcgguuccagguucucuuuuuacauauuuauuuauuuauguguuuauauguguaugccugagugucuguguauguucaugaacccccggugaucagaacagggcacuguaucuccuggaauuggagucaucaguaguugugaacagccgugugugugcugagacucagaucuucucuuagagucuucucuuagagaagucaguguccuuuaucacugagccaucucuccaggccccagguucccaggugcuuggugccuuacucaaagcacugaaguaagcacacauggauucccaaagaagcaaggaaauuguucuaaggagagugauagcgcagaucagaauauaccagagcagcaggccacucaaggaaggguacucaccggcccugauuauuauuuaggguuuucuuuuauggagguuuaagggaagaaagaaggccaaugagagggucaucaaguuaaggcugcuuaccuccauaccccuaaaaccugaguuuuuaucucuagggcucaccugguaggagagaacucaaaguuguccucugacuuucauguauguacuuauguguagguacacacacacacacacacacacacacacacacacacacacacacauaccuucugcaaguuguccucugaccaccauagcgcaccaugguaaguacacaugaacacauacguaauuaaaaauuuuaaaauagaagcggaguucucucuaacaauguuuaagauuacagcuuacuuucuacaacucugaaaaaucccaccuucauacucucucugugugucuuucuuacacguaagauacagcuuccuaugguucaauuagugaaagagcaaaacacaauuuuucuuuuaccauuacaugaucaagagaaaaucccaaauccaagaucaauucccaggagacccccuagugauggggcauccugcauaauuugccaguagaauguuuccau

SEQ ID NO: 6698 - RNA, 775 nt, Mus musculus
cgucgugacccgcugacagaggaggcccaggagcgucugcgggagccggugggcccaggcagcaagaggguugucaccaaagacugguuggcggcaaugacuggcugcggaaagagccuguguggagcccgccucugaugagccgggagcuucccgccucgcuuuuagccaaucagagauaguguguagggggcgcgguggaacugggcggaguccgggcaggaaugggccugucugagcaaguuugcgugaccuagguugcggcgacagaguccugcaaagcagugugauuuuggaucguacuggcuucuccgggcaggaucuuggaggccuuaagcugauuccggcuacugaccuggagcaggcaaugcggcuuuccacguugucauaggcccuagcuuucagagugugguggggaacaccugggauaacugccucucuguuacccuccuagcaagagugaggcuauccuuaacgaggcaauugugucccucugguuagccaucugcggaggaagcacuccagggaauugcuuuuccaccagccagaguagaaauuuguuuccggggaaagagauuucagagaucaccuugcaggacugaagccaagacaguaauggacagguccacaccucgaccuucacuguucaacucuauaucaagucugacucuuuacuuaaaccucaguuucauauuagaacucagaagauaagacuucucuuugucccucuucccaauguggccguauugaauaaaucuccuuuuucuauaucuua

SEQ ID NO: 6699 - RNA, 65261 nt, Mus musculus
uaagauauagaaaaaggagauuuauucaauacggccacauugggaagagggacaaagagaagucuuaucuucugaguucuaauaugaaacugagguuuaaguaaagagucagacuugauauagaguugaacagugaaggucgagguguggaccuguccauuacugucuuggcuucaguccugcaaggugaucucugaaaucucuuuccccggaaacaaauuucuacucuggcugguggaaaagcaauucccuggagugcuuccuccgcagauggcuaaccagagggacacaauugccucguuaaggauagccucacucuugcuaggaggguaacagagaggcaguuaucccagguguuccccaccacacucugaaagcuagggccuaugacaacguggaaagccgcauugccugcuccaggucaguagccggaaucagcuuaaggccuccaagauccugcccggagaagccaguacgauccaaaaucacacugcuuugcaggacucugucgccgcaaccuaggucacgcaaacuugcucagacaggcccauuccugcccggacuccgcccaguuccaccgcgcccccuacacacuaucucugauuggcuaaaagcgaggcgggaagcucccggcucaucagaggcgggcuccacacaggcucuuuccgcagccagucauugccgccaaccagucuuuggugacaacccucuugcugccugggcccaccggcucccgcagacgcuccugggccuccucugucagcgggucacgacgucuuuccgggucgccugcgcaccuucgcugcugagcgcgacgcaggcgcacuagcugauuucucccgggaggucccugagcacguggguugugcuguccugcgcgcgcggagcgacuggaaccugauuuuugcugguguucaccguggguggcagacuagcaaaggccauggcaccagcgggaauccugaacgggaaacugguuucugcguaaguacuugccagugauagugguggugggcucagagcagggcgugcagauccccaagcgccugggcucugcaggagaggugcuuagaugggguuugcgggaagagaggacaucgacacgggcuccuagaaucugaagacugguuuccugaagccagagaaacacaugcccggcccaaugugcaauugcaauagacugccugggguggcugcauuccuagguuuggcggcaaguccugaccugaccuuguucucaaaaguguagcugcuggcaucauucugccuagacacgggcuaccugaggaguccaaccucagaaacccagcauagccgcuugucuggcaauuugguggugauucgguuguggcaagauuugacacgggugauuggucaaaucagagagagggucucuuucuaauuuuuuguuuguuuguuuucugacaaagggucucuccacggagcccuggcuguccugcaacuuacucuguagaccaugcugaucuugaacucacagagauccccuccugccucugccuccugagugcugggauuaauggcuugggcuaccacaccuggccuagaggguuuccucuaauucagcgcauuccucauuacaccaaaugcugucuuuuuuucucuuucaccccgccggcuucacuuccaagguaucgcacaggcaaggcaagcgccgcaccacucagcuacuacgccagcgcucgcuugcucuacccuuuaacagccuaccuauccguccuggcgcuaaaguuacuuuucaguuuggcucuugugugcugacccuauuccauauuccgucagaccaccuguucuggccgugcagauuuaaaugcuuaacuagugggaauguuugccaagugucgucccagagaguagcacccuuuugcuguuugggagagagggcugggaauugagccccuaaguguggagcccgaaagugugcauaacaucugggcuacauuccuugcuuuuuguuuagggagugaguguuggggacugcugaggagagagaaaggucuguuuuugugaacuugcugaagguugcuuuuccgacauuagguaucugguuauuuauuaacugcuggggcuagcaguaaguguccaguaaacacuugguuuugucacaagagaccuugagagaaugauggugaagccuacucuagaguaaagagagcuuuuguugaagauugcgaaaaaagaggaaaaauauaaauuaaauggugaaucuugcacuaaggcaaggaagaacuccagauuuuuggacuagaaaucauaauauauacaaguucuuuucuuucuuucuuucuuuuuuuuuuuuuccuuuuucuuuuuuuaaaagacagggucuuagguaacccaggcuugccucaaacucaaauguaucugauucuggcuuugaacugcugauucagugcuugcuuauacuuccaagggcugagaucacaggucuggaccacuacaucagacuuuuguuuguuugcuuguuuuucaagccaggguuucucuguguaucccuggcuguccuagaacucacacuguagaccagguugaccucaaagagaucuacuugccucugccuccugaguguugggauuaaagacauauaucaccaugccugcuuuuuuccccuuucuuaaaccuuaaugugguggcuggagagguggcucagggauuaaggagagcacaucuuguucuuccagauaacucaguucaguucuuagcacccuguucagaccauucacaacugccuguaacuccagcuccaagggaaagaugccuucuggguacccacggacaggcauggcauacacuuauacacauacacaugcacagaaauaauguuuuuuaaaaaaaacuuacuaaguauauuuuagguuagucacauauuaugggaugcauauagguaguaauaauguauaugguuacuaaagugacaaauguaaauuauaagacuugcuaagaugaacuuacugggcacaauccuggauacaguagucuuugauuacccacaguccucuguucuacccacucuuccauaucucccacuuuguauucuuugggaaaagucugguuucuugccaugccccgucuuauuucuagcugugugcuuggauuuaacuucccaaugaaugcaauuauguagcauuuuucuugcaaugucaggguuguuuuucagcauagugucuucugguucuguccaugugacagaucuccuuuuuuaaggaguaauaauuuacaguaugucuaauucucuuucucuauuugucuguugaagccauggcuauucagugauagaggaacuggcaccugcaaugcccuggcuucaaaagacucuguaaugucauaagagcaaccauuaauaaggucacaaccuagauggguuggucccauauuuuagcucuugugaauaaugcuacaauuguuauuagugaacagauuucuuuacaagguuauaauuuaauuuucuuugguuacuuauccaggaaagggauuguuaguucugguaauuguauuuuguuuuuaauuuuuuuuuaaagauuuauuuauuauuauauguaaguacacuguagcugucuucagacacaccagaagagggagucagaucuuguuacggaugguugugagccaccaugugguugcugggauuugaacucuggaccuuuggaagagcagucgggugcucuuacccacugagccaucucaccagccccuuguuuuuaauuuuuaaaaccugauuugauuuuuaaaauuuuaaguggauacagagucuguacauauucauaggauacuuuguaacauuuuuuaguuaccauuuuuuauuuuaguguaucuguguuuugucugcauguaugucucugugagggugucagauugauucccuggagcaggaguuaacaauugugaacugucagaggggugcugguaauugaaccugggucuuuuggaagagcagacaguguucuuaaccacugagcugucucuccagccccaucauguaaugugguguguguguguguguguguguguguguguguguguguguguuugaaacaguguuucccuuguguaaccuuggcuguccuagaacucacucugcagaccaggauggcuucgaagucagagaucugcuugucuuugccucuggagugcuggcauuaaaguuaagagucaccaugcccugccugucuaauuucaaaacaaaacaaaacaccauaaauuaacccauuuacuauaggcuaguaacgguagcauuuacuggucuuucaguuccucagucuugauguugaguugacugugacaauagagguggcauuguagauccaggucccaccagccacuaguaccaguaagaucuuagagccagaccccauagcucauugcuucaccuugguuuuugucacagaaggauauuucugauuuuuaaaaggcaacuccaugcuacuauuuuuagugaucauaugaauuuauguuuccaccaacagugcaccaggauuucuuuuuuuucugugcuucccuauuuguuccauauauauacauguauguguauauacacacacaauuacagugaguuugaaugguguguacauguggagaccagaggacaaccuguaguucucuucauugagggaugaacauaggaaucaggguugucagguuucgcgguaaggacuuuaauugcuggaccuuuggccuugcccuuuugauaauacuuccucaugggugugaguuuuuuuugggagggggggaugugaaguuuuaucucagugauuuuaauuugcuuuucccucagaagaggugcugagggauguguguuaguugccuauuaguuuuaugucuuugagucuuuuucaacauguagauuacugaaguaccaguuucugguuaugaauauacuauauaugaguaaauauaugcucacaccuucuuacugugcucuuucuugaaguguucgaauuagauuguaaagagauaauuuagguuuucuucuuggugguuaaugaggaauuggugguauggguguguuucacuugaguggagaggaaauuaaauauaagcuccauuaaaaaguagcuggagagguggcucagugguuaagagcggugacugcucuuccugagguccugaauucaauucccagcacccauuuggaagcuuaucuguaacuccaguuccagggaaugugauggccucuguguaccaggaacacacucaguucauauauaaacacgcagacaaaacacccauauacaaaaacaauaaaauaagugauaugaaauauauaugcagcuuuguuuaugucuauaucuaaaauaccuaggaacuuucucacuucuuacuaguuguguggcuuuaagcagauuucuuaacuucuguccuguaauuuccucagauguaaauaaaaauuaauaucuagauuauuggguuucuagcaaacugaaaugauaguuuuagucuugugagacagggcauuuauauuacccuggcuucccuggaacucacaaacaucuuccucaugucccucccaucuaaguaucaggauuaaagaucugugccaccaugccaacuaccuaaaugaguuuuuuuaaaaaagauuuauuuauuauuauauauaaguacacuguagcugucuucagacacaccagaaaagggcgucagaucucauuaaggaucguugugagccaccaugugguugcugggauuugaacucaggaccuucagaagagcagucagcgcucuuaccugcugagccaucucaccagcccccuaagugaguucuuaacagagaaacgcuuacaaaucuuccuggcacauagugaauguuuaguauacauuagcuauauuagacauauuaauaaucuauaauugauguauacaugaacgccugcuugguuuucuuuuugaaagccauagcuagcuggcuugagaucuauuccagugguucucaacauugguuggauauuagaaucgcuuugagauuuuuguccuuauucaaagugguaggauagaggguuggugaaauaccacgaaggcuaaaggcucuugccaccaaggccgagaaccucaguuugaucccuaagauccacaugaagaaaggagagaaaugaccccuguaaauuguccgcugaacucuauagcccuguaggcacaauguuuugaaugccuacccuuagguuauuccaaugcugauuuuuuuuuuucugcuuucauaucuuguuucaaccuggacaugacaucgugaugcuuaugccaagaaucuccugucucaaguuugugugaacaguucuuaggguuuauucucugccuugucagucaaugcugaucacccaauggcugggcagaauagagaauaagguggaacauccgccagccagaggaaagagagagggagauuagaucagcugguaggauggaggaauuggagccaugaagaagguucugaagaaccagaucaaaaauaaugugcaaguaucaugggauggggcuggggaguggccagauuagcuuagaagguaaagguuuaacuacccagcuauugaggugcaguuuugaauaaaucuuauuuuuucuguaugguuauuggggaauagcauaauauaaagaaauacagccaccugauuaauucacuguuuauauuaauaauuuauuuauguagccauacacacaaaggaaauaaauguaauagaagcuugcuuacuugcucucucucuuucucucucucuccuuuucuuucuuucuuucuuucuuucuuucuuucuuucuuucuuucuuucuuucuuucuuucugaugugucuuggcaugguggguuaagcuuguaagucuaaaacuuacgauguggaggcaggaggaucaggaguucagggccauccuccauacagugaauucaccagguacaaccuuggcuaucuuugaaacacagcuuccuugugcucucagaaaauacuucccagaagauuucaccuuagugaugcuagucucuuaaucaccauucauuuuuuaagcuccagcuaaccagcauauauugucccgguaguccuuucuauucuggacucuaaagacagagccacauggcaaaguugcugaguucugcuguuugcuggggcuggaauaugguucccuuauucuuuuacgggcuuucuguuuuccaacucccucacugccuaggguuggcuguccuggaacuugcucuguagacugaccuugaacucagagaucuacacgccuccuaaaugcuaggaauuaaaggugugguccaccaugccuggaccuaaacuuagcugggcgaaaucuugucccaaaguccugcucuguuguauuuaucuucuagaacauagaauucagcuccauuucaacuuccugguaccccuuuaauacucaaaacauauauuuuuuaacauauauuuuuuauuuuuccuuucuaagcuugcuaugcuuauuauucagaaugcucuucaugagacuuaaccagaaaacaaagucucugcugaguuuuuuugagauuuccuuugucgaugcaauuaauauaaauuucuuuaccuuagccucagggagacuuuuaagauaaagccaaaaagcagccaaauuccucaccaaaaauaucauaaggacaaucucucauccacuucucuucugagaccucuggagcuagacuuccacaguucagaucacccucagcaacaaagucuuacuuuauuccuacuaggauggccuauuaagccccacuuaaagcauuucacugcucucuaaauccaaaguucccaaguucacauucuuccaagcaaaagccuggucaguccuagcacagcaauaccccacucccgguaccagcuucugucuuaggguuuuacugcuguguguucauaugaccaaggcaacucuuccaagggcuacauuuaauugaagcuggcuuacagguuagaagucuuguccauuauccucaaagugguagcauggcagaguccagguaggcauggugcaggaggagcugagaguucugcgccaucuguaggcugcuagaagacuggcucccagguuccagaccaaaguuucuguugugcuuacagacgaccuuuuucucuuuucuuugugagacaggaucuuaauauagccaagcuggcuuugaacuuaacuguguagugaguguaugauaucuugguggacuucugacccugcugccuuccauaucuggaaugcugggauuacaggcaugugauacuacaugguuguaauuuuuuuuuuauuuguuugguggguacugggauucaaaccuaagaccuuguaaggcaaguguuuuacuuuugaaugauaucaaccaacccuaagaguuucauuuucuuuuuaaauuuuauuuaucauugcuuguauguaggugcugaugcauugugucacggugcguauauggaggagaccagaggacucuguagaguugguuuucccuugacugggacguuccagggucaaacugaggcucucaggcuuguccagcaagagcuaccucacuggcccugggcaguucccuucaguauacuccuaugguggcuccuugucacuuugaccuaggagcuggugugccuguugacaguucucagugaacaagaauuugguaggugaguuugccugcuagucauuucaguaccugcaugcuugcgccauagcugugggaauccuggcccagaggugaucuuucagcuugagcuguguauacauagagccucuugguuaugguaaguugucuacacuuuuccuuuugcuaggcuaaagacauccuauccuccccgcucccugguaaagccaggacuuaaaccuaccccugagccaugauuuccuuaggcuguuuuuuccuuuuugggguggggaugguuucaaaauguaguuucucugugucgcccugacuguccuggaucuagccuaguagacuaggcuggccuugaacucacagagaucugcuuaccucugccuucugagugcugagacuaaaggugugcgccacuacaucuggcucucuuacuuuuugagaugguuccuguuaaauugcccaggcuagcuuugaacucauucuguaggccagguaaaccccaaacuugauguccuccugccucagcuucucagcuagaauuacagcccucugccacaagccuggguguguguggccugggaauagagucagcuauguguccuuugcauauuuauucucuugcuugguggugcuuuuucuaugccaggacaucuucaaagcccaaaucucuccccucauugaguuugcugaccgauagguaccugugcauguacuugauaaaucagauguccaguaacagaaugugcuagggagagcuagggauuucugugggugggcucaguguuaaugagaaugaauguuauauucuuugucaaaguguccuaugggcuuggacggagcugugagccugucaguauuagggagaaggaggcugggaaccaaggaugaauagccugugcuuuggaccucugaccucagugguuuguaaauaacugccugggaucagcagggauggccccagggcaagcugaguggcccuugagugaguagcagaacugacuuuggaggugaaauuugcccaggcacagggugaacuguaaggguguugagcauacauaggagagggucuuagaugagagcacaggucuuccagggauuuauucugguuugugugaucuguuuggcuuccccuuuuguuuauuuguuuguuuuuuuauguaccagcuccugcucuuucuucaagcagauauauuuuagacuuccgugucucuuacugguggcagugucccggggacaaguccaagggacuuguagcuauucugugucgccauaaccagcucugacaaccagaucugguuagauaaugauagaucugguauauaauagagagauaaugacuaaaucuggugugcgcccugugcuggcagacccacuggcacgauuuccccuguuggcauagaguuggucgcagcuucuugguucuuuguaugcagagccagcccagcuugucuccuaacgcugucuuguaacaaaaccaguggcuuauaagccaaauguuuuguuugacuugcagaaauuauuuuuaaaaaauuagauuacauugcaacacauucaugucuguaauuauacuuaaaaaucuggaugccugacucuuugaaagaugacuuagaguuuagcaauuucuguucugcauucuugcaguacuggcguugaaacuggggcugugugugccgggcagaagccuggccacugagcuacauucccagcccugugggcugaaugccuaaagucaggagcuuguuggaucugaguagguggagaucugcuccuuccuugaguaggguagcaggcagggagacagaaucaagugucugucugucugucugacugucgugaaguagggucucacucugcuucuacuguguggauuccagacgucuuagugaggguuucauuacugugaugagacuguaguugaaccaauuuaaacgugucccugucuagcuuacaaaugaaugagacucagacuaugguuauuucauuuggcuuugacaauuacuggggguaaacccuaaucuacuuuucuagcugcuggccuggcgacuuccccagugguaugccccaauuacuuccuguuucucccggccauugaccauggcucaucucucaugguggcuuccuccucguccuguucuuucuuauuuuccuuuuuuucugcuacccccaaccagguaacucaaaacccaccuaccucucuucccuccaguaauuggcuauacuauuuuuauuuaaccaauaguuuuuaaauuaaggaaaagguuugcgccacaaaacuagaccuauagguauaggaguuaguauuacaauacauagcaacagaccaaaacucaguaagagacaccauaaccaaggcaauucuuacaaaggaaaacauuuaguuuuuugauuucuugaaacaggguuucucuguguaguccugcuuguccuggaacucacuguagaccagacuggcuggccuugaacucagagacccaccugccugugcuuucugagugccguaauuaaagguaugugccacuaccaccuagcauuaugauucauuuuauuuuuggagugcguuuguuugucucucucauguauauguauauccaugugugucuauauucaauuuuguuuuaacuuuuaacuuaaaagcgauucuugucagguaguaguggcucacaccuuuaauccugacacaccggaggcagaggcagguggaucuaugugaguuugagacaaacauggaagccugcaggcagauaugguguuagagagccaagaguucuacaucuugaucugaagacaaccaagaggagacugcauuucuacagugggcagaauuugagcauagagaccuuagagcccguccccacagugacccacuuccuccaacaaggccacaccuccuaaaaaugcuuuuuccuaugggccaagcauucaaacacaugaauuuguggggccauaucuauucaagccaccaccccaggguggaauugaaguugucagucauggcagcaaacucuucuacaaggcuaucuuucuagccugggauucggcucucauucaguagcccaggcuauccucauagauagcagaccuaucaguauaacaguucuccucccccaguuuucugagugucaggauuacaggugagccgcccugcugcuuuagaacuugcuaguuaaccuuuuuuuuuuaauuuauuaagauguuuuuauugagacaguggguuaagaacccugccuauucuuccagaggauccagguuagguuccuagcaugcauauguauauacauauacauauauauuuauuuauguguauauauacaucuuacaacucacccaucuguaacuuccguuccaagaauaugacccucuucuguccuccgcagguaccaggcacgcacgugguacacauaccuacauuuaggcaaaacacccaugcacauaaguaaaauaaauaaauucuuuuaaaauuaaauguuuuauuccauuugauuuugugugugugguggguucauggucugccacuacuuauuuuuauuugcuggagggcagaggggaggagcuugguguugucaugacacagccuuggagggcaggggacaccuggcagggagucaguucucuccuucuaugcgugggucccagggauuaaauucagguuauugggguugucagaugucccuuaacccgcugagccaucucuucagccuuauagacuacuguuguuuguuuguuuguuuguuuuugagacagggccucucuauuauguagcuccaucuaucuuggaacucuguagaucaggcuagccuugaacucauagagauccacuugccucugccuccugagcucaccccaucuagucugaucuauuucuugcacuucugacaccuacccacuagauggcaguaucaccuugaaacuacaucccgaguccuuguuuucacggcuuguaucacaucacuuggcugugauuauucuaccggcguccgucaaucagauccagagugcuaugcuggcuuugcuggcuuuucaguuucugugcacacuuccauaccgauugcucuuacguagagacugacagacgucuucucuagguuguaggugguuggugaagaaugcugugaaucuggcgugauuauuuguacuuggaggaccauguguuuuucugguugcuucuucuggcuucacuuggcucugaaguccuuacauggaagaucuaguccagggacaguggagaggcaugggggcuguggaaagacugggggcggggggcaguggagaggcgugggggcuguggaaagacuggguguggggggcaguggagaggcaugggggcucccacaacugaagacugcagugauuggggaguccuucugucacagcacuuagacuucuggaaauuuggggcuauaaaaauuggaagaaauuacuaccauuuaauugacuaucgucugagaccagccuccugaagacaggugaagcuguguuugcccuuuaauguccguugcuccagcuguagccaauucuuagcuuuccuccuucucuuuaucuuaggguucuuaguagccaccccagaaggcaagagcagaguaccuucucuuccucaaagcaauagaaauagacagcuuauggugaaauggaaaggggcuagugagauggcucagugggugaagggccuugcuacagugagauggcucagugggugaagggccuugcuacggagccugacguuuggaguucaagaccucccuccaccgugggaggggaaaagugacccccgcaaguuguccucugaccacauacauacuauggugugcacacacaguacuuugaucuauuugucuuugagacagugucucacuauguaacccuggcuagccuggaccucauuauguagaucaggcuugccuuaaacucuuaauuaucugucugcuucugccucccaagugcugggaguaaggcugagauaguuaucuauaccaaggcccugauuucugagcuucauuaguuagccagucuaaauauguagacuuaagaugacaucuaccguuguccuccaauguccacgcauacaugcgaauaccuguagacaugaaaacaugcuuauucacagaagagagagcggccuguuaggaaaagauuaggacagucaauguaaaugacuuccaaccugcaucucuuuaucccuagaagggaaacuuggagcuuagguucuuuuaaaugguagcaugaaacuuggagcuuagguucuuuuaaaugguagcauggaacucuggaacguucuguccuauagucuuggccuacugaguaaaaccaguguuuuccggcucaccaccuauggcgcuggcuucccauagcuuugccaccugcugaguauuuuuauuugucccuagacuccaacuguaggucucaaaugcccacuugcccuuagacaauccgguaaauagcuugacugcauuggcaugaaaugugcucugggccucagcaugcucccagcugauaguuuucuaucaccuucacaguccccaaagcugaguccacguagcugugacaucuucuaugcgacuccugcagaugggucuggaaucgguuagccugucagccacacuguaaucugcucucgacugugcuggccgggcccugcaguggugguuucuuucuagugccucagcuugcagcgcccugcuccauuaccaguucagcaaccggaaugaauucuaacaguguacgaccgaccgaccaugugaucuguguucaaaacccugucauggccucccaucacaccagaauaaaauagucucugugcuggccaucacucccgguuuccagguggccagcaggugccugcucaggguccuggcacaugcucaucuuuuugccauuuggcucgaggaaagccacuggccuguugugagccugugcuucauuugugaguggcauauagaaugccuucuuacuugacaaggggguugucucaggagugcccaccuguucuacuguuguuuuuccuucuccuucuccuccuccuucuuccccuucucuuccagccaguuuuugugucuuucuaguagugacacacuaugauuuugcuuagguugaaauaagcuuuggccuaccacaugccccucugccuuccuaucccaucuuuguuuuugagucaggcuggauucaaacucaucauguagcuggcgauaaccccacacucccgacccucuugcuccuaccucccaguugcugggguuaaaggcuuucacaccaugcccugcuuggccaguagagugcuggacacaaggcacuuuguacuccuguuaucugaccucggcccuccaguaccuugauugacagccuagaggagagggagugggaagaagaggcgagccucggaacuugacagcagagcucagagcuugcccucagcucuguccccauagcacagcucauugccuugauggggagcagcaaaggcggggaccgcagggacguggacaccggcagcugccaggcagucugugcuuguuuuacagcagagcugccuccaugguccaggucaaauccgguugaaaaccaguagcaacaacagaagaaacuccaaaacuauggccuauucuuuuuugaacuuuauucuuguguugaguaaugcuuugaaaaaaacaaggucacuaacuagaaauaaaaguuggaguaaaacagugauuuaaaaaaaauuuuuuuuauugaaacauagucuuugcuaugcacuaaugugccugauacuuauauguagcucaagcuggccucagaggcccaguaauuugcuucggucuuguugaauacugggauugaagaaguuucccccauacacccugauuuuauuuuuuauuuuaagacaggcucucuuaaguugcccagggugaccuugaacucacuuguagcccaagcagaccuugaauuuuugacccuccugaauagcugagccaccauugccugcuggcccuuaagaucaugauagucacuaggcugggucuucugcaacggugauucucucuuaauuguugagcuacgucuucagcccccaauugagguauuuuaaacaucuuccccugcacuugccugguucaguccucaucguuaaaaguuacagaacaaucuaaggucaguugagggaaguuggugggaaggccaugagacacacacuuguuagauaauguccgucagcgaaggugguuuuaacuuccaagagauguauccagugcucugccucacuuacgcuugccaugaaguaagugguaacuccuuccaccuuuucuuucccucuaggcaaaucagggaucgacugaagaaccagguaacucggaugcaggagcagguaccuggcuucaccccuggccuggcaauccugcagguauuggagcaucuuauucccguuaacaccauucuuaccuagccucuucacagcaguagaggcugcagcacuucagaccugggccucccaccuugugaaaccucagacacacccauggcuucucacugugggcucccauuucugguacccagcuucccggugcugguuuaucuugcucuaugacaguauggugggugcuuuucuccuuuuuuuguuguuuuaagguagggucucauauaugccagugauauggagauaggcuauguaggcaagggugaccuugaacucccgucuucugccucugccucccaacuuccaggauuguaggcaugugccaccuugccuggcuuuguguggugcuggggauggaacauggggcuuucugcaugcugggcaagcccucuccccacugagcugcaccguuagcccugcccacuaggucuucuuaggaccuuuuguacuuuuuuuuuuuuuuccaaagauuuauuuauuagaauaaguucacuguagcugucuucaaacgcaccagaagaggguaucagaucucauuaugggugguugugagccaccacgugguugcugggauuugaacucaguaccuuuggaagagcagucggugcucuuacccacugaaccaucucaccaucccccuuuuguacucuuaaacuuuaaacagaacuuagcuaugaauacuuacuguguugggaauaaaauuuggguuuauguauuuacuuauuuucaagcacauuaauucuuguuaaaagauuuuuguuuuuuuggacugggucucacucugcaacccuggcuugaaacacaguaaguaauaacucggaguuauugauaggaaguggagucuaacaacauagaggguaguaucuacccagcucuugugcuguuuaaggauuauuguaaauauaaaggcuuuuacuggggaacuaaagggucaaagguaggguagaaacccuggguuaggauuaaaaauuuucagcaacacuggcugguccgaaauucccuauguugaauuauacauuauuuauaauuuaauuauuuuuaaguaccuguguaagugugugcccuuguguaggugugugcacacaugaaggcagcaagccagugaguccaggaggagggaccagguccccagcgugggugcugugagcacgauucuuccucugaacugccgagccaauggaaacucuugauauguuaaaguaaacaucauggagagagaaccguguuugagacaggcccugcuuuguaccccaagcugacauugaacuucagaguacugagacuguaggugugcacuacugugccugcuuuagaacuuuucaauaguaaaauuuggugagaaggcaugcauuaccugcggaaaacuuaaaaccaacaacaacaaaaaaccccaaccguacacauucauugacucggugugugugcgugugcgcccugccuggcgcuccugugggauucaaagguagcuccaggagcugucuuagucagcggugcuguugcugugacggaaccccacgaagggaaagggcugugugcccugugcaugcugggagaaggcaaggcaggagcaccgacuggcaugagaaauggaggcaggagcucauguagacgccauggacgggugcugucuacuggccugcuccucauggcuggcucagccugcuuuucuguagaacccagaaccaccagcccagggauggcaccacuaauaaagaaagggcuggccccucccacaguaagaaaguaauggaugggcauuauaauguauauguauaaucccaacccuugggaugcugaggcaggaggaccgcuggcagccuggcuuaugugagugugagggcagcccuggcuauacagcaaaacccuguacaaaagaaugcaaaguaaacuuguuggacuuuguaaaagcuacaucuggaggggaaaauauggcagagaaaaaugcccugcaccaaaaaaaaaaaaaaaaaaaaaaaaaaagaaaggaaggaaggaagaaagaaagaaagagcaagcaagcaagcaagcaagcaagcaagaaagaaagaaagaaagaaagaaagaaagaaagaaagagcgagccagacucuggaggcagaggcaggcggauuccugaguucgaggccagccuggucuacagagugaguuccaggacagccagggcuauaaagggaaacccugucucgaaaaaccaaaaaaaaaaaaaaaaaaaaaagcccugcagacuugccuauagccugaucuuacggaggcauuuccucaauccaguuuccauccuuggguaacucuagcugugucaaguugacauaaagacuacaggagucauuucuccuuccacugugugggucuuggagagcuggaccucuucuguuuccacauuggucuccugcuaugugcuguucugaucgaggaaaaccugucuggaccuguagauuggggguagagcacucaccuacauguaagggacucuaaguuuaauuuuuaacauucucucucucccucccccucucucugccguccuucuuauacaccccagaaccaccugcccauaggauugcaccaucagcaaugagcugggcccucccacaucaaucacucauuaagaaaaugcuccacugacuagcccacagaacagucugguggggccauuuucuuaauuaagguucccucuucccaaaugacucuagcuugugucagguugacauggaauagucaagagucaacaguuuugguuuuuaguggguuuuuuuauuuguuauugagacagauuugguggccgcaguccacggccuuggacuugugaccaucaccuugccccauccuccugagggcugggauuggcaguguguagcaccaggacagcucaguuguucaguuuuagaaaauauuugcaaaauacugaagccugaguaaucacuguugguucuuucgagaaaaguugguuuucuguggaagagcgcaucugguucaucuggcaaggcaaaauaacacaaaugcuuugccuauuaauagcacugagcuuccuucacagacagcaggggagcugugggaaccuccggauucuuuacauaaaauccucaaaagacgcccagguugaaguuuaauaacaucaaugguuggcguuaccuaccaagagcauuccuuagugaaacugccauuugucuuuccugagggaccauggcuggguagauacauggagaauagugggguugguaugguauccuuggucugugcugccaccaucagacuugcugccaccaucagacuugcccacuguuacuucauaccaccaauacaaaagccaacccaauuuuuaaaaaggaaaaaaaaaaaagacaaaucauaucauacucuguaaagguugucagaauuuaaagugacauuccuuaugacaaaccuuugcaaagcgguucacaaagggacagucgucacacaugacugcuucauaacuguaucaucaaagucucuaccaauauacuauaacuuuacacaaaaccacaaccucauacagaaagcaguucuacucagcaauuuacugccuguccaaccauagccuaacaucaucauuaccaugcaaacacuugcuauauaucccuagaacucuugccucagccucaggcaccaccaccaucaucauccagacacucccuauauagcccaagcuuaccuugaacuccugccucagccuuaagugcuacaauuauggguucaugagggaauauugacaaacugguuaccuucugugcaguuuucucucugaucuaaagauucauccaauagggaggcgaauaguugcuuaggcagauguccagaugggugccugaaggauugauuggguggcagaaauagcuugcauuugaaacuugcuucagagucaccaucuuccuugucccacguucugucugugcgugucugcacauaugccacuuaauccuuuguaaaccucugucccuuauguaucaaaaaacucagaacaagugguaguuaaauaccgccuccccugacccacucggcuguuuauccacaucgccuuagcagagcagaaauacagaagguuaugguugugccuggugugcucugugugugguagcuuuuuauuuuuauuuuuuaaaccuccaauaacuaagaaccaaagauuuguguggugggugucuaccugguacauuuggggacugguuacuucuuaacucauucuuacuguuuuugugggaagaacugcaugccuuaggcaugaauugugacucugggcuggagguguagcucaguggcagaacaccugcccaguaugcaccaggcucuggguuuauccucaacauugcaaaggagaaaagggggggaggaggaggagaaagaggaagaggaggaggagagagagagagagagagagagagaaugagaaugaaugagacucacuucuguaacucagugaacuaauaagcuacgucgcuugguccagcaguucacugagacgucaaaauggagucagucgcacuaauguucgauggcacugaguuauuuaucugaccugagaaaaagcagccgaguugccccggcaggccaguuuccccagaugugucaguugugacccucccugccuccuuccagaggaaguaacuuugaaaugguagcugaguuuucuucuugcuuucuucagccuauucugucuaaaaaacaaaaaaacaaaaaauaccccaacaaaacaaacaaacccccaagcaccucugccuuaugaaaugaaagaaacccagcucuuugaauugugguuucuuccuuuuuccuuccuuccucuucccuguccuucaguguacaaaggguucuuaguaucucuguugggucuuaacccauuauguagccaagguggcucugaacuucaguuccuucucuuucuacuucccuagggcugcaguaacagccgccuggcacgauacccagcuuaaguucuuuuaaccaaacuuuuucuuagcaauaauuguuaaaauugacuucacauuuauugauuuugcaaguaucuacuauagucuaauuaguuucugcugccugugucuaagcaaugagacaaugguguagaccuccugucuuuugcucugaaguuuuguugucuuccgcacccaugccagaagguuaucucucuucaaagccugugugguacgugcuugcaaucccagcacuggcucaguggaggugagaggacugggaauucaaggccagucuguuccucugugugugugucugugugugugugugucugucugucugucgccuuuucauggggcuguugaccuauggaaucugugucuuggaucuugaaucuauucccugcuuuauaccucuguucuucucacccugggucacccugugacugcucacugguuuucuguuucuagucuaaaaacuuccauucuuuuuaaguauauaaauaagccugcauguaugucugcacuacugcauaccuggugcccacauaggccagaagagaccauugaauccccuggaugguugugagccaccacacagguacuggaaauccagcccagauucuuugaaagagcagucggugcucuuagccccucaagucucucuucagcaggaagcccuuguuaaaauacaaaucucaucauaacuacacucccucuuuacugagggaugacaguagauaaguguuuaugcugguucaaagguacuguauauauuugugauugugcuaauuguuaaauuaccccuauaagauaaaagcuaucacaacaguaaaaacaucuuaggggcuugcccaaagccacucagaagggaugaguuuggcaccccgaucaagcccuggguacaaaaccugcuuguuucuuuuuuugucaccauauaaaucaacucuucuuaagggaauaauaguuuauucugauccaauuacaaauagccgugauaggucagaaaauguggauucaaaggaucugaaaggaaccauggaaagguuacaugaacuuuuauagucaccaaaaagaaaguuaucagaccacuuguuugcaaaguacauagauagggccaucacguuuaugggcuacaccaaagcaaggaaaucgacuuagauacuaucuuuguccucaguucuaggguuaauggaggcuagccuugucaagcuuauuucuagaguuuuaucuaaagguuaugaggaagucagauagaagguggauagcaaauggagccuggaaagauagccagaggucucuuuggcucuuaacuggcaacggucucuucauauuuagaauguucuauuuagccaggugggcagucuacaggaucucaagcucauuacaucaucaugcuuuuaaaggacguccugcagccaggguggggcugccagggcagaggugcacagcugugaauuaaguccagacuggaaaaccaaacugcagaacauacacgaucugguccaaguauauacuuguuagauuuuucucccucccucucucccucccuuccauucuauuucuuuucuucucagacuuacuucgauuucugcuauaaaaaauauaugugguagccauagcagaagucuggauccucuaaaggagcucuggugugaguuuucacaagguggccacagucucuuuccagaaguuggggguagcuguaagucuuggacaugguuuuagagucggccuuggugaaguuguccagaguggcagaauagccccuggcugguguguaucagucaucaauacuggcuaucaaagcuuccugggcacaggaacagagaucaugcuaaugccucaggugacacagaaccacuaugguugucaccuuucaugggaauggggcuugccaaucuuuauuccuacaguaaccucucugcagaacgaccaugaaaaucuuggccaauaugguuaccuccucgaaggaccuaacacuaaguccaacuugaccguugcagcccacaucugcacgaucuuuagaacagcauccuuuagagaugcucuuaagagaaugucaguggucacagaguccucgauaggcagggagaauagguagaucucaccaaggcccuugaucuucguguucuugaccagauggcccagcuuggaaauggggauccucucauuguccuguuuuagcuccaugaaccaugggaccucaccauggccccuaagauggauagcugagccuucccgagccugggcccccaguccuccuguggcaccugccauauuucugaggaagaagcugauggcuaguggguguuuuggguuuuguuguugguuggcugguggcuuuuuugagacaaggucuuauggagcagaugcuggcacugaaccugcugggcagccaagacugccuugaaaucuguacccaucucaaaaaugcagggauuacaacugcgugccccaugguguaauggugcaugcuugugauccaagugcucaagaggcaguggcaggcagaugugugugaguucaaggcuaaccuggucuacauagcaaguucuuggccagccaggaccguaucuugagacccuguguggaagagaaaagaauaaucaaacuuuaacauacacucugucuggcuguuauaaaaaguguuugcaaaggcccugaaccaggguuuauaaccccagcaugugggaggcagcggcagaagggucauaaaagauucuagcccauuuugggcuacaugagacccagguugaucucaaacucauaucagucucccuccugccucagccuucuacaugcugugauuacacaucgggcuuaguuuugucuuguugggucucucugaugguuugaggccccaccccuuugcaggaagggauugccacuccagaugaaaugcuuaaguaacauucuugauaaaucauugggauuaagauguguucuggggaaccagucuaccgcccacccacuugacugccagucaagaaucuaauguucuuuaaacauucuugcaucuagucuaucauugauuacauaaccagcucccuuagagcuggggacguccugcaggcucagcaugcaggaggcaggaccgaaaagcacagcuuaaucuccaagauucgaguuccuccugggccccagccagagguuuuaggaugcuuggccgucuacagaacggagagaagcaaaacacugcagagagaucuugaccuacacauggggaggcacuugugaaauaaguuuuuacagauaacuuaaugcaaugaagaaucacaaguaugaccaugaggaagaguguguacagugugauggggucaggguucaaaggguacaaaggcucccacacugacacccgucaggugggcgcugguuugcuccuccuauggugucuguucugauaagcuagcccaguagccccgucuuacugguuucacuaccgucuggcugauggugagcauuuuuccauugucccuggguggucggugccuuugggaacuucugccucucuagugucuuuuugacugaugauaauuucucaguuccaauuacucaucuauuacuccucccacauuucuggaaaccuguagcauucucacccuguuuacagugcaggcacugggcaacaccugcauacccuuuuuguuguaaccaggguuauccuugucaauagccuuguuuacagugcaggcucugcaucagccucccggggagcuugagauuacagguucaugccggugccuccagccccugguuuuccuuuuggcauugucagaggaucacugaucgaagcuggaggguaaagagugaagccacuuauauucaccccagccuuccccuuccccacccuccuuugucuuccauaaaaguucucggcucaaacguucguuuuauccaaacuaaaauugcagaaguuuuucuguacacuuugccuuucccuaagugucugauuugcauguauuuauuauuccagguuggcgacagagaugauuccaaucuuuauauaaaugugaagcugaaggcugcugaagagguaaagccaagaacagggaugcuggcauccuucucacuaccuccccaggucccguugguaaccccuucgcccuguguggcccuccccacaaaacuaauuuaacuauugggcaaggcagagucaggugaccuagccggcugauuucucccugugugguucucauugaugguuuucuucccugagaggcaggugagaggcugcggaaugguguugaaugugauggugacaaaagggcugauucuccacacacagggcaaaaugacacccgauacuccauugcuucagucacacuccuucagagaggcaggcugucuuaguuaagguuuuacugcugugaacagacaccaugaccaaggcaacucuuauaagaacaacauuuaacuggggcuggcuuacagguucagaaguucaguccauuaucaucgaggagagagcauggcagcaucccgauagucaugguauaggaggagcugagaguucuacaucuucaucugaaagcugcuagcagaauacugacuuucaggcagcuaggaugagggucuuaaagcccacacccacagugacacacccacuccaacaaggccacaccuucaaauagugccacuccuugggccgagcacauacaaaccaucacacaggcccagaucucagguucucauaccauuucccuguuucuuguguuuauuucugcagauugggaucaaagccacucacauuaaauuaccaagaacauccacagaguccgaggugagcguguggaugcacauggcgaggugucucccugucugcuugcuuuggugggacuucaggggcugagauacacuuugcagacagaaaauauuucuuuacagccuuuccuuccuccuuucagugucugugauuaauuaguacaaaucaacuguggcacuacuuuuagguguuaaaauaugucaucucccugaacgaggaugccucugugcacggauucauagugcagcugccuuuagauucagagaauuccauuaacacugaggcagucaucaaugccauugcacccgagaaggauguggaugggugagugcuccccguuggcuuuauuuagagcaugauucuauucuggaagcauagcguguuuguuucuagaggacagaggcuccacuccuuccuccuaauuugacuguuuuagguugacgagcgucagugcugggaagcucgccagaggugaucuaaaugacugcuucaucccaugcacacccaagggaugcuuggaacucaucaaagaggcagguaagagugagggaaaccagcaggaaaaucgugaagacucgccucugccugccaaacccugggacugcagguguuuucacaaguacacuggcucugcgccgauuuccuuagcuguuaguuaaacuuaacuacagcaugugcacuccacagggcuggagagacagugcagcauuuucuugagcuucuuugugaaucaggaccacuacgacccacuuccucuguauugccacguaucuagaaagcucuuucuuaggaagcuuugccuuccuguuggcuucaagagaacuugccucaaaaccaaggauucagcccccugcacugaaagcaaaaagaagcaaacaaacagaccagagagaguuguuuccuaagagauagcagaaccaagauuugaacccaggguuguguauauucaaagcaauuuauuuugggggugggacuccuaaaugccaaugagaauucugccaguacaaagugaguaauguuguggguuccugccccuggaaccagccccaagucaacugugguuccaacacuagacagauggcuggaguggaucuugugaacauucaccccacauuacuucaguacauagcuaguaccuuuguauuuuaguuuccuuauaaauacuuuuagcagaguuuauuuuuugcacagaaacgaguccuguuagaaagaagcaggucagaaguuucaagggaggcauuuggccagaguuaguaaugaaaguugucugugguuggccagcaaaggccaagccagaagccuugacccagcugugauaguucagaacuacaauuuauauucuucaguguguuuagccaauauuuauuacagcuuuauaggaaagagucccaugagcuauuacacccgugacuuccuggugucccacaagcuacuguugccuuaagguagcuucaaaucuuugcugagucuuaauuaguaaaguugucauuggucaauugauugggugauuugcagugcugagaaugaaagccaggggcuccagcaugcuugucaguuguucuguaguugaccuauccauucaacccagcaauggacuugucaauucguucaaacuucaaggacuucaauucuaguguagucaugguguuagcauucucuaagugcuggucuucugaugaaguugguucuuuuucaaagugugguuuaaaucccaagcaaggguucauagcuuuucagccuugccaggguagaguggccaggcagaguauuucggagcacucugcuccuuucugucugggcggcccauuucaggccccuccugguaacgggguaacccugugcagcuuucucccuguucucuucucauguuagacagacggucauagcugcaucucacaggccagagggcgagggagagacuugucaccucuguaggauucagguuucaguucuaaaaagcaccucaaggccugccugugcucuagagaggauguucagggcaauccaggccagcuagugucucaaaagaagcacaagccuggggcaguuccauggaagagcccaggcauagcgugugugagugaggccuugaguuuggucuucagcacugggguggggggauguuggcaaagugccaggagugcaggugcugagucagcgaaaggcuuuccagccacuugcaguuccuauuaucucuccccgggagauaacccuguguucaggcccuaagccagacagaacuuuggaugagaaacuguaugaauaaacucacugaaucuggggagucguacugauacuaaucugauucucuccuuugcccugacccuguuccagaugccguaguuuucaugacuguuuugcccgcguaguuuagucugauagcuacuuccauauggcuguuagcuguguguugagguuucuuuuuugaguguaggauuucuucccacucccucaugacucaaugaacagaucuuggccuaagcggaaccccaagcccuacuguaggaaggacagugggcaggucccaggcugaagcuggagcugaggcugugcuuggcguaggagcguucuuaggaagauuucugucggaugcagacgaucugcuucugugcacuuuugcuguuuuccaucuggguggugugugaacgagggcagcugcuucuccaucucuaaugugugcuggcuucucuuccaggggugcagauugccggaaggcacgcgguggugguuggucgaaguaagauaguuggugcacccaugcaugaccuccuucuguggaacaaugccacggugaccaccugccacuccaagacugccaaucuggacaaggagguaggcaauccaggguagcguagacguccagccugugugcacgcguggggacauuagcucucuaaccccaguaacugugcugugcuucaugucucauuguccaagaggaagggacaaauucaaaucacaagcuugccagcauugauccagaucuuucugacauucugaccaugcacuuucuacaccagcaugcccugugacagacaggguuuagcaguggaauuaugccauuuacaggucucccgggcagguuguuggccuuggauggagguacuccagacgagguugaacagugggcaucucucgcuguccuuuguuuuauuauuguuagacugggguugaacuccuuagaauaggcagaauuuuaccacugagcuacauucuuagcuucagcagcuuauucuugauccuuacguuggaucccugaguccaaaaugucacauggcuguguccugcgggcagagaacaagauggaggccugguacccccucuuuaauauucucaaacuguccuggguugauggugggagcaagugccuuccauaaacgaggguuccaucacuaggaauguuguccuaaguuuggcuccaaaucugugcucucuucacccucacugguucucauugccuuuccuguuagggaaaauaccuagagaagggggcuucuggcauguguaggauugaguauggcaugggauugggccagcagaaacucugguuugcauuugaggccuuacccaguaucccugaaaguguuacugauaauuaaagauguuauaucacagcucaugauuuuccuuuuugugucucuguguguguguguguguguguguguacaugcaugcauguguguguauuugcguguuuugauuauuuaauuucugaagucuagaucccuccccuccuuagguaaauaaaggagacauucuggugguugccacaggccagccugagauggugaagggggaguggaucaagccuggggcuguggucauagacugugggaucaauuauguuccaggugaguggugccagacagagaaccaacugcagcacauuuuaugucaaguacccgggcucagugagccugcugugaggagguugucugugugcuguccugccuggggucagagguguggcuccccucugcucugcuaauccucaauugacuuuguacagagagagugggagagggggcagcuguaucauagcuuauuuguuuguuugcuugcuugcuuguuuguuaucucuuccgguagccauaacuguccugugccagcuuccugaaugugggacuacaggugugcaggaccucuccugguuucuguucugccuuuguauacccguuguauucuaaggaaggcacuggagagauuuuaugauaaacuacaguaggauuuccuugucugugaucuugcuuucccugguuucaguuacucaaggucaacugugguccaaaaauaugacauggagagcuccuaagacauuagugagguuguuucuuuguuuuugagucaucgucaugcuauaguucuugcuggcuuggaacucauuauauagaccagguuggcccugaccucccugagaucugccugccucugccuccagggugcuaagauuaaaggugugcaccaacacaccuggacgguuaaugaauuuuaaauuguuugccauccagaguggcuugaagaagucuugugccauccuucucugucccacuucuuccggcuugggacaggagccacucuuuugucaccuguguacauucuaacuucuaaccacucuacuuugccuguuaguugcuugguaaucuucucuuaucagaugugaacuuaggucauuaaauuggugacaagugcuuaacaguuaguacaggaauauccacauguauguauguguguguguauauauauauauauauauauauauauauauauauauauauauauacacacauacauauauacauacauauauauauguauaugcuuuuuuuuauugcauguaggagcaguaacuacuuauucacugagcaguauagcaggccuugggcucugugccugaauauggccuaguuguggacuccauuaauucauuuauucauucauucauccauucauucauucauuuuguaguugugggaaucagacccagagccuugugcaugguacacaagugcucuccccuugaaccacagcaggaaucgcugcucucuguacuugcacuucggauggcuucuucaguuccccuccuccaugucaguucuuccuaaaucacaucugauuuuccuuucauccagagaugaucuuugucuccugaaaauccuucuugccccucacuccagucccacagaacucagcauuuugggugugucuugugcucuucuggcuccgaguucugcucugaggagcuccuuccucaguggucucuacgcugccuggucuagcauccugccugcugacgcuagcacucagaucuggggaguuggugaagcaguuacagcaaggaucauuauuuuuuuucucccuucccaucugaaguuuaaaaugcagacacugagcugccaggagcauucgucacugucaaguucucaccauuucuaaccucccucccacucggccucgcuuuuaagacaguagcucauaauugaucacucauuugcugguguaauuaucuacugggugcggaagaaguugcucuccugcaucuucccacugugaauacuugcaaugugacaucuaaacucagucugcuuacauccccacaucucuggaucauaaacuacuacuaugggcauuuuaaaaagagagacagauaaaagagaaaaauguggucuaggggugcagcucaguggaagaguuccuaagcuaugcuacacccuggauuccauccuuauuacuucaggcaaagggagagauuuauuuguuuacuuauguacuugagauuaaaaaaaaauaaaccaaacugggucagaaucuagaauucuguagaugugccugaaacuuuggcauuaacaucgauuucuuauguagauauuaaaacaguauagguggucaucaguguuuccacugguccuaugcauauggucacauaaauauaaguaaggcugaaauauguaguucccugggaauggugguaucaucguuacaggccagaggugugucucaagauccacagacugaucuuugaauaucuucauuugaugaagcaaucuaguccacuccuuaggucacuucuugguucauauuuuuuaaauuguuugggaauugaguaucagugguagaagaagaguuuagcaaacacaagacucugaguuuuaucuuauuaaaaauugagccuggaagauuuuaucgaaaggacccagauauagcugugccuugugagacuaugccggggccuagcaaacacagaaguggaugcucacagucagcuaauggauggaucacagggcucccaauggaggagcuagagaaaguacccaaggagcuaaagggaucugcaacccuauaggcggaacaacauaaugaacuaaccaguaucccggagcucuugacucuagcugcauauguaucaaaagauggccuugucggccaucacuggaaagagaggcccauuggacacgcaaacuuuauaugccccaguacaggguaacgccagggccaaaaagggggaguggguggguaggggaguggggguggguggguaagggggacuuuugguauagcauuggaaauguaaaugagcuaaauaccuaauaaaaaaaaugaggcagaggcagaaggaucucugugaguugaaggccagcguggucuccaaaacagccagggcuacacagagaaacccugucuugaaaagacaaaaaaauaauagauacagauaaauagguaagaauuguuccuuugcuccucguguggcucacacaaugagucaccuuacagauuaagaacggauuaaugcauacauuuuuccaguuuuuacauuuugauuugcaauguuggggagucaaacucaggacuuugcacauucugggcaaacacucugccacugagccacaucuccagucaccucaaaagaagccuuuucaggaaucgaguggcuggagcuggugacuggcuuuccggcuuggcuaguaaagauacuuggagacgugacagugcuuuauuuaacaggggcagauuccucaccucaccaucuccacucacaaccuaagaguuucuguacugccucuauagguaguagccuccaaacugaguuucagagccagacucaagccagacuugaguuuuaugauuggaaauuuccauugacggagaaagcguggagcuaggaagggauaaccgugcuguuacguggccacuguccucccgaccacacaguaguggugaggcucuuguccccucuucagcagggaauuaagucaacccucauaguguuuggucaguguguauguguacugggcaugugcagaagucaggauaacuuuuuggaaucgguucuugccucccucugccuuggugagauagauuccuuuccaccauccuguauucucccagguuagcuggcccacuaguuuucuggugauuuuuccugucaaccccucagccugggaauguuggacuuacaggugcauccaccuccuaacguggggaucuaaaccauucuuucucccuccuccugcaucccgaaaaggcuuugggaaggacuagaaucuuucuugccauggugugcugcuuuagccuuucaaugaccuaaaauauugugagcaggugugcguuaggccuuugcauuuuuggaccacaagucagugccaagccucgaagggugaaggauagugauagugaacaggcucauccuagagacggaagcuucuugguuugggguuguuuuauuuuuuauuuuuauuuuuuggcuacaucaaaaaccuuccucucccagcauagcaacaugccugaagagaacuggaaaugugccuaagauucuaccagauccuccccaggaacuuuaaugcuucgaggucuaggccugucccucagcgucucccggaagugccccagagcaggguguaggauguucucugugugagcggcggugcaucucugaguuuguucccuugaauagcuguucuucgcuggagagauuugugcuucugguccuuuuaagggaaguguaauuauauucuuugccuugagcaagcauuuaagaaacugcucaguauuuggaaugggauguugaauuguuccuccggcuccugccuggagcucuguaacugcugacaguugcuguagaaacguaucuggcagcugugacauaguuggagcuuuguguaccuaaaaaaaaaaauuccuuuguaggccuuggcaaauuaacauuugaaaaggucguacauuuuaagaauaagaagcguauuuuauuauuuaucaccagagggacuauaaaaggaaucugaaaagcccccuuuuuaaaaguauuuauuuauucuuaaauuuauuuauucuuaauuuauucuaaauuauuuuaauuuucuguucuugccacuuagacaucuccugagguuuuucagauaauguaauuuucucccuagaagaugguggagcaccugccagcuaucuagcacuggggauuggaauagaauccagggcccgucucgugcuggaccagugcucuaccacagaacugcacccuggcauguccaguagcuuuaauuaaauagacacucaagccucaugggacuaauacccucugcagauggggagccaagcuuauaaucaaucacuacgucaccgugccucugagacucuaugauuacgucacugugccucugagacucaacuuugauuucucucccuuuccugauccagaugauacaaaaccaaauggaaggaaagucgugggugauguggccuacgaugaggccaaggagagggcgagcuuuaucacgccugucccugguggcguggggcccaugaccguggcaaugcugaugcagguauggcgcagaaaguucuggauuauucuagagacuuuccuacccaaagacaccacuaagacccacucagaaauuaggcugagauaagagucuguuggaggaaagaggagggagagaccaaacaaugguauccuucacauugauagaggaggcggugcccuuaaguccuuuggggucuagaacugaaguacaaacacgcuggcuggcuuuacaccugcuggugugggugaaacaaagaccucggagcucggugccuccucucucccuucuagcugagguguuuacacggggguggggugggguggguguugggguugcggauggauuccguuggucugaacuguggugaccuggggcucagaccugcuguguggaguuaaacuauucgcuguuucucucuccguccuucucccuuugcccagagcacaguagagagcgcacagcgcuuccuacagaaauuuaagccagggaaguggacaauucaguauaacaagcugaaccucaagacuccugucccaagguaggcgugaaauguucucgguuagaagguuguggcuggucaggguuaacugcuggguaccauggguccaugugugcauugauugaggggaggagccuguuacuagugugggguuaauuaaacauggugacuaaacccauccuuguguuuuuaaagugacauugcuauaucacgaucuugcaaaccaaagcucaucgggaaccuggcccgagaaaucgggcugcucaccgaagagguggaguuguacggggaaacgaaggcuaaagucuugcugucagcauuagaucgccugaagcaucagccagaugggaaauaugucguggugacuggguauguguguucuguggccagcgggcuucacagucagccgucuguuaucaccagugaggcauuugcgcauguguggaagagcugucagcuuagucucuuuguugguuuuuuuuuguuuguuuguuuguuuguuuuucgagacagaguuucucuguguagccuuggcuguccuggcacucacuuuguagaccaggcuggccucgaacucagaaauccgccugccucugccugggauuaaaggcgugcgccaccacgccuggcuucucuuuguuguuuuaagguuuuauuuuuguuuuaaauuauguucaggagagcauguauaagugugagugcccacagacuccuaaagaggugauugguuccaggggaucugguagccucguggcuucugagagcaccaggcaugcaugugguacacguacaugcaugcagguaaaacacuuguauacauaaaauaaaaacaaauaaauacaucuuuuuuuaaagugggggaugggucuggagagauggcuugaugauuaagagccuaggcugcuuuucccggaggaccaggguuugaaucccagcaccuacagcugucuauaacuccagcccugaggggucugauugaugcccucuucuggccuccucaggcacugcauguuguggacauguaggcaaaaaaaaaaaugucaauuuuuuuuuggaaaaaaaaaaccuuaaauucaugagacaucagggucaagggucaguuauaugucuuguggugaguagagcuaaccuucuuuacaguuguauuuauuauuauuguauauguaaaugaugucugcaugcaggggugcaaguguggaggugggaggacaguuuuguagagcugguucuugcuugccaccucuguaugaguucuggaugaaacucaggggaaggcuguaccuggggcuaacuuacagauggccgugagcuuagauggcuuguuaggcacauggaugcugggacgcgaacucaguccucgaagaacagcaagugcccuugaccacugagccaucuugccagccccuuguucuuacuguuuagauuagauuauuauuagacuguacagugacuugggugacauuaauucuauugucucucucuucuuugaagaauuacuccaacaccgcugggagaagggaagaguaccaccacgaucgggcuggugcaggcccucggcgcccaccugcgacagaacgucuuugcaugugugcgacagccuucgcagggccccaccuuugggauaaaagguacuguggccagaggcgccugccuuccccugccuuuccuuuagucuucccagacugagucuucacccaggagggcuuuggcugguuuagauagcugaaauguuugcuucagacauuuguauuguggugcauuugagaaaggcuuucguuguuaccccaggucuauccuuuugacauaugcagagaaucucgggauguguaaaauggaguucaaagggcuuuuauuugaccccgguauccacuccacugucuuaguaacagcaaaggaaauccuagcugcugguccaggcuuacacugaaaugguccagccacaccgaugucucccugacucauuuagugaaugcuuucugcuagguaccgugcuaagcacuuuguguuuucgucauucucuccucccaugacaugucauuaccguuuaugauagcagcagugggacuuuacuggugauuugguuaaggcuccaucacacaguuagucaguuaguuaguuaguuaguuaguuggcugugggugaguaaaugggugagugacuuaguucaagccacagccuauguguggcagucagagcaccaccuccuaaguuuauuuucuauuuucaucauauggauccuagagacuuggcagucaggcguggcagugugugucuuuaacccacuaacucucaccagccacuagugcaauggucucaacccaugggucccgacccccuuagggucacauaucagauauuuacauuaugauucauaaguagcaaaauuacaguuuugaaguagcaccuaaaagaauuuuaugacugugggucaccgcaacaaggaggacuguaugaaagggucccagcacugggaaaguggcgagccauggugacucuugccucgcgcccauuucagccucuguauaccacacuugaauaggugaggacacuggaucgcuguauuuaaccuccuuguuucggccaccgugcuucuguagugcugcucuuuuugguuccuucauguuauuuauugacauuguguauuuauuuugcacacauugguugagguuaaauuaaggccaucacacgugcugggcacacacagccccugagcuacacacacacgcagacaugcuucugcuguugucuuagcuuccacugcgcaucuucaguguacacggugcugugccacauaauggcuccuuacacauuugugcguugugcaccccagaccaccccaugcccucccuccucuuuccuccucccccucccauugcuccucucuguuuuccuagacagcguugcuucuacuuucaaaacauacucuuuuaauugaaacuguuuuucuuaauuauacuauguucuuagaggcggcuuuuccguuugcuggcugacaagggaucaucuucugcuugucccaguaguuaauguucucagcaggaacaccucuucccuccugccagcucugacuugcugucuguuagcuuccuuuugucuuugagacgaggucgucccagguauuucaggcugcccuggaacacacuguguagcccagguugaccugugugccgucuuccuaccucccgagugcuggaauaguguguaugugccgcugugccccgccuuggagcuuguuguaauaacccccuuuugacucuagaagccuugucccuuauuccgacucgagaacccaguguucucuuuccucauauugaauuuuccuccuugcguugucuuccucacaaaaaugaaaccuguucuuucgugcugauguuuacggcauccuuacagcauccuggacaucuugaccggccucuuguugaccacaugggcuacagcaccuucgaggcucggcuguuuucugauagcuaucuuauguucuagaagaguuggugucucuguucgguguguaccuucgagauucuuuuucuggaagcuagaguagcuucgugaguaggaaguuacucgggcuugccuuuauguagcugucaucuggguuucuaacauguuaggaaucacggggaaccggcuucuaaagauaaugaguagguauguaugugugugugcauguuucugucauuugcacuccgauuucaauugagagccuguucagcgugaacgugaucaagcguuucagugagguaaaggaaauuagaaaacaccugcucacaucuguccaagugacggagagaguaaacaaacaauuugcuuaguagauaugaaaauggguuuguuggucuuuggguuccaauucacagagaagcaaguuaaccugaguuccagcuguugcucuguccccuagguggcgcugcaggaggcggcuauucccaggucauuccuauggaagagguaaaaccgcucaggguuugacugaacccuacccugugugauagaguuuccuuuccagagaugagauuuaaagagagagagagagagagagagagagagagagagagaaugauuagugggcacuccacuuguuucuuggcaggagcaguauauuaaacaaacaaaaaaaaccuuuauuuguggacuugaguguagacuugagacaacagguuggacuuaggcacaaccuuucaauggggauagucauuuugaacaagcaaacacaugcaugccacaugguccccagaagcaucaggggcuuggggauucaggagcaguguggggacccagaggggaacaacugucuaugccccugugcagccucugaccuuggcaggagguuggccgugagggggguggugcucugcucucugcacacuuauauggaaaacugcuaauuccuucacugggaguuguuucaaaggccagauaacugggcauuauuuuuucuucaguauucacuguguagaucagucuggccucgaacugguggcaguccuccuucagccuccuuggcauauagaagcccacucgugagccuguccaagagcaguacuucagccagcacccacugguguuaguguggagacuguguugguugugggaggcugcagguuggaaaaggcagagcuagagacugcuauggcuuccgcucuuuuguaguuuaaccuccaccucacuggugacauccacgccaucacugcugcuaacaaccucguggcugcugccauugaugcucggauauuucaugagcugacccagacagacaagguagaaugccgaggguguggggggggguaccugaauuaguauuggucuuuuggugccaugacaguaggacccccucaucuaaagcucuuuucuucucuuucuuuaaggcucucuuuaaucgucugguaccuucaguaaacggaauaagaaaauucucugacauccaaauccgcagguuacggguaagcuuuugccuacuagauagaugauaccauaagaaauuuaauuaaagauaacaaggauugaaggcagggguuucccucauuucuuuauaaauuauagugauugaucguauaguagauagagcugacaauuaguccucagcuaagaagagcgagggcgcagcuuucuaaugugaagauugagggcagcaucguggagaugugcagcuucugggucccuggccucccuagcccugggaucuugaggacauguucuuugugggccaucucuugguucagucuucuaugagacgagcuuaaucagaguauuaguaacuccuguguuuuauuugaauuucuauauuuauauccauguaaaaaaaauuuauguguauuaacuguaggcacgugugggucacaguacuauguagagauuagaggacaacuuuugggaaucaguccuuaauuuccaauuuguuguggcagggucucucugguuucugcugcuauguagaacaucauucucuagucucuuuccaucuugcguaggagugccggguauggaugugcaccccacaucuggcuuuaccuagguuugaggaacuaaucucaggucauugggcuuuugaagcaaguagauuuacauucugaauaaucuacccaaaccucuauagccagcgagcacauguuuucaccacauacccuaauaauuccugucuucgauuuuuauuuuacaugaaaaaugaaaauuggcauucacacaaaaaccugugcauacauguuuuaaugacucuauuaauaaucuccccaaagugagaaaagucuucaguguucuucaauggaugaaugguuaaacaaauugccgugcaucugugcaauuaaaagaaaugagcugcugaaaggcacagcaacuugguugacucucagaggcauuaugucuaaucaaagaagccaguguccaaaaaaaagaucacaggcugugcuucugcuucugugguaucuucagggagacaggacaucagacuagucuaugccaagagucguggaucaagggacgguguaacuaacuauaaaggaauagcagagggauauucguguguaauucuauugaaguaaggaaaucguuuaugugugcuuauauaugcacauaauaagcacuugcugaaauggugugugcugcuuaucaacaguucuguucaauuauuuuuaauucuuugcaacuuaucuuuuugugugguauucaggaguauacccaggcccucgugcuuacuaagcuccuacugagcuacauacauccccaaacccugaagcuuugugggaguuuuguuuguuuuguuuugauaauuuauuguguguguguguguguguguguguguguguguguguuacaccgccuugugcccuuggaggccagaaaagagcaucugguccccuggaacuggaguuacagauauuugugagccuccauaugggugcuggaaccugaaccuggguccuccgcaagaacagcaagaguuuuuaacccccaggccuucuauccugcccugagcaacucuguguuuugaugcugcaagaguaacccuggagguuccuuuacccagauauguuguuuacauguugcucuacuuacaacucuguugauaauuuuuguaucuggguuucuguugguggcuuuuguugcccgcugagaacacacuagcuagcuuucgagcagcuugauauuccuuagcuuuguuuacgccuccccugaaaccugugcuuagaguguuaccccaucaugacagagcuauagucugagugugaccccaucaugacagagcuauagugguucuagaccucaugacauugacaguugagauugacccucaccuccaacagcagggcaacugagccgcuugugggugucuuugaagagugucgaguccuaggcucauggucucaugcagugguggcacacaccuuuaaucccaacucuccgaaggcagaggcgggcagaucucugaguggaaggccagccuggucuacagagugaguuccaggacagccagggcuacacagagaaacccugucucaaaagagaggaaggaagggaggaaagggucuugcuggggcucuugacucgugucugcugaagaugaggagggcacuguuugauaagcauuuccauuucgagaagugacccuuacaggcauuaaauaaaauuuaaaaguaucuaacuucuguaaggagaaaaauaaagacccuuuuuuaugucuuuuuagaacaguaagaagccagggaaaguauugagccauagaaaagcguguaaaagaguuuaaauugauuuuuuuuucauugauugcugcucaauuuugccuuuccuaaacuuugacuucaguuggguuucuuggguuucucagucugguuuuuaaaacugugcauauucuuuuucauuucaauauaguuagugaauccagaaaugcauuguggugguucuugguuggggcuguuuuuggcuggguugagagaagucucuggagcucaguuacagagcagacauaccgagugggacaggaaacaaccuccaggcuuagccaggggcucaggucacaguuuucccuucuggauuuaagacgcugccauuccaagggugugccacaggcaugauucaaucauaguccuuauuucccuaucucaauauaaggucaauuuaaaaaaaguaugcuucucuguuuugacuuuuuugggggguguggugggggauuauauuaguuuacaguucaaaguacaguccaucuuaguggggaaguugaagcagcaggggcuugaagcaacugguagcugucacaucuauaaucaggaaacagaggaauggauggauggauggaugaauacuguuguuuugguuuuggguuuggguuugguuugguuugguuugguuugguuugguuugguuugguuugguugagacggucuggccgucuugaaauacacuguguagaccagacugccucaagcucagagaucugucuaccucugccuccugagggcuggcucuugucuuauuuuauguuuuaauuuccuuucuuuucagaggcuaggcauugagaagacugaccccaccacgcugacagaugacgagauaaacagauuugcaagacuggauauugacccagaaaccauaacauggcagagagguauguacccagcccaggcugugcgcccccuguacuuugguagcccccaucucucccuccuccaggaggcuccugggucaggauacuuauccagaauggucauauccuuugcuugucagccuuagcugcaauguagaugucccuuugugagguuggcugaaugucuauucaguguugauugaaaugaggauuucaggggaguucaugcauuaaccaaaaauaacauuucuuaaguuucaauuuuaugcagaaaguuugggugucaugaagugggaaaaugaugucuaaucacuugaaucaugugugcguuuuauucugagaacgcucuggcacuggugacuugguuuuucauggaucucuuuauccugcuaaucauucucccguuuauuaacuccuccuguaacacuugccagccuucagccuuuagacguuugccugacuucagggccauauguuguuuugcucuguguacaauuagcauagcuugggauuuuauuuucuguccaccuccuuuguaucacagcagagagggaauuuccaucaaaccaugcagaaugcaccagaaggccaacuuaccaacuuuuuucuugucuuuauuggcacagcgacuguuaauguucaguucauuuggagguuuugguguuuguuuugaucauguagcccaggcugguuugggguucucuauguagccaaggcugacuuccugcuuccaccucccaaaugcugaauuacagcuguggaccacaaauacaccauucuuuaaaaaaaaauuuuuuuuuuagauuuuuauuuuuuauguguaugaguacguucaucuauguccuuuuaacauguguauauagugucuacagaaacuagaagagggcaucagauacccuggaacuggaauuagacaguugcaaguugccaugugggugcugggaauugaaccuggguccucuggaagagcagccagugcuauuaaccagugagccaccucuccaguccccauuuuaauuucuuuaauuaauuaauuaauuuaauggguguuuuccugcauacaugcaugagcgccauauccaagccuggugcccaaggagacugggcgagcaugggaucccuggaacuggaguuacucugaaugguugugagcugccguguggcugcuaaaaacugaacccuggucuucugcaagugcagugagugcccucagccacggagccaucucuccagaccccgcugcaguauuuuuagaagaaggaagcucaccaucuguuaggagaauuuaauccauugucuaaucauuuccuuuagcguguaucuguguguguuugggguucagguguagagcgcgucuuacuguguagucuacacugaccuugaacuccucagccuugcaugaagugccacaucuggcugcuauuccuuuccugauguuuauugguuugcuacaaaugaaacaguaagggaggagccuacagaagcucugugugcauccuccucccugagucucagccagcuugaaaagucaucguuuuacacaacuaaauagauaacaagcaguggugugaugauguuauucuaagucuucaacuuuaccucuguuccucagugcagugggggaucaguuucucuagauagagcugaaaguugcaucccuccagacucuuguccuugcuggugaccaugccacuccugggguacuucaccuccuuaacauuccaagggcucugggagccugguucuguaaacccacagcaaagauaugucuuuuuggauucuauacauaggggaagaaaaagcaggaguccacuaaacagugagggguauggagcccuggggagcgagguuuggcggcuggugguuggccuguccagguuaccugagguuauacuaguggguauauagucugucugucaucaccagagaaugugcuaaggagaggccaggccugagagcuagaguucuuugcaggcaucugcacuuggucugaguugauggcucuugugugggguguauggucagcgagucgcccacagaacaauccacaccucagcuuuuucauaaacugggucacucuguguuucucugcuaauauagaaugugcuuugaaguagaguccagauuucauaauuguuugaauucuuuagaaggaacgaaguuuauccacuccaaauuccuuuugcuuuaagugccaucucucugcauuucuggccuguggccgugucucuuacaccguagucuagcuuuguagaccauuucugaaaucaaguauuaauaagcuaucguuagacaagauuuguuguuuuaaaacucuguugcuagaguggacaugguaaugcgcaccuucaaccucaacauucaggagguuagggacagggggaucucuguaaauuugaggccaguauggucuacauaguaaguuccagggcugccagagcuucauaauagagaucuugucucugaaagaacaacaacaacaacaacaacacacacacacacacacacacacacacacauacucaugugcaugcacacauacuaaaugcuguuccucccuuuagcuuuaugggcccuacaucucuauggaauuauuuauuuuugagacagggucaugcucccuagcccaggaaagccauaacuuuguuauuguccugccucagcucucagaguacugguguuccaggugugugcuaucuacccuguguuucucccuccucccucccucccucccuuucuuuaccuuaccacugaacuauauccccauuccuuuauucauguaccuuuucuuaagcacuguuccugcccucccuuucugccauaguguuggacaccaacgauagauuccugaggaagaucacaauuggacagucuccaacagagaaaggccacacacgcacgguaacuguucaucuccaguaauugcuccaugggaacuagcucucgcugccuccauccuccuccaucgccucccuacgaccacaccggcagguguuguucugccuucucccuuuuaaaauggaagugaguagguguggcacggagcgcuccugacagcuugugcaauaaauccaugugucaccugugugguuuuccccagcauucucuccuggagguggagaaccccgagugaauauucuugcauauaaauuaauuaaaauuguuucucuucuguggccauuugacuguauauauccucaguguaagaguaccuguuuuguccccuuuguguuagggaaacuaaccaauauuccaagcugcuuucucagagauaaaaugauagcucacuggccaugcuacagcuuuuuauuuuuaagggugaucuuaugcagcucagacuggccucaagcuuauuauagccgagggugacuuugaacucugcuccuccaugagcugggauuauaagcguguacgaccucaccuguuaucugaggugcuggggaucagguguucagggcuuugugcaugcugggcaagugcucugccccaaugcuacaaucccuagaacacugacuuuuaagaaaaaaugauuauucaaggccucugaacaauuauaaauuucucaacuguuggaagauuacuuaguuauuucuaauccauccuuguuagcuauuugucugagccaaaagagaugccucugauauuccuccuccugguuugacacaaagggucuucuuuaucucucugcccacaggcccaguuugauaucucuguggccagugagaucauggcaguccuggcccucacgagcucucuggaagacaugagagagagacugggcagaauggugguagcguccaguaagaaaggggagccuaucaguugcgaagaccuggugagugacaggcagggagggucuagcaucccggggucuuucagugauuguuaaaagcagagauuaugcucugcucaaaaugaugcaauuaacugauugacugauugcaaaaguuaugaaauuuauauuuuuagacguucuucauagcgaaugaugguaguaguguugggcucuuaugacaggccacaagugccaggugacuugaaugaugcuuucuuccugcaagugucuuccugagcaagcccugacuacagaucaugugaccaucuagaguccccccccaaguguuugccuccccaugacacuugguuuagaaggacucaauggccaguuuggccaauagucuucuaacugagucucucucucauuugcuuguuuaguguuuugcuguuguugucucuuuagacagggucucucuaugucuggcuguccuggaacgcuauguauauauguauaucuggcuauguauacuaggcuggccugaaugucacagaguuccacucugccucccaaguacugaaauuaaaagugucugccacuaugcccauauaguccaggcuauccccaaaucaauagccaucuaguuuagccccacccacccccgaguucugagauuauaaugaugguucucaauccuccuaaugcuacagcccuuugauacaguugcuuucauugcgguggcccccaaccauaaaaugauuuuuguugcuauuuuauaacuguaauuuuguuacuguuaugaaucauauuuuuuagagauugagguucgccaaggggucauaacguucagguugagaacuaacagaucauaagcaugugccaccucaccugcuuuagaucaaaauguaaacgacucuuuguaucaacacauaccaguagagcuggcgugauggcagacaaauuuuuaaaaagggaggaaaauauuaacuuuguuuucacuguuaauauguguuuuaaauuuuaacacccagaccuuaaauuuagaaccgcauuaauguugaacauaaaugagaaccguugcucgaucucgcuugguguucaccacugguuuuguuuagcgacgauuagaagccuuaaaaguaggagcuggauuuggggguugaaauuagacuucuggcuaguauucuggcuuccgcuuugggaaacauacauugauuuugauuuauacaccauuucugcucagauaccaaaguuauaaauaacucguugcuguuggaaguaccguaucuacucugaacuggucuaaauggaucccccccgcccccccaagccaguggcagagcuugauugaggcgcuuguuucuggcgccacgugcuuuuucagaaaauuguaugcgaaagccguuuucauucugcuuccucucccugcuaagauaacugguggcuuccuaguaccgcaaggaaaaauaagaaauagagaugaauggcugagauuagguguaagcacuaauugcugcaagaugguuacaaugaaugagaagccccggagugcugaauuuugguuucaggagauuggauuucugcuagcacgaguugaugcuucgugggcuugucuugcagggcgugaguggggcgcugacggugcugaugaaggaugcaaucaagcccaaccucaugcagaccuuagaggugagcuggcugacuccuggguccagcguucaccuccucuauucggagccaggagauuaucacgcagccuuuccuugcagaaucagacaccucuuuugaaagauucuccaaagucaguuuguuaugggagcauugugugugccacagcaugcauguagaaguugucaguggacaacgucguggagucggguuuucuccugguacuuuuacuugggcuuuggaauuugaacucaggucucuaagcuugcaaggcaaucuccuuuauccagugagccaucuugcuaucccauagaaaccuuuucuacuguucauaucuuuccuuacuuuccuucuuacuguagcugaggugaggggguguaacugaaauaaaauagaugccuuuggggcuggagauguaggucaguggcugagaauuuacuuggcaugcuaaaggcccuggauuuaauucccggcacugcuguggaaagggggugguaauuuuuggagauuuuccucccagaaggucccccccccccccaaauuccagcuaaauccuagcccuuuggcuccuguggcuccauuaugaagccagguuggcauuugcucaugacgucauggucuccacagggcacgccaguguuuguccaugccgggccuuucgccaacauugcacacgggaauuccuccaucauugcagaccggauugcacucaagcugguaggcccugagggcuucguaggugaguucuccugcauccucagugggcggccaugaugaguuuaucuuauaucacagaguggcccuggugguuuacaguugcuccucucccuugcaguaacggaagcuggauucggagcagacauaggaauggaaaaguucuucaacaucaagugccgguauucuggucuccagccacacguggugguucugguugccacugucagggcccuuaagaugcacggggguggccccacggugaggaccagggacugggagaguggcuauuaggaaccuuccaggugcuugaaggaaauuucaugacauaucucugggucugccugcuuuccacugcucuuauuuauccucaugcuggauagggugccaaaagccaggggguggccauacacaggcuccgucaccuucagggacagauccucuugcagcauuuugaggagacccaaacugucuuuaugacugccuaucuaacccccuccacaggcuugugcuuggcccuauugauauuaaaaaacaacaacaacaacaaaaccaacaaaaaaaaccagugucaaccaguuauuuauaaauccaaauccaauuuuccuucuuaauauugaugcuggcagccagccagccaagcacugagcugaaaagcagaauucagcuugugaguagcagugcuggcuggcaggguucugagagccugcaguaggucgauguggcugccggaggccaugaaggagaaugacaggaccucuggcugguaugggcaaagggugggcucgcccagaaucagcuccaaccugcacucggugaauucuccugaacuccuauugcuuagaaauuacacuuaaguauuuucccaucucuucucuucuuguuuguuuguuugcuugcuugccuuuugagacaggguuucucuguguagcccugguuguccuagaauucacucuguagaccaggcucacucacgcccuccuccuccuccuccuccucuuccuccuccuccuccuccuccuccuccuccuccuccuccuccuccuccucccucugccuccugagugcugggauuaaauguagcagcacaccuggcuccacaucuuuucuucauguaaaguuuuuuguacuguuuauuuuaggguuaaauuucuguuccuuaggcaucgguauuguaacuuagagaacaagaccucccuugucuacagaauagaaucuauuucuuggugcaguggcauacauuuguucuuauauagcaauucucaaguguuuuggauuuuuuuuucuuuguuuucaggagcgggggacugucuuaguuuggguucuauugcugugaagagagagacaccaugaccacagcagcucucauaaacgaaaaccguuaauuggggcuggcuuacaguuucugagguuuagucuguuaccaccgugggugggacucaguggcaugcagagagacauggugcuggagaaggagcugagaguccgacuuccugauccacaggcagcagaaggagacugugugccacacuaggugaagcuugagccugaaugaccucaaagcccgccuccacaggaucacacuuccuccaacaaggccacaucuccuaaucgcgccacaccccauggucaagcauuuaaacacauuagucugagaaggcuuguaccuauucgaacuaccagcuuacgcuggggagugaagccgcagcuuugcauaugucugacaaaauuuuacuaccaggccuuuacagccucuuuguacacuuaaaaauuauugaaggccuaagaaaaaacuuuuauuuauaugcauuauagcuauuaauauuuaauauauuugaaauuggaacugaguuacauguugacauaaaaagcacuuuaaaugaaaagcuauuauauuuucugagacaaaauauaggcacuguccacucuuccugucucuucuaugucugguucacuagaaacgguagguucucuuuggagagauuguuguccacucagugagaaagugaaggcuccuuuagggaaauaguuuuggccuugggcccccugagcauaccaugugaaggcacuuuccuaacccucaccaugaccucugguaguccuuagccguguugccccugacuagacuuugccaaccuaggacaccccuuucugcgaggaaugcuguauucuucugauccuacccagcauuccugucucagauagacuucagucaccauccucacaccguggcgugagcaagggcagcuaagcgagaaacccacaaagccuuaaacucccccaaaacacugaaaauuggauuuggauuuauaaauaacugguugacacugguuuuuuuuguugguuuuguuguuguuguuguuguuguuuuuuuuuaauaucaauuagggccaagcacaagccuguggaagggguuagauaggcagucauaaaaaaagggggggcuuuuuuuuuuaacucuugagugugaacuguauaggagacaauauuauguugcaaagucaaaagguuggaccugccagggagucugagccccuacccuggcaguccugaaaggaggcuuugccuguccagcgcugcccuggagccagacgugugggaaguuacguggacggacacugcuuccuguuucucuuccacguggcccuucaagagucacaaccccauagacuggacaugcagaccucagucuuccuggagaguagaagacccagcuagacgcuuuuuaaucaccauguugccuacagugaccacuaagucaaccuugagccauuugguguaccauacaguaggguugagccagcucccuagaucaggacccaggcccuuccuccuagcgacacaaugggcuaacugcuuuagaguuuauauaccucugagucugcucuaccucagaggaagaaagucugccguugugcccccagccccuuuucuugggcucaggcugcccucuaacugcuacguugaugaggagcuuguagugauuccugcuuccaucuucugagugguaggggguccaggcacacacuggcucuuguuuucccccucuucauuauuccgacaucacagcccacccaccaccccaccuucugccaaggcacgagcaaccacgcuccuuacaggccugaccuuagacaucaguagugacuuucaggguugguggcugucuuuuuucccccccaugcucacccuuacuuccauuccacuggugugugcuucauucccugggaucaguguucugccacagcauauuucugucuaccuuggcauucauccaucugugccauacccuacccccacccaaucucgcaucacaaagaaacaccugacugcucgaagcucuacagucucacauuccaagccuguugagcaggaaacagcuucacacugcugcccauuacucuuuggggagugcagccacuugccugucaguguacugagcaccacuuuagugccaacagugaguaggaaacguggcugacuuucuauccuaucuucuaggucaccgcuggacugccucuucccaaggcuuacacagaagagguaacuacaauuauuuccgaucaguuguccuaggaaaccgcauccaaaaucggcaugucuuaaucuggaaggcaaaagguggggagguccuugggguguugaggacaaagccugcagugcccugggaaucacauuaaggaaauagcagugacuaaauuuggcaguuugcuccuggggaacaaagcuguaucuagaagcuuuauguugcuauucguuagagauggggaucucguuaaguagucuaggcuggccuugaacuccaguguuaugauuagagcaugcaccucauaccuaccuagagagagucauuucugcuuguuacaacuacuuccaaaaguguuacuggcaucugauagguaaaagacagagaugguuguuaaacugcugugguguguaagacaccccaccccaguaauaaaaaugacaguaaugcuggaguuacgaagcccugcucuagacugucacgcagaagucauaaaugccacuuaaaucaagcaagaagagagcuuuagaaauaaccuuuccuucugcaaauucaaaccuaaaucaaagaccugagauagagccaguaaauguccugguugaguuuggaggcacgucuucuguacauggauucggucuauugggcaggagcucaaagaacaguucugagcucuuuuuuuucuucuucuucauacugauaucauuuaccaucaaagaaauaucccuagggccacugugagugauuacauaaccgaugggccuuugauuagaugcagggucagcugcugucacuguugauucaauuucucuguccuggagggaagcucuuacguuaucaggcagugcacggucgguguacggcccccagaugaaguuugcaaaauugacuggaaaaaaagaugguuggugccuugagucugccugucuucugagcugugauuugccuuuuauggucaucugugugagucaggcguaggaggggaauucacagcucuggcccuccugcuaccccacagccuuuccugugucuaauuacagugacugccccgaacuggcccagcuggugucuucauuuaagaaauucggcuuauuuaaaacuguucucagucggucuuauauauuguuuuuuuuuuuuuuuaugugacuagagguaaaaaacaagagugugcuuuaaaucgucagauuaaucuugaucucagauuacaaugaaagggccucacaagcugcuugauagcuuaguugguaguaugauuguacuucaugcacgcacgaagcuuugggcuuacucccuacuacugagcaaggccaggcaagccagggccuuagugucaguguuggcacccuuggaaagaggaaggagugggaccaaaauccuugacuuuauagcaggucuaaggcgggccugggcgacaugaggccccaugcccauccauccauucaucuagaucuacauagauaguuaaauuuugggggacauaccuaguggaaggagagagccagccccugcaaacugaccuuugauugucacacucauaccaugguacaagccaccguggggggcauacacaaaugaguauaauuuugaaaauaacaaauagccaugcuugguggcacgugccuuucauccaaguacuugggaggcagaucucugugaguucaaggccagccuggucuacaucgugaguuucaggacagucagagcuacagaguaaaaaaaaacaaaaaccagaaggaagaaagucuuuaaaguauguuucaagacaaaaaugguggcauacuccuauaauccccacauuuaagaggaugaggcaggaggaucacaagagcccagaaaauauaguaagguccugucaggaaauaaguagguagugguuaagagcacuggcuucucuuccagaggacccgacuuugauuccagguacccacauagugggucacaaccaucugucacuccagucccagagaggagccaacccccuccucuggcuuccagggacacugcauacacauggugcacaaacaugcaggcaaacaccuauauauacaaaauaauuacauuuuuuaaaaaagcuuuuauuuuuaagaauuaaauaaauacggcucagugguuaagcacaguggcugcucuuccacggggccugaguucauuuuccagcacccacauggcagcucacagccaucuguaacucugguuccaggguaucuggcagccucucacagacaugcagaacaccaguacacauaaagaauagauagacagauagauagauagauagauagauagauagauagauaaacaaguaaguagaugguuuuuaaaauuaaauaaguaauauuucucauaugaaugagacuaucaguacauugcccagaacaaacucuuacucaagauugaucuauguguaggaagguuuugccuacuuuggcauccuuuggcccuccuuugcuucauguugucaugugcuagggucaugggcaugugccaccacagcuggcauaugugcggagagucaaacugaggacuucaugcgucuaagcaagcacucugccaacucagcuauagccucagccccuaauaaucauuuuuacgcuggguuuuuuuuuuuaaaaccucuauguuuuguauguguacaugggaaguacuucauguaugcaugcauaucauacccaugucuggcucccucagaggcagaagaggacaucggaucuccaggaacuggaauuuuaggugguugucuuagagccccuuguaagaacagucagugccucaacugcugagccaucucuccagcccuggcuuuucuuuuaagcuuauuuuuauucacgugucuccgugugcaggcgcgugcauaggguggagguugggagugucugaagagaccagaagaggaugagccauagcgcugggguuacaggcugaugugaguugccugacuuggguacuggauccaaacucauuuccuguggaagagcaggaaguauauacuuaagcacugaguuaucaguccugcccaggccccggguuguccaaauagcauuuccuuauuuuauuagccuugggaaggcuccugguuaaguuccuuaaauccucugaaacuucacugacuuauugcuugacagucuuuauggcugguggggccugugcugggcucugcccugaucaaauggcucccacugagaaaagucuuguugguuuguagcacaccuugggaguuaaucuguguaaauacacaagcugugaaugucuuuaaguagaggcaucagacucauccccuucaaagaacuaagaggccauugcguguuuucaaggcguagggagguagcacagcuucaaucgagugcuguagacaggggucgcuucucuuccaccaguagcaugugggaagugcaucacuggcccucauaguggccaccaccaucuugcccuucuuccagcuccaagacacaccuuccuuuuuuuucuuguuaucuuauuugagacaagaauuuacuguguacccaggcuaaucucaacuugucuauccuccagccucugccugcugaaugcugggauuacaggcgugccccagggacaguggcagugucucugucuuaaauagaggcagcagcuguuuucaggucagcguguuuugaccuuacaggccauuugcuguuguuugacaggaccuggaccugguugaaaagggcuucaguaacuugaggaaacaaaucgaaaaugcuagaauguuuggagucccugucgucguggcugugaacguguucaaguaagugugaaauauagagaggaggaaugucggaaaugccaggaaauagcuccuguagcaagcgcagugccgccuuuagcuccgaguaguucuccacuuacugcuguugguuauugcuuguggucuagcuugugaugugacaggcaccauguguaucacagcagacacacguuagcuaccucaccacugagguccaaaagucagaauugcuccugagggcccucuucucuacugagcaacucggagaacacauaggcuugacaagaaauguucuuuucggguguucccaggccuuuugugcuuacaggagagcacaggcugcagaauaucuuuauuucuccaggucaggugggacgcucuguugagagaguugaaugcauugagcuagaaguguucgcgcaagagcuguguggguggcuuggcacuuuagcacuguuuaggguuuugcaauaaugcccucaccgcagugcgaugggaagcagcaauuuuuaaagcuaguauuuacugauucccaguggugugccgggauuguuccacaugcuuuaaacauauuccugucuaagccucauggcaucccugggcagcgcugcugugaaguuuuccauuuuuuccuuguggagccaaauaaguacagauaaaguaacuggccaaaggucauagagcugagcuagaagcgggcaggacugagugguguccuuuucucaggcgguauuccucgugggcuuuaguggcauaagcaaggcauacucuccccuccagccaccuucauucuuuaacgugaagcccuccugugcaggacagauacagaugcugagcuggaccuugucagccgccucuccagagaacacggggcuuuugaugcugucaagugcacccacugggcagaagggggccagggggccuuggcccuggcucaggcuguccagagagcgucacaggcccccagcagcuuccagcuccucuaugaccucaagguagguuugcuuguucugugcaaaaugccgcaaguguggagcuugugugcagcuacggguagccuuacgcacgggucugauucccucacaggugagucacccgcaaccacagccuggacccugagcucaaggcaucugucuuacaaacacagaugaccucauacccuaacuuuguaaagcuuauaauauauacaccccuuuguggguggagccaaccauguaagucacuccauugacgccuuucacuacugcaucagccacguaguaagacauugacaaggagccagcuauauauggcuggaaauuuuucguaacacuuccugguauuguguugccucagguucagagaaacaccagcacccuaaaccaaagugcuuccacaggcuucgucagagucuccauaacugagucaggggacucgcaucuggccuugcagaagcaguuugucccauggcacauugcaguuagcucagagaaugccauuauuaauaugggguugcauuucaggaugugauagggugugagccugucaacagaaauuagaaacuuuguuaaccauaguguacauuauaguucauucugcuuguauucuucacgcuacauuuuugauugguuuuucaaagacuuugggaaguaaccgcaaaacagauuggagccuggaucagaugauucagucacuaaagugucugccacuuaagugcugaccugaguucagaucccuccaccacauguaagauccagauguaguggugcgugucuguaaaugccggugcuggaaacaugcgcaucuguagaguuaacugccggccagcauugccaagucagugagcugcagguucagugagagacccugacacaaaaaacaagguguagaagguuagaggaaguuaccggagguuauccuguagccuccaucuguucuccugagcacgcaugugcacgcacacacacacacacacacacacacacacacucagaaagaggaaacccuauuauucuugaguuuuuucauuuguuuguuuguuuaagauuuauuuauuuauauauuauauguaaguacacuguagcugucuucagauacuccagaagagggagucagaucucauuauggaugguugugagccaccaugugguugcugggauuugaacucaggaccuucggaagagcagucaaugcucuuuuccgcugagacaucucuccagccccuauucuugaguuuuaacuuaaaacauuucugccuuuucucucugcacugugcacaugugugugccuaagacacggaguuaauuggcauacuccuauugguaauggcauucuccuaaugagcuuugguuuuguaaauggcuuuggaaauuuguuugagcaaucacccuucuagaaaaugccauaaacauaaaugcacacaaguaaggaucacuugcaaggccccucuccaagccccuguccagggucaggagcccuagaccuuccgggcugucaggugaccugaagggugagaggacagggcuucagauccaguucuccagggacuuuucucuguucuggaaaccggaggcugccacuuugugucauucaacaucugugggucuuaaaccacccugcagccagagugguuuugcuuccgaaguucuaaaugugccuuggcauuuaagacucuccaauuauaagaugcauguucgcgucaucugcaucuuucuaaagccacugcugagagugagcgcgcuuucauguccgcugucuaaagcucucgcaagucgucacugguuagcaaagaguaaaguuuggauuuuauagguacaacauugcucuuuucaaaaaucuaccugauauacucauuuagcccugguugcuuaggggcuugauaguguacaucuauacaacuguaugucuauguagacaauagcuuuacaucugugagauauuuuccacuuaaccaaacccgggacuuuguauuaaaaugguucugggcuggcaagauagcuuaccguauaaaggcaguugcagcaaaccagaugaccugaguucaguccccagagcccacauugcugaaagagaacugacuuuuguaagcuguccucuggucuccacacaggagcaaugggaaaagcauucccauaugcuuaaacacauuacuauaaauagauaagguagcuuguuuguuuguuuguuuguuuuuuuaauuauaagaaaauguuucuaacccuaagcuggagauguaguuuagggguagaguguuagucuagaauaugcaagacccugggauuugguuaaauguuugugacccaaaaaaacccucaaguuuuuguacuuauagcacauagcauugugucccuuuuggggagcacugaucuagaauguccuugcuacgaauccuuacauguguccagucacaguccccuucucuuuuguacacuagcucucaauugaggauaaaaucaggauuauugcacagaggaucuacggggccgaugacaucgaauugcucccggaagcacagaacaaagcagaaauuuacacaaagcagguagguguuuacacccgagcuuccuggccuuguggccuccuacacucuacccgucagauagcggccucgucucccaaaugcuggguuugacuucaaaguugcaacccuaaauucuguauuuaccugaaaguguauaugagcaucucgaaaagccaggauggauuacagaauaucucacugggauacuaagacaccccuguaguguacuguguuugauuuuucuggauggucaucagucauucauaggauauagauaguacuuuccuccuucccuuacugggauucuuuuuuguuuuggucugcaguaacuaaacuggaggguagguaguaaggcagagguggguaugcagggaaguagcuaucucagagccuccugagaauauccaaauguucuucauuguauagucauauacauuccauauucccuuuuucccacccagggcuuugggaaucuacccaucugcauggccaaaacacacuuguccuugucucacaacccagagcaaaaaggggugccuacugguuucguucugcccauccgggacauccgugccagcguuggggcagguuuccuguauccuuuaguaggaacgguaagugaaggcuguaagaggaauauugcuucuccucugaaauguaucacucaggcugucagagagugccagauugccauagucuaggagaaagguguaauuaggccuauccuaguuaauccuggucuugauauggacugugcaguuacaaugcggcaccuaccucuauugcauaaguucuaugccccgguggcaguuuacucuugguucaauccagaaugggucuaauuaggcucggaugauaccaaaauucagucugcucucuguacauggcuucagcauccacugauucaguugucuguugguugauaggcguuggguaugguggcacacuccuguaauccugaggugcagaggcaggaagucuguuguaaguuugaggccagcaugguguacuuaauggguucuaggucagccaaggcugcauacauagugagacccuaucgccaacaaaaccagcaacucuccuuuaacaagccggugcccacgugugggucugggcacuugcugccgcuuucugaucaucucggccucuccuuuuccuuucuaucuuccugcucaggccuauauucaaguaucuuuaauaaaacuugguuuccaaaacaaaacugcuauggggaaaaaaaaugugucuguauagauucaucguucucuaaauaauguccuguaacggcuguuuauauaguucuuacauugcacuggcugugaccgagcacuugccuaguauacugcccaaggaccuggguucaaucucagcauagcacaaaggaaccaaagccaaacaaccuuagcaacuccugguugcuaugggaaucucggcagagcucagaaggugcggccugcgugcgugugugaugcuuuaacaacguguaguggcuuuucagaguuugauaucuagguuugcauguaaguugauuuucugcuucucggugaccagaucuuccucucugagaaagaauaaaagcacugaaaauccuacccguugcugcucuaacaaccaugucuagaauuuucuggcagcacaugcaugcguauuugggucgguggcaucuaucccuugccuuuauaaugcugacugcuggguuauucugggucugaagaccaguucuuuccuuuccccacuuugucccuacacccaccccuuucuuucuuucuacagaaugcuuugauagaagccuuggaguguauugauccaugugcucagaugucaggauuagauuuuucuuaaauauugauguuuuguguuacagaaaaugacucaucuguuuuaugacauuuguauaguaaaguuuuagaacuucagucuaaacugucuuccuuucugggucugaucucgagaguguauauauucauuauacaggcaguaugacagaaagaaaaauacauuuucaguucccaaccaugcgaaugugcugauagguggcagagccaaguguucagaaaagaagcaagcacagauacagugcagacgcuucaaguuuagcuuuaaaaagccugcgaucguaagaauagagaccgucaaaccguccaggcuauauacagaaaugucuuggcccgaauuaaaggaugcgaaacguacuaucaagucacugcaacagaaaucacaugggcgucuaugcaagcaagacucauggaacgaaaauucaaaagcagaccagugcuguuccuuuuucuggcugcuuuguuuagcugcuuugagagaugguuuugcuagguagcccugguuuguguuaacucaccaaguaccccaggcugggacuacagggugucccagcuuccuuagcucuugugacgcacagcuaaggcaguugaauggugagcucacuggcuuccccagcaucugccagugccggguaggguacagagccaugcuuccccugccacaucagcccugacuguccugggcaaggucagagggaggccuggccuuuggcuugaagagggacaugaggguuucuuguugaguucaucucugaaucaaugacuggguuuuuaauauguaacaagaauacccacugcauugaugcacuaaaagguguuucugguucuguagcugcugcaaggcacaaaguggagguaaauaaucauuacgaggugugugugugcacucgugugugugugcauguguguacucguguguguguguguguguguguguguguguguguguguuugugcauauaugguaugugguuuauggugaguguguguguauaugucucuguguguguguguguuugugcguauaugguaugugguauaugguaaguguguguguguauaugucucugugugugugugugugugugugugugucuguguauauauauauauacguugaauguguagaguucacagaugacuuguaacaacugauucuugccuuucacucuguggaucucagaaaucaaacucagguugucaggcuugguggcaaaaguaaaaagccacugaaccacccugcuaguccucuaaguuccuuuguaaugcuguuuugccucacagaugagcacaaugccuggacucccuacgcggcccuguuuuuaugauauugauuuggauccugaaacggaacaagugaauggauuguuuuaagcaggugagcugcuacugggcaggaguuuucucguuugccuuuauuuuugcuuuacaugugugcguuuguuuauuucaugggagcaggagagggugugugcauggucuguguggaguccugaguccugagaauuccaguuugguagcaagugccuuucccaguugaacggucuugccuggucugcagaaaguauaucaguucuuauguuuguuacuuuguagcuuauucaugaauucuaaggcucaaacugagucuacaaacacucaaauucaagugauuuccaaauauuuccuuccagauucauugagaaggcaucagugguaaucaggaacgauacuugacaauaaucagcaaauacaacacucauguuucagucuggaagagggaggcuccaaugccccuggcaguucagggagaauguguacagccuagccacuauggaggucugaggcggauauuagcuucccuugcagcauccccaggaggcuuggggcucagaguugaugauguaguagaggcaggagcggccccaaguccauuuguauuguauauuguauuguauacuuugaaaagacagagaccagguagugguggcacacaccuuaauccuagcacucugaaagcagagccagauggacauccugguguacagagugaguuccaggauagccaggacuacaccuagaagcccuaccucacaggaaggaaagggagggagggagggagggagggagggaggagagggagggaggaaggaaggcaggcaggcaggcaggcaggcaagaguuaaggaaggcaggaaggcaggcaggcaggcaggcaggcaagaguugggcugggguguaaaugaugguggagcagucagccugugugagagccacguucagugcccaggaaagcacucauacacucacagagacauaaguuggcuaauuguccagaaagcagagaagaaagagaaccagugcuagagcucugggacccuguaugacagggccccagguacucaccgcagugacacauucaguucagaucucaaaaaugucaagcaggaaaguccucaacauuccucuccaaggacuuaaaagccagccugccuguggaagaaugagcuguggccggccuaucuggugcagucagggccguggaaugagaagagaagagaaugccugucuuaucagcaauaaggagcuuuuagacagcagaggaaugucuccaaaugugugcggggaagauaacuuucauccuguguuuacuuuccccuggccaaaucugccaagguauuuucagacaggcaaagggguugccacccccacuucugcuaggaggcuauuuaacgaugucaucuacaccagcaaaaugaggaacugaacuaagaaaggggaaggugugagcuuuagggaaguggauuuggacaguagcaaauagggggguggucugacaaaaggacguggcugugaguuuccggucuagcacugagcaggcgggagggcuggaaggagcugccugagaaagugacggugcaggaggcaagcuguggucuucauucugaccauaugaggagaguaagaagggugcuuguuucagggaagcgcuuucugcacagggucagugagcgaaggacaugucccuggcucccugcucagucuggaagucacacaaccaccaggcucuggguugucuucaaguucauauguggacaggcccuggaagacucacccagagggaaaggguaugagugugaacagcuuuaagauguagcuggaaaaugaugaaauguggaaggaaagaggaagcugcuaugcuuggagaaaaugcucauucauucaucuguccguucacccauccauccauccauucauucauucugcuuuucuuuccagaucuuccaucuccaagaggccacucuguccggccagugucuguucaggcccacugaagaagugugcagaagucuuggaagucuguccccgcccugaagagcuucagaaauagugggaguuucccuaaagccuuucauagccuuaauucaugucauguauaaauuaacauaaaucaugucuauuuacauagugaagguccagaauaaaugaaauaauuuugcuaccuugguguugaaacaua

SEQ ID NO: 6700 - RNA, 65261 nt, Mus musculus
uauguuucaacaccaagguagcaaaauuauuucauuuauucuggaccuucacuauguaaauagacaugauuuauguuaauuuauacaugacaugaauuaaggcuaugaaaggcuuuagggaaacucccacuauuucugaagcucuucagggcggggacagacuuccaagacuucugcacacuucuucagugggccugaacagacacuggccggacagaguggccucuuggagauggaagaucuggaaagaaaagcagaaugaaugaauggauggauggaugggugaacggacagaugaaugaaugagcauuuucuccaagcauagcagcuuccucuuuccuuccacauuucaucauuuuccagcuacaucuuaaagcuguucacacucauacccuuucccucugggugagucuuccagggccuguccacauaugaacuugaagacaacccagagccuggugguugugugacuuccagacugagcagggagccagggacauguccuucgcucacugacccugugcagaaagcgcuucccugaaacaagcacccuucuuacucuccucauauggucagaaugaagaccacagcuugccuccugcaccgucacuuucucaggcagcuccuuccagcccucccgccugcucagugcuagaccggaaacucacagccacguccuuuugucagaccaccccccuauuugcuacuguccaaauccacuucccuaaagcucacaccuuccccuuucuuaguucaguuccucauuuugcugguguagaugacaucguuaaauagccuccuagcagaaguggggguggcaaccccuuugccugucugaaaauaccuuggcagauuuggccaggggaaaguaaacacaggaugaaaguuaucuuccccgcacacauuuggagacauuccucugcugucuaaaagcuccuuauugcugauaagacaggcauucucuucucuucucauuccacggcccugacugcaccagauaggccggccacagcucauucuuccacaggcaggcuggcuuuuaaguccuuggagaggaauguugaggacuuuccugcuugacauuuuugagaucugaacugaaugugucacugcggugaguaccuggggcccugucauacagggucccagagcucuagcacugguucucuuucuucucugcuuucuggacaauuagccaacuuaugucucugugaguguaugagugcuuuccugggcacugaacguggcucucacacaggcugacugcuccaccaucauuuacaccccagcccaacucuugccugccugccugccugccugccuuccugccuuccuuaacucuugccugccugccugccugccugccuuccuuccucccucccucuccucccucccucccucccucccucccucccuuuccuuccugugagguagggcuucuagguguaguccuggcuauccuggaacucacucuguacaccaggauguccaucuggcucugcuuucagagugcuaggauuaaggugugugccaccacuaccuggucucugucuuuucaaaguauacaauacaauauacaauacaaauggacuuggggccgcuccugccucuacuacaucaucaacucugagccccaagccuccuggggaugcugcaagggaagcuaauauccgccucagaccuccauaguggcuaggcuguacacauucucccugaacugccaggggcauuggagccucccucuuccagacugaaacaugaguguuguauuugcugauuauugucaaguaucguuccugauuaccacugaugccuucucaaugaaucuggaaggaaauauuuggaaaucacuugaauuugaguguuuguagacucaguuugagccuuagaauucaugaauaagcuacaaaguaacaaacauaagaacugauauacuuucugcagaccaggcaagaccguucaacugggaaaggcacuugcuaccaaacuggaauucucaggacucaggacuccacacagaccaugcacacacccucuccugcucccaugaaauaaacaaacgcacacauguaaagcaaaaauaaaggcaaacgagaaaacuccugcccaguagcagcucaccugcuuaaaacaauccauucacuuguuccguuucaggauccaaaucaauaucauaaaaacagggccgcguagggaguccaggcauugugcucaucugugaggcaaaacagcauuacaaaggaacuuagaggacuagcagggugguucaguggcuuuuuacuuuugccaccaagccugacaaccugaguuugauuucugagauccacagagugaaaggcaagaaucaguuguuacaagucaucugugaacucuacacauucaacguauauauauauauacacagacacacacacacacacacacacacacagagacauauacacacacacacuuaccauauaccacauaccauauacgcacaaacacacacacacacagagacauauacacacacacucaccauaaaccacauaccauauaugcacaaacacacacacacacacacacacacacacacacacacacgaguacacacaugcacacacacacgagugcacacacacaccucguaaugauuauuuaccuccacuuugugccuugcagcagcuacagaaccagaaacaccuuuuagugcaucaaugcaguggguauucuuguuacauauuaaaaacccagucauugauucagagaugaacucaacaagaaacccucaugucccucuucaagccaaaggccaggccucccucugaccuugcccaggacagucagggcugauguggcaggggaagcauggcucuguacccuacccggcacuggcagaugcuggggaagccagugagcucaccauucaacugccuuagcugugcgucacaagagcuaaggaagcugggacacccuguagucccagccugggguacuuggugaguuaacacaaaccagggcuaccuagcaaaaccaucucucaaagcagcuaaacaaagcagccagaaaaaggaacagcacuggucugcuuuugaauuuucguuccaugagucuugcuugcauagacgcccaugugauuucuguugcagugacuugauaguacguuucgcauccuuuaauucgggccaagacauuucuguauauagccuggacgguuugacggucucuauucuuacgaucgcaggcuuuuuaaagcuaaacuugaagcgucugcacuguaucugugcuugcuucuuuucugaacacuuggcucugccaccuaucagcacauucgcaugguugggaacugaaaauguauuuuucuuucugucauacugccuguauaaugaauauauacacucucgagaucagacccagaaaggaagacaguuuagacugaaguucuaaaacuuuacuauacaaaugucauaaaacagaugagucauuuucuguaacacaaaacaucaauauuuaagaaaaaucuaauccugacaucugagcacauggaucaauacacuccaaggcuucuaucaaagcauucuguagaaagaaagaaagggguggguguagggacaaaguggggaaaggaaagaacuggucuucagacccagaauaacccagcagucagcauuauaaaggcaagggauagaugccaccgacccaaauacgcaugcaugugcugccagaaaauucuagacaugguuguuagagcagcaacggguaggauuuucagugcuuuuauucuuucucagagaggaagaucuggucaccgagaagcagaaaaucaacuuacaugcaaaccuagauaucaaacucugaaaagccacuacacguuguuaaagcaucacacacgcacgcaggccgcaccuucugagcucugccgagauucccauagcaaccaggaguugcuaagguuguuuggcuuugguuccuuugugcuaugcugagauugaacccagguccuugggcaguauacuaggcaagugcucggucacagccagugcaauguaagaacuauauaaacagccguuacaggacauuauuuagagaacgaugaaucuauacagacacauuuuuuuuccccauagcaguuuuguuuuggaaaccaaguuuuauuaaagauacuugaauauaggccugagcaggaagauagaaaggaaaaggagaggccgagaugaucagaaagcggcagcaagugcccagacccacacgugggcaccggcuuguuaaaggagaguugcugguuuuguuggcgauagggucucacuauguaugcagccuuggcugaccuagaacccauuaaguacaccaugcuggccucaaacuuacaacagacuuccugccucugcaccucaggauuacaggagugugccaccauacccaacgccuaucaaccaacagacaacugaaucaguggaugcugaagccauguacagagagcagacugaauuuugguaucauccgagccuaauuagacccauucuggauugaaccaagaguaaacugccaccggggcauagaacuuaugcaauagagguaggugccgcauuguaacugcacaguccauaucaagaccaggauuaacuaggauaggccuaauuacaccuuucuccuagacuauggcaaucuggcacucucugacagccugagugauacauuucagaggagaagcaauauuccucuuacagccuucacuuaccguuccuacuaaaggauacaggaaaccugccccaacgcuggcacggaugucccggaugggcagaacgaaaccaguaggcaccccuuuuugcucuggguugugagacaaggacaaguguguuuuggccaugcagauggguagauucccaaagcccugggugggaaaaagggaauauggaauguauaugacuauacaaugaagaacauuuggauauucucaggaggcucugagauagcuacuucccugcauacccaccucugccuuacuaccuacccuccaguuuaguuacugcagaccaaaacaaaaaagaaucccaguaagggaaggaggaaaguacuaucuauauccuaugaaugacugaugaccauccagaaaaaucaaacacaguacacuacaggggugucuuaguaucccagugagauauucuguaauccauccuggcuuuucgagaugcucauauacacuuucagguaaauacagaauuuaggguugcaacuuugaagucaaacccagcauuugggagacgaggccgcuaucugacggguagaguguaggaggccacaaggccaggaagcucggguguaaacaccuaccugcuuuguguaaauuucugcuuuguucugugcuuccgggagcaauucgaugucaucggccccguagauccucugugcaauaauccugauuuuauccucaauugagagcuaguguacaaaagagaaggggacugugacuggacacauguaaggauucguagcaaggacauucuagaucagugcuccccaaaagggacacaaugcuaugugcuauaaguacaaaaacuugaggguuuuuuugggucacaaacauuuaaccaaaucccagggucuugcauauucuagacuaacacucuaccccuaaacuacaucuccagcuuaggguuagaaacauuuucuuauaauuaaaaaaacaaacaaacaaacaaacaagcuaccuuaucuauuuauaguaauguguuuaagcauaugggaaugcuuuucccauugcuccuguguggagaccagaggacagcuuacaaaagucaguucucuuucagcaaugugggcucuggggacugaacucaggucaucugguuugcugcaacugccuuuauacgguaagcuaucuugccagcccagaaccauuuuaauacaaagucccggguuugguuaaguggaaaauaucucacagauguaaagcuauugucuacauagacauacaguuguauagauguacacuaucaagccccuaagcaaccagggcuaaaugaguauaucagguagauuuuugaaaagagcaauguuguaccuauaaaauccaaacuuuacucuuugcuaaccagugacgacuugcgagagcuuuagacagcggacaugaaagcgcgcucacucucagcaguggcuuuagaaagaugcagaugacgcgaacaugcaucuuauaauuggagagucuuaaaugccaaggcacauuuagaacuucggaagcaaaaccacucuggcugcagggugguuuaagacccacagauguugaaugacacaaaguggcagccuccgguuuccagaacagagaaaagucccuggagaacuggaucugaagcccuguccucucacccuucaggucaccugacagcccggaaggucuagggcuccugacccuggacaggggcuuggagaggggccuugcaagugauccuuacuugugugcauuuauguuuauggcauuuucuagaagggugauugcucaaacaaauuuccaaagccauuuacaaaaccaaagcucauuaggagaaugccauuaccaauaggaguaugccaauuaacuccgugucuuaggcacacacaugugcacagugcagagagaaaaggcagaaauguuuuaaguuaaaacucaagaauaggggcuggagagaugucucagcggaaaagagcauugacugcucuuccgaagguccugaguucaaaucccagcaaccacaugguggcucacaaccauccauaaugagaucugacucccucuucuggaguaucugaagacagcuacaguguacuuacauauaauauauaaauaaauaaaucuuaaacaaacaaacaaaugaaaaaacucaagaauaauaggguuuccucuuucugagugugugugugugugugugugugugugugugcgugcacaugcgugcucaggagaacagauggaggcuacaggauaaccuccgguaacuuccucuaaccuucuacaccuuguuuuuugugucagggucucucacugaaccugcagcucacugacuuggcaaugcuggccggcaguuaacucuacagaugcgcauguuuccagcaccggcauuuacagacacgcaccacuacaucuggaucuuacaugugguggagggaucugaacucaggucagcacuuaaguggcagacacuuuagugacugaaucaucugauccaggcuccaaucuguuuugcgguuacuucccaaagucuuugaaaaaccaaucaaaaauguagcgugaagaauacaagcagaaugaacuauaauguacacuaugguuaacaaaguuucuaauuucuguugacaggcucacacccuaucacauccugaaaugcaaccccauauuaauaauggcauucucugagcuaacugcaaugugccaugggacaaacugcuucugcaaggccagaugcgaguccccugacucaguuauggagacucugacgaagccuguggaagcacuuugguuuagggugcugguguuucucugaaccugaggcaacacaauaccaggaaguguuacgaaaaauuuccagccauauauagcuggcuccuugucaaugucuuacuacguggcugaugcaguagugaaaggcgucaauggagugacuuacaugguuggcuccacccacaaagggguguauauauuauaagcuuuacaaaguuaggguaugaggucaucuguguuuguaagacagaugccuugagcucaggguccaggcugugguugcgggugacucaccugugagggaaucagacccgugcguaaggcuacccguagcugcacacaagcuccacacuugcggcauuuugcacagaacaagcaaaccuaccuugaggucauagaggagcuggaagcugcugggggccugugacgcucucuggacagccugagccagggccaaggcccccuggcccccuucugcccagugggugcacuugacagcaucaaaagccccguguucucuggagaggcggcugacaagguccagcucagcaucuguaucuguccugcacaggagggcuucacguuaaagaaugaagguggcuggaggggagaguaugccuugcuuaugccacuaaagcccacgaggaauaccgccugagaaaaggacaccacucaguccugcccgcuucuagcucagcucuaugaccuuuggccaguuacuuuaucuguacuuauuuggcuccacaaggaaaaaauggaaaacuucacagcagcgcugcccagggaugccaugaggcuuagacaggaauauguuuaaagcauguggaacaaucccggcacaccacugggaaucaguaaauacuagcuuuaaaaauugcugcuucccaucgcacugcggugagggcauuauugcaaaacccuaaacagugcuaaagugccaagccacccacacagcucuugcgcgaacacuucuagcucaaugcauucaacucucucaacagagcgucccaccugaccuggagaaauaaagauauucugcagccugugcucuccuguaagcacaaaaggccugggaacacccgaaaagaacauuucuugucaagccuauguguucuccgaguugcucaguagagaagagggcccucaggagcaauucugacuuuuggaccucaguggugagguagcuaacgugugucugcugugauacacauggugccugucacaucacaagcuagaccacaagcaauaaccaacagcaguaaguggagaacuacucggagcuaaaggcggcacugcgcuugcuacaggagcuauuuccuggcauuuccgacauuccuccucucuauauuucacacuuacuugaacacguucacagccacgacgacagggacuccaaacauucuagcauuuucgauuuguuuccucaaguuacugaagcccuuuucaaccagguccagguccugucaaacaacagcaaauggccuguaaggucaaaacacgcugaccugaaaacagcugcugccucuauuuaagacagagacacugccacugucccuggggcacgccuguaaucccagcauucagcaggcagaggcuggaggauagacaaguugagauuagccuggguacacaguaaauucuugucucaaauaagauaacaagaaaaaaaaggaaggugugucuuggagcuggaagaagggcaagauggugguggccacuaugagggccagugaugcacuucccacaugcuacugguggaagagaagcgaccccugucuacagcacucgauugaagcugugcuaccucccuacgccuugaaaacacgcaauggccucuuaguucuuugaaggggaugagucugaugccucuacuuaaagacauucacagcuuguguauuuacacagauuaacucccaaggugugcuacaaaccaacaagacuuuucucagugggagccauuugaucagggcagagcccagcacaggccccaccagccauaaagacugucaagcaauaagucagugaaguuucagaggauuuaaggaacuuaaccaggagccuucccaaggcuaauaaaauaaggaaaugcuauuuggacaacccggggccugggcaggacugauaacucagugcuuaaguauauacuuccugcucuuccacaggaaaugaguuuggauccaguacccaagucaggcaacucacaucagccuguaaccccagcgcuauggcucauccucuucuggucucuucagacacucccaaccuccacccuaugcacgcgccugcacacggagacacgugaauaaaaauaagcuuaaaagaaaagccagggcuggagagauggcucagcaguugaggcacugacuguucuuacaaggggcucuaagacaaccaccuaaaauuccaguuccuggagauccgauguccucuucugccucugagggagccagacauggguaugauaugcaugcauacaugaaguacuucccauguacacauacaaaacauagagguuuuaaaaaaaaaaacccagcguaaaaaugauuauuaggggcugaggcuauagcugaguuggcagagugcuugcuuagacgcaugaaguccucaguuugacucuccgcacauaugccagcugugguggcacaugcccaugacccuagcacaugacaacaugaagcaaaggagggccaaaggaugccaaaguaggcaaaaccuuccuacacauagaucaaucuugaguaagaguuuguucugggcaauguacugauagucucauucauaugagaaauauuacuuauuuaauuuuaaaaaccaucuacuuacuuguuuaucuaucuaucuaucuaucuaucuaucuaucuaucugucuaucuauucuuuauguguacugguguucugcaugucugugagaggcugccagauacccuggaaccagaguuacagauggcugugagcugccaugugggugcuggaaaaugaacucaggccccguggaagagcagccacugugcuuaaccacugagccguauuuauuuaauucuuaaaaauaaaagcuuuuuuaaaaaauguaauuauuuuguauauauagguguuugccugcauguuugugcaccauguguaugcagugucccuggaagccagaggaggggguuggcuccucucugggacuggagugacagaugguugugacccacuauguggguaccuggaaucaaagucggguccucuggaagagaagccagugcucuuaaccacuaccuacuuauuuccugacaggaccuuacuauauuuucugggcucuugugauccuccugccucauccucuuaaauguggggauuauaggaguaugccaccauuuuugucuugaaacauacuuuaaagacuuucuuccuucugguuuuuguuuuuuuuuacucuguagcucugacuguccugaaacucacgauguagaccaggcuggccuugaacucacagagaucugccucccaaguacuuggaugaaaggcacgugccaccaagcauggcuauuuguuauuuucaaaauuauacucauuuguguaugccccccacgguggcuuguaccaugguaugagugugacaaucaaaggucaguuugcaggggcuggcucucuccuuccacuagguaugucccccaaaauuuaacuaucuauguagaucuagaugaauggauggaugggcauggggccucaugucgcccaggcccgccuuagaccugcuauaaagucaaggauuuuggucccacuccuuccucuuuccaagggugccaacacugacacuaaggcccuggcuugccuggccuugcucaguaguagggaguaagcccaaagcuucgugcgugcaugaaguacaaucauacuaccaacuaagcuaucaagcagcuugugaggcccuuucauuguaaucugagaucaagauuaaucugacgauuuaaagcacacucuuguuuuuuaccucuagucacauaaaaaaaaaaaaaaacaauauauaagaccgacugagaacaguuuuaaauaagccgaauuucuuaaaugaagacaccagcugggccaguucggggcagucacuguaauuagacacaggaaaggcugugggguagcaggagggccagagcugugaauuccccuccuacgccugacucacacagaugaccauaaaaggcaaaucacagcucagaagacaggcagacucaaggcaccaaccaucuuuuuuuccagucaauuuugcaaacuucaucugggggccguacaccgaccgugcacugccugauaacguaagagcuucccuccaggacagagaaauugaaucaacagugacagcagcugacccugcaucuaaucaaaggcccaucgguuauguaaucacucacaguggcccuagggauauuucuuugaugguaaaugauaucaguaugaagaagaagaaaaaaaagagcucagaacuguucuuugagcuccugcccaauagaccgaauccauguacagaagacgugccuccaaacucaaccaggacauuuacuggcucuaucucaggucuuugauuuagguuugaauuugcagaaggaaagguuauuucuaaagcucucuucuugcuugauuuaaguggcauuuaugacuucugcgugacagucuagagcagggcuucguaacuccagcauuacugucauuuuuauuacugggguggggugucuuacacaccacagcaguuuaacaaccaucucugucuuuuaccuaucagaugccaguaacacuuuuggaaguaguuguaacaagcagaaaugacucucucuagguagguaugaggugcaugcucuaaucauaacacuggaguucaaggccagccuagacuacuuaacgagauccccaucucuaacgaauagcaacauaaagcuucuagauacagcuuuguuccccaggagcaaacugccaaauuuagucacugcuauuuccuuaaugugauucccagggcacugcaggcuuuguccucaacaccccaaggaccuccccaccuuuugccuuccagauuaagacaugccgauuuuggaugcgguuuccuaggacaacugaucggaaauaauuguaguuaccucuucuguguaagccuugggaagaggcaguccagcggugaccuagaagauaggauagaaagucagccacguuuccuacucacuguuggcacuaaaguggugcucaguacacugacaggcaaguggcugcacuccccaaagaguaaugggcagcagugugaagcuguuuccugcucaacaggcuuggaaugugagacuguagagcuucgagcagucagguguuucuuugugaugcgagauuggguggggguaggguauggcacagauggaugaaugccaagguagacagaaauaugcuguggcagaacacugaucccagggaaugaagcacacaccaguggaauggaaguaagggugagcaugggggggaaaaaagacagccaccaacccugaaagucacuacugaugucuaaggucaggccuguaaggagcgugguugcucgugccuuggcagaaggugggguggugggugggcugugaugucggaauaaugaagagggggaaaacaagagccagugugugccuggacccccuaccacucagaagauggaagcaggaaucacuacaagcuccucaucaacguagcaguuagagggcagccugagcccaagaaaaggggcugggggcacaacggcagacuuucuuccucugagguagagcagacucagagguauauaaacucuaaagcaguuagcccauugugucgcuaggaggaagggccuggguccugaucuagggagcuggcucaacccuacuguaugguacaccaaauggcucaagguugacuuaguggucacuguaggcaacauggugauuaaaaagcgucuagcugggucuucuacucuccaggaagacugaggucugcauguccagucuaugggguugugacucuugaagggccacguggaagagaaacaggaagcaguguccguccacguaacuucccacacgucuggcuccagggcagcgcuggacaggcaaagccuccuuucaggacugccaggguaggggcucagacucccuggcagguccaaccuuuugacuuugcaacauaauauugucuccuauacaguucacacucaagaguuaaaaaaaaaagcccccccuuuuuuuaugacugccuaucuaaccccuuccacaggcuugugcuuggcccuaauugauauuaaaaaaaaacaacaacaacaacaacaacaaaaccaacaaaaaaaaccagugucaaccaguuauuuauaaauccaaauccaauuuucaguguuuugggggaguuuaaggcuuuguggguuucucgcuuagcugcccuugcucacgccacggugugaggauggugacugaagucuaucugagacaggaaugcuggguaggaucagaagaauacagcauuccucgcagaaagggguguccuagguuggcaaagucuagucaggggcaacacggcuaaggacuaccagaggucauggugaggguuaggaaagugccuucacaugguaugcucagggggcccaaggccaaaacuauuucccuaaaggagccuucacuuucucacugaguggacaacaaucucuccaaagagaaccuaccguuucuagugaaccagacauagaagagacaggaagaguggacagugccuauauuuugucucagaaaauauaauagcuuuucauuuaaagugcuuuuuaugucaacauguaacucaguuccaauuucaaauauauuaaauauuaauagcuauaaugcauauaaauaaaaguuuuuucuuaggccuucaauaauuuuuaaguguacaaagaggcuguaaaggccugguaguaaaauuuugucagacauaugcaaagcugcggcuucacuccccagcguaagcugguaguucgaauagguacaagccuucucagacuaauguguuuaaaugcuugaccaugggguguggcgcgauuaggagauguggccuuguuggaggaagugugauccuguggaggcgggcuuugaggucauucaggcucaagcuucaccuaguguggcacacagucuccuucugcugccuguggaucaggaagucggacucucagcuccuucuccagcaccaugucucucugcaugccacugagucccacccacggugguaacagacuaaaccucagaaacuguaagccagccccaauuaacgguuuucguuuaugagagcugcuguggucauggugucucucucuucacagcaauagaacccaaacuaagacagucccccgcuccugaaaacaaagaaaaaaaaauccaaaacacuugagaauugcuauauaagaacaaauguaugccacugcaccaagaaauagauucuauucuguagacaagggaggucuuguucucuaaguuacaauaccgaugccuaaggaacagaaauuuaacccuaaaauaaacaguacaaaaaacuuuacaugaagaaaagauguggagccaggugugcugcuacauuuaaucccagcacucaggaggcagagggaggaggaggaggaggaggaggaggaggaggaggaggaggaggaggaggaagaggaggaggaggaggaggagggcgugagugagccuggucuacagagugaauucuaggacaaccagggcuacacagagaaacccugucucaaaaggcaagcaagcaaacaaacaaacaagaagagaagagaugggaaaauacuuaaguguaauuucuaagcaauaggaguucaggagaauucaccgagugcagguuggagcugauucugggcgagcccacccuuugcccauaccagccagagguccugucauucuccuucauggccuccggcagccacaucgaccuacugcaggcucucagaacccugccagccagcacugcuacucacaagcugaauucugcuuuucagcucagugcuuggcuggcuggcugccagcaucaauauuaagaaggaaaauuggauuuggauuuauaaauaacugguugacacugguuuuuuuuguugguuuuguuguuguuguuguuuuuuaauaucaauagggccaagcacaagccuguggaggggguuagauaggcagucauaaagacaguuugggucuccucaaaaugcugcaagaggaucugucccugaaggugacggagccuguguauggccacccccuggcuuuuggcacccuauccagcaugaggauaaauaagagcaguggaaagcaggcagacccagagauaugucaugaaauuuccuucaagcaccuggaagguuccuaauagccacucucccagucccugguccucaccguggggccacccccgugcaucuuaagggcccugacaguggcaaccagaaccaccacguguggcuggagaccagaauaccggcacuugauguugaagaacuuuuccauuccuaugucugcuccgaauccagcuuccguuacugcaagggagaggagcaacuguaaaccaccagggccacucugugauauaagauaaacucaucauggccgcccacugaggaugcaggagaacucaccuacgaagcccucagggccuaccagcuugagugcaauccggucugcaaugauggaggaauucccgugugcaauguuggcgaaaggcccggcauggacaaacacuggcgugcccuguggagaccaugacgucaugagcaaaugccaaccuggcuucauaauggagccacaggagccaaagggcuaggauuuagcuggaauuugggggggggggggaccuucugggaggaaaaucuccaaaaauuaccacccccuuuccacagcagugccgggaauuaaauccagggccuuuagcaugccaaguaaauucucagccacugaccuacaucuccagccccaaaggcaucuauuuuauuucaguuacacccccucaccucagcuacaguaagaaggaaaguaaggaaagauaugaacaguagaaaagguuucuaugggauagcaagauggcucacuggauaaaggagauugccuugcaagcuuagagaccugaguucaaauuccaaagcccaaguaaaaguaccaggagaaaacccgacuccacgacguuguccacugacaacuucuacaugcaugcuguggcacacacaaugcucccauaacaaacugacuuuggagaaucuuucaaaagaggugucugauucugcaaggaaaggcugcgugauaaucuccuggcuccgaauagaggaggugaacgcuggacccaggagucagccagcucaccucuaaggucugcaugagguugggcuugauugcauccuucaucagcaccgucagcgccccacucacgcccugcaagacaagcccacgaagcaucaacucgugcuagcagaaauccaaucuccugaaaccaaaauucagcacuccggggcuucucauucauuguaaccaucuugcagcaauuagugcuuacaccuaaucucagccauucaucucuauuucuuauuuuuccuugcgguacuaggaagccaccaguuaucuuagcagggagaggaagcagaaugaaaacggcuuucgcauacaauuuucugaaaaagcacguggcgccagaaacaagcgccucaaucaagcucugccacuggcuugggggggcgggggggauccauuuagaccaguucagaguagauacgguacuuccaacagcaacgaguuauuuauaacuuugguaucugagcagaaaugguguauaaaucaaaaucaauguauguuucccaaagcggaagccagaauacuagccagaagucuaauuucaacccccaaauccagcuccuacuuuuaaggcuucuaaucgucgcuaaacaaaaccaguggugaacaccaagcgagaucgagcaacgguucucauuuauguucaacauuaaugcgguucuaaauuuaaggucuggguguuaaaauuuaaaacacauauuaacagugaaaacaaaguuaauauuuuccucccuuuuuaaaaauuugucugccaucacgccagcucuacugguauguguugauacaaagagucguuuacauuuugaucuaaagcaggugagguggcacaugcuuaugaucuguuaguucucaaccugaacguuaugaccccuuggcgaaccucaaucucuaaaaaauaugauucauaacaguaacaaaauuacaguuauaaaauagcaacaaaaaucauuuuaugguugggggccaccgcaaugaaagcaacuguaucaaagggcuguagcauuaggaggauugagaaccaucauuauaaucucagaacucggggguggguggggcuaaacuagauggcuauugauuuggggauagccuggacuauaugggcauaguggcagacacuuuuaauuucaguacuugggaggcagaguggaacucugugacauucaggccagccuaguauacauagccagauauacauauauacauagcguuccaggacagccagacauagagagacccugucuaaagagacaacaacagcaaaacacuaaacaagcaaaugagagagagacucaguuagaagacuauuggccaaacuggccauugaguccuucuaaaccaagugucauggggaggcaaacacuuggggggggacucuagauggucacaugaucuguagucagggcuugcucaggaagacacuugcaggaagaaagcaucauucaagucaccuggcacuuguggccugucauaagagcccaacacuacuaccaucauucgcuaugaagaacgucuaaaaauauaaauuucauaacuuuugcaaucagucaaucaguuaauugcaucauuuugagcagagcauaaucucugcuuuuaacaaucacugaaagaccccgggaugcuagacccucccugccugucacucaccaggucuucgcaacugauaggcuccccuuucuuacuggacgcuaccaccauucugcccagucucucucucaugucuuccagagagcucgugagggccaggacugccaugaucucacuggccacagagauaucaaacugggccugugggcagagagauaaagaagacccuuugugucaaaccaggaggaggaauaucagaggcaucucuuuuggcucagacaaauagcuaacaaggauggauuagaaauaacuaaguaaucuuccaacaguugagaaauuuauaauuguucagaggccuugaauaaucauuuuuucuuaaaagucaguguucuagggauuguagcauuggggcagagcacuugcccagcaugcacaaagcccugaacaccugauccccagcaccucagauaacaggugaggucguacacgcuuauaaucccagcucauggaggagcagaguucaaagucacccucggcuauaauaagcuugaggccagucugagcugcauaagaucacccuuaaaaauaaaaagcuguagcauggccagugagcuaucauuuuaucucugagaaagcagcuuggaauauugguuaguuucccuaacacaaaggggacaaaacagguacucuuacacugaggauauauacagucaaauggccacagaagagaaacaauuuuaauuaauuuauaugcaagaauauucacucgggguucuccaccuccaggagagaaugcuggggaaaaccacacaggugacacauggauuuauugcacaagcugucaggagcgcuccgugccacaccuacucacuuccauuuuaaaagggagaaggcagaacaacaccugccgguguggucguagggaggcgauggaggaggauggaggcagcgagagcuaguucccauggagcaauuacuggagaugaacaguuaccgugcguguguggccuuucucuguuggagacuguccaauugugaucuuccucaggaaucuaucguugguguccaacacuauggcagaaagggagggcaggaacagugcuuaagaaaagguacaugaauaaaggaauggggauauaguucagugguaagguaaagaaagggagggagggagggaggagggagaaacacaggguagauagcacacaccuggaacaccaguacucugagagcugaggcaggacaauaacaaaguuauggcuuuccugggcuagggagcaugacccugucucaaaaauaaauaauuccauagagauguagggcccauaaagcuaaagggaggaacagcauuuaguaugugugcaugcacaugaguauguguguguguguguguguguguguguguguuguuguuguuguuguuguucuuucagagacaagaucucuauuaugaagcucuggcagcccuggaacuuacuauguagaccauacuggccucaaauuuacagagaucccccugucccuaaccuccugaauguugagguugaaggugcgcauuaccauguccacucuagcaacagaguuuuaaaacaacaaaucuugucuaacgauagcuuauuaauacuugauuucagaaauggucuacaaagcuagacuacgguguaagagacacggccacaggccagaaaugcagagagauggcacuuaaagcaaaaggaauuuggaguggauaaacuucguuccuucuaaagaauucaaacaauuaugaaaucuggacucuacuucaaagcacauucuauauuagcagagaaacacagagugacccaguuuaugaaaaagcugagguguggauuguucugugggcgacucgcugaccauacaccccacacaagagccaucaacucagaccaagugcagaugccugcaaagaacucuagcucucaggccuggccucuccuuagcacauucucuggugaugacagacagacuauauacccacuaguauaaccucagguaaccuggacaggccaaccaccagccgccaaaccucgcuccccagggcuccauaccccucacuguuuaguggacuccugcuuuuucuuccccuauguauagaauccaaaaagacauaucuuugcuguggguuuacagaaccaggcucccagagcccuuggaauguuaaggaggugaaguaccccaggaguggcauggucaccagcaaggacaagagucuggagggaugcaacuuucagcucuaucuagagaaacugaucccccacugcacugaggaacagagguaaaguugaagacuuagaauaacaucaucacaccacugcuuguuaucuauuuaguuguguaaaacgaugacuuuucaagcuggcugagacucagggaggaggaugcacacagagcuucuguaggcuccucccuuacuguuucauuuguagcaaaccaauaaacaucaggaaaggaauagcagccagauguggcacuucaugcaaggcugaggaguucaaggucaguguagacuacacaguaagacgcgcucuacaccugaaccccaaacacacacagauacacgcuaaaggaaaugauuagacaauggauuaaauucuccuaacagauggugagcuuccuucuucuaaaaauacugcagcggggucuggagagauggcuccguggcugagggcacucacugcacuugcagaagaccaggguucaguuuuuagcagccacacggcagcucacaaccauucagaguaacuccaguuccagggaucccaugcucgcccagucuccuugggcaccaggcuuggauauggcgcucaugcauguaugcaggaaaacacccauuaaauuaauuaauuaauuaaagaaauuaaaauggggacuggagagguggcucacugguuaauagcacuggcugcucuuccagaggacccagguucaauucccagcacccacauggcaacuugcaacugucuaauuccaguuccaggguaucugaugcccucuucuaguuucuguagacacuauauacacauguuaaaaggacauagaugaacguacucauacacauaaaaaauaaaaaucuaaaaaaaaaauuuuuuuuuaaagaaugguguauuugugguccacagcuguaauucagcauuugggagguggaagcaggaagucagccuuggcuacauagagaaccccaaaccagccugggcuacaugaucaaaacaaacaccaaaaccuccaaaugaacugaacauuaacagucgcugugccaauaaagacaagaaaaaaguugguaaguuggccuucuggugcauucugcaugguuugauggaaauucccucucugcugugauacaaaggagguggacagaaaauaaaaucccaagcuaugcuaauuguacacagagcaaaacaacauauggcccugaagucaggcaaacgucuaaaggcugaaggcuggcaaguguuacaggaggaguuaauaaacgggagaaugauuagcaggauaaagagauccaugaaaaaccaagucaccagugccagagcguucucagaauaaaacgcacacaugauucaagugauuagacaucauuuucccacuucaugacacccaaacuuucugcauaaaauugaaacuuaagaaauguuauuuuugguuaaugcaugaacuccccugaaauccucauuucaaucaacacugaauagacauucagccaaccucacaaagggacaucuacauugcagcuaaggcugacaagcaaaggauaugaccauucuggauaaguauccugacccaggagccuccuggaggagggagagaugggggcuaccaaaguacagggggcgcacagccugggcuggguacauaccucucugccauguuaugguuucugggucaauauccagucuugcaaaucuguuuaucucgucaucugucagcgugguggggucagucuucucaaugccuagccucugaaaagaaaggaaauuaaaacauaaaauaagacaagagccagcccucaggaggcagagguagacagaucucugagcuugaggcagucuggucuacacaguguauuucaagacggccagaccgucucaaccaaaccaaaccaaaccaaaccaaaccaaaccaaaccaaaccaaacccaaacccaaaaccaaaacaacaguauucauccauccauccauccauuccucuguuuccugauuauagaugugacagcuaccaguugcuucaagccccugcugcuucaacuuccccacuaagauggacuguacuuugaacuguaaacuaauauaaucccccaccacaccccccaaaaaagucaaaacagagaagcauacuuuuuuuaaauugaccuuauauugagauagggaaauaaggacuaugauugaaucaugccuguggcacacccuuggaauggcagcgucuuaaauccagaagggaaaacugugaccugagccccuggcuaagccuggagguuguuuccugucccacucgguaugucugcucuguaacugagcuccagagacuucucucaacccagccaaaaacagccccaaccaagaaccaccacaaugcauuucuggauucacuaacuauauugaaaugaaaaagaauaugcacaguuuuaaaaaccagacugagaaacccaagaaacccaacugaagucaaaguuuaggaaaggcaaaauugagcagcaaucaaugaaaaaaaaaucaauuuaaacucuuuuacacgcuuuucuauggcucaauacuuucccuggcuucuuacuguucuaaaaagacauaaaaaagggucuuuauuuuucuccuuacagaaguuagauacuuuuaaauuuuauuuaaugccuguaagggucacuucucgaaauggaaaugcuuaucaaacagugcccuccucaucuucagcagacacgagucaagagccccagcaagacccuuuccucccuuccuuccucucuuuugagacaggguuucucuguguagcccuggcuguccuggaacucacucuguagaccaggcuggccuuccacucagagaucugcccgccucugccuucggagaguugggauuaaaggugugugccaccacugcaugagaccaugagccuaggacucgacacucuucaaagacacccacaagcggcucaguugcccugcuguuggaggugagggucaaucucaacugucaaugucaugaggucuagaaccacuauagcucugucaugauggggucacacucagacuauagcucugucaugaugggguaacacucuaagcacagguuucaggggaggcguaaacaaagcuaaggaauaucaagcugcucgaaagcuagcuaguguguucucagcgggcaacaaaagccaccaacagaaacccagauacaaaaauuaucaacagaguuguaaguagagcaacauguaaacaacauaucuggguaaaggaaccuccaggguuacucuugcagcaucaaaacacagaguugcucagggcaggauagaaggccuggggguuaaaaacucuugcuguucuugcggaggacccagguucagguuccagcacccauauggaggcucacaaauaucuguaacuccaguuccaggggaccagaugcucuuuucuggccuccaagggcacaaggcgguguaacacacacacacacacacacacacacacacacacacaauaaauuaucaaaacaaaacaaacaaaacucccacaaagcuucaggguuuggggauguauguagcucaguaggagcuuaguaagcacgagggccuggguauacuccugaauaccacacaaaaagauaaguugcaaagaauuaaaaauaauugaacagaacuguugauaagcagcacacaccauuucagcaagugcuuauuaugugcauauauaagcacacauaaacgauuuccuuacuucaauagaauuacacacgaauaucccucugcuauuccuuuauaguuaguuacaccgucccuugauccacgacucuuggcauagacuagucugauguccugucucccugaagauaccacagaagcagaagcacagccugugaucuuuuuuuuggacacuggcuucuuugauuagacauaaugccucugagagucaaccaaguugcugugccuuucagcagcucauuucuuuuaauugcacagaugcacggcaauuuguuuaaccauucauccauugaagaacacugaagacuuuucucacuuuggggagauuauuaauagagucauuaaaacauguaugcacagguuuuugugugaaugccaauuuucauuuuucauguaaaauaaaaaucgaagacaggaauuauuaggguauguggugaaaacaugugcucgcuggcuauagagguuuggguagauuauucagaauguaaaucuacuugcuucaaaagcccaaugaccugagauuaguuccucaaaccuagguaaagccagauguggggugcacauccauacccggcacuccuacgcaagauggaaagagacuagagaaugauguucuacauagcagcagaaaccagagagacccugccacaacaaauuggaaauuaaggacugauucccaaaaguuguccucuaaucucuacauaguacugugacccacacgugccuacaguuaauacacauaaauuuuuuuuacauggauauaaauauagaaauucaaauaaaacacaggaguuacuaauacucugauuaagcucgucucauagaagacugaaccaagagauggcccacaaagaacauguccucaagaucccagggcuagggaggccagggacccagaagcugcacaucuccacgaugcugcccucaaucuucacauuagaaagcugcgcccucgcucuucuuagcugaggacuaauugucagcucuaucuacuauacgaucaaucacuauaauuuauaaagaaaugagggaaaccccugccuucaauccuuguuaucuuuaauuaaauuucuuaugguaucaucuaucuaguaggcaaaagcuuacccguaaccugcggauuuggaugucagagaauuuucuuauuccguuuacugaagguaccagacgauuaaagagagccuuaaagaaagagaagaaaagagcuuuagaugaggggguccuacugucauggcaccaaaagaccaauacuaauucagguacccccccccacacccucggcauucuaccuugucugucugggucagcucaugaaauauccgagcaucaauggcagcagccacgagguuguuagcagcagugauggcguggaugucaccagugagguggagguuaaacuacaaaagagcggaagccauagcagucucuagcucugccuuuuccaaccugcagccucccacaaccaacacagucuccacacuaacaccagugggugcuggcugaaguacugcucuuggacaggcucacgagugggcuucuauaugccaaggaggcugaaggaggacugccaccaguucgaggccagacugaucuacacagugaauacugaagaaaaaauaaugcccaguuaucuggccuuugaaacaacucccagugaaggaauuagcaguuuuccauauaagugugcagagagcagagcaccaccccccucacggccaaccuccugccaaggucagaggcugcacaggggcauagacaguuguuccccucuggguccccacacugcuccugaauccccaagccccugaugcuucuggggaccauguggcaugcauguguuugcuuguucaaaaugacuauccccauugaaagguugugccuaaguccaaccuguugucucaagucuacacucaaguccacaaauaaagguuuuuuuuguuuguuuaauauacugcuccugccaagaaacaaguggagugcccacuaaucauucucucucucucucucucucucucucucucucucucuuuaaaucucaucucuggaaaggaaacucuaucacacaggguaggguucagucaaacccugagcgguuuuaccucuuccauaggaaugaccugggaauagccgccuccugcagcgccaccuaggggacagagcaacagcuggaacucagguuaacuugcuucucugugaauuggaacccaaagaccaacaaacccauuuucauaucuacuaagcaaauuguuuguuuacucucuccgucacuuggacagaugugagcagguguuuucuaauuuccuuuaccucacugaaacgcuugaucacguucacgcugaacaggcucucaauugaaaucggagugcaaaugacagaaacaugcacacacacauacauaccuacucauuaucuuuagaagccgguuccccgugauuccuaacauguuagaaacccagaugacagcuacauaaaggcaagcccgaguaacuuccuacucacgaagcuacucuagcuuccagaaaaagaaucucgaagguacacaccgaacagagacaccaacucuucuagaacauaagauagcuaucagaaaacagccgagccucgaaggugcuguagcccauguggucaacaagaggccggucaagauguccaggaugcuguaaggaugccguaaacaucagcacgaaagaacagguuucauuuuugugaggaagacaacgcaaggaggaaaauucaauaugaggaaagagaacacuggguucucgagucggaauaagggacaaggcuucuagagucaaaaggggguuauuacaacaagcuccaaggcggggcacagcggcacauacacacuauuccagcacucgggagguaggaagacggcacacaggucaaccugggcuacacaguguguuccagggcagccugaaauaccugggacgaccucgucucaaagacaaaaggaagcuaacagacagcaagucagagcuggcaggagggaagagguguuccugcugagaacauuaacuacugggacaagcagaagaugaucccuugucagccagcaaacggaaaagccgccucuaagaacauaguauaauuaagaaaaacaguuucaauuaaaagaguauguuuugaaaguagaagcaacgcugucuaggaaaacagagaggagcaaugggagggggaggaggaaagaggagggagggcaugggguggucuggggugcacaacgcacaaauguguaaggagccauuauguggcacagcaccguguacacugaagaugcgcaguggaagcuaagacaacagcagaagcaugucugcguguguguguagcucaggggcugugugugcccagcacgugugauggccuuaauuuaaccucaaccaaugugugcaaaauaaauacacaaugucaauaaauaacaugaaggaaccaaaaagagcagcacuacagaagcacgguggccgaaacaaggagguuaaauacagcgauccaguguccucaccuauucaagugugguauacagaggcugaaaugggcgcgaggcaagagucaccauggcucgccacuuucccagugcugggacccuuucauacaguccuccuuguugcggugacccacagucauaaaauucuuuuaggugcuacuucaaaacuguaauuuugcuacuuaugaaucauaauguaaauaucugauaugugacccuaagggggucgggacccauggguugagaccauugcacuaguggcuggugagaguuaguggguuaaagacacacacugccacgccugacugccaagucucuaggauccauaugaugaaaauagaaaauaaacuuaggagguggugcucugacugccacacauaggcuguggcuugaacuaagucacucacccauuuacucacccacagccaacuaacuaacuaacuaacuaacugacuaacugugugauggagccuuaaccaaaucaccaguaaagucccacugcugcuaucauaaacgguaaugacaugucaugggaggagagaaugacgaaaacacaaagugcuuagcacgguaccuagcagaaagcauucacuaaaugagucagggagacaucgguguggcuggaccauuucaguguaagccuggaccagcagcuaggauuuccuuugcuguuacuaagacaguggaguggauaccggggucaaauaaaagcccuuugaacuccauuuuacacaucccgagauucucugcauaugucaaaaggauagaccugggguaacaacgaaagccuuucucaaaugcaccacaauacaaaugucugaagcaaacauuucagcuaucuaaaccagccaaagcccuccugggugaagacucagucugggaagacuaaaggaaaggcaggggaaggcaggcgccucuggccacaguaccuuuuaucccaaagguggggcccugcgaaggcugucgcacacaugcaaagacguucugucgcaggugggcgccgagggccugcaccagcccgaucguggugguacucuucccuucucccagcgguguuggaguaauucuucaaagaagagagagacaauagaauuaaugucacccaagucacuguacagucuaauaauaaucuaaucuaaacaguaagaacaaggggcuggcaagauggcucaguggucaagggcacuugcuguucuucgaggacugaguucgcgucccagcauccaugugccuaacaagccaucuaagcucacggccaucuguaaguuagccccagguacagccuuccccugaguuucauccagaacucauacagagguggcaagcaagaaccagcucuacaaaacuguccucccaccuccacacuugcaccccugcaugcagacaucauuuacauauacaauaauaauaaauacaacuguaaagaagguuagcucuacucaccacaagacauauaacugacccuugacccugaugucucaugaauuuaagguuuuuuuuuuccaaaaaaaaauugacauuuuuuuuuuugccuacauguccacaacaugcagugccugaggaggccagaagagggcaucaaucagaccccucagggcuggaguuauagacagcuguaggugcugggauucaaacccugguccuccgggaaaagcagccuaggcucuuaaucaucaagccaucucuccagacccaucccccacuuuaaaaaaagauguauuuauuuguuuuuauuuuauguauacaaguguuuuaccugcaugcauguacguguaccacaugcaugccuggugcucucagaagccacgaggcuaccagauccccuggaaccaaucaccucuuuaggagucugugggcacucacacuuauacaugcucuccugaacauaauuuaaaacaaaaauaaaaccuuaaaacaacaaagagaagccaggcgugguggcgcacgccuuuaaucccaggcagaggcaggcggauuucugaguucgaggccagccuggucuacaaagugagugccaggacagccaaggcuacacagagaaacucugucucgaaaaacaaacaaacaaacaaacaaaaaaaaaccaacaaagagacuaagcugacagcucuuccacacaugcgcaaaugccucacuggugauaacagacggcugacugugaagcccgcuggccacagaacacacauacccagucaccacgacauauuucccaucuggcugaugcuucaggcgaucuaaugcugacagcaagacuuuagccuucguuuccccguacaacuccaccucuucggugagcagcccgauuucucgggccagguucccgaugagcuuugguuugcaagaucgugauauagcaaugucacuuuaaaaacacaaggauggguuuagucaccauguuuaauuaaccccacacuaguaacaggcuccuccccucaaucaaugcacacauggacccaugguacccagcaguuaacccugaccagccacaaccuucuaaccgagaacauuucacgccuaccuugggacaggagucuugagguucagcuuguuauacugaauuguccacuucccuggcuuaaauuucuguaggaagcgcugugcgcucucuacugugcucugggcaaagggagaaggacggagagagaaacagcgaauaguuuaacuccacacagcaggucugagccccaggucaccacaguucagaccaacggaauccauccgcaaccccaacacccaccccaccccacccccguguaaacaccucagcuagaagggagagaggaggcaccgagcuccgaggucuuuguuucacccacaccagcagguguaaagccagccagcguguuuguacuucaguucuagaccccaaaggacuuaagggcaccgccuccucuaucaaugugaaggauaccauuguuuggucucucccuccucuuuccuccaacagacucuuaucucagccuaauuucugagugggucuuaguggugucuuuggguaggaaagucucuagaauaauccagaacuuucugcgccauaccugcaucagcauugccacggucaugggccccacgccaccagggacaggcgugauaaagcucgcccucuccuuggccucaucguaggccacaucacccacgacuuuccuuccauuugguuuuguaucaucuggaucaggaaagggagagaaaucaaaguugagucucagaggcacagugacguaaucauagagucucagaggcacggugacguagugauugauuauaagcuuggcuccccaucugcagaggguauuagucccaugaggcuugagugucuauuuaauuaaagcuacuggacaugccagggugcaguucugugguagagcacugguccagcacgagacgggcccuggauucuauuccaauccccagugcuagauagcuggcaggugcuccaccaucuucuagggagaaaauuacauuaucugaaaaaccucaggagaugucuaaguggcaagaacagaaaauuaaaauaauuuagaauaaauuaagaauaaauaaauuuaagaauaaauaaauacuuuuaaaaagggggcuuuucagauuccuuuuauagucccucuggugauaaauaauaaaauacgcuucuuauucuuaaaauguacgaccuuuucaaauguuaauuugccaaggccuacaaaggaauuuuuuuuuuuagguacacaaagcuccaacuaugucacagcugccagauacguuucuacagcaacugucagcaguuacagagcuccaggcaggagccggaggaacaauucaacaucccauuccaaauacugagcaguuucuuaaaugcuugcucaaggcaaagaauauaauuacacuucccuuaaaaggaccagaagcacaaaucucuccagcgaagaacagcuauucaagggaacaaacucagagaugcaccgccgcucacacagagaacauccuacacccugcucuggggcacuuccgggagacgcugagggacaggccuagaccucgaagcauuaaaguuccuggggaggaucugguagaaucuuaggcacauuuccaguucucuucaggcauguugcuaugcugggagaggaagguuuuugauguagccaaaaaauaaaaauaaaaaauaaaacaaccccaaaccaagaagcuuccgucucuaggaugagccuguucacuaucacuauccuucacccuucgaggcuuggcacugacuugugguccaaaaaugcaaaggccuaacgcacaccugcucacaauauuuuaggucauugaaaggcuaaagcagcacaccauggcaagaaagauucuaguccuucccaaagccuuuucgggaugcaggaggagggagaaagaaugguuuagauccccacguuaggagguggaugcaccuguaaguccaacauucccaggcugagggguugacaggaaaaaucaccagaaaacuagugggccagcuaaccugggagaauacaggaugguggaaaggaaucuaucucaccaaggcagagggaggcaagaaccgauuccaaaaaguuauccugacuucugcacaugcccaguacacauacacacugaccaaacacuaugaggguugacuuaauucccugcugaagaggggacaagagccucaccacuacuguguggucgggaggacaguggccacguaacagcacgguuaucccuuccuagcuccacgcuuucuccgucaauggaaauuuccaaucauaaaacucaagucuggcuugagucuggcucugaaacucaguuuggaggcuacuaccuauagaggcaguacagaaacucuuagguugugaguggagauggugaggugaggaaucugccccuguuaaauaaagcacugucacgucuccaaguaucuuuacuagccaagccggaaagccagucaccagcuccagccacucgauuccugaaaaggcuucuuuugaggugacuggagauguggcucaguggcagaguguuugcccagaaugugcaaaguccugaguuugacuccccaacauugcaaaucaaaauguaaaaacuggaaaaauguaugcauuaauccguucuuaaucuguaaggugacucauugugugagccacacgaggagcaaaggaacaauucuuaccuauuuaucuguaucuauuauuuuuuugucuuuucaagacaggguuucucuguguagcccuggcuguuuuggagaccacgcuggccuucaacucacagagauccuucugccucugccucauuuuuuuuauuagguauuuagcucauuuacauuuccaaugcuauaccaaaagucccccuuacccacccacccccacuccccuacccacccacucccccuuuuuggcccuggcguuacccuguacuggggcauauaaaguuugcguguccaaugggccucucuuuccagugauggccgacaaggccaucuuuugauacauaugcagcuagagucaagagcuccgggauacugguuaguucauuauguuguuccgccuauaggguugcagaucccuuuagcuccuuggguacuuucucuagcuccuccauugggagcccugugauccauccauuagcugacugugagcauccacuucuguguuugcuaggccccggcauagucucacaaggcacagcuauaucuggguccuuucgauaaaaucuuccaggcucaauuuuuaauaagauaaaacucagagucuuguguuugcuaaacucuucuucuaccacugauacucaauucccaaacaauuuaaaaaauaugaaccaagaagugaccuaaggaguggacuagauugcuucaucaaaugaagauauucaaagaucagucuguggaucuugagacacaccucuggccuguaacgaugauaccaccauucccagggaacuacauauuucagccuuacuuauauuuaugugaccauaugcauaggaccaguggaaacacugaugaccaccuauacuguuuuaauaucuacauaagaaaucgauguuaaugccaaaguuucaggcacaucuacagaauucuagauucugacccaguuugguuuauuuuuuuuuaaucucaaguacauaaguaaacaaauaaaucucucccuuugccugaaguaauaaggauggaauccaggguguagcauagcuuaggaacucuuccacugagcugcaccccuagaccacauuuuucucuuuuaucugucucucuuuuuaaaaugcccauaguaguaguuuaugauccagagauguggggauguaagcagacugaguuuagaugucacauugcaaguauucacagugggaagaugcaggagagcaacuucuuccgcacccaguagauaauuacaccagcaaaugagugaucaauuaugagcuacugucuuaaaagcgaggccgagugggagggagguuagaaauggugagaacuugacagugacgaaugcuccuggcagcucagugucugcauuuuaaacuucagaugggaagggagaaaaaaaauaaugauccuugcuguaacugcuucaccaacuccccagaucugagugcuagcgucagcaggcaggaugcuagaccaggcagcguagagaccacugaggaaggagcuccucagagcagaacucggagccagaagagcacaagacacacccaaaaugcugaguucugugggacuggagugaggggcaagaaggauuuucaggagacaaagaucaucucuggaugaaaggaaaaucagaugugauuuaggaagaacugacauggaggaggggaacugaagaagccauccgaagugcaaguacagagagcagcgauuccugcugugguucaaggggagagcacuuguguaccaugcacaaggcucugggucugauucccacaacuacaaaaugaaugaaugaauggaugaaugaaugaauaaaugaauuaauggaguccacaacuaggccauauucaggcacagagcccaaggccugcuauacugcucagugaauaaguaguuacugcuccuacaugcaauaaaaaaaagcauauacauauauauauguauguauauauguauguguguauauauauauauauauauauauauauauauauauauauauauauacacacacacauacauacauguggauauuccuguacuaacuguuaagcacuugucaccaauuuaaugaccuaaguucacaucugauaagagaagauuaccaagcaacuaacaggcaaaguagagugguuagaaguuagaauguacacaggugacaaaagaguggcuccugucccaagccggaagaagugggacagagaaggauggcacaagacuucuucaagccacucuggauggcaaacaauuuaaaauucauuaaccguccagguguguuggugcacaccuuuaaucuuagcacccuggaggcagaggcaggcagaucucagggaggucagggccaaccuggucuauauaaugaguuccaagccagcaagaacuauagcaugacgaugacucaaaaacaaagaaacaaccucacuaaugucuuaggagcucuccaugucauauuuuuggaccacaguugaccuugaguaacugaaaccagggaaagcaagaucacagacaaggaaauccuacuguaguuuaucauaaaaucucuccagugccuuccuuagaauacaacggguauacaaaggcagaacagaaaccaggagagguccugcacaccuguagucccacauucaggaagcuggcacaggacaguuauggcuaccggaagagauaacaaacaagcaagcaagcaaacaaacaaauaagcuaugauacagcugcccccucucccacucucucuguacaaagucaauugaggauuagcagagcagaggggagccacaccucugaccccaggcaggacagcacacagacaaccuccucacagcaggcucacugagcccggguacuugacauaaaaugugcugcaguugguucucugucuggcaccacucaccuggaacauaauugaucccacagucuaugaccacagccccaggcuugauccacucccccuucaccaucucaggcuggccuguggcaaccaccagaaugucuccuuuauuuaccuaaggaggggagggaucuagacuucagaaauuaaauaaucaaaacacgcaaauacacacacaugcaugcauguacacacacacacacacacacacacagagacacaaaaaggaaaaucaugagcugugauauaacaucuuuaauuaucaguaacacuuucagggauacuggguaaggccucaaaugcaaaccagaguuucugcuggcccaaucccaugccauacucaauccuacacaugccagaagcccccuucucuagguauuuucccuaacaggaaaggcaaugagaaccagugagggugaagagagcacagauuuggagccaaacuuaggacaacauuccuagugauggaacccucguuuauggaaggcacuugcucccaccaucaacccaggacaguuugagaauauuaaagaggggguaccaggccuccaucuuguucucugcccgcaggacacagccaugugacauuuuggacucagggauccaacguaaggaucaagaauaagcugcugaagcuaagaauguagcucagugguaaaauucugccuauucuaaggaguucaaccccagucuaacaauaauaaaacaaaggacagcgagagaugcccacuguucaaccucgucuggaguaccuccauccaaggccaacaaccugcccgggagaccuguaaauggcauaauuccacugcuaaacccugucugucacagggcaugcugguguagaaagugcauggucagaaugucagaaagaucuggaucaaugcuggcaagcuugugauuugaauuugucccuuccucuuggacaaugagacaugaagcacagcacaguuacugggguuagagagcuaauguccccacgcgugcacacaggcuggacgucuacgcuacccuggauugccuaccuccuuguccagauuggcagucuuggaguggcagguggucaccguggcauuguuccacagaaggaggucaugcaugggugcaccaacuaucuuacuucgaccaaccaccaccgcgugccuuccggcaaucugcaccccuggaagagaagccagcacacauuagagauggagaagcagcugcccucguucacacaccacccagauggaaaacagcaaaagugcacagaagcagaucgucugcauccgacagaaaucuuccuaagaacgcuccuacgccaagcacagccucagcuccagcuucagccugggaccugcccacuguccuuccuacaguagggcuugggguuccgcuuaggccaagaucuguucauugagucaugagggagugggaagaaauccuacacucaaaaaagaaaccucaacacacagcuaacagccauauggaaguagcuaucagacuaaacuacgcgggcaaaacagucaugaaaacuacggcaucuggaacagggucagggcaaaggagagaaucagauuaguaucaguacgacuccccagauucagugaguuuauucauacaguuucucauccaaaguucugucuggcuuagggccugaacacaggguuaucucccggggagagauaauaggaacugcaaguggcuggaaagccuuucgcugacucagcaccugcacuccuggcacuuugccaacauccccccaccccagugcugaagaccaaacucaaggccucacucacacacgcuaugccugggcucuuccauggaacugccccaggcuugugcuucuuuugagacacuagcuggccuggauugcccugaacauccucucuagagcacaggcaggccuugaggugcuuuuuagaacugaaaccugaauccuacagaggugacaagucucucccucgcccucuggccugugagaugcagcuaugaccgucugucuaacaugagaagagaacagggagaaagcugcacaggguuaccccguuaccaggaggggccugaaaugggccgcccagacagaaaggagcagagugcuccgaaauacucugccuggccacucuacccuggcaaggcugaaaagcuaugaacccuugcuugggauuuaaaccacacuuugaaaaagaaccaacuucaucagaagaccagcacuuagagaaugcuaacaccaugacuacacuagaauugaaguccuugaaguuugaacgaauugacaaguccauugcuggguugaauggauaggucaacuacagaacaacugacaagcaugcuggagccccuggcuuucauucucagcacugcaaaucacccaaucaauugaccaaugacaacuuuacuaauuaagacucagcaaagauuugaagcuaccuuaaggcaacaguagcuugugggacaccaggaagucacggguguaauagcucaugggacucuuuccuauaaagcuguaauaaauauuggcuaaacacacugaagaauauaaauuguaguucugaacuaucacagcugggucaaggcuucuggcuuggccuuugcuggccaaccacagacaacuuucauuacuaacucuggccaaaugccucccuugaaacuucugaccugcuucuuucuaacaggacucguuucugugcaaaaaauaaacucugcuaaaaguauuuauaaggaaacuaaaauacaaagguacuagcuauguacugaaguaauguggggugaauguucacaagauccacuccagccaucugucuaguguuggaaccacaguugacuuggggcugguuccaggggcaggaacccacaacauuacucacuuuguacuggcagaauucucauuggcauuuaggagucccacccccaaaauaaauugcuuugaauauacacaacccuggguucaaaucuugguucugcuaucucuuaggaaacaacucucucuggucuguuuguuugcuucuuuuugcuuucagugcagggggcugaauccuugguuuugaggcaaguucucuugaagccaacaggaaggcaaagcuuccuaagaaagagcuuucuagauacguggcaauacagaggaagugggucguagugguccugauucacaaagaagcucaagaaaaugcugcacugucucuccagcccuguggagugcacaugcuguaguuaaguuuaacuaacagcuaaggaaaucggcgcagagccaguguacuugugaaaacaccugcagucccaggguuuggcaggcagaggcgagucuucacgauuuuccugcugguuucccucacucuuaccugccucuuugaugaguuccaagcaucccuugggugugcaugggaugaagcagucauuuagaucaccucuggcgagcuucccagcacugacgcucgucaaccuaaaacagucaaauuaggaggaaggaguggagccucuguccucuagaaacaaacacgcuaugcuuccagaauagaaucaugcucuaaauaaagccaacggggagcacucacccauccacauccuucucgggugcaauggcauugaugacugccucaguguuaauggaauucucugaaucuaaaggcagcugcacuaugaauccgugcacagaggcauccucguucagggagaugacauauuuuaacaccuaaaaguagugccacaguugauuuguacuaauuaaucacagacacugaaaggaggaaggaaaggcuguaaagaaauauuuucugucugcaaaguguaucucagccccugaagucccaccaaagcaagcagacagggagacaccucgccaugugcauccacacgcucaccucggacucuguggauguucuugguaauuuaaugugaguggcuuugaucccaaucugcagaaauaaacacaagaaacagggaaaugguaugagaaccugagaucugggccugugugaugguuuguaugugcucggcccaaggaguggcacuauuugaagguguggccuuguuggagugggugugucacugugggugugggcuuuaagacccucauccuagcugccugaaagucaguauucugcuagcagcuuucagaugaagauguagaacucucagcuccuccuauaccaugacuaucgggaugcugccaugcucucuccucgaugauaauggacugaacuucugaaccuguaagccagccccaguuaaauguuguucuuauaagaguugccuuggucauggugucuguucacagcaguaaaaccuuaacuaagacagccugccucucugaaggagugugacugaagcaauggaguaucgggugucauuuugcccuguguguggagaaucagcccuuuugucaccaucacauucaacaccauuccgcagccucucaccugccucucagggaagaaaaccaucaaugagaaccacacagggagaaaucagccggcuaggucaccugacucugccuugcccaauaguuaaauuaguuuuguggggagggccacacagggcgaagggguuaccaacgggaccuggggagguagugagaaggaugccagcaucccuguucuuggcuuuaccucuucagcagccuucagcuucacauuuauauaaagauuggaaucaucucugucgccaaccuggaauaauaaauacaugcaaaucagacacuuagggaaaggcaaaguguacagaaaaacuucugcaauuuuaguuuggauaaaacgaacguuugagccgagaacuuuuauggaagacaaaggaggguggggaaggggaaggcuggggugaauauaaguggcuucacucuuuacccuccagcuucgaucagugauccucugacaaugccaaaaggaaaaccaggggcuggaggcaccggcaugaaccuguaaucucaagcuccccgggaggcugaugcagagccugcacuguaaacaaggcuauugacaaggauaacccugguuacaacaaaaaggguaugcagguguugcccagugccugcacuguaaacagggugagaaugcuacagguuuccagaaaugugggaggaguaauagaugaguaauuggaacugagaaauuaucaucagucaaaaagacacuagagaggcagaaguucccaaaggcaccgaccacccagggacaauggaaaaaugcucaccaucagccagacgguagugaaaccaguaagacggggcuacugggcuagcuuaucagaacagacaccauaggaggagcaaaccagcgcccaccugacgggugucagugugggagccuuuguacccuuugaacccugaccccaucacacuguacacacucuuccucauggucauacuugugauucuucauugcauuaaguuaucuguaaaaacuuauuucacaagugccuccccauguguaggucaagaucucucugcaguguuuugcuucucuccguucuguagacggccaagcauccuaaaaccucuggcuggggcccaggaggaacucgaaucuuggagauuaagcugugcuuuucgguccugccuccugcaugcugagccugcaggacguccccagcucuaagggagcugguuauguaaucaaugauagacuagaugcaagaauguuuaaagaacauuagauucuugacuggcagucaagugggugggcgguagacugguuccccagaacacaucuuaaucccaaugauuuaucaagaauguuacuuaagcauuucaucuggaguggcaaucccuuccugcaaagggguggggccucaaaccaucagagagacccaacaagacaaaacuaagcccgauguguaaucacagcauguagaaggcugaggcaggagggagacugauaugaguuugagaucaaccugggucucauguagcccaaaaugggcuagaaucuuuuaugacccuucugccgcugccucccacaugcugggguuauaaacccugguucagggccuuugcaaacacuuuuuauaacagccagacagaguguauguuaaaguuugauuauucuuuucucuuccacacagggucucaagauacgguccuggcuggccaagaacuugcuauguagaccagguuagccuugaacucacacacaucugccugccacugccucuugagcacuuggaucacaagcaugcaccauuacaccauggggcacgcaguuguaaucccugcauuuuugagauggguacagauuucaaggcagucuuggcugcccagcagguucagugccagcaucugcuccauaagaccuugucucaaaaaagccaccagccaaccaacaacaaaacccaaaacacccacuagccaucagcuucuuccucagaaauauggcaggugccacaggaggacugggggcccaggcucgggaaggcucagcuauccaucuuaggggccauggugaggucccaugguucauggagcuaaaacaggacaaugagaggauccccauuuccaagcugggccaucuggucaagaacacgaagaucaagggccuuggugagaucuaccuauucucccugccuaucgaggacucugugaccacugacauucucuuaagagcaucucuaaaggaugcuguucuaaagaucgugcagaugugggcugcaacggucaaguuggacuuaguguuagguccuucgaggagguaaccauauuggccaagauuuucauggucguucugcagagagguuacuguaggaauaaagauuggcaagccccauucccaugaaaggugacaaccauagugguucugugucaccugaggcauuagcaugaucucuguuccugugcccaggaagcuuugauagccaguauugaugacugauacacaccagccaggggcuauucugccacucuggacaacuucaccaaggccgacucuaaaaccauguccaagacuuacagcuacccccaacuucuggaaagagacuguggccaccuugugaaaacucacaccagagcuccuuuagaggauccagacuucugcuauggcuaccacauauauuuuuuauagcagaaaucgaaguaagucugagaagaaaagaaauagaauggaagggagggagagagggagggagaaaaaucuaacaaguauauacuuggaccagaucguguauguucugcaguuugguuuuccagucuggacuuaauucacagcugugcaccucugcccuggcagccccacccuggcugcaggacguccuuuaaaagcaugaugauguaaugagcuugagauccuguagacugcccaccuggcuaaauagaacauucuaaauaugaagagaccguugccaguuaagagccaaagagaccucuggcuaucuuuccaggcuccauuugcuauccaccuucuaucugacuuccucauaaccuuuagauaaaacucuagaaauaagcuugacaaggcuagccuccauuaacccuagaacugaggacaaagauaguaucuaagucgauuuccuugcuuugguguagcccauaaacgugauggcccuaucuauguacuuugcaaacaaguggucugauaacuuucuuuuuggugacuauaaaaguucauguaaccuuuccaugguuccuuucagauccuuugaauccacauuuucugaccuaucacggcuauuuguaauuggaucagaauaaacuauuauucccuuaagaagaguugauuuauauggugacaaaaaaagaaacaagcagguuuuguacccagggcuugaucggggugccaaacucaucccuucugaguggcuuugggcaagccccuaagauguuuuuacuguugugauagcuuuuaucuuauagggguaauuuaacaauuagcacaaucacaaauauauacaguaccuuugaaccagcauaaacacuuaucuacugucaucccucaguaaagagggaguguaguuaugaugagauuuguauuuuaacaagggcuuccugcugaagagagacuugaggggcuaagagcaccgacugcucuuucaaagaaucugggcuggauuuccaguaccugugugguggcucacaaccauccaggggauucaauggucucuucuggccuaugugggcaccagguaugcaguagugcagacauacaugcaggcuuauuuauauacuuaaaaagaauggaaguuuuuagacuagaaacagaaaaccagugagcagucacagggugacccagggugagaagaacagagguauaaagcagggaauagauucaagauccaagacacagauuccauaggucaacagccccaugaaaaggcgacagacagacagacacacacacacacagacacacacacagaggaacagacuggccuugaauucccaguccucucaccuccacugagccagugcugggauugcaagcacguaccacacaggcuuugaagagagauaaccuucuggcaugggugcggaagacaacaaaacuucagagcaaaagacaggaggucuacaccauugucucauugcuuagacacaggcagcagaaacuaauuagacuauaguagauacuugcaaaaucaauaaaugugaagucaauuuuaacaauuauugcuaagaaaaaguuugguuaaaagaacuuaagcuggguaucgugccaggcggcuguuacugcagcccuagggaaguagaaagagaaggaacugaaguucagagccaccuuggcuacauaauggguuaagacccaacagagauacuaagaacccuuuguacacugaaggacagggaagaggaaggaaggaaaaaggaagaaaccacaauucaaagagcuggguuucuuucauuucauaaggcagaggugcuuggggguuuguuuguuuuguugggguauuuuuuguuuuuuuguuuuuuagacagaauaggcugaagaaagcaagaagaaaacucagcuaccauuucaaaguuacuuccucuggaaggaggcagggagggucacaacugacacaucuggggaaacuggccugccggggcaacucggcugcuuuuucucaggucagauaaauaacucagugccaucgaacauuagugcgacugacuccauuuugacgucucagugaacugcuggaccaagcgacguagcuuauuaguucacugaguuacagaagugagucucauucauucucauucucucucucucucucucucucucuccuccuccucuuccucuuucuccuccuccucccccccuuuucuccuuugcaauguugaggauaaacccagagccuggugcauacugggcagguguucugccacugagcuacaccuccagcccagagucacaauucaugccuaaggcaugcaguucuucccacaaaaacaguaagaaugaguuaagaaguaaccaguccccaaauguaccagguagacacccaccacacaaaucuuugguucuuaguuauuggagguuuaaaaaauaaaaauaaaaagcuaccacacacagagcacaccaggcacaaccauaaccuucuguauuucugcucugcuaaggcgauguggauaaacagccgagugggucaggggaggcgguauuuaacuaccacuuguucugaguuuuuugauacauaagggacagagguuuacaaaggauuaaguggcauaugugcagacacgcacagacagaacgugggacaaggaagauggugacucugaagcaaguuucaaaugcaagcuauuucugccacccaaucaauccuucaggcacccaucuggacaucugccuaagcaacuauucgccucccuauuggaugaaucuuuagaucagagagaaaacugcacagaagguaaccaguuugucaauauucccucaugaacccauaauuguagcacuuaaggcugaggcaggaguucaagguaagcuugggcuauauagggagugucuggaugaugauggugguggugccugaggcugaggcaagaguucuagggauauauagcaaguguuugcaugguaaugaugauguuaggcuaugguuggacaggcaguaaauugcugaguagaacugcuuucuguaugagguugugguuuuguguaaaguuauaguauauugguagagacuuugaugauacaguuaugaagcagucaugugugacgacugucccuuugugaaccgcuuugcaaagguuugucauaaggaaugucacuuuaaauucugacaaccuuuacagaguaugauaugauuugucuuuuuuuuuuuuccuuuuuaaaaauuggguuggcuuuuguauuggugguaugaaguaacagugggcaagucugaugguggcagcaagucugaugguggcagcacagaccaaggauaccauaccaaccccacuauucuccauguaucuacccagccauggucccucaggaaagacaaauggcaguuucacuaaggaaugcucuugguagguaacgccaaccauugauguuauuaaacuucaaccugggcgucuuuugaggauuuuauguaaagaauccggagguucccacagcuccccugcugucugugaaggaagcucagugcuauuaauaggcaaagcauuuguguuauuuugccuugccagaugaaccagaugcgcucuuccacagaaaaccaacuuuucucgaaagaaccaacagugauuacucaggcuucaguauuuugcaaauauuuucuaaaacugaacaacugagcuguccuggugcuacacacugccaaucccagcccucaggaggauggggcaaggugauggucacaaguccaaggccguggacugcggccaccaaaucugucucaauaacaaauaaaaaaacccacuaaaaaccaaaacuguugacucuugacuauuccaugucaaccugacacaagcuagagucauuugggaagagggaaccuuaauuaagaaaauggccccaccagacuguucugugggcuagucaguggagcauuuucuuaaugagugauugaugugggagggcccagcucauugcugauggugcaauccuaugggcaggugguucugggguguauaagaaggacggcagagagagggggagggagagagagaauguuaaaaauuaaacuuagagucccuuacauguaggugagugcucuacccccaaucuacagguccagacagguuuuccucgaucagaacagcacauagcaggagaccaauguggaaacagaagagguccagcucuccaagacccacacaguggaaggagaaaugacuccuguagucuuuaugucaacuugacacagcuagaguuacccaaggauggaaacuggauugaggaaaugccuccguaagaucaggcuauaggcaagucugcagggcuuuuuuuuuuuuuuuuuuuuuugguuuuucgagacaggguuucccuuuauagcccuggcuguccuggaacucacucuguagaccaggcuggccucgaacucaggaauccgccugccucugccuccagagucuggcucgcucuuucuuucuuucuuucuuucuuucuuucuuucuuucuugcuugcuugcuugcuugcuugcuugcucuuucuuucuuucuuccuuccuuccuuucuuuuuuuuuuuuuuuuuuuuuuuuuuuggugcagggcauuuuucucugccauauuuuccccuccagauguagcuuuuacaaaguccaacaaguuuacuuugcauucuuuuguacaggguuuugcuguauagccagggcugcccucacacucacauaagccaggcugccagcgguccuccugccucagcaucccaaggguugggauuauacauauacauuauaaugcccauccauuacuuucuuacugugggaggggccagcccuuucuuuauuaguggugccaucccugggcuggugguucuggguucuacagaaaagcaggcugagccagccaugaggagcaggccaguagacagcacccguccauggcgucuacaugagcuccugccuccauuucucaugccagucggugcuccugccuugccuucucccagcaugcacagggcacacagcccuuucccuucgugggguuccgucacagcaacagcaccgcugacuaagacagcuccuggagcuaccuuugaaucccacaggagcgccaggcagggcgcacacgcacacacaccgagucaaugaauguguacgguugggguuuuuuguuguuguugguuuuaaguuuuccgcagguaaugcaugccuucucaccaaauuuuacuauugaaaaguucuaaagcaggcacaguagugcacaccuacagucucaguacucugaaguucaaugucagcuugggguacaaagcagggccugucucaaacacgguucucucuccaugauguuuacuuuaacauaucaagaguuuccauuggcucggcaguucagaggaagaaucgugcucacagcacccacgcuggggaccuggucccuccuccuggacucacuggcuugcugccuucaugugugcacacaccuacacaagggcacacacuuacacagguacuuaaaaauaauuaaauuauaaauaauguauaauucaacauagggaauuucggaccagccaguguugcugaaaauuuuuaauccuaacccaggguuucuacccuaccuuugacccuuuaguuccccaguaaaagccuuuauauuuacaauaauccuuaaacagcacaagagcuggguagauacuacccucuauguuguuagacuccacuuccuaucaauaacuccgaguuauuacuuacuguguuucaagccaggguugcagagugagacccaguccaaaaaaacaaaaaucuuuuaacaagaauuaaugugcuugaaaauaaguaaauacauaaacccaaauuuuauucccaacacaguaaguauucauagcuaaguucuguuuaaaguuuaagaguacaaaagggggauggugagaugguucaguggguaagagcaccgacugcucuuccaaagguacugaguucaaaucccagcaaccacgugguggcucacaaccacccauaaugagaucugauacccucuucuggugcguuugaagacagcuacagugaacuuauucuaauaaauaaaucuuuggaaaaaaaaaaaaaaguacaaaagguccuaagaagaccuagugggcagggcuaacggugcagcucaguggggagagggcuugcccagcaugcagaaagccccauguuccauccccagcaccacacaaagccaggcaagguggcacaugccuacaauccuggaaguugggaggcagaggcagaagacgggaguucaaggucacccuugccuacauagccuaucuccauaucacuggcauauaugagacccuaccuuaaaacaacaaaaaaaggagaaaagcacccaccauacugucauagagcaagauaaaccagcaccgggaagcuggguaccagaaaugggagcccacagugagaagccaugggugugucugagguuucacaaggugggaggcccaggucugaagugcugcagccucuacugcugugaagaggcuagguaagaaugguguuaacgggaauaagaugcuccaauaccugcaggauugccaggccaggggugaagccagguaccugcuccugcauccgaguuaccugguucuucagucgaucccugauuugccuagagggaaagaaaagguggaaggaguuaccacuuacuucauggcaagcguaagugaggcagagcacuggauacaucucuuggaaguuaaaaccaccuucgcugacggacauuaucuaacaagugugugucucauggccuucccaccaacuucccucaacugaccuuagauuguucuguaacuuuuaacgaugaggacugaaccaggcaagugcaggggaagauguuuaaaauaccucaauugggggcugaagacguagcucaacaauuaagagagaaucaccguugcagaagacccagccuagugacuaucaugaucuuaagggccagcaggcaaugguggcucagcuauucaggagggucaaaaauucaaggucugcuugggcuacaagugaguucaaggucacccugggcaacuuaagagagccugucuuaaaauaaaaaauaaaaucaggguguaugggggaaacuucuucaaucccaguauucaacaagaccgaagcaaauuacugggccucugaggccagcuugagcuacauauaaguaucaggcacauuagugcauagcaaagacuauguuucaauaaaaaaaauuuuuuuuaaaucacuguuuuacuccaacuuuuauuucuaguuagugaccuuguuuuuuucaaagcauuacucaacacaagaauaaaguucaaaaaagaauaggccauaguuuuggaguuucuucuguuguugcuacugguuuucaaccggauuugaccuggaccauggaggcagcucugcuguaaaacaagcacagacugccuggcagcugccgguguccacgucccugcgguccccgccuuugcugcuccccaucaaggcaaugagcugugcuauggggacagagcugagggcaagcucugagcucugcugucaaguuccgaggcucgccucuucuucccacucccucuccucuaggcugucaaucaagguacuggagggccgaggucagauaacaggaguacaaagugccuuguguccagcacucuacuggccaagcagggcauggugugaaagccuuuaaccccagcaacugggagguaggagcaagagggucgggagugugggguuaucgccagcuacaugaugaguuugaauccagccugacucaaaaacaaagaugggauaggaaggcagaggggcaugugguaggccaaagcuuauuucaaccuaagcaaaaucauagugugucacuacuagaaagacacaaaaacuggcuggaagagaaggggaagaaggaggaggagaaggagaaggaaaaacaacaguagaacaggugggcacuccugagacaacccccuugucaaguaagaaggcauucuauaugccacucacaaaugaagcacaggcucacaacaggccaguggcuuuccucgagccaaauggcaaaaagaugagcaugugccaggacccugagcaggcaccugcuggccaccuggaaaccgggagugauggccagcacagagacuauuuuauucuggugugaugggaggccaugacaggguuuugaacacagaucacauggucggucggucguacacuguuagaauucauuccgguugcugaacugguaauggagcagggcgcugcaagcugaggcacuagaaagaaaccaccacugcagggcccggccagcacagucgagagcagauuacaguguggcugacaggcuaaccgauuccagacccaucugcaggagucgcauagaagaugucacagcuacguggacucagcuuuggggacugugaaggugauagaaaacuaucagcugggagcaugcugaggcccagagcacauuucaugccaaugcagucaagcuauuuaccggauugucuaagggcaagugggcauuugagaccuacaguuggagucuagggacaaauaaaaauacucagcagguggcaaagcuaugggaagccagcgccauagguggugagccggaaaacacugguuuuacucaguaggccaagacuauaggacagaacguuccagaguuccaugcuaccauuuaaaagaaccuaagcuccaaguuucaugcuaccauuuaaaagaaccuaagcuccaaguuucccuucuagggauaaagagaugcagguuggaagucauuuacauugacuguccuaaucuuuuccuaacaggccgcucucucuucugugaauaagcauguuuucaugucuacagguauucgcauguaugcguggacauuggaggacaacgguagaugucaucuuaagucuacauauuuagacuggcuaacuaaugaagcucagaaaucagggccuugguauagauaacuaucucagccuuacucccagcacuugggaggcagaagcagacagauaauuaagaguuuaaggcaagccugaucuacauaaugagguccaggcuagccaggguuacauagugagacacugucucaaagacaaauagaucaaaguacugugugugcacaccauaguauguauguggucagaggacaacuugcgggggucacuuuuccccucccacgguggagggaggucuugaacuccaaacgucaggcuccguagcaaggcccuucacccacugagccaucucacuguagcaaggcccuucacccacugagccaucucacuagccccuuuccauuucaccauaagcugucuauuucuauugcuuugaggaagagaagguacucugcucuugccuucugggguggcuacuaagaacccuaagauaaagagaaggaggaaagcuaagaauuggcuacagcuggagcaacggacauuaaagggcaaacacagcuucaccugucuucaggaggcuggucucagacgauagucaauuaaaugguaguaauuucuuccaauuuuuauagccccaaauuuccagaagucuaagugcugugacagaaggacuccccaaucacugcagucuucaguugugggagcccccaugccucuccacugccccccacacccagucuuuccacagcccccacgccucuccacugccccccgcccccagucuuuccacagcccccaugccucuccacugucccuggacuagaucuuccauguaaggacuucagagccaagugaagccagaagaagcaaccagaaaaacacaugguccuccaaguacaaauaaucacgccagauucacagcauucuucaccaaccaccuacaaccuagagaagacgucugucagucucuacguaagagcaaucgguauggaagugugcacagaaacugaaaagccagcaaagccagcauagcacucuggaucugauugacggacgccgguagaauaaucacagccaagugaugugauacaagccgugaaaacaaggacucgggauguaguuucaaggugauacugccaucuaguggguaggugucagaagugcaagaaauagaucagacuagauggggugagcucaggaggcagaggcaaguggaucucuaugaguucaaggcuagccugaucuacagaguuccaagauagauggagcuacauaauagagaggcccugucucaaaaacaaacaaacaaacaaacaacaguagucuauaaggcugaagagauggcucagcggguuaagggacaucugacaaccccaauaaccugaauuuaaucccugggacccacgcauagaaggagagaacugacucccugccagguguccccugcccuccaaggcugugucaugacaacaccaagcuccuccccucugcccuccagcaaauaaaaauaaguaguggcagaccaugaacccaccacacacacaaaaucaaauggaauaaaacauuuaauuuuaaaagaauuuauuuauuuuacuuaugugcauggguguuuugccuaaauguagguauguguaccacgugcgugccugguaccugcggaggacagaagagggucauauucuuggaacggaaguuacagaugggugaguuguaagauguauauauacacauaaauaaauauauauguauauguauauacauaugcaugcuaggaaccuaaccuggauccucuggaagaauaggcaggguucuuaacccacugucucaauaaaaacaucuuaauaaauuaaaaaaaaaagguuaacuagcaaguucuaaagcagcagggcggcucaccuguaauccugacacucagaaaacugggggaggagaacuguuauacugauaggucugcuaucuaugaggauagccugggcuacugaaugagagccgaaucccaggcuagaaagauagccuuguagaagaguuugcugccaugacugacaacuucaauuccacccuggggugguggcuugaauagauauggccccacaaauucauguguuugaaugcuuggcccauaggaaaaagcauuuuuaggagguguggccuuguuggaggaagugggucacuguggggacgggcucuaaggucucuaugcucaaauucugcccacuguagaaaugcagucuccucuugguugucuucagaucaagauguagaacucuuggcucucuaacaccauaucugccugcaggcuuccauguuugucucaaacucacauagauccaccugccucugccuccggugugucaggauuaaaggugugagccacuacuaccugacaagaaucgcuuuuaaguuaaaaguuaaaacaaaauugaauauagacacacauggauauacauauacaugagagagacaaacaaacgcacuccaaaaauaaaaugaaucauaaugcuaggugguaguggcacauaccuuuaauuacggcacucagaaagcacaggcaggugggucucugaguucaaggccagccagucuggucuacagugaguuccaggacaagcaggacuacacagagaaacccuguuucaagaaaucaaaaaacuaaauguuuuccuuuguaagaauugccuugguuauggugucucuuacugaguuuuggucuguugcuauguauuguaauacuaacuccuauaccuauaggucuaguuuuguggcgcaaaccuuuuccuuaauuuaaaaacuauugguuaaauaaaaauaguauagccaauuacuggagggaagagagguagguggguuuugaguuaccugguuggggguagcagaaaaaaaggaaaauaagaaagaacaggacgaggaggaagccaccaugagagaugagccauggucaauggccgggagaaacaggaaguaauuggggcauaccacuggggaagucgccaggccagcagcuagaaaaguagauuaggguuuacccccaguaauugucaaagccaaaugaaauaaccauagucugagucucauucauuuguaagcuagacagggacacguuuaaauugguucaacuacagucucaucacaguaaugaaacccucacuaagacgucuggaauccacacaguagaagcagagugagacccuacuucacgacagucagacagacagacagacacuugauucugucucccugccugcuacccuacucaaggaaggagcagaucuccaccuacucagauccaacaagcuccugacuuuaggcauucagcccacagggcugggaauguagcucaguggccaggcuucugcccggcacacacagccccaguuucaacgccaguacugcaagaaugcagaacagaaauugcuaaacucuaagucaucuuucaaagagucaggcauccagauuuuuaaguauaauuacagacaugaauguguugcaauguaaucuaauuuuuuaaaaauaauuucugcaagucaaacaaaacauuuggcuuauaagccacugguuuuguuacaagacagcguuaggagacaagcugggcuggcucugcauacaaagaaccaagaagcugcgaccaacucuaugccaacaggggaaaucgugccagugggucugccagcacagggcgcacaccagauuuagucauuaucucucuauuauauaccagaucuaucauuaucuaaccagaucugguugucagagcugguuauggcgacacagaauagcuacaagucccuuggacuuguccccgggacacugccaccaguaagagacacggaagucuaaaauauaucugcuugaagaaagagcaggagcugguacauaaaaaaacaaacaaauaaacaaaaggggaagccaaacagaucacacaaaccagaauaaaucccuggaagaccugugcucucaucuaagacccucuccuauguaugcucaacacccuuacaguucacccugugccugggcaaauuucaccuccaaagucaguucugcuacucacucaagggccacucagcuugcccuggggccaucccugcugaucccaggcaguuauuuacaaaccacugaggucagagguccaaagcacaggcuauucauccuugguucccagccuccuucucccuaauacugacaggcucacagcuccguccaagcccauaggacacuuugacaaagaauauaacauucauucucauuaacacugagcccacccacagaaaucccuagcucucccuagcacauucuguuacuggacaucugauuuaucaaguacaugcacagguaccuaucggucagcaaacucaaugaggggagagauuugggcuuugaagauguccuggcauagaaaaagcaccaccaagcaagagaauaaauaugcaaaggacacauagcugacucuauucccaggccacacacacccaggcuuguggcagagggcuguaauucuagcugagaagcugaggcaggaggacaucaaguuugggguuuaccuggccuacagaaugaguucaaagcuagccugggcaauuuaacaggaaccaucucaaaaaguaagagagccagauguaguggcgcacaccuuuagucucagcacucagaaggcagagguaagcagaucucugugaguucaaggccagccuagucuacuaggcuagauccaggacagucagggcgacacagagaaacuacauuuugaaaccauccccaccccaaaaaggaaaaaacagccuaaggaaaucauggcucagggguagguuuaaguccuggcuuuaccagggagcggggaggauaggaugucuuuagccuagcaaaaggaaaaguguagacaacuuaccauaaccaagaggcucuauguauacacagcucaagcugaaagaucaccucugggccaggauucccacagcuauggcgcaagcaugcagguacugaaaugacuagcaggcaaacucaccuaccaaauucuuguucacugagaacugucaacaggcacaccagcuccuaggucaaagugacaaggagccaccauaggaguauacugaagggaacugcccagggccagugagguagcucuugcuggacaagccugagagccucaguuugacccuggaacgucccagucaagggaaaaccaacucuacagaguccucuggucuccuccauauacgcaccgugacacaaugcaucagcaccuacauacaagcaaugauaaauaaaauuuaaaaagaaaaugaaacucuuaggguugguugauaucauucaaaaguaaaacacuugccuuacaaggucuuagguuugaaucccaguacccaccaaacaaauaaaaaaaaaauuacaaccauguaguaucacaugccuguaaucccagcauuccagauauggaaggcagcagggucagaaguccaccaagauaucauacacucacuacacaguuaaguucaaagccagcuuggcuauauuaagauccugucucacaaagaaaagagaaaaaggucgucuguaagcacaacagaaacuuuggucuggaaccugggagccagucuucuagcagccuacagauggcgcagaacucucagcuccuccugcaccaugccuaccuggacucugccaugcuaccacuuugaggauaauggacaagacuucuaaccuguaagccagcuucaauuaaauguagcccuuggaagaguugccuuggucauaugaacacacagcaguaaaacccuaagacagaagcugguaccgggagugggguauugcugugcuaggacugaccaggcuuuugcuuggaagaaugugaacuugggaacuuuggauuuagagagcagugaaaugcuuuaaguggggcuuaauaggccauccuaguaggaauaaaguaagacuuuguugcugagggugaucugaacuguggaagucuagcuccagaggucucagaagagaaguggaugagagauuguccuuaugauauuuuuggugaggaauuuggcugcuuuuuggcuuuaucuuaaaagucucccugaggcuaagguaaagaaauuuauauuaauugcaucgacaaaggaaaucucaaaaaaacucagcagagacuuuguuuucugguuaagucucaugaagagcauucugaauaauaagcauagcaagcuuagaaaggaaaaauaaaaaauauauguuaaaaaauauauguuuugaguauuaaagggguaccaggaaguugaaauggagcugaauucuauguucuagaagauaaauacaacagagcaggacuuugggacaagauuucgcccagcuaaguuuagguccaggcaugguggaccacaccuuuaauuccuagcauuuaggaggcguguagaucucugaguucaaggucagucuacagagcaaguuccaggacagccaacccuaggcagugagggaguuggaaaacagaaagcccguaaaagaauaagggaaccauauuccagccccagcaaacagcagaacucagcaacuuugccauguggcucugucuuuagaguccagaauagaaaggacuaccgggacaauauaugcugguuagcuggagcuuaaaaaaugaauggugauuaagagacuagcaucacuaaggugaaaucuucugggaaguauuuucugagagcacaaggaagcuguguuucaaagauagccaagguuguaccuggugaauucacuguauggaggauggcccugaacuccugauccuccugccuccacaucguaaguuuuagacuuacaagcuuaacccaccaugccaagacacaucagaaagaaagaaagaaagaaagaaagaaagaaagaaagaaagaaagaaagaaagaaagaaaaggagagagagagaaagagagagagcaaguaagcaagcuucuauuacauuuauuuccuuuguguguauggcuacauaaauaaauuauuaauauaaacagugaauuaaucagguggcuguauuucuuuauauuaugcuauuccccaauaaccauacagaaaaaauaagauuuauucaaaacugcaccucaauagcuggguaguuaaaccuuuaccuucuaagcuaaucuggccacuccccagccccaucccaugauacuugcacauuauuuuugaucugguucuucagaaccuucuucauggcuccaauuccuccauccuaccagcugaucuaaucucccucucucuuuccucuggcuggcggauguuccaccuuauucucuauucugcccagccauugggugaucagcauugacugacaaggcagagaauaaacccuaagaacuguucacacaaacuugagacaggagauucuuggcauaagcaucacgaugucauguccagguugaaacaagauaugaaagcagaaaaaaaaaaaucagcauuggaauaaccuaaggguaggcauucaaaacauugugccuacagggcuauagaguucagcggacaauuuacaggggucauuucucuccuuucuucauguggaucuuagggaucaaacugagguucucggccuugguggcaagagccuuuagccuucgugguauuucaccaacccucuauccuaccacuuugaauaaggacaaaaaucucaaagcgauucuaauauccaaccaauguugagaaccacuggaauagaucucaagccagcuagcuauggcuuucaaaaagaaaaccaagcaggcguucauguauacaucaauuauagauuauuaauaugucuaauauagcuaauguauacuaaacauucacuaugugccaggaagauuuguaagcguuucucuguuaagaacucacuuagggggcuggugagauggcucagcagguaagagcgcugacugcucuucugaagguccugaguucaaaucccagcaaccacaugguggcucacaacgauccuuaaugagaucugacgcccuuuucuggugugucugaagacagcuacaguguacuuauauauaauaauaaauaaaucuuuuuuaaaaaaacucauuuagguaguuggcaugguggcacagaucuuuaauccugauacuuagaugggagggacaugaggaagauguuugugaguuccagggaagccaggguaauauaaaugcccugucucacaagacuaaaacuaucauuucaguuugcuagaaacccaauaaucuagauauuaauuuuuauuuacaucugaggaaauuacaggacagaaguuaagaaaucugcuuaaagccacacaacuaguaagaagugagaaaguuccuagguauuuuagauauagacauaaacaaagcugcauauauauuucauaucacuuauuuuauuguuuuuguauauggguguuuugucugcguguuuauauaugaacugaguguguuccugguacacagaggccaucacauucccuggaacuggaguuacagauaagcuuccaaaugggugcugggaauugaauucaggaccucaggaagagcagucaccgcucuuaaccacugagccaccucuccagcuacuuuuuaauggagcuuauauuuaauuuccucuccacucaagugaaacacacccauaccaccaauuccucauuaaccaccaagaagaaaaccuaaauuaucucuuuacaaucuaauucgaacacuucaagaaagagcacaguaagaaggugugagcauauauuuacucauauauaguauauucauaaccagaaacugguacuucaguaaucuacauguugaaaaagacucaaagacauaaaacuaauaggcaacuaacacacaucccucagcaccucuucugagggaaaagcaaauuaaaaucacugagauaaaacuucacaucccccccucccaaaaaaaacucacacccaugaggaaguauuaucaaaagggcaaggccaaagguccagcaauuaaaguccuuaccgcgaaaccugacaacccugauuccuauguucaucccucaaugaagagaacuacagguuguccucuggucuccacauguacacaccauucaaacucacuguaauuguguguguauauacacauacauguauauauauggaacaaauagggaagcacagaaaaaaaagaaauccuggugcacuguugguggaaacauaaauucauaugaucacuaaaaauaguagcauggaguugccuuuuaaaaaucagaaauauccuucugugacaaaaaccaaggugaagcaaugagcuauggggucuggcucuaagaucuuacugguacuaguggcuggugggaccuggaucuacaaugccaccucuauugucacagucaacucaacaucaagacugaggaacugaaagaccaguaaaugcuaccguuacuagccuauaguaaauggguuaauuuaugguguuuuguuuuguuuugaaauuagacaggcagggcauggugacucuuaacuuuaaugccagcacuccagaggcaaagacaagcagaucucugacuucgaagccauccuggucugcagagugaguucuaggacagccaagguuacacaagggaaacacuguuucaaacacacacacacacacacacacacacacacacacacacacaccacauuacaugauggggcuggagagacagcucagugguuaagaacacugucugcucuuccaaaagacccagguucaauuaccagcaccccucugacaguucacaauuguuaacuccugcuccagggaaucaaucugacacccucacagagacauacaugcagacaaaacacagauacacuaaaauaaaaaaugguaacuaaaaaauguuacaaaguauccuaugaauauguacagacucuguauccacuuaaaauuuuaaaaaucaaaucagguuuuaaaaauuaaaaacaaggggcuggugagauggcucaguggguaagagcacccgacugcucuuccaaagguccagaguucaaaucccagcaaccacaugguggcucacaaccauccguaacaagaucugacucccucuucuggugugucugaagacagcuacaguguacuuacauauaauaauaaauaaaucuuuaaaaaaaaauuaaaaacaaaauacaauuaccagaacuaacaaucccuuuccuggauaaguaaccaaagaaaauuaaauuauaaccuuguaaagaaaucuguucacuaauaacaauuguagcauuauucacaagagcuaaaauaugggaccaacccaucuagguugugaccuuauuaaugguugcucuuaugacauuacagagucuuuugaagccagggcauugcaggugccaguuccucuaucacugaauagccauggcuucaacagacaaauagagaaagagaauuagacauacuguaaauuauuacuccuuaaaaaaggagaucugucacauggacagaaccagaagacacuaugcugaaaaacaacccugacauugcaagaaaaaugcuacauaauugcauucauugggaaguuaaauccaagcacacagcuagaaauaagacggggcauggcaagaaaccagacuuuucccaaagaauacaaagugggagauauggaagaguggguagaacagaggacuguggguaaucaaagacuacuguauccaggauugugcccaguaaguucaucuuagcaagucuuauaauuuacauuugucacuuuaguaaccauauacauuauuacuaccuauaugcaucccauaauaugugacuaaccuaaaauauacuuaguaaguuuuuuuuaaaaaacauuauuucugugcauguguauguguauaaguguaugccaugccuguccguggguacccagaaggcaucuuucccuuggagcuggaguuacaggcaguugugaauggucugaacagggugcuaagaacugaacugaguuaucuggaagaacaagaugugcucuccuuaaucccugagccaccucuccagccaccacauuaagguuuaagaaaggggaaaaaagcaggcauggugauauaugucuuuaaucccaacacucaggaggcagaggcaaguagaucucuuugaggucaaccuggucuacagugugaguucuaggacagccagggauacacagagaaacccuggcuugaaaaacaagcaaacaaacaaaagucugauguagugguccagaccugugaucucagcccuuggaaguauaagcaagcacugaaucagcaguucaaagccagaaucagauacauuugaguuugaggcaagccuggguuaccuaagacccugucuuuuaaaaaaagaaaaaggaaaaaaaaaaaaagaaagaaagaaagaaaagaacuuguauauauuaugauuucuaguccaaaaaucuggaguucuuccuugccuuagugcaagauucaccauuuaauuuauauuuuuccucuuuuuucgcaaucuucaacaaaagcucucuuuacucuagaguaggcuucaccaucauucucucaaggucucuugugacaaaaccaaguguuuacuggacacuuacugcuagccccagcaguuaauaaauaaccagauaccuaaugucggaaaagcaaccuucagcaaguucacaaaaacagaccuuucucucuccucagcaguccccaacacucacucccuaaacaaaaagcaaggaauguagcccagauguuaugcacacuuucgggcuccacacuuaggggcucaauucccagcccucucucccaaacagcaaaagggugcuacucucugggacgacacuuggcaaacauucccacuaguuaagcauuuaaaucugcacggccagaacagguggucugacggaauauggaauagggucagcacacaagagccaaacugaaaaguaacuuuagcgccaggacggauagguaggcuguuaaaggguagagcaagcgagcgcuggcguaguagcugaguggugcggcgcuugccuugccugugcgauaccuuggaagugaagccggcggggugaaagagaaaaaaagacagcauuugguguaaugaggaaugcgcugaauuagaggaaacccucuaggccaggugugguagcccaagccauuaaucccagcacucaggaggcagaggcaggaggggaucucugugaguucaagaucagcauggucuacagaguaaguugcaggacagccagggcuccguggagagacccuuugucagaaaacaaacaaacaaaaaauuagaaagagacccucucucugauuugaccaaucacccgugucaaaucuugccacaaccgaaucaccaccaaauugccagacaagcggcuaugcuggguuucugagguuggacuccucagguagcccgugucuaggcagaaugaugccagcagcuacacuuuugagaacaaggucaggucaggacuugccgccaaaccuaggaaugcagccaccccaggcagucuauugcaauugcacauugggccgggcauguguuucucuggcuucaggaaaccagucuucagauucuaggagcccgugucgauguccucucuucccgcaaaccccaucuaagcaccucuccugcagagcccaggcgcuuggggaucugcacgcccugcucugagcccaccaccacuaucacuggcaaguacuuacgcagaaaccaguuucccguucaggauucccgcuggugccauggccuuugcuagucugccacccacggugaacaccagcaaaaaucagguuccagucgcuccgcgcgcgcaggacagcacaacccacgugcucagggaccucccgggagaaaucagcuagugcgccugcgucgcgcucagcagcgaaggugcgcaggcgacccggaaagacgucgugacccgcugacagaggaggcccaggagcgucugcgggagccggugggcccaggcagcaagaggguugucaccaaagacugguuggcggcaaugacuggcugcggaaagagccuguguggagcccgccucugaugagccgggagcuucccgccucgcuuuuagccaaucagagauaguguguagggggcgcgguggaacugggcggaguccgggcaggaaugggccugucugagcaaguuugcgugaccuagguugcggcgacagaguccugcaaagcagugugauuuuggaucguacuggcuucuccgggcaggaucuuggaggccuuaagcugauuccggcuacugaccuggagcaggcaaugcggcuuuccacguugucauaggcccuagcuuucagagugugguggggaacaccugggauaacugccucucuguuacccuccuagcaagagugaggcuauccuuaacgaggcaauugugucccucugguuagccaucugcggaggaagcacuccagggaauugcuuuuccaccagccagaguagaaauuuguuuccggggaaagagauuucagagaucaccuugcaggacugaagccaagacaguaauggacagguccacaccucgaccuucacuguucaacucuauaucaagucugacucuuuacuuaaaccucaguuucauauuagaacucagaagauaagacuucucuuugucccucuucccaauguggccguauugaauaaaucuccuuuuucuauaucuua

SEQ ID NO: 6701 - RNA, 19068 nt, Mus musculus
uagacagaaauaugcuguggcagaacacugaucccagggaaugaagcacacaccaguggaauggaaguaagggugagcaugggggggaaaaaagacagccaccaacccugaaagucacuacugaugucuaaggucaggccuguaaggagcgugguugcucgugccuuggcagaaggugggguggugggugggcugugaugucggaauaaugaagagggggaaaacaagagccagugugugccuggacccccuaccacucagaagauggaagcaggaaucacuacaagcuccucaucaacguagcaguuagagggcagccugagcccaagaaaaggggcugggggcacaacggcagacuuucuuccucugagguagagcagacucagagguauauaaacucuaaagcaguuagcccauugugucgcuaggaggaagggccuggguccugaucuagggagcuggcucaacccuacuguaugguacaccaaauggcucaagguugacuuaguggucacuguaggcaacauggugauuaaaaagcgucuagcugggucuucuacucuccaggaagacugaggucugcauguccagucuaugggguugugacucuugaagggccacguggaagagaaacaggaagcaguguccguccacguaacuucccacacgucuggcuccagggcagcgcuggacaggcaaagccuccuuucaggacugccaggguaggggcucagacucccuggcagguccaaccuuuugacuuugcaacauaauauugucuccuauacaguucacacucaagaguuaaaaaaaaaagcccccccuuuuuuuaugacugccuaucuaaccccuuccacaggcuugugcuuggcccuaauugauauuaaaaaaaaacaacaacaacaacaacaacaaaaccaacaaaaaaaaccagugucaaccaguuauuuauaaauccaaauccaauuuucaguguuuugggggaguuuaaggcuuuguggguuucucgcuuagcugcccuugcucacgccacggugugaggauggugacugaagucuaucugagacaggaaugcuggguaggaucagaagaauacagcauuccucgcagaaagggguguccuagguuggcaaagucuagucaggggcaacacggcuaaggacuaccagaggucauggugaggguuaggaaagugccuucacaugguaugcucagggggcccaaggccaaaacuauuucccuaaaggagccuucacuuucucacugaguggacaacaaucucuccaaagagaaccuaccguuucuagugaaccagacauagaagagacaggaagaguggacagugccuauauuuugucucagaaaauauaauagcuuuucauuuaaagugcuuuuuaugucaacauguaacucaguuccaauuucaaauauauuaaauauuaauagcuauaaugcauauaaauaaaaguuuuuucuuaggccuucaauaauuuuuaaguguacaaagaggcuguaaaggccugguaguaaaauuuugucagacauaugcaaagcugcggcuucacuccccagcguaagcugguaguucgaauagguacaagccuucucagacuaauguguuuaaaugcuugaccaugggguguggcgcgauuaggagauguggccuuguuggaggaagugugauccuguggaggcgggcuuugaggucauucaggcucaagcuucaccuaguguggcacacagucuccuucugcugccuguggaucaggaagucggacucucagcuccuucuccagcaccaugucucucugcaugccacugagucccacccacggugguaacagacuaaaccucagaaacuguaagccagccccaauuaacgguuuucguuuaugagagcugcuguggucauggugucucucucuucacagcaauagaacccaaacuaagacagucccccgcuccugaaaacaaagaaaaaaaaauccaaaacacuugagaauugcuauauaagaacaaauguaugccacugcaccaagaaauagauucuauucuguagacaagggaggucuuguucucuaaguuacaauaccgaugccuaaggaacagaaauuuaacccuaaaauaaacaguacaaaaaacuuuacaugaagaaaagauguggagccaggugugcugcuacauuuaaucccagcacucaggaggcagagggaggaggaggaggaggaggaggaggaggaggaggaggaggaggaggaggaagaggaggaggaggaggaggagggcgugagugagccuggucuacagagugaauucuaggacaaccagggcuacacagagaaacccugucucaaaaggcaagcaagcaaacaaacaaacaagaagagaagagaugggaaaauacuuaaguguaauuucuaagcaauaggaguucaggagaauucaccgagugcagguuggagcugauucugggcgagcccacccuuugcccauaccagccagagguccugucauucuccuucauggccuccggcagccacaucgaccuacugcaggcucucagaacccugccagccagcacugcuacucacaagcugaauucugcuuuucagcucagugcuuggcuggcuggcugccagcaucaauauuaagaaggaaaauuggauuuggauuuauaaauaacugguugacacugguuuuuuuuguugguuuuguuguuguuguuguuuuuuaauaucaauagggccaagcacaagccuguggaggggguuagauaggcagucauaaagacaguuugggucuccucaaaaugcugcaagaggaucugucccugaaggugacggagccuguguauggccacccccuggcuuuuggcacccuauccagcaugaggauaaauaagagcaguggaaagcaggcagacccagagauaugucaugaaauuuccuucaagcaccuggaagguuccuaauagccacucucccagucccugguccucaccguggggccacccccgugcaucuuaagggcccugacaguggcaaccagaaccaccacguguggcuggagaccagaauaccggcacuugauguugaagaacuuuuccauuccuaugucugcuccgaauccagcuuccguuacugcaagggagaggagcaacuguaaaccaccagggccacucugugauauaagauaaacucaucauggccgcccacugaggaugcaggagaacucaccuacgaagcccucagggccuaccagcuugagugcaauccggucugcaaugauggaggaauucccgugugcaauguuggcgaaaggcccggcauggacaaacacuggcgugcccuguggagaccaugacgucaugagcaaaugccaaccuggcuucauaauggagccacaggagccaaagggcuaggauuuagcuggaauuugggggggggggggaccuucugggaggaaaaucuccaaaaauuaccacccccuuuccacagcagugccgggaauuaaauccagggccuuuagcaugccaaguaaauucucagccacugaccuacaucuccagccccaaaggcaucuauuuuauuucaguuacacccccucaccucagcuacaguaagaaggaaaguaaggaaagauaugaacaguagaaaagguuucuaugggauagcaagauggcucacuggauaaaggagauugccuugcaagcuuagagaccugaguucaaauuccaaagcccaaguaaaaguaccaggagaaaacccgacuccacgacguuguccacugacaacuucuacaugcaugcuguggcacacacaaugcucccauaacaaacugacuuuggagaaucuuucaaaagaggugucugauucugcaaggaaaggcugcgugauaaucuccuggcuccgaauagaggaggugaacgcuggacccaggagucagccagcucaccucuaaggucugcaugagguugggcuugauugcauccuucaucagcaccgucagcgccccacucacgcccugcaagacaagcccacgaagcaucaacucgugcuagcagaaauccaaucuccugaaaccaaaauucagcacuccggggcuucucauucauuguaaccaucuugcagcaauuagugcuuacaccuaaucucagccauucaucucuauuucuuauuuuuccuugcgguacuaggaagccaccaguuaucuuagcagggagaggaagcagaaugaaaacggcuuucgcauacaauuuucugaaaaagcacguggcgccagaaacaagcgccucaaucaagcucugccacuggcuugggggggcgggggggauccauuuagaccaguucagaguagauacgguacuuccaacagcaacgaguuauuuauaacuuugguaucugagcagaaaugguguauaaaucaaaaucaauguauguuucccaaagcggaagccagaauacuagccagaagucuaauuucaacccccaaauccagcuccuacuuuuaaggcuucuaaucgucgcuaaacaaaaccaguggugaacaccaagcgagaucgagcaacgguucucauuuauguucaacauuaaugcgguucuaaauuuaaggucuggguguuaaaauuuaaaacacauauuaacagugaaaacaaaguuaauauuuuccucccuuuuuaaaaauuugucugccaucacgccagcucuacugguauguguugauacaaagagucguuuacauuuugaucuaaagcaggugagguggcacaugcuuaugaucuguuaguucucaaccugaacguuaugaccccuuggcgaaccucaaucucuaaaaaauaugauucauaacaguaacaaaauuacaguuauaaaauagcaacaaaaaucauuuuaugguugggggccaccgcaaugaaagcaacuguaucaaagggcuguagcauuaggaggauugagaaccaucauuauaaucucagaacucggggguggguggggcuaaacuagauggcuauugauuuggggauagccuggacuauaugggcauaguggcagacacuuuuaauuucaguacuugggaggcagaguggaacucugugacauucaggccagccuaguauacauagccagauauacauauauacauagcguuccaggacagccagacauagagagacccugucuaaagagacaacaacagcaaaacacuaaacaagcaaaugagagagagacucaguuagaagacuauuggccaaacuggccauugaguccuucuaaaccaagugucauggggaggcaaacacuuggggggggacucuagauggucacaugaucuguagucagggcuugcucaggaagacacuugcaggaagaaagcaucauucaagucaccuggcacuuguggccugucauaagagcccaacacuacuaccaucauucgcuaugaagaacgucuaaaaauauaaauuucauaacuuuugcaaucagucaaucaguuaauugcaucauuuugagcagagcauaaucucugcuuuuaacaaucacugaaagaccccgggaugcuagacccucccugccugucacucaccaggucuucgcaacugauaggcuccccuuucuuacuggacgcuaccaccauucugcccagucucucucucaugucuuccagagagcucgugagggccaggacugccaugaucucacuggccacagagauaucaaacugggccugugggcagagagauaaagaagacccuuugugucaaaccaggaggaggaauaucagaggcaucucuuuuggcucagacaaauagcuaacaaggauggauuagaaauaacuaaguaaucuuccaacaguugagaaauuuauaauuguucagaggccuugaauaaucauuuuuucuuaaaagucaguguucuagggauuguagcauuggggcagagcacuugcccagcaugcacaaagcccugaacaccugauccccagcaccucagauaacaggugaggucguacacgcuuauaaucccagcucauggaggagcagaguucaaagucacccucggcuauaauaagcuugaggccagucugagcugcauaagaucacccuuaaaaauaaaaagcuguagcauggccagugagcuaucauuuuaucucugagaaagcagcuuggaauauugguuaguuucccuaacacaaaggggacaaaacagguacucuuacacugaggauauauacagucaaauggccacagaagagaaacaauuuuaauuaauuuauaugcaagaauauucacucgggguucuccaccuccaggagagaaugcuggggaaaaccacacaggugacacauggauuuauugcacaagcugucaggagcgcuccgugccacaccuacucacuuccauuuuaaaagggagaaggcagaacaacaccugccgguguggucguagggaggcgauggaggaggauggaggcagcgagagcuaguucccauggagcaauuacuggagaugaacaguuaccgugcguguguggccuuucucuguuggagacuguccaauugugaucuuccucaggaaucuaucguugguguccaacacuauggcagaaagggagggcaggaacagugcuuaagaaaagguacaugaauaaaggaauggggauauaguucagugguaagguaaagaaagggagggagggagggaggagggagaaacacaggguagauagcacacaccuggaacaccaguacucugagagcugaggcaggacaauaacaaaguuauggcuuuccugggcuagggagcaugacccugucucaaaaauaaauaauuccauagagauguagggcccauaaagcuaaagggaggaacagcauuuaguaugugugcaugcacaugaguauguguguguguguguguguguguguguguguuguuguuguuguuguuguucuuucagagacaagaucucuauuaugaagcucuggcagcccuggaacuuacuauguagaccauacuggccucaaauuuacagagaucccccugucccuaaccuccugaauguugagguugaaggugcgcauuaccauguccacucuagcaacagaguuuuaaaacaacaaaucuugucuaacgauagcuuauuaauacuugauuucagaaauggucuacaaagcuagacuacgguguaagagacacggccacaggccagaaaugcagagagauggcacuuaaagcaaaaggaauuuggaguggauaaacuucguuccuucuaaagaauucaaacaauuaugaaaucuggacucuacuucaaagcacauucuauauuagcagagaaacacagagugacccaguuuaugaaaaagcugagguguggauuguucugugggcgacucgcugaccauacaccccacacaagagccaucaacucagaccaagugcagaugccugcaaagaacucuagcucucaggccuggccucuccuuagcacauucucuggugaugacagacagacuauauacccacuaguauaaccucagguaaccuggacaggccaaccaccagccgccaaaccucgcuccccagggcuccauaccccucacuguuuaguggacuccugcuuuuucuuccccuauguauagaauccaaaaagacauaucuuugcuguggguuuacagaaccaggcucccagagcccuuggaauguuaaggaggugaaguaccccaggaguggcauggucaccagcaaggacaagagucuggagggaugcaacuuucagcucuaucuagagaaacugaucccccacugcacugaggaacagagguaaaguugaagacuuagaauaacaucaucacaccacugcuuguuaucuauuuaguuguguaaaacgaugacuuuucaagcuggcugagacucagggaggaggaugcacacagagcuucuguaggcuccucccuuacuguuucauuuguagcaaaccaauaaacaucaggaaaggaauagcagccagauguggcacuucaugcaaggcugaggaguucaaggucaguguagacuacacaguaagacgcgcucuacaccugaaccccaaacacacacagauacacgcuaaaggaaaugauuagacaauggauuaaauucuccuaacagauggugagcuuccuucuucuaaaaauacugcagcggggucuggagagauggcuccguggcugagggcacucacugcacuugcagaagaccaggguucaguuuuuagcagccacacggcagcucacaaccauucagaguaacuccaguuccagggaucccaugcucgcccagucuccuugggcaccaggcuuggauauggcgcucaugcauguaugcaggaaaacacccauuaaauuaauuaauuaauuaaagaaauuaaaauggggacuggagagguggcucacugguuaauagcacuggcugcucuuccagaggacccagguucaauucccagcacccacauggcaacuugcaacugucuaauuccaguuccaggguaucugaugcccucuucuaguuucuguagacacuauauacacauguuaaaaggacauagaugaacguacucauacacauaaaaaauaaaaaucuaaaaaaaaaauuuuuuuuuaaagaaugguguauuugugguccacagcuguaauucagcauuugggagguggaagcaggaagucagccuuggcuacauagagaaccccaaaccagccugggcuacaugaucaaaacaaacaccaaaaccuccaaaugaacugaacauuaacagucgcugugccaauaaagacaagaaaaaaguugguaaguuggccuucuggugcauucugcaugguuugauggaaauucccucucugcugugauacaaaggagguggacagaaaauaaaaucccaagcuaugcuaauuguacacagagcaaaacaacauauggcccugaagucaggcaaacgucuaaaggcugaaggcuggcaaguguuacaggaggaguuaauaaacgggagaaugauuagcaggauaaagagauccaugaaaaaccaagucaccagugccagagcguucucagaauaaaacgcacacaugauucaagugauuagacaucauuuucccacuucaugacacccaaacuuucugcauaaaauugaaacuuaagaaauguuauuuuugguuaaugcaugaacuccccugaaauccucauuucaaucaacacugaauagacauucagccaaccucacaaagggacaucuacauugcagcuaaggcugacaagcaaaggauaugaccauucuggauaaguauccugacccaggagccuccuggaggagggagagaugggggcuaccaaaguacagggggcgcacagccugggcuggguacauaccucucugccauguuaugguuucugggucaauauccagucuugcaaaucuguuuaucucgucaucugucagcgugguggggucagucuucucaaugccuagccucugaaaagaaaggaaauuaaaacauaaaauaagacaagagccagcccucaggaggcagagguagacagaucucugagcuugaggcagucuggucuacacaguguauuucaagacggccagaccgucucaaccaaaccaaaccaaaccaaaccaaaccaaaccaaaccaaaccaaacccaaacccaaaaccaaaacaacaguauucauccauccauccauccauuccucuguuuccugauuauagaugugacagcuaccaguugcuucaagccccugcugcuucaacuuccccacuaagauggacuguacuuugaacuguaaacuaauauaaucccccaccacaccccccaaaaaagucaaaacagagaagcauacuuuuuuuaaauugaccuuauauugagauagggaaauaaggacuaugauugaaucaugccuguggcacacccuuggaauggcagcgucuuaaauccagaagggaaaacugugaccugagccccuggcuaagccuggagguuguuuccugucccacucgguaugucugcucuguaacugagcuccagagacuucucucaacccagccaaaaacagccccaaccaagaaccaccacaaugcauuucuggauucacuaacuauauugaaaugaaaaagaauaugcacaguuuuaaaaaccagacugagaaacccaagaaacccaacugaagucaaaguuuaggaaaggcaaaauugagcagcaaucaaugaaaaaaaaaucaauuuaaacucuuuuacacgcuuuucuauggcucaauacuuucccuggcuucuuacuguucuaaaaagacauaaaaaagggucuuuauuuuucuccuuacagaaguuagauacuuuuaaauuuuauuuaaugccuguaagggucacuucucgaaauggaaaugcuuaucaaacagugcccuccucaucuucagcagacacgagucaagagccccagcaagacccuuuccucccuuccuuccucucuuuugagacaggguuucucuguguagcccuggcuguccuggaacucacucuguagaccaggcuggccuuccacucagagaucugcccgccucugccuucggagaguugggauuaaaggugugugccaccacugcaugagaccaugagccuaggacucgacacucuucaaagacacccacaagcggcucaguugcccugcuguuggaggugagggucaaucucaacugucaaugucaugaggucuagaaccacuauagcucugucaugauggggucacacucagacuauagcucugucaugaugggguaacacucuaagcacagguuucaggggaggcguaaacaaagcuaaggaauaucaagcugcucgaaagcuagcuaguguguucucagcgggcaacaaaagccaccaacagaaacccagauacaaaaauuaucaacagaguuguaaguagagcaacauguaaacaacauaucuggguaaaggaaccuccaggguuacucuugcagcaucaaaacacagaguugcucagggcaggauagaaggccuggggguuaaaaacucuugcuguucuugcggaggacccagguucagguuccagcacccauauggaggcucacaaauaucuguaacuccaguuccaggggaccagaugcucuuuucuggccuccaagggcacaaggcgguguaacacacacacacacacacacacacacacacacacacaauaaauuaucaaaacaaaacaaacaaaacucccacaaagcuucaggguuuggggauguauguagcucaguaggagcuuaguaagcacgagggccuggguauacuccugaauaccacacaaaaagauaaguugcaaagaauuaaaaauaauugaacagaacuguugauaagcagcacacaccauuucagcaagugcuuauuaugugcauauauaagcacacauaaacgauuuccuuacuucaauagaauuacacacgaauaucccucugcuauuccuuuauaguuaguuacaccgucccuugauccacgacucuuggcauagacuagucugauguccugucucccugaagauaccacagaagcagaagcacagccugugaucuuuuuuuuggacacuggcuucuuugauuagacauaaugccucugagagucaaccaaguugcugugccuuucagcagcucauuucuuuuaauugcacagaugcacggcaauuuguuuaaccauucauccauugaagaacacugaagacuuuucucacuuuggggagauuauuaauagagucauuaaaacauguaugcacagguuuuugugugaaugccaauuuucauuuuucauguaaaauaaaaaucgaagacaggaauuauuaggguauguggugaaaacaugugcucgcuggcuauagagguuuggguagauuauucagaauguaaaucuacuugcuucaaaagcccaaugaccugagauuaguuccucaaaccuagguaaagccagauguggggugcacauccauacccggcacuccuacgcaagauggaaagagacuagagaaugauguucuacauagcagcagaaaccagagagacccugccacaacaaauuggaaauuaaggacugauucccaaaaguuguccucuaaucucuacauaguacugugacccacacgugccuacaguuaauacacauaaauuuuuuuuacauggauauaaauauagaaauucaaauaaaacacaggaguuacuaauacucugauuaagcucgucucauagaagacugaaccaagagauggcccacaaagaacauguccucaagaucccagggcuagggaggccagggacccagaagcugcacaucuccacgaugcugcccucaaucuucacauuagaaagcugcgcccucgcucuucuuagcugaggacuaauugucagcucuaucuacuauacgaucaaucacuauaauuuauaaagaaaugagggaaaccccugccuucaauccuuguuaucuuuaauuaaauuucuuaugguaucaucuaucuaguaggcaaaagcuuacccguaaccugcggauuuggaugucagagaauuuucuuauuccguuuacugaagguaccagacgauuaaagagagccuuaaagaaagagaagaaaagagcuuuagaugaggggguccuacugucauggcaccaaaagaccaauacuaauucagguacccccccccacacccucggcauucuaccuugucugucugggucagcucaugaaauauccgagcaucaauggcagcagccacgagguuguuagcagcagugauggcguggaugucaccagugagguggagguuaaacuacaaaagagcggaagccauagcagucucuagcucugccuuuuccaaccugcagccucccacaaccaacacagucuccacacuaacaccagugggugcuggcugaaguacugcucuuggacaggcucacgagugggcuucuauaugccaaggaggcugaaggaggacugccaccaguucgaggccagacugaucuacacagugaauacugaagaaaaaauaaugcccaguuaucuggccuuugaaacaacucccagugaaggaauuagcaguuuuccauauaagugugcagagagcagagcaccaccccccucacggccaaccuccugccaaggucagaggcugcacaggggcauagacaguuguuccccucuggguccccacacugcuccugaauccccaagccccugaugcuucuggggaccauguggcaugcauguguuugcuuguucaaaaugacuauccccauugaaagguugugccuaaguccaaccuguugucucaagucuacacucaaguccacaaauaaagguuuuuuuuguuuguuuaauauacugcuccugccaagaaacaaguggagugcccacuaaucauucucucucucucucucucucucucucucucucucucuuuaaaucucaucucuggaaaggaaacucuaucacacaggguaggguucagucaaacccugagcgguuuuaccucuuccauaggaaugaccugggaauagccgccuccugcagcgccaccuaggggacagagcaacagcuggaacucagguuaacuugcuucucugugaauuggaacccaaagaccaacaaacccauuuucauaucuacuaagcaaauuguuuguuuacucucuccgucacuuggacagaugugagcagguguuuucuaauuuccuuuaccucacugaaacgcuugaucacguucacgcugaacaggcucucaauugaaaucggagugcaaaugacagaaacaugcacacacacauacauaccuacucauuaucuuuagaagccgguuccccgugauuccuaacauguuagaaacccagaugacagcuacauaaaggcaagcccgaguaacuuccuacucacgaagcuacucuagcuuccagaaaaagaaucucgaagguacacaccgaacagagacaccaacucuucuagaacauaagauagcuaucagaaaacagccgagccucgaaggugcuguagcccauguggucaacaagaggccggucaagauguccaggaugcuguaaggaugccguaaacaucagcacgaaagaacagguuucauuuuugugaggaagacaacgcaaggaggaaaauucaauaugaggaaagagaacacuggguucucgagucggaauaagggacaaggcuucuagagucaaaaggggguuauuacaacaagcuccaaggcggggcacagcggcacauacacacuauuccagcacucgggagguaggaagacggcacacaggucaaccugggcuacacaguguguuccagggcagccugaaauaccugggacgaccucgucucaaagacaaaaggaagcuaacagacagcaagucagagcuggcaggagggaagagguguuccugcugagaacauuaacuacugggacaagcagaagaugaucccuugucagccagcaaacggaaaagccgccucuaagaacauaguauaauuaagaaaaacaguuucaauuaaaagaguauguuuugaaaguagaagcaacgcugucuaggaaaacagagaggagcaaugggagggggaggaggaaagaggagggagggcaugggguggucuggggugcacaacgcacaaauguguaaggagccauuauguggcacagcaccguguacacugaagaugcgcaguggaagcuaagacaacagcagaagcaugucugcguguguguguagcucaggggcugugugugcccagcacgugugauggccuuaauuuaaccucaaccaaugugugcaaaauaaauacacaaugucaauaaauaacaugaaggaaccaaaaagagcagcacuacagaagcacgguggccgaaacaaggagguuaaauacagcgauccaguguccucaccuauucaagugugguauacagaggcugaaaugggcgcgaggcaagagucaccauggcucgccacuuucccagugcugggacccuuucauacaguccuccuuguugcggugacccacagucauaaaauucuuuuaggugcuacuucaaaacuguaauuuugcuacuuaugaaucauaauguaaauaucugauaugugacccuaagggggucgggacccauggguugagaccauugcacuaguggcuggugagaguuaguggguuaaagacacacacugccacgccugacugccaagucucuaggauccauaugaugaaaauagaaaauaaacuuaggagguggugcucugacugccacacauaggcuguggcuugaacuaagucacucacccauuuacucacccacagccaacuaacuaacuaacuaacuaacugacuaacugugugauggagccuuaaccaaaucaccaguaaagucccacugcugcuaucauaaacgguaaugacaugucaugggaggagagaaugacgaaaacacaaagugcuuagcacgguaccuagcagaaagcauucacuaaaugagucagggagacaucgguguggcuggaccauuucaguguaagccuggaccagcagcuaggauuuccuuugcuguuacuaagacaguggaguggauaccggggucaaauaaaagcccuuugaacuccauuuuacacaucccgagauucucugcauaugucaaaaggauagaccugggguaacaacgaaagccuuucucaaaugcaccacaauacaaaugucugaagcaaacauuucagcuaucuaaaccagccaaagcccuccugggugaagacucagucugggaagacuaaaggaaaggcaggggaaggcaggcgccucuggccacaguaccuuuuaucccaaagguggggcccugcgaaggcugucgcacacaugcaaagacguucugucgcaggugggcgccgagggccugcaccagcccgaucguggugguacucuucccuucucccagcgguguuggaguaauucuucaaagaagagagagacaauagaauuaaugucacccaagucacuguacagucuaauaauaaucuaaucuaaacaguaagaacaaggggcuggcaagauggcucaguggucaagggcacuugcuguucuucgaggacugaguucgcgucccagcauccaugugccuaacaagccaucuaagcucacggccaucuguaaguuagccccagguacagccuuccccugaguuucauccagaacucauacagagguggcaagcaagaaccagcucuacaaaacuguccucccaccuccacacuugcaccccugcaugcagacaucauuuacauauacaauaauaauaaauacaacuguaaagaagguuagcucuacucaccacaagacauauaacugacccuugacccugaugucucaugaauuuaagguuuuuuuuuuccaaaaaaaaauugacauuuuuuuuuuugccuacauguccacaacaugcagugccugaggaggccagaagagggcaucaaucagaccccucagggcuggaguuauagacagcuguaggugcugggauucaaacccugguccuccgggaaaagcagccuaggcucuuaaucaucaagccaucucuccagacccaucccccacuuuaaaaaaagauguauuuauuuguuuuuauuuuauguauacaaguguuuuaccugcaugcauguacguguaccacaugcaugccuggugcucucagaagccacgaggcuaccagauccccuggaaccaaucaccucuuuaggagucugugggcacucacacuuauacaugcucuccugaacauaauuuaaaacaaaaauaaaaccuuaaaacaacaaagagaagccaggcgugguggcgcacgccuuuaaucccaggcagaggcaggcggauuucugaguucgaggccagccuggucuacaaagugagugccaggacagccaaggcuacacagagaaacucugucucgaaaaacaaacaaacaaacaaacaaaaaaaaaccaacaaagagacuaagcugacagcucuuccacacaugcgcaaaugccucacuggugauaacagacggcugacugugaagcccgcuggccacagaacacacauacccagucaccacgacauauuucccaucuggcugaugcuucaggcgaucuaaugcugacagcaagacuuuagccuucguuuccccguacaacuccaccucuucggugagcagcccgauuucucgggccagguucccgaugagcuuugguuugcaagaucgugauauagcaaugucacuuuaaaaacacaaggauggguuuagucaccauguuuaauuaaccccacacuaguaacaggcuccuccccucaaucaaugcacacauggacccaugguacccagcaguuaacccugaccagccacaaccuucuaaccgagaacauuucacgccuaccuugggacaggagucuugagguucagcuuguuauacugaauuguccacuucccuggcuuaaauuucuguaggaagcgcugugcgcucucuacugugcucugggcaaagggagaaggacggagagagaaacagcgaauaguuuaacuccacacagcaggucugagccccaggucaccacaguucagaccaacggaauccauccgcaaccccaacacccaccccaccccacccccguguaaacaccucagcuagaagggagagaggaggcaccgagcuccgaggucuuuguuucacccacaccagcagguguaaagccagccagcguguuuguacuucaguucuagaccccaaaggacuuaagggcaccgccuccucuaucaaugugaaggauaccauuguuuggucucucccuccucuuuccuccaacagacucuuaucucagccuaauuucugagugggucuuaguggugucuuuggguaggaaagucucuagaauaauccagaacuuucugcgccauaccugcaucagcauugccacggucaugggccccacgccaccagggacaggcgugauaaagcucgcccucuccuuggccucaucguaggccacaucacccacgacuuuccuuccauuugguuuuguaucaucuggaucaggaaagggagagaaaucaaaguugagucucagaggcacagugacguaaucauagagucucagaggcacggugacguagugauugauuauaagcuuggcuccccaucugcagaggguauuagucccaugaggcuugagugucuauuuaauuaaagcuacuggacaugccagggugcaguucugugguagagcacugguccagcacgagacgggcccuggauucuauuccaauccccagugcuagauagcuggcaggugcuccaccaucuucuagggagaaaauuacauuaucugaaaaaccucaggagaugucuaaguggcaagaacagaaaauuaaaauaauuuagaauaaauuaagaauaaauaaauuuaagaauaaauaaauacuuuuaaaaagggggcuuuucagauuccuuuuauagucccucuggugauaaauaauaaaauacgcuucuuauucuuaaaauguacgaccuuuucaaauguuaauuugccaaggccuacaaaggaauuuuuuuuuuuagguacacaaagcuccaacuaugucacagcugccagauacguuucuacagcaacugucagcaguuacagagcuccaggcaggagccggaggaacaauucaacaucccauuccaaauacugagcaguuucuuaaaugcuugcucaaggcaaagaauauaauuacacuucccuuaaaaggaccagaagcacaaaucucuccagcgaagaacagcuauucaagggaacaaacucagagaugcaccgccgcucacacagagaacauccuacacccugcucuggggcacuuccgggagacgcugagggacaggccuagaccucgaagcauuaaaguuccuggggaggaucugguagaaucuuaggcacauuuccaguucucuucaggcauguugcuaugcugggagaggaagguuuuugauguagccaaaaaauaaaaauaaa

SEQ ID NO: 6702 - RNA, 1143 nt, Mus musculus
cuugcauuuaagacaucacauucaggacugugacauaccagauuaaagagagagcgguuacacaagcaugguugagcauagaaauguuuacagaguucacuccuuggaacauaacaacuucuuaaugaaacgccacagacauauuuaguuuaaguacacuaaaagacacaaguuacauuguaaaaauuucccacaugaacuauuuuuagcacagauaccacaaagaucccugucaaguauucacaggaauccaagguucaguaucaagaauuagccggugcaaacaggcuuuauucgcuguccgcuucgcagcuuguuuuccucccaugauagcaguuauucccuucaguggucagagaaagcgguccaguuuuacuuccaaagaacauuagugaguuccuacggauaauccuuauuccaucucccgucccuauuuauuacuuagauggucuucauccaagaagcaaugggauauuuauuuucuuuguuccuuuucuuauaugaaaauaauggggcuggugagauggcucaguggguaagagcacccgacugcucuuccgaagguccgaaguucaaaucccagcaaccacaugguggcucacaaccauccguaacgagaucugacgcccucuucuggagugucugaggacagcuacaguguacuuacauauaauaaauaaauaaauaaaucuuuaaaaaaaaaaaaaaaaaaagaaaauaauguauuuggagggaaguuuccuuaaugcugaaauagguguauuuuacuuccacuaaugcuaaauccuaucuuccuugaugaacgauacaaacaguucagaagaguaagaacucaaguagcacucccauuucuggcgcauuuucauaaaaacuaauuuucucaacuaauuaucuauuaaguagggcugcaagcauguucuagaaucuaccagauggaauacugaaccgggcuagccguggaaccgcuuccugcuguugguuuccaucagcacacuaaccauuuuagagcaaagccucacaccagcccugcgagguaggugcuguggacaccuccgcuuuacuuggaagagguaaguaaccacuucaaacauucuauacauuaaagagcaacaacacugcuugucaggcagacugcacucacug

SEQ ID NO: 6703 - RNA, 2765 nt, Mus musculus
ugggcggggcuucauuugcauaacggccgccccuuggucucccugcccaaggcuggcgucaagcgccucacccaacuagauaucaguuggaccaccggcuggucacuccgaccaggcaagccugugggagcgccggacggguuggagcgggcgggcccggggaccgauuggcucugagaguuuccagcaggcagggaggaggggacuauaagaaccagaagccccguagaggucuccgggagacgcuagucgcgcucguggagaguugugagaagcgaccguuggcucaggucccggcuugcgcuugccucuccugacgcuuucguccuaacguugcuuugccuguuuuuucagucaggaugucugcccgcggcccggcuaucggcaucgaccugggcaccacuuacucgugcguggggguauuccaacauggcaagguggagaucaucgccaacgaccaggguaaccgcaccacccccagcuacguggccuucacugacaccgagcgucucaucggcgacgccgccaagaaccaaguggccaugaaccccacaaacaccaucuucgacgccaagcggcugaucggacggaaguucgaggacgccacagugcaguccgauaugaagcacuggccguuccgaguggugagcgaaggugggaagcccaaagugcagguggaauauaaaggggagaugaagaccuucuucccugaggagauuucuuccaugguccucacuaagaugaaggagaucgccgaagccuaccuggggggcaaggugcagagcgcagucaucacuguuccugccuauuucaacgacucgcagcgccaggccaccaaggaugcgggcaccaucaccggccucaacguguugcgcaucaucaaugagcccacagcagcggccaucgccuacggccuggauaagaagggcugugcgggcggcgagaagaacgugcucaucuuugaccugggcgggggcaccuucgauguguccauccugaccaucgaggauggcaucuuugaggugaaguccacggccggcgauacccaccuggguggcgaagacuucgacaaccguauggucagccaccuggcggaggaguucaagcgcaaacacaagaaggacauugggcccaacaagcgcgcugugcgccggcugcgcaccgccugcgagcgcgcuaagcgcacccugagcucguccacgcaggccagcauagagaucgacucgcucuacgagggcguggauuucuacacguccaucacccgcgcccgcuucgaggagcucaacgccgaucucuuccgagggacccuggagccgguggaaaaggcgcugcgcgaugccaagcuagacaagggccagauccaggagauagugcuggugggcggcucaacccgcaucccuaagauccagaagcuccugcaagauuucuucaacggcaaggagcugaacaagagcauuaaucccgacgaggcgguggccuacggcgccgcugugcaggcggcuauccucaucggcgacaagucggaaaaugugcaggaucugcuguuacucgacgugacuccauugucgcucggcaucgaaacagcuggcggugucaugaccccacucaucaagagaaacaccacgauccccaccaagcagacgcagaccuucacuaccuacucagacaaccagagcagcgugcuggugcaaguguacgagggcgaacgggccaugaccaaggacaauaaccucuugggcaaguucgaccugacugggauccccccagcaccccguggggucccccagaucgaggucaccuuugacaucgaugccaacggcauccuuaacgucacugcugccgacaagagcaccgguaaagaaaauaaaaucaccauaaccaacgacaagggucggcugagcaaagacgacauugaccggauggugcaggaggcggagcgguacaaaucggaagaugaagcaaaucgcgaucgcguggcagccaaaaaugcgguggaguccuauaccuacaacaucaagcagaccguggaagacgagaaacugaggggcaagauuagcgagcaggacaaaaacaagauccucgacaagugucaggaggugaucaacuggcuugaccgaaaccagauggcagagaaagaugaguacgaacacaagcagaaagagcuugagagagugugcaaccccaucaucagcaaacuuuaccaaggcgguccaggcggcggcggcuccucuggagggcccaccaucgaggaaguggacuaggcuugcgcuggaguccgcguaaaccucuuuuccuuucuuuucuuuuuucuuuuuuuuuuuuuuuccuuuucucccuuuuguuuugguuucuuuuaaauguccuugugccaaguaagaucuauuauuggaagucuuuagccuggugcauacauaugaaaggaaaggugcaacaacuuaguuuaguuauaaaagguuaguucuaaaaguuugauuugggggaaaaaugagguuucucuuuaaugcauuuagagcgauugcugauuuaagcucuuuuuguuguuguuaagcuuacguauguacauggagauuugcuugaaaguagaacccugaugcucgcacaccugaccuguggaagcuugguuacacuaagacacaggaaagcuugaauuguuuauuuuuauguacuaugagaugaaaguaagcacugcagugauauuaaagacagguauauucuguaaacacauaaaugcacauuuaaaguaaagcugaaauugaucucaaaau

SEQ ID NO: 6704 - RNA, 2765 nt, Mus musculus
auuuugagaucaauuucagcuuuacuuuaaaugugcauuuauguguuuacagaauauaccugucuuuaauaucacugcagugcuuacuuucaucucauaguacauaaaaauaaacaauucaagcuuuccugugucuuaguguaaccaagcuuccacaggucaggugugcgagcaucaggguucuacuuucaagcaaaucuccauguacauacguaagcuuaacaacaacaaaaagagcuuaaaucagcaaucgcucuaaaugcauuaaagagaaaccucauuuuucccccaaaucaaacuuuuagaacuaaccuuuuauaacuaaacuaaguuguugcaccuuuccuuucauauguaugcaccaggcuaaagacuuccaauaauagaucuuacuuggcacaaggacauuuaaaagaaaccaaaacaaaagggagaaaaggaaaaaaaaaaaaaaagaaaaaagaaaagaaaggaaaagagguuuacgcggacuccagcgcaagccuaguccacuuccucgauggugggcccuccagaggagccgccgccgccuggaccgccuugguaaaguuugcugaugaugggguugcacacucucucaagcucuuucugcuuguguucguacucaucuuucucugccaucugguuucggucaagccaguugaucaccuccugacacuugucgaggaucuuguuuuuguccugcucgcuaaucuugccccucaguuucucgucuuccacggucugcuugauguuguagguauaggacuccaccgcauuuuuggcugccacgcgaucgcgauuugcuucaucuuccgauuuguaccgcuccgccuccugcaccauccggucaaugucgucuuugcucagccgacccuugucguugguuauggugauuuuauuuucuuuaccggugcucuugucggcagcagugacguuaaggaugccguuggcaucgaugucaaaggugaccucgaucugggggaccccacggggugcuggggggaucccagucaggucgaacuugcccaagagguuauuguccuuggucauggcccguucgcccucguacacuugcaccagcacgcugcucugguugucugaguagguagugaaggucugcgucugcuugguggggaucgugguguuucucuugaugaguggggucaugacaccgccagcuguuucgaugccgagcgacaauggagucacgucgaguaacagcagauccugcacauuuuccgacuugucgccgaugaggauagccgccugcacagcggcgccguaggccaccgccucgucgggauuaaugcucuuguucagcuccuugccguugaagaaaucuugcaggagcuucuggaucuuagggaugcggguugagccgcccaccagcacuaucuccuggaucuggcccuugucuagcuuggcaucgcgcagcgccuuuuccaccggcuccagggucccucggaagagaucggcguugagcuccucgaagcgggcgcgggugauggacguguagaaauccacgcccucguagagcgagucgaucucuaugcuggccugcguggacgagcucagggugcgcuuagcgcgcucgcaggcggugcgcagccggcgcacagcgcgcuuguugggcccaauguccuucuuguguuugcgcuugaacuccuccgccagguggcugaccauacgguugucgaagucuucgccacccagguggguaucgccggccguggacuucaccucaaagaugccauccucgauggucaggauggacacaucgaaggugcccccgcccaggucaaagaugagcacguucuucucgccgcccgcacagcccuucuuauccaggccguaggcgauggccgcugcugugggcucauugaugaugcgcaacacguugaggccggugauggugcccgcauccuugguggccuggcgcugcgagucguugaaauaggcaggaacagugaugacugcgcucugcaccuugccccccagguaggcuucggcgaucuccuucaucuuagugaggaccauggaagaaaucuccucagggaagaaggucuucaucuccccuuuauauuccaccugcacuuugggcuucccaccuucgcucaccacucggaacggccagugcuucauaucggacugcacuguggcguccucgaacuuccguccgaucagccgcuuggcgucgaagaugguguuugugggguucauggccacuugguucuuggcggcgucgccgaugagacgcucggugucagugaaggccacguagcuggggguggugcgguuacccuggucguuggcgaugaucuccaccuugccauguuggaauacccccacgcacgaguaaguggugcccaggucgaugccgauagccgggccgcgggcagacauccugacugaaaaaacaggcaaagcaacguuaggacgaaagcgucaggagaggcaagcgcaagccgggaccugagccaacggucgcuucucacaacucuccacgagcgcgacuagcgucucccggagaccucuacggggcuucugguucuuauaguccccuccucccugccugcuggaaacucucagagccaaucgguccccgggcccgcccgcuccaacccguccggcgcucccacaggcuugccuggucggagugaccagccggugguccaacugauaucuaguugggugaggcgcuugacgccagccuugggcagggagaccaaggggcggccguuaugcaaaugaagccccgccca

SEQ ID NO: 6705 - RNA, 466 nt, Mus musculus
uacucagggucacuggggugacaggacugcagagugggccccuggccugucuaggaauaucggucgaacaccgagccugcgagaggcucuucgcgcccacuugcucacccgauugggguacuccuucuccacacaguccccacacaucgucacgcaguuuucggagaacgaccccagcgacacccggaaggcgaaaccucgcgagaguugagauaucgauuuugucgcacacgaucuaaggacuccacagcuggcuaaaagucuccgcccauagcaacgguuguuaggcggucuccggguaaggagggugcaccgaggacuggacucaaaaaucuucagguauugaaaagaucugaggacucaaagaagugucgaaaagaggaagaggcuuugagccugaaagaacuucuaauaggcgccuucuugaauucugauuaaaaaagaauuacagaaguacagcaaaaag

SEQ ID NO: 6706 - RNA, 3057 nt, Mus musculus
uggcuuccuuuuuuuauuggguucuuauagcaaauacucuuccaaccguuauuccaccccaaucccuuccagcccccuagcacuagguaggagagaaagaagguuagagagaaaggggacauaaaacucuuuagauuacguccaguaccuauggacaauuccagucuuaauugucaaaauaucuaacaauccagcaauagcaaaccagcaguccagcaaguguacagcaagcacagcagcagggguuagcaaggaccagcaggaaccagcagcaggggaguaacggcugccacaagcccccuuggaccucuccagagucccaaaauuaaacuaucugcagcuggcaaaaaucaugucccuaauagugcacaaggcaaaucauaaucaccuguggugaggcagccucuucuuccacaccugggauugaaacaaaagacauauucacauaacuggauuuuuaaagaaaccaaaauucucaauacaguugucuuucuucagguuccuauaggauccaacuagcugucaaaaguggauaaagaauuguaagagauuuagauaauaaaucaucugaucaaugaaauaauuacugacaauuguauaccagauauuacaaaaccucuuugaccuauauaacugggcuuuguuggcaguucuucaagauaaugcaguauugacaguguuugaucuuauuagucauuggaauaagccaaguaguagacaagaaaauuuauaaggauggguaauggugagauugcuuagcuaguaaaauauuugcugccaagccagacagccugaguuccauaccugagacccaccugguggaaggagauaaccaguuccaacaagcugucuucugacuaccacauguauacuguguuaugcugcuccaaauaaauaagcauaauaaaaagaaaaugaauaaaaggauugagugaauuugaagucagggcauugaaucagaacacaauugaugagauuucugaacaagaucaaaauguaaacagcagugcucagagcugaauugcaaaagaagggcauguccaucagggugaagacauccagcuuggaagagaaggagaacagacuuaauaucuucaccugaacauuugauucuuauggcaaaagauauccuaugucuggaagggcaugagccugacaaucccugaaggucucugguacucuugaagcacugcuaggguggauaaauucuaagauggccuagaaaggggccucgagaacacauuuaccucauucuguuccaaaacacucaaaccuccuagagaauugugagcgccccauuaugaagcaguccucagggaggcgaagcuagcucuuguuuuucuguuaucaugagcaagguaguggacuuuuagcagggaaggagcaucuacaagugcuucugaggcuggccagugcagcucaugauaugaaaaaggaauuugugagcuuccuguuuuaugaggccaguguaaaccucgggauaugaauauuuugcaccaugauaacugugaggugggaacuaaguaugaaguauuguuauuaccaggcuuaaaauauguccagcaaauuuauucccuaaaugaaauuuguggcuuauagauuauuuuuacaacuauauuuuauuauuauuauuauuauuauuauuauuaaauuauuuauuuacaugccaaaaguugcccccuuccuggucccuccuccccuaguucuucacuuauacacccugccucugagaggguguucucccauccauccaucuaucuccaugucacccccgccagcauccuucuucccuggggcauaaaguuucuacaggauuaagugcauccucuuacacugaagccauauaaggcagugcacucuuacaccuguuccuggggccgugaaccaguccauguaugcuccuuggcucuuggcuuagucuuugggagcucugaggggucugaguuaauugacauuguuuuucuucuuaugggguuauaauccccuucaacucuuucaguucuuccucuaacucuuccauauugguugcugaucucaauccaaugguuggcuguaaguaucugcauuugucucagucaguuguugguagagccucucagaggacagccaugccgggcuucuuucugcacacacagcauggccucagcaauagugucaggauuugguguguguguaugagaugggucccaaguugggcuggucacugggugaccuuucuuucagucucugcuccauuuuugucccugcauuuccuuuagacaggaacaauucuggguuaaaaauugugaagaugggugggugguccccugccucaccugggggccauaucuaucuacuggauuuggucucuuccaguuccaucuccccauuguugggcauuuuauauuuuuagagaaauaucccuaagcuaccaauacucucugcucuucuuguacccuaagccuaugguugacaaagcuggugucuguuguuggggagggggguaucucuuacucuaaaaacaauugguagaguuguucuuuuuuacauugauugcuuucaguugcuuuugacaauaaacuucuguucuuuucuagaacuucuguucuuuucuagaagaaagggguaaagaacugcaggauauuugccauucucuuguuuuuguuuagaugauacaagcaaugacacaaauauuagaauaacuguauuccggaaaagcauuuugauacuauagggccgggacgaauuuugauuucaucauuacuacugcuguucccuaaaagcuguauugacuuuacaaaguccuuuagggaaaaaucuccaggggcaaaccuguuaucuuuuuagaugggaguaugacuggguuacuacuacauuugcucugugaaaugguagaaaauauugaaucuuaucaugagugcugggcuugaggaagccacaaauuugaaaaacaaacuugacuuuuaagagaaaguauuugagagauucacugguguucaggaagauaacgugaagucucaacuuaccucugaauguuaccauaaugacuaaacccuaaguguaaauaguagaaugcua

SEQ ID NO: 6707 - RNA, 16135 nt, Mus musculus
cgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcucgugaugucauuuucaugucauguaaguguaacugugaauacaugauuucacuguucugcauuuaaauuuccuauuuaauugccaucggcuugcagauuuucuucuuuccuucuguggauuguuuuugacucagugcugaugucucaguuaucauacauguugauaguguacuucuauuucauuuagggcugcuggcuguucuucuauuauuugagaagcccaauuucuucauccauucucugguugauguguagucuggucauuuccaauuuuccagcauuacaaauagugaugcucugacacucauuauuuugucucuguguaaaugcuuggaauuucuuccucaggaguggggcuucugggucguugagcaugggccucuucaagucugguuauuucugaauuguguagcaaaagagcugggaguuucucuucccucggcaugcucauuggugccugguauguuuagacuuuuacauuuuuuuuucagaacuccugauguaaaaugguuuauaauuguuguuuucucuaauccguuucucauuuuauaaccaauucaggaaaauagaaauaaaggucaaauggggcucuugcuuggcucugauuugcuuucuuaggaguaagaagcaugagcauuaggcguaggcuggguugcccagauauuuggaucuuuauuauguaucuuggauguuuaagaugcacaguacccagaacugacagcuaaucuucauaugcuugaaaaaucccucaugguaugucuacugcccaccuagguagacaucagaaaccuggaagccaggacuugggcaguguuuaugaucuaacaggcagauguacccacaaacaugugugugauuuaauggaugaaugcuauguagguucuaggcugauaaauagguggagaggugcccugauuuugcagucuacagugguggcucugccuaguauguuguccucagccauacucaguugcgauccugucuucccugcagaaguucaucaggagguacaguugugcauagguuggauagcagaauuuaugauuugaugcugugaggacuagcagaguugauuucuggugucuaccuagcuggacaggggggauuuucaagcauaggaaguuguuuggcaacauaagguacugugcaucucaaauagugcaagguguagugggaaacacuccacuauucgggaauggaaucccacuuuucugucccucugugugcacucgaguaaauccuguugucugugaucaagaaugccuucauugcucuuaauuucuauuugcugaugcuuuguguaacuaucuugaacccucucucaagcacucugcaguacuggacauuacuaccagucuagcuuuagaaugagaacacccagacaccaaagaguaauucacccaaggacuuggcaagaggugcuggcaccccagcauuagccugccgcagagccuauuaggugagaccuacuuucuuccaccucuugaugcucaccuguccaucaucagacaucugucugucugucugucuauucauccaucuauccguuuuuccuucuuuccuuccuuccaccaucuaucuaucuaucuaucuaucuauagcacuuuucacauuuugaaguugucuauuuacuuccuguuguucacaagaagugcauccauuacauagaaagcaaagacauuccucauucuccauugcaucucuagucccaagcagagcugacacacugagagggcaugcuagugaacaggauucuauaccauggcuuuuauagggggagauaaccagacuagacuccaaccugcuugacaauguuucucaugcauguuuuauucaguaguugcacacuaugacaucucaggccucaggagcugaagcucuauccaaugcauacuuuucugaaauuccuugaaaauuuaaaaucuuuccaauaccgaaucaaguaugcuucaacaucuaugcccuggguccacaugaccauagaaguuccagggggucucuagguaaaugaugagccccugucagaggcagucaggaaccaagugaagagaugcacccccaccacucacugccugucuucugcaguauggcuuuguuacuggaaccugauagccucagaucuucacugaugagagggccaauugccuuugugaaguaccuggaaggugucugucacucagcagcuauucuauuucuaucuauucuuuucagcuuagaucuccccacuuacauccuuucccuucgauccucccuuuuguguucucucuacucuuucaaugauugcugugguuauuaaaaaaaaaaucaacaccaaacuuaauggccuuuguacuucuuugguuuuucuucuuuuuguggaguguuuaugcgugcauauguuugugcucacauccuuguagcuauguuuauguauauaucaucuacauauauguguauauauagagagaccaauguagauguugggagucuuucuuagucacucuccaccuuguucauuaaagcagggucucucaguugaauccagaguuuacccauaaugcuagucuacagcuugcucugaggauugccugucuccacuuuuuaagugcuggaguuacaggcaggccgccaugcuuucugcagcaguugcuggggcgcuggggaucugaacuccagucaccaugccuacgcagcaagcacuuuagcugcugaaccaucuccccagcuucaaggauagcuguugauuuccagaauuagcaggauuguaaaacccacucuggcccccuccuccacucacaugguuaaaucuggaugcuggaacaaauguaauggguagagagaacuuuaaagaggugccacaaaaggcaaagaaauucugacugcaucugugggugcuuuaguuucucucagacucuuacauguauacaguugucucccauaucuauguuuuuguguggguacauuggacaaggggacagucacauucugcauagggcaaagcuggccaggcugucuagagcuuucucugaggugcucacagcuauacaauuucaacucauggaucacuauuucuguauuccuauuuuuugauauuuucagccugcagaucacuagucaaggaaugcaagauaucagguaggaguugcuacgucaguuccuggugugagugaagaagcaagaguguguggaauuagccagacagucauaaauccaauucuacuccaucuacuagcucuggccuugggaaaauugcuaaguuuaaccucuuuaacaaccauuuuccucauuuguaaacaacccuaugggguauuguacaguuuagagauaauguauguaaaucacucacagagcauauacuuacuguucuuaucauggccaggucagggccuagcuucacugugcuccccauuucugguucacuucccuaacacacacacacacacacacacacaaacacacacacacacacacacacauacauuugaacacaaauauagaucuaaaugcccauauauaucacauauauaaauaacacacuacucauacacagaucauaugcagcacauaagacacagcacacacacauguacauacaaacaugcaauuuugcaucacuccaugcaaacacccuauauauguacugcacacacaggcacauguacacacagcauucauagcacaauacuccauacccauuguaggcuccauucccauccacucauuuggcuugcugagauaagaaucucuucuaugauuugaacauauugaagacccauuugauuucacugagagaaaaaagggaugcaauuuggccauucuaccugacagcaaaggagaaaaagaacaacgcuugguucagaaaacaguauaagaagagaauaacagcaucuacugagcuuguuuaguuucagguaaugcacacacucuuggggaacccuaagaguugggguuugaggugcuucgucucuucuuugcagagaacagggcuggcucuuugucuuacauaggcauaauaccagaggugaugagagucucaauagcaccaucaccuuaaaauaguaucaauugcuucuguccuccuuggagugugugauuguggaacauuucuugggacaugucaaaaccaacauccagcugcucucaugagcauuagcaacauagcaacuuguuuaggcucacauuggauuauguguucagaccccauucacuaacuagacaacaagaacaauacaucuaaaggucuauugcaugucacauaggacacuccuuuggcaggaugaccuggaacaugcccuuuucugaggaguaaauuugauuucguaagcacucacugcuggccuucauaucguugcucaccaacucacaggaguuagguguugcuguccuucccauuucacagaugacaaaacugagccaaauaaccugcuuaggggaaugcuggugaguagcagccggguuucaaagccaggcagcucugucucccacauacuaagcuaaaugggaugucuucuagaacaucaagaagaaggucaaaggcacaauauuaggagcaauaagccuucccugugggagaaugggccauguuuccauuagugcugaugugggauagauaugcuugcaccuugaaugaagcagagaaccagugguggacaugaucuggguugggucuugugaugguuuggccuccauaaagucauguguuugaaugccugcccgacagggaauggcacuauuaggagguauggccuuguuggaguaggugugaucuuguuagaaugggugugucauuaugggggugggcuugucugcuccuauguuuaagcuugacccaguguagaauuccuggcugccuuuggaucaagauguagaacucucagcuccuccagcaccaagucugucugcaugcugccaugcuuccuaccaugaugauaauggacuaauccucugaaacuguaauccagacccaauuaaaucuuugccucuauaagaguugccuuggucaugugccucuucgugacaauaaaacucuaugacaggccuuaucucugcucucauuuccagcacuguauacuuggaauggagauggaguaagaccacuucugccauauuagauguuuaaccuugacccuugaacacucagugccaaagugugccucagucacuguggcugucuccuggacucaucaccugaacaucuuccugcucugcuugagaacuaaaagagucuuguagaagccuggcaugcuagaguuugaagggcgugggaugguuuugaaggggcugaauccuuuaggagaugggggagguuuccauugucaagaggaugacaaucaaaggaggagaaggagggauacacuggggaccaggaggaaggugguauacagcaggggguggggcgugagaaacuccauccugggagccucugcugaguaggccauccucuagcgagcuucugcuuccugauacugcucugcucuggaucugaccuguaugagguggacuggggagacgucuuucaccuuauggcaggggcccccucuucagcucugugacucuuucauggucuaaauacccccuugaaaaacacggacacuguagcuauggauauaacauugacauaagauuuuuggaggauaguccauucagugauaaacucaguaggugucacacuuucccauagccuacagcucuggguuaguagaacagcuauuauugguaaaaauguccuggagagaugggggugggaggagggagggagggagggagggagggagggagggagggagggagggagaaagagagagacagagagagagagagagagagagagagagagagagaacacaaguaaaggagggagggaagugcagaauuaguuguagccucacugucuguguuaguucuauaucucuauaacaaaaagccugagauaucaauuuauaaauagaagagguuuacuugggccacaguucuggauaucccagugcacaacaugcuagcucugcccuuugggcccguggaagguaucacgcaguguggcacauguggacucaggugaccagagcacucgcuucuucccugauguugucccugguucugucuuuuguucucugcaaucuaaucucaacauggcugucagaggaguccucucaaaauucaacucagagcaugccucuuauacuuaagcucucagcucaaaacccuccggcgguuucucacuuuguucauagcaacagcuaauaucuucauaauggcguggcacagccuguacuuucugcugugacuacuuuuuugaccucacauucuuuucuauccuccugggccauucugccccaucacugucccggcucucaaauccuuggcugucuccugcucccguuccuguuuucaacaugcccucuucugcugcuuggcucucucccuccccuuaaaaaagccuuugccaugaucaucucaguagugagacucucccuggccacuuugaaauagcaaacagcgcuucucugaucccaaugccacuuagccgucucauguccccuuuugaucacagcgguugcuacugcgccuaacaaaccagaucacauacuuacccagugauauuuuucuucuucaaggaccgaaacuccauggcagcaguggagauuuuugucugauguguucacagguguauucuugcugcuuagaacagcgcuaguaagagcuguguaagcaucucacucacaaccgcaacaaacuuacccagauugccuguaggucagugcuucucuaccucccuaaugcugggacccuuuaauacaguuccucgaguugugcugacccccaaccaugaaauuauuucccugcuacuuuauaacuguacuuuugcuauggcuagaauucauaauguaaauaucugauaggcuggauaucugauaggagaccccugugaaagagucaguuggccugcaaaggggucucaacccagagguugagaaacacugccauagggcauuuuucuugauucaugauuggaaugaaggacccagcucucuguggguggugccacccuugggcaggugaguaacauuguugccuugaguggagagcaaugaccugagaucuaacugacaugcuuucuaaggauucuugugucuuguuugggagucuuuaaguguggaaucccuuguauaguccccgauccaccaaccugaguuuuagcaguuagcaggagaaaccccuaagauagccugagcuccugggauaucucaggucuuuugcuuaagcucugaccagcuugguccagaaaaccauaacauuccaucccucaguggaccucugguguguaggccucauuucccuagagucugucucugaucuuauuuucuugagccuaaguuugaggccagagugggaggagacuuggaagaagagggagugagcaccuuugaggaugccgagacaagauuuggugggggagccacaagauuucuucgaagcuagggaugaaaauuguuuucgguuaguuuaaaggaauugaggcagaggagccaguggagagacaaaagaugacccacaaaugcuaaaaguuagaaucucucaguagguuagggauucuuuaaaauuauaacaagcuuucagcacuuauucuguuugcuggccucaaaggaacacggaaagcaaagagcaagaauaggcuccaaggcaggucaugaagucuaaugcagcugucgccugggcuguguucagcuuccaucugauucugagauccugcucaaugcaggaggucgccuuugggcuuucaacacugcaggggaugauuuaaaucuaaauaauaauaaaaagcuacugcuuuuuauuggacuuuuauuuuguaaguggauggaaacauuucauauccacauuagguuuugaaacccaaucuagggacuugcugagucccagaggggucguucagcugccugggaguucccugauauuugaaucuuuccuccaaggcagaagggaaagugcuuucagggaagccaugauaacauuuuuuuauuugaaagaauucacacuccaagagaggcacacacguucacagguacaugugcacacacagucuuuuauacuagauauucuguaaaauuacagaguuguagauuggaaggggccccggagauuaucuagucuaauguugggauacuucagaugaagacccuucugcuacauggguuaaguaccuuaggcaaggucacaggcaucuagugggagagagcuggcuacaauucagcuuccucgacucaggucuaauuuucuuucugcuacaccacauugccuuccaaauaagauaauguauaugaaaucacuuugaaaacuagaaugcauuacacaaguauugggcauggugagagagagagagagagaaaaaaugauaaugagcuagcuuucuucggaggcaagugugaccugcucgggucucuuucugaauaaagaauauucauguuucaugaacccuauuucuaauuauguuucugcauauggccuccagaaaaugagcaucagaggugccaaaccaaaauacauucuucauucaaguacaucggugaacaguugacccuccauuuuugaaggcuuugcauccaugcaugcaaccaaccaugaacugaaaauauuaaaaaaagaaauuuaacccauauugaauauggauagguuuuccccugucauuauuucuuaaccaaugcaauaaagguuuacauuaugguagguauuauaaguaaucuaguggugauugaaaauauacaggaagcuguguggagcaaauccuguaacauuuuauuaucagggacuugacacccacagauuuggguaucuauagagagacccagagccaaacucccccauacccagagaaugaacucccccccucucuguccaccucucucuagugucugcuguuaguuauugcauauagaccaacaggccacagcaucccagaugcacacagucauacuaugucauaugucuaaaugagcuggucuaguucuugauaucagcuccuguuaucaaggucaauuaauauguuuuccacaccaagaauaacugacuaauagaaaggauauuguuuuaaaaagccuuuaauauaguuuugugaugugaaugguaauguucaaaguuugguuauuaaauugguuuucguagauuugaagcacauaaaauugcuuaaaacuaauugaaauguuuuaauuacaaaaagauauacucucuuagagguagaagggcuauucauuuaauuaacaaaugauucaucaaaagaauaaauugcuacuuaagauacugccgauuauuaaauauuauugcaaauuacuugaggaauuaaaauuuuauuuuugcacuauuaauagacuaauuuacuaaaucaaauauuaauuaugaauaauuuaaaaguaguucuauguugcuuucucuggugagugugugugcauuaguccuuauccauuguaaugucuguguuuucuagaaggaacaugacagacauucacuaucccagucuaugguuaugacaacaugugaaauauuggugagaaaacccaugccucgcaguuuggaggcucucugguaguccuggcuaaaguacucuggauggauuaaaaugggcugugaugagucugugggcacuagguuuuauuucuuauucauucacauguuagcaagugggagccuccuuguucccaguccucucugugacaagucagcucucuccucccuacuugacccuucaccuauccuccacaguccucauugucuagacacaucuacccaauacacauacauacacacagacacacacacacacagacacacacagacacacacagagacacacagacacacacagacacacacacagacacacacagagacacacagacacacacacagacacacacacagagacacauacacacacacagacacacacagacacacacaggcacacacacacacacacacacacacacacagccucacagccauccuggaguucuuggagaaggggacauauacuagggcuggcugcauuugcugcuucauugcguggcucagcaggacagacuuuccuguaggcugugucuuuugcagauaacucuuuuuaaaaagaaacuaucaaauaacagaggaguggaaauccaguugcaaauaaaacuguuugcaguuuuaagucuaaagcaaaugcuauuuuaauacuuggacauggugugcuguacugcuaggagaaaugaccagguucaugaccucaaggguagaccaguacugcucuuaugcuggagaucuggguggccuucgcuucauugccuuccuguuuccugcaucgucuucuaauggcagaccucuucccugccaauguaauggaccuauggcccagaagagaccaucacaaccucuuagaucuaguuccaagaggaguucggagacagacacagcauaacaaacagaacuucucugaaguggucuccuuugugagcuguaaggggaaaggacucuggcagucaaggaagcagccuagcaggcugugaaagcugaggggcaagccuaccugcgacagaugcagggaugcaggacuaaggaugcccugaugcuuuucagcagcuuaagauuuucucucugguauaagaaccucagauaacagaaaugacucucgggguuugggugggaagaugcccuacugaaacagugguuacaaggacagaaauucuaucuuuaauuagcuucaguacaaagccaaguguuggcucccagaacaacgugaagagccuuucccuuagacuccccuagacucagacauucagauggcaucuuuagaaucccauuucccucugacccacugcuuugcuuugcagaauuaaucugguucuccaguggcguucuguucauguggcaaauaucugcugcugccugcuccauccacccagggagcuucaggcuugcuucuuaguuuucacaacguagaaagaucccucccaucaucaucaucaccaccaucaucaaaaugccuccccccacacacacacauacacacacauacacacacacucaccaccuccugaaaucgggugaccaauuuagguucaggcacuucccuuggugacauggaagacugagcuacguccaaagcauagcauuguuaccauggaucuggaaggagaccccuuucuggaugacacagaagauggagugcuauggcuguuacagaugaaguguggggcacggaaaugggaaaugcagaugaagaagcagaugugcccggaugggacuucagguacucccagcaggaagccucauggucucaucugggaaggcuggauucaggcgucugacccacuccugugcaaacaccagggcaauggccgacuaaacaguuggguaguggugauguccuagaaggaacaggcacaggcagccuguaugcuguaccacacagggcaggacuagcaacggggacagcaggagaaccacccugcauguacugagcacacaugaaauccucccucagaccagcuguuucucuuuucuguuuacuguacuggguugcucucucccuuggcuugaccaucaugagcagggagggaaagagggaugaguuguggacacuuugccaggauucucuuuacauggcacaggugugacggcuaccaggugucaccugggccucagacuggucagguguggaaaacagggcuguuaacaaaugcuaauggccucagccuaugcagcuaacuggaguguguucauucauucugggaacucucugggauuucucucugccacucucuguccugggacgacagugcuggacgugucaggaugacaucuucggggaaccggcuaucauuuuugcacuagcucccucccuucacacagaaaugguuagcaagaaauuccaggcuuagaaauggguuagaggguaaggggaugccuggcuucggaaaagguuguggguuuggggagacuguguagauaacuucacccuccuucacuaggggcuuucugauccuagggcccuaaagcaaaaagggauucagaggcaggucuaguuagcuguggaaguccuuggcaaggccauaaauccaucucagcugagaaaacuguuuacuuacagagccaaaccaagcaagucggcccuuaauagacuagagcuggcuggcugcucccauuccugaauuugguccuauccucaaaauacugauuuaaggcucuuuugauuucccacaguccucucaaacuggaugagguggaggcuuaaccuugacuuuaugugggaaaagccagagggagugggaagaggacagaucuugguggcaugguacuggcuucagauaccaucuuccuguagagcagugguucucaaccuuccgaaugcugcaacccuuaauaugguuccucagguugaccccaaucauaaggcuauuuucauugcuacuucacaacuguaauuuuguuacuguuaugaaucauaagguaaaucucuauguuguccaauggucuuaggugacucuggugaaagggauauuugacccccuccaaaggguucgccacccacagguugagaaccaaugguguaaagaaccuagggugcaggauguggcccugggacuuagagaugaagagcugguaucuccugcagguaugacagugugcaaggcccauuggugugcucuggggacacacaaugacagcacauagcaagagucgccaaaggcauguagaacgucucuccucccugggauagaagcucccagcucaggacuuggggcuaagaaucacggcuagaguucagaagaugcugcucccaggcuaguccucagcagagcuagaggggagcucgacuuccauuuucaggauggaaagagaaaaauugccuaauaaaucacucagcacucacugacagccugcugggaggggcacgaaggaaggacuugagagagacgcuggagcugaaauguguccacuaauucuguuagaccacggauucuuuagacaccucugcccagacccagcuagggcccacccaaguagguaggggaaggagggagggggggaagggcagaauggaggcuggcagggcgcaagagagugggauuucacucaaugugcagggcagaauucugaauacugugagccccaggugucgcuuguguugcccuguauacucaggucugggaccccgaauccauugaauagcacaugcagaaagagccagcacacuuugacaugguucuagcaacaacuuaaucugccuuuaaacucccgcuuuccaguggcgagaagucagaacagguugagaguuggcuccccucgccccaucuugggaacuuggggaaaugagaagcaugagugccuguuacugugucuuuaagucuacgguggaggaaacuuguggucacugcuucuguuaccugucaggucuuggcugaagccacaugucgcuaggcacucuguuuguuccuaacagucugcaggugguauugugguggagaagccacugauccugggugcugugugugagggaguccucaccacucacagguauggucagcucuuccucucuggucuuaagacucccaccgcuuuuugaaacgagcucuucccuuccagucuucccuggguguccuacucuuccaggugggcaagugcuuuuuccugggcacuugcaacuucuggcuguagcuccaaacuaaagugccaagaaaacucuccugaggugaaggaucccagauaccccaaacaaagaccucuugggauaggaaaggggcaugcaccucucauuuucucaguccccugaagccaaacugaggcaaauuauuuucccagucagcaauucagguuugguagagguggcuccuuuuguaucuacauaguuccauagaagcaaagaagcccagagacgugaggucaguggccugagcaccuuugcugcucucauacccuuuacuucaucaucaucaucaucacuaaugcaugaacaugcauacacuaaugcauguacacacacacacacacacacacacacacagagagagagagagagagagagagagagagagagaaaggggagggauacuccccaguauagaaccauugagcucuguguugaccugcuaagcugguagcgauaauuuauuugaaaauaacuaaaucuucccugcaaauccauguugucuguacuuguuccugcuccugucaccacuauuaucagaacugccaaucacaucagaaaucagggagggacgugccaauuuaggucauugcccgccucucccuggaggaccaugugaguccuccccaucuuugcuaggacuggucucuagaggucccugacucgaaguccugucacucccuggggaggauggcuagaucucaucacgaggacaagcuuuccuuuauuauccuucuccaacuuucuuuucuaaaugucauccuagcaaucauuaaucagugaauaagaaguuauaauuaauagaggcccggaucguucaaguggaagauuauucuuuugaauucuuguauuuuucuuggaagauguccucgaguuaauuauuuaguauuuggauuuuauuuuauuuuuucgagcuccagucuuguaucugaaaugaacaaauugaucacagccaugugggggaugaggggaugaugucuaaauguuugcaggagacuggugugaggaaucuaagcagggcugggagcucugcugcucccucugcugguauuaaagauuggaagcaaacaagccgccagccucagagcuguccaagcccuaggaaagcucuggggugcucagggcacacccaacagagaccagagccugcaggucagauuucaggaugacuggcugagaguggaggacccuggugagcaaauuagcaaggagaagguagcacagggcuggauuugguggcugcagggucccugagaccugucaccauuucuuucagaugaagccaucuuauguuuccaugcauauuggaaacacagaccauuucaaguucuacacugagcuagaggaagacauuguucaaaugugagacgcaggagagugcagauuugagaccaugcagaguccucggauggaaaguuaaacgggaagagugagugggagugucuccagagguacuggccuugccuguaucacgcagacugccucucucuugcugguauaaggaucauauucccaaguacaguucauauuuauaccccgauucccuuguugcacucgcugguaucaguuguuuuuaaagaggacaccacuguguauuuuuccccuggcucagcaacuuccggaggaguucuguuaugccaccgcucucugugugguuccguucauaucuuuuuggcauuagguuacaaugccuggaccacauuccugcugaccucaguucacuggucuuggggaugcccugcgucgacaucugaaacggcagcagggcucuaugaaggggaggcugggcagcuccaggggaaguccugagcuaugcagggaugaggaugaaguggcaaugcugaaaucccuguuugggggccugaaagucauucauuuauucacuaccccaccagacaaugacaguuguuuaucugccccuguaggagcaauacacuacaagaugagccuaugccuuuuaaggacaaauauuucauaguuagaggucuuuucacauugcggucaauugcuggcuaaaguggacucgauucucuucuuguauccgauuuuauuuuuauauugucuuugcaguuuccuccccuuagagacgacucugcccuugaauguccgauguucuucugaccaguaacaauggcaggaauaaugacacgcaguuuggccaucaguaacugagcacuucaggacccagcagaaagucacccugugucggaagaacagagguuacuuggaguaguagccauccuucccugaugguuaccuuccuaccugcugugcucuagucag

SEQ ID NO: 6708 - RNA, 1655 nt, Mus musculus
cucugggaagaacccuccuagcaucacugcccugugcucuggucccuggggauguuauaauuaauauauuuuauauaaauacacagaagaauagaaaauauaaaaucugagaaguugagggaaagugaggaacuuggggagaagauggggcugcagaccuugcucaggccaacuugaucucuucuuuaaccccuuuggcuucuggcuucuccuccuugguuuucuccucuucugugacuucuuuuuucucuucaggaacuuucucuuucucaugcucuguuuuaacucuuuuggcauuuuugaaguuagaagaguucuugcgaccaccuucucccuccucaucugagucugagaacucuuccucagagguaaugcguuugucagaggagcagauggagaugcguuugucagggucuuccucauccucauccccacucucuucugggauggaauccucugguauggccugcaucuggaccccaggggcauggggaagcauccucaaguucucaaagagacgcugcuugaucuucuccagguacucauuaguguucugguuagucauauuggaagggcugaugugaagcuugaaaucugguccauaguauucaaaguagucauuguacggcagcucauuagggaucucuguauccagggccuccagggccaccagggccacugcuguucguaaguccagcaccgagcgacauuuccggaugguguagccaccuccucccagcaucagcaugggcaaguugaaacucuucacgaacuccacacacuugucguguccuuugauggucagauugaagcaaccuaaccgaaccccagacagggaaucugagccacacuguaggaucacugcacuaggcuggaacaucuccauuacuuuggacaugacuggcuugaagauggcuucauaggacucgucgucaaugccgucucgcaguggguaguucacagcguaguacuugccuuugccagccccgaugucccguaguuccugggagguacucuccauauuuaugaaaggacacagucaugacccggucuguaguauagaaggccucuuccacuucaucgccauggugaauaucaaugucaauauagagcacccucuggugguacuuuagcaguuccaggauggccaagaugaugucaucgacguaacagaagccagaugcuucagacuucuuugcauggugcaggcccccagcccaguucacagcgauguccgucugcugcuuauuaagcuucacagcacuugcgacagagccucccguggacaacugacagaacucaaacaagccaucaaauaccggacaguccucaccaacguugaaucucugcaucugcuugcuguauucagacauguuaucugggcgaauagaacgcaggaauuuaauguagucaucacugugguacuuggucaucuccucagcauuggcuuugugaggacgguagauuuccauuuuucgguagagaucauaguugagcagcaaauugugagucaugaggauucagugaggcuucauggggugcccuuguccauaauaguaguuuccaacgucccggucguaguaguaacagacuuuccucuugguacccugagucugcaccaucuugcucgcugcccggcccuccugucagucucu

SEQ ID NO: 6709 - RNA, 1139 nt, Mus musculus
cagagaaacacugucucaaagaauuagaaauagcuuauggcuccgugauagauuuuaaucuaucugagcuuuguugcuagguucuacaguuguguaaaaugcugacuagccugggagaucaauacugcagugauccugugaugaaaagaacaaacuaagacacauuaggccaggcagacucacccagcugugagacugaacaguguaaacaacacacagaacuuacauaucuugguucucccaccaaagccuucucauuaaaaaugcuaauaguucuguuuuccuucugccaucgauuacagucauaugguccuuaauuuauacaacaaaauaaauagacuucaugacuccuaacaaugauuugaaacuaacuaaaacgaaacauugaaacugcuuuuuuuaauuaguuuuauaaccaaacauagccaauuuucaugaauauguuccaaguuuugggggguuuauuuuguuugguugauugggguuguguguggggggggguauuucaagauguucagguucuuaacuggagcucuagagaugugcugaucuuugggccacuacuuagcuauuguacaccagcccauuuguguccugggcauuuuuuuuuuuuuuuuuuuacaacgagaacaauuaaaaugaguaggcaugaaaaaaagcugggucuagcuagaccuugccagcuccacugcuuugucucaagccagugcucaucuguuuuagaacccuugagaauccucucacccauagcuaugggaagcaggaagcuaucaagccaaauguaguuuaauuccgauaagcaccugucaacauucuaaaaguaacucuagguacauuaaaccuggaaagaugccaaaugaaaaaaacggugcuugaaaaggcagucucuuacaaaguaaggaguaaagggagaaacagacaaguucuugggauuccaaacacggggucagauauuccagacguuaagaggaaaucuauuuuaagagaaguuuuuacuuagacacuuuagaaauauccacuccccuuaaauguaagucauguauuuuaucuauuaaaguccaagccauuguccuuggcaagaauccuggccaucacugccagaucacuguauacauuuaauaaaaaauauuuauaaaaac

SEQ ID NO: 6710 - RNA, 18252 nt, Mus musculus
uagucauccaagaaacuauuuuauuaucaaauaacaaccaagggcuugggaaauuaugaaggauacuaucauagaucgaaguacacacaaccgugacucucuaggaggucuuaacuugcuuugccccauagggcaaaggucaucucugaggaaggacaucuuccgccacaccaacuguccgacuaacggcuccugcccuuuguaauuaaccucagaauacuuuccagacgcugucucccagacaaaauguaauuuccuaauaaugauuggggaaaauugaaccaaacacuggacuugggcuccaggagauagcaaacccgcgagacuuccaaagagucaauuaguggccagaggagugguagaagggcuggcucaacgaucccacaggccuaggcccuggaccacugaagaccauugcuccacgguuguguuauucaacuuuucauagugcuuggaaguauacucugaauguaucaccgccaggcggccgccaaauccaggacuacauuucccagagggcuuugcucccuggcgguugcaguugaaccggggugugucuaggaucagaagccauaagucccgcuguccucuuuagagcaucaacuucaacugcgcuucgguggugcugagauguucggauuccugcuucugcucucucuucccuucauccuguacuuggucacgccaaaaaucaggucugugcgaauguugcuuuuucuugccaggucuuuuagagaagauaaaaaaucccuacugaagcccucucccuagcccccguaaagaaagacuaggaaaggacugagaagcccuuuaagguagcaaagaucuggaguuuacuggacuguaggcgagauccuggugcccuggaugugggcacggccagacgucagaccccagguggucguaaaagcgcuccaggucuccaucauccuguauugcucuuucuggccuaccuuauuuccucuagcacuauuugcucucuagcuucgggaagccgcugaguauggcgggcuuuagauucuaacuguuuucuccacucccaagcuuugaaccagccuuugucuaacuauuugucuccagcccuugagguacuacaggaggguugcacuuuuugcucucugaacccgaugccaauguuaucuggggcaugcuuccuuguugccguuauucacuuguuuagguguuugugacaacugaaggggaagauucauuguccuucggaguaggaacacgugcuuguuugcccuaauuagauuacuaggagccaggagaagaaccacguggucaaaggaugguuucuuaauuaagugucaggucagcccaaaccuggagguguguguaaucaccugagaaucagcggcaggcuaccacaaggggcaguccacugauugguucugaguaagucaccaggagugacgguggaccaguaauaaacgccaccuucuuucugggcguggccauaguuccuauuggagcugaggcugugccauccuucugucauuucuuaccaugaccaacauuuuuucuuccaagaccuacuucccacucuuuuugcuuuuucuucucucucugguggcuacuuucauuuuuccccucuccucucugaauacuuacagcucccauaaguaggcacacaugggccuuguacucagguaaaaacuuggguuucuuuuuaccacaagaucuucauauccauauagaaucucaacaaaacaugaaccggagcuacauccagugaaaugugucuuagaagcgagcacucuaaggacucuacuauccccguuggagccagcaugggagaguggggccagagcugcgcuuucaaaguugauuucuuguuuucgaugaugacagaggaaggaggaagagccaauuccugguccccaggauuugucaguguugaaguucagucugaagggacgugagacacagagccaggggccuugaucgcugaggagagagagguuccuuuggguaccacaaguuaguuugucuuaaguaguggcugcuugcagauaacaaguuuaguggaaugguugaaaugcuccuuaaaaacgcacuucugagucaacagauccuuuuaguccuaaaauugagaagagaagaggaaaaucugaggguuguguuugugcuucauccauuuggaaaggccagcaaagccuacgcacaggugcaaggacuccaaccagacaaacguauggauccucacucugcuggaacucugcucuguuguuguuuuguuguuguuguucugauauuaaugugugaugucaguagucaaacccagggcuuggcaucuggguaaacuauguaugcuuacccuguuauauuccuagcccuugucucauucuuaaauguuuuguuuuuguuuuuaaaugugugaauguggcuaucuuuuucuuauuuuugaccuagauucauaagcuuaugauuucuauucuuugaauuggauuagcccuucuuaagauuauaagaugcuguuugucacagauuggcauagaaaggccacuuuucuucuguuugguugaaucuuaugauuuccuaagccaagcaugccugauuggaaacuaaacugaagucaggugccugaccaaucaaacacuuaucuaggucuugugcuuuggggagcagguauaacuuuguuucaguuauuugagacggaaucucucuauaucucccuggcuguccuggaacucacuauguuagaccaaacuggccuugaacuuagaaaucugccugccacugcuuccccagugcuaggauuaaaggcaugggccaccauacucagccagaucuaacuuuuguuuuuaaaaugcuaucacuuuuuguccuuaaacaagagcauaaaauuuuuguuuuccuuuuugagacaguuguaacccaggcuggccucgaacucaucuaucuccugagugguauauaccuggccuaagagcagaaagcugucuucuuuauuccuuacuuccuaauauuuauuuacuguguguuauuauauggugguacggguacacaugcguguacuauggcgugcauguggaagucagaggauaacuuugaggagucaaaccucacuuucuaucauauagauccuguagacuguacugaugucaacaggcuuagaggcaagcaugccuaacugcuaaggcauccugccggccuugccuuuuuuuuuuuuuuuuaacuuaaccuuauaaaagaauaacauuggaagccauaaaagcaaacucagcccuggaauuggaagaagaauguagcuucaggaguccuuggcaggaauggauaacgaaggauugauguuuucuuguguuucuaggaaaaugcuguccaguggggugugcacaucuaauguucagcuucccgggaagguagccauagucacuggugcuaacacaggcauugggaaggagacagcuaaagaucuggcccaaagaggcaagugcacauguuucuaacucaccuaugcugauauuuuacuccucacagugaugguuguuucuucccagacuuagaauguaagaacacuccaaguaccuuauuaauuuccuguuauagucugaaucuaguaugguguucuacauauaaugggcacuuaaaacuuuaaaaaauagcaaauaccauuuuuauuauuuuuuucuuugcuaaguugcuucagauaccauggucgugaaauaagggauaaaaauuccgauuuuguaaaaugucaggagcacucagcaucuguguucagucucucaaaccacuugaaaccagagcugacugguuuuuugcuucguuugguugacaggagcccguguguauuuagcuugccgggauguggacaagggggaacuggcggcucgugagauccaagccgucacagggaacagucaggucuucguacggaaacuggaccuagcugauaccaagucuauucgagccuuugccaaagacuucuuagcugguaaguggugagagacgauauuauaaucauugggauaugauuuaugucaaagggacaucuucaggaugcagaaaugaaaagagagccuguuuuaguuccuuuacuauugccaugcugagacacugaacaaggcaacauauaaaagaaaguauuuaauuugggguucccaguuccagaaggcuagaguccaugacugucauagcgagcaaggagcguggcagcagguuggcagacauggcugucaagcaguacugucuggaucugcaaccaugaggcagaaagaaguagcuaauugggaauggugugggcuuuugaaaucucauagcccaccccgaauaacauaccuucuccaacaaggccacacuucugaauccuucccaaagaguuccuccagccccaaaauuauagcagugagcaagagcuaaagcugaaacuguagcagaaacaucagaacucaauaggggcuugguaggguauagcacagucauccaggcuaagauaggaagcugaggaggcccuaggcucuugagagcuggagcuauauagaagguugagauucauaagagagccauuugguccacagucuauguacuaagaagaagaacaaagcccuggccaccuuggacauaguacagcagcuuacuagcucuggaucuguugcuuacuuuuccuuugcugugacaauacaguugcagaaggguaggguccaugauggcagacuaagguguggcagcagguguagcugagagcucacaucuacaacagccagcaagauacagaaggcguacugggaagggcaugaggucuuugaaaccucaaaaccagucccuagagacaugcuuccuccagcaaggucacacuaccuaauucucuccaaacagcuaccagcuaggaaccaaguauuuaaauguuugagauucaugggggaaugucucauucaagccacauucuuaggaucuggguagagaaagaaagaguggugauuugugauaauuagaaaccaggcugauaucauguuuaaaaagaccuauggggccagcaagauggcucagcagguaaaggugcuugcugccaagcaaccagaguucaauuuuuaggacccaccuggcagaaggagagaacuaacucacauguguuguccucugaccugcacauacuccaugccauguauuuucugucuuucucucucaaauaaauagaugcaauaacacuuuuuagaaggcugugguaucuccccauaaguagguaugccucacccccaucacccagggaucuagacuucuugagaaaaauauuucuacccuuaagaguuuacagucaggcuggagagauggcucaaugguuaagagcacuaacugcuuuucuagagguccugaguucaauucccagcaaccauauggugucucacaaccaucuguaaugggaucuaaugcacucuucuaguguguuugaagacagcugcaguguacucauauuaaaaaagauaaacuuaaaaaaaaaguuuauggucauaaauuauaaaucacacaaggaaaugaacugagagagagagauggcagguuucuuugaaggccugagucccacaaguauggguguucacggggcacccaagccucaccccuccaccccuguuagcuucuaagucuuuccauucagcuuggaacgucuuucuguugggagagguagauggaacacuuccccaaaccaaugaggaaggugcuuugggggagccuggaugugauagucugugauguaaaauggaauuuugcccugucaagguguguagauuagcccuagucuuauaauaaaaaaaaaccaaaaaacaaaacaauacaaagucacuggaggaauaagggcggagagugcugucucacaccccugcuuucaucccccacuugggagccugggcugugaggaggcugucugagaugugaacacccuggcugucuucucuuccugcagaggaaaagcaucugcaccuucucaucaacaaugcgggcgugaugaugugccccuacucgaagacugcagacggcuuugagaugcacauuggcgucaaccaccuggguaagaagucugucuccaaccaaagccauggggaaccgagaacucagagccuuaucuguggcaucauuggggcucggggcuauaauuaaccaugcaugcauaguacauaguuaagaacugccuaaaagaugaaggcuaauccugaggcuugcuucacguucugccuacacacacacacacacacacacacacacacacacgcauguauauuuauacguguauguauauauguauguauaaagauuuguuuuuauuugcguguaugucuauaugcuacauguauguaugugucugcagaagcugaaagcaucagaucuucuggagcuggaguucugaguaguuguggccuuccacauaugauuacuaggaaaccaacuuggguccucuggaagaacagcacacacucuuaacugcugagccaucgcuccaacuuuuuucccuacuuuuuaaaucuguaauucagauuuggcuuuuguugagaguaauuugaauagcuugauuagacagagggcuguguugcuagucuuaacaaucgaucuuuauaguuagcaacagguagaggccauguguucuccauguuccuuugaggguuaagguuuuucuuagacuaccuccaacucgugauuuucuugcgucagccuccugagugcaugugugugccaauguuugcucuuaaacagugaugguaaaacaggauucauauccuuagcccaaacaugucucacauaaggacgucuccuaucuuugccugcuucuuguuccuaaaauccccucugaaccuguucucuaacucauaaugagaaguugcugugguggaccucauucccgaguaccauccaucucucucucucucucucucucucucucucucucucucucucucucucucgcucacucucucucucucucucucccccucccucccucccucccucccucccucccucccucccucccucccucccucccucccucccucccucccucccucccuccaagaggugaucucuguuuaucacgcuccuucuuaucugcacaugggugcugaacaacccugauaauccuacuuuuucucaacaggucacuuccuccugacccauuugcugcuagaaaagcugaaggagucggccccaucaaggauagucaacuugucuucuuugggacaccaucugggcaggauccacuuccauaaccugcagggggagaaguucuacagugcgggucucgcguacugccacagcaaacuagccaacauucucuucacuaaggagcuggccaagaggcugaaaggugagugggcgugagcagugugagagacaggagacaguaagaauagcagaaagccacaggacgggggugggggguugggggggaggugcuuuccagagccugucaccugcacagaccugcuuccaugagucuaacuggguaugcuuuuaguaaguagcccccacugaauauuggagguggcuggcuagggacaggggaacucugacucugaggacuuggccucacugcuuacugcagcacuaccugcauguuacugagauuuccaagauuuagucccuccuagguaaagugagaacugcuucacagcuuguggucauaauccauucaguccucacaagcagucuggguuuuuacuccuugugacaagugaagugguacuuaauaacagacauuaguaugaaacauguacugggagugauagacaggggaggggcaucucucuaauagcaaaaggucaagcaagggagagaugguuuagcaggucagagcacuugcuuuuauaaagacucagguucgauucucagcguccacaugguggcucacccaucugcauuucuaguuccaggagcuucugaccuucugaccuccuggggauacuaugacacacacaugcaggcaacaucgucauaacuauaaaauaaauauuuuuuuaaagaaaagaaagaucaaauuuaagggaaaaauaugcuugagaaagggaauuucuagucaugaguaaacagaggucguuagcguugucugcuguguauuucuaauaaagagaaagggagucuagggcaggcagugccuagcaguugaaccagacagaacugaagcucaaggagucaggagcaagagccucacuguugaaacagggugaccaaaccacaaggacagcuacagaaguugcaagaugagaagaaggaagccaguggucaucucagacccgguguccagucugugcuagggcaaggcaucccuuaucgguucaggacaguuaaggagaaaauguuguaagaacuaccaaagggugggugaagaagcuaagaugaugcagagguagagagaugcauccauugugagaguuagggaaaaacaguaagggagcccuggcaguuggguucauuaagugggaaauagugguauguauaauacaggaacccugaugugcaggaagauugaucauccgucccacagacaugcaucccauguccuucguagggucuggggaugaaguagaggaugaggcagguucagggacuucuugauuugcuuuacagcucugagggaaagugaggcuaauagguguuuaacagccggcacaugaaguuuuucuaguuguaugucacauucacuuuaugacauucaaauaguuuagaaguacacagaacuaaagauagaaagccucuauuaaucccccagccugagcccggagcgagcaggggcuggagcaagagggagaagggaaggggaaaaggaaauucccccauccuucaaauuaccacugucaucagcugccagucaccuuccuaugcguuugcuucuguguauucgucauagacggaucuacaacucuaauaaaaucucugugaccuuuccauguaauauguuacugcuauucaaaggagcaguugcccacaacuccagcuccaggggaucuucuggccucugcaugugccccacacauggcauacauacacagaaacacacacaguguugauaaacacaucagucccagcacuugggaagcagaggcaaucagaucucuaugaguuccaggccagcuugaucuacagagccaguuucaggacaaccaaggccacacaaagaaccccuaucucaaaaaaaaacaaaacaccccaaacaaacaaaauuguauggugggaguuuaaugcacugugagaauucugagguuugguaucuggguagaaagugaugacuaaggaaaggaguuacagcaccuggagauuuaagaacauuggaagaggcauggggucauggaaggcaguggaaagaagccugagagggagggaugaggaagaccaaccgugcgaagggcugcugggaggcugggacuuggcucuccuacccuagugcagcggcaagccugucucuuaggagccugcuuccugagucugcagcguguauaaauugcagugaguaggugcaugugacauagaugcucaccaggagcagagaucgccugugggugucauaagugucgucacaugcuuugcucucuuugucuaguuguuaaaucaaauuuugucuuccuucuugacauguccccugccugccccagguucuggagugacaacauacucuguacacccuggcacaguccauucugaauugacgcgguacuccucuauuaugagauggcuuuggcaacuuuucuuuguuuucaucaagaccccucaagagggagcucagacgagccuguacugugcccugacagaaggucucgagagccuaaguggcagucauuucagguaugaggguaucugucuuugaaaugaguuguuacugcuuuggggaaauaacuugggguuugcuugaucugguauaugcauuuuuguaaaauguguauuucccagagucagagagauggcugggcuagcacaggcugcucuuccagagggccuggguuccauucucagcacucaguuacaauuguguguaacucuaguuccagggaaucggacauucccuucuggccacuguggguacugggcauguacaggguucauagacauacauugcacauaaauacucauacauauaaaguaauaacaauagauuaaaaaaauuuauuuauuauauguaaguacacuguagcugccuucagacacuccagaagagggugccagaucucguuacagaugguugugagccaccaugugguugcugggaauugaacucuuaacacugagccaucucucaucuccuaaaauagcuuuugucguuuaauaaaagaauuugccuguucacacuuuuuuuaguacccacuagcuuugauuuuauuuuuauaccaucuuuuauaguaauaauuauguuuuuuuuuagcuuuuguucucucucucaugucaauccuguuuucuucccuuuuuguaccccaacuucuucuuuuuuuaaaaaaaagaauuauuuauuuauuuuauguguuugagugcacuguagcucucuucagacacaccagaagaaggcauugggucccuguaggugcugggaauugaacucaggacucuagaagagcagccaguguucuuaacggcugagccaucucuccagccccucuauuuuguuuuuaaucuguauuucucuauuaucuucacaauugaaauagaaccaaucgagucccuuguugucauaguuaggguuuuacugcugugaacagacaccaugaccaaggcaagucuuaaaaaaaaacaacauuuacuuggggcuggcuuacagguucagagguucaguccauuaucaucaaggugggagcauggcaguauucaggcaggcauggcacaggcagagcugagaguucuacgucuucauccaaaggcugcuaguggaagacugacuuccaggcaacuggggugagagucuuaagccgacacccacugugacacaccuauuccaaccaggccacaccuccagauggugccacucccugguccaacaauauacaaaccaucacacuuguauuuuauuuuauuauuuucucagugcuggggauggacccugaggccucuuggggcaaguucuaucacugccacguccccugccuaaguuuugguguuuuggguguguuguaugcauguuuguaugcaugaaggcuugcaugugugucuguccuuggggaagccagaggauaacuucaggcaccauccaccuuuugaaggggguaggacacagagaaugacaagauuucuugucuuuggcuugagacaugccaagagagccagacucccuggccagugugucgcaggaacccaccugucucaguccccuguccugggauuacagguuugugccaccacaucugguuuguuuuucuauaacgugcauccucauguuugcaaagcaugcccuuuacccacuaagcuaaucucccagcccuguuaucuacuuauauauuuaucuuuucagacauggucuugcugcauagcaaacugaucccaaacucacaaucugccugccucugccucaauuuuuauuguagaauaaauagcauauuaaccccauauucacccacuguccagcuuaagcugccauaacucauggccaaacaugucccauucccauccucaagccugucaccauauuuuuauaaagaaaaucaugugucacauaaguucaaacuuauauuuuauccccaccuucaagauauuguugguauuuuauagacaagacuguggguagaguuagaguggaaagaugaauaaacauacuguggguagcguuagaguggaaagaugaauaauagcauuagauuggaaagaugaauaaacagaugacaaaggguuaauaaugccagccugguggagcagucauagaaguuagugcagcagagaaauagaauaugaucugaucucugcuuugggagaaacaaaaaaggaauaaaaaauuuuuaaauuaauuuauuuauuaaugauugaauaaguaaccccauaaguaaccaguuccugguuucaagcagugacaacuggaaugaaaaggcagcuuccaugagcgaggccugccugacuucuuaauggaugccuaguugaguguggggcugaaagaggauuugguaacccaguuucacaucuguggaaccugguuguugaugagaacgggaagggagaugcagaauggggaaagaaugcauggaacuuaauuccaaagcagugggcaugaagucuggcaaacaagcaagagggaaguguacugcagugucagugcagacugggaaugucaguggccagccagcugucuuacauaccucgaggggaacuguuuaggaguguggggacaccaacugucuugaaccuuaguuccauuguuucccauccacucuucaaagaggacaaguugauugggaggguaaauuugcuauugccaaaagaauaaaaauuagauauucaguugaagugaccuaagacuauauauuugucuaguaugugauaucugcaugcauacaaguuguguaucaaauaguuggaaauaaagaucugaacuucaaaaacuauauaaaguauaaaagcacuguacacuagacacauaacacuguguguuggaaguguuuuauucuuuugagucaaggucuuacuaggccuucgcuguccuagaacuugcucuguggaccuggcugaccucagacagagagucaccugcuucugcaucccagggugcugggaagaaaggugugcgccgccacacuggccccagaucuaucuaucuaucuaucuaucuaucuaucuaucuaucuaucucucucucucucucucucucucucucucucucucucuuuuuggagacauggucucaugcugauuucaagcucaaucucuaguugaagcuggcuuugaacuccuaauccuccugccuuuuaauucccaaaugcucagaugugugacucuuaaggaaauuuucuuaugcugugaauauuaauuuuuucuucauuuugaaggucuagcagcagucacaggucucuagaggugaauuugaagccuguccugauagagagaggccuugacuauuuuaguagcuauucccuugccugcuccuacuaaccuacuuucugucucuauggauuugccuagucuccauauucguauaaguggaaucauaacuagaaucucuugugguuucuuucaccuaccuaaauguuuucaaguuucauucaugugaaaguauauuucaccuuuuaguuaaaaacaauauuucauuguauguucauaucauuauauaccaugcauaaaaugaacauaccauucugcuuucuggcuauuuaaauaauacuguuaugaacauucauuuaauauuuauuuuacuauuguuuggcuuauuccauucugguuuuggaaacaaggcuggccuggaacuuguggcaguuauuguaccucagcuucccaaguucugggauuauaggugugagcugcaaugucuggcuguggguuuuguuuugugcuguauguguuuguuuuugagaucaguuuucacucuguaucucagcuggcuuugaauuugcaaaguaacccaggugggccuugauccuccugcuucugccucuugaauacuuggauuaaagacuuacaccaucauacuugacccacaugggaauuuuuguauggacauuccuuaaugaucuauggaggaaucucugagccauucggcaacuucguauuuaauuguagaggaacuaccaggcuuuuccaaguagcuguccaauuuugcauucccacuagcagugugugaaggcuuagguuucuccagccuauggacagcaccuuccuuccuucuagucuuagccauccuaguauauaugaaauugcagcuuauccuuuucauuuuccugcuaauguugagcauuuuugugugcuuuguucauuugugcaucuuuauuggagaauugucuuuucagcucuucugccauuuuuaaaauuagguuuugcuuuuuacuguucaguguucuuuauaggcuagauacaagcccuuuaucagauauaugauuugcaaauauaucuuuauauucuguggauuaucaucccaucuuuuuugaugguauccuuuaaagcucaaacacauuuauagcaugcauguauguguaugugcgcaugugugcgcucgugcauguguugcugggacugaacccagagcuucugcugcugagcucuaucccuaacccaagugucuaauuuuaauguugaugaaguccaauuuaucauguuuguuugucaguuggacuuuuggugucguauccagggauccacugccuuacuugaggucauaaggauauacuacgguacuaucuuuccuucuaaccauccauucaaguuaauuuuuuaaugugauugauacacuggaaaggcccguguuaguuacuuuccuucuugcugagaccaauuagcugacaagagggaggagcagucaguucagaggaguggcuagguccugcagaacaacccagaugucucauucaccuguggccagccaugugaguugagagaauuucugauucucuuuauauuuaugcuggggaggaagucuugcucaguaaagcuuuugaaccuccuuuaacuaugagacugaagacaaaguugcuuacacaugguauuguggggaggucagcaguccucagaggaggccuuucuugugggaggcugccuugugcagagcccuaccuucccccuccuagacacugguauaccuccauccucugugacagccauaacuguagucagacauugccaagcuuccucaggagggaucccaccauguuugagaaccacugcccuggagcacaaagcggggacaaaaggacaaggaaaaucccaguaugaguacuagaggggcaaggggguugcucgaaucgguaaacacuugggguuuguccagaguuacucugcuuauguucccaccagcauuucuugcaagaucuugggaugaacugauucucauguagcuagcacaucugauauucagaccuaaguucacuugcuagcauccacagaaaagucaagugcauugguacacaccugugaucccaggacaagggaggcagagacaggaagaucuuugaggcuugcuggcuagccagucuagcugaauuggugaccucuaguucacugagagacccugcccuaaaaggaagguggagaguuauugaggaagacaugugaugucaacaucugccuuccuuauacaugaauacacaugugcacaugugcacacaugaacaugaauguaugcaugcugauguguacacacacaugcaugcacaaaauguacuagaugcagagaguauaaaaugaauaaaagagaauuguccuugaaagaaguuucuaggugguacagaguuuggaugccuguccugcagaguuauggcaguguagaggaggauucugagaacaccucucuguggcucgacuguguccccaacacaacaguguggagaacgaaaaucaucaagcucauggaauacugcugccauuauuacugagugggcuugguauuaaaaagugauuucccucauucucacuuuuaugcuuuuuguucuuccucgcccuuucucacugugcccccaugugcuaggacuuaagugggccaggcagucaguacucaaccacugagguagcucccgauccuucuccacuccuguaacaaugccuucugcagccaaugugaacagcaggauguuagccacaggucacugcccaaggccuugagggguagaccuuugaccuccuuugaaguaaauggaccugucuguacagugucugggcgacacugauauagcuaagcauauacacagaccaccacuuuauagcgaagcauucugaucggagauaguugauugagaagauagaaauauuuucuugagggagagacugaagaauagucuggcugugguggcaugugccuauaaccccagcauuugagaggagggagucaaaaggaucaugauguugaggccaggcugggccaacagagcaagugguccaagccagccugggcuacauagagagaugcaaauaaauaaaaggaucagcaaaugaaggaauaggauagcauuguucuguaaaguaucugggggacccgugagcucuagauuguuuuccuggcauauucuuuauauuaggcaaagagaaaaugccauuauugacccuguguuucaagucucucuguuucccuuccagugauugccaguuggcaugggucucuuaccaaggucgcaaugagauaauagccaggcggcugugggaugucagcugugaccugcugggccucccaguggauugguaaguggugguuuggacucaaaagaagauuggaggagaugaugauuauccuucaaaguggccaaaaccuugaaccugaagagcgaagaacuucaagccuuuccugcuuggcauccaguuaaauccuaguacacugccagguuccucgaaaccccuugaguuuguauugacuuauuuuguuccugcuccugccagcguuucuagugguaucacuaagacagaggaccuucaugugaccuacacagcuccuauuuuccuuuggaaacucccccuaaccaggagcaugaaagcccuaugaagauugguacaugacaauguggauuagauggagcuccuccgagccgaccauccucuccuugaagaacuccauuguaaccucagcugaaccucaggagucccggagccuggcucaagggcaggcagggcuuuguggucccaacaucuggauacuuaagaaaaguuuuuacuaaaucuggcagucugaagcuuuggcuucugagacacuuuucuauguccagaccacugaagagcuuccuucucuaagaaauuugugggauuugaagggcagagauaaaaauaaagccaaacugucauuuucucccgcuguuucucagccuaguaaggagguaaugaaaggaacgguaugagacgauaggucacuggggucaguuacugaccccagacccacagaggccucuuuuuugugccuuaguuucucuuaggaaacuagaaaaggaaaggccuucucauugucauugugucgauuuugugugucuucuugugcauucaugcaguugaauguguuuccacaaaauucacaauagccacaaaggaaaaguucuuaaucagacuguaguguagacaaauuaccagagaugggacaaaucacuguggagucuuugaguacaguugcaaagcaagggagacacuaucuguguuguaaucggucacugagaagcacagaugccgcagggaagaaguuuaaaagaaaaauccuaggaggggacacaugauaaugaaggggucagcugaggaucuaaaaccauaacggaaaggcaguaauagacagcuacagaaaggcacacugucuuaaucaccagucagucagagugauaggaaaauguccaaagcacaagagugaaauauuucucuauucagaaauguuauccuaaggauugguaauuauagucaguucauaaucuuuuagagcauuuucuuacauuagcuuaacaagauguccauuucaggaauguguauggagagaugggauggcuuaguaaugccugcuguuccagaggacccugguucaauuacuaggacccacuuggcaaccacaaccaucuauaaccucaguuauagaugaucuagaggaucagacagccucaucuaccuccacaggcccugcaggaauguggugcauagauauauaugcaggcacacauacaaauaauuuuguaaaaaaaaaagaaaucaauuuugacuuuggggguaugcucuccugaaauguugaggccccuggguuugaucccagcacugcaaaagaaaguagagauagccucaauuuacuacgauucugcuuuauuuggagagcuuuuaucaaaagcaaugcagaccaagggugucaggaaucccucauguucccaucacugguuuggaggaugcuauucuaagggaguuugccauuuccucgggcugacaauuauauuuuaagcuugaauauguaagacugacaggaccacaaucuuuaacuucuaauauuuguaaauuaauaaauuuauggguuuguucugaccaauaaacguauuuuaaaauuaguuuauggggauauuggaaaauuuuugacaaugcagugauuaauuaaaauaauauuucacuuaauuuauauucacuugucaaugaaaacaaagguucuuuucaauuaccuuguuuuuaauucuagauuauaacuguuagaauuaaaugaaaguaauuguagcuuaa

SEQ ID NO: 6711 - RNA, 762 nt, Mus musculus
cacucaggcuuccaugcuguaaggaacaguacuuccuuccucuccagcgcuggugauaugacucacagcaaaacgugaagaugacuuuccugaugcaccaaauggcagcuggcuguagcgacucaggcuugugguccccagcacuccggaggaugaggcgggagacccaugacauugagucuagggcuacauaucuggacccugucucaaaacaaacugauaaaccagcagacaaauaucaagaaugaagaacuugagcaauaagaggaaacgcaucaagugcuagacacgugguacauccuucucucuaccuagcuauaaugacccucauauucugcccguuauacagguaagaaaacugaggccugagguuaaaugauauucuuucucuuucaguacucagaacugaaccuuggaccucaugcuugcuaggcacugagcuauauccccaguccuaaaugauguucccaauguuacagagcuuguaagagucugagccaaagcuccaggaauucuauuuucuuuuccuuuuucuuuuauuuuauguauaugaguaccuuauuguauauguauauuuuauuuuauguauaugaguguuuugccugcauuuaugcauauguaccacgugcuggcuggugcccuuggaggucagaagguggugcuggauccccuagaccuggaguuauaguuguaauccacccugugggugcugggaauugaacuggaguccucugcaagagcaauaaaguguucucauccacu

SEQ ID NO: 6712 - RNA, 1117 nt, Mus musculus
guaauuggucaccucuguauuguaauugguguugaguguuggcuuuaccaugccaagaaggaaaggaaaugccaaaggcuccaaugguuguagcacuuuacaaagccugugcucugucuacaaaagaugccucauguaaagucacacuucccaggucuuguugagcuuagcuugggaggacuaucucuuuuggggugggccaagaaguucacauucccagcuugguacuuaugaaccucaugcaggccacuggcacauuggcacaaagccaggguuuagugauugcacaaggggcccgaucccuacgaagccagcccaaggagccacaucagcucucucugagccuucgcuuguugcagcaaauacuccucuucaagucaccugcagccaauaggaugcuagaggacaggcuccuaaccaucuuggcucuccgcagcagucuucugcagacuucugcagaacuggggugucccacaaagagaugaggggcacuuagcacacaaugcuuucuuuucugguuuugguggagaaaucucugcugucugaucaugacucagaaauuauauaacuuguucagagaacaaaaugcuaaguguucauuaagugaguugggagacccagaagguccagacacuguauagagcagguccuggagcugcaggcagagaucuaauuggggggaggcccuggaagggagagaggaugagaaggagcuuuaacggaggaauuucugagaccaucauggaguucccgucuuuucuuuagugucuccaaucggcuucauacaauacagucaagguauaguggaucaacuccaggacaggcaaucacagugcagacccaucuuaccaucugggaggugggacaucuccauagggugauggagaaaggucacaggcaggguugggacgagaacucuugccuugucuuuccucaauauucucuuucuacuugaaaagagaaggauaaaguccuccagugcuggagucagauggcuuuaguguguagccugaaagauucagucuacuggccaugugacuccuccacaguacuaaagggaauagauuucuccaauagagugguccagcuugccucuuccucugggccccgggaauua

SEQ ID NO: 6713 - RNA, 5266 nt, Mus musculus
ccgggagagucagaaaggcgaggggcgccgggagcaggcgugugggacuccugaccggagagccggaggcugcgccuuccccgcaccgggaccuucacgacacaccagauccuaguccuugccccgugcgaacgcccacgaugaccaccacccucguguccgccaccauuuuugacuugagcgaaguuuuaugcaagguaaagcagggcggagcguuggcuuuuugaaaguuucucuugugcuccaagaaacucuaaaaaguuugggucucggggacgugaaggaguuucacugcuugcguuucccuccauggugaaggaauuuguuuauguccuccucgcacuuaaguuucaggucccaggugggguucugugaauccggggagcaaaguucugggcgacugcuccaguuugcggggcaaggaggugcggaagagugguuagguuugggacgaauuuugaaggauucuuuucugcauggugcaccuccggagcugggcuaagcgggugggcucggcuucgcagugugcgccuuggguuuccuguacccgcuggagauguucgagguuacccaacaccuuuugcuaggggucucuaggaaaagcgaggucucagggcgguaucugacugggagaauuuuccugucuguuuuggggagcuaagagauaaugcgacgaagaaagaggccgacuuaagguucaaaaagauguaggcaaagcgacuuuguaguggaguuuguccgccccagcugggcuagguucccgcugcgggagcuggucgaucgugcugcaaacuuggggcugaaacuguuugcuuaccuggguugugaggcacuacgguucguugacuaaggaauaggggaacaaaaugcugccagaccucaaguucccgccaguuaggauuuaagagggccaaaauggggcaguuugccagucagguuuuugaaaaacaaaacagaaaaaaacuuuuaaaaccguaauguuccaggagugcgauugaaauaacuccgugaauguuguuaauuuuuugcccgcucuacuucccccaaccccccaauuugaaaggaugaagcugcuaggcuacuuuuaauugcugaacuguuuuugccuucccuuaaacacgucgggucauguugcucucuuccuagcucgcugcuccugucggugcagcugccaaggccccggggcugcaggguuggggugcagggccgugcuggaguugaagagcaacaucaaaaacuuugcauuuucggcuucuuucccucccugcguuuuuccaagucuguuugcccuggcggcagccugagcuagccaacuccauccugggccccgcugccccgcucuuugaucuauuucucuuucuuuugcccccuccccccgcaggacuuuuuaaaugaaccucauuguuggaagcggcucuccucuggguuccuguaauccgcucgguggggugguugcgguuacaggguuaccgauucccgauccccugcugcggauccuaagggacuaacuuuagaauuugcacaaugacacacacccacaugugucaggggccuggagauaacuuucaagucucccacccccacucuuuucuaaaucuuagguaguuugggcaggugacuagggcuuguggcagccucuguccuugcucacucacacacccccgcccccaauugacugagucggggagugugagcgugcuggugcuuuccuucucgucugcagcuuugguucaagauuaaacacuggugcucuuauccagagcucucucgcagccaggaaaccaagugcaaaggcaucuuccuagugaaggggguggagaaugcugggagaaaaucccucccagggugugggauaccuacccuucccgaaccuuguguuuucagacacuauaucccucuacccacaucccagacuaggcccuuccacaagcaaggaaaaagcacaguuugaaaaccuguugccaaaggaagggcacacuuguggaagaggaaaugguggagaguguggggccagauuuuguggggguggggguggcgggggggggggggcggguaagcagggacugauugagagaggauuuggcucauccuuccaaacuucuaaacuagguuuaccugauucuuuuagggggagggaaaugaaaagggacugucuugugugaaaggcucucugaguugaggaauguauaaacggggcccggauuuuagaggggggaaaauuagcuuuagggacaggaggaagcuacauaucgggucagcacggggcgggaugaauacauaacuuuuucuuccacacacggcaggauuuugcgguuucuuaugagcagugccaaaauaaauccagguggcuccuuuuagagagacuggccuaucagauggagaggugcuguccuuuguggacaccaugcccuggccucguggauguccucagucacucauccgucccuuucuuucccuccccucccaggguaacaagaugcucaacuacagcacucccagcgcugggggcugccugcuggacaggaaggcagugggcaccccugcuggcgggggcuucccucgcaggcacucggucacucugcccagcuccaaguuccaucagaaccagcuucucagcagccuuaagggugagccggccccgucccugagcucacgcgacagccgcuuucgagaccgcucuuucuccgaagggggcgagcggcugcugcccacccagaagcagccugggagcggccaggucaacuccagccgcuacaagacggagcugugccgucccuucgaagaaaacggugccuguaaguacggggacaagugccaguucgcgcauggcauccacgagcuccgcagccugacccgccaccccaaguacaagacggagcugugccgcaccuuccacaccaucggcuuuugcccguacgggccccgcugccacuucauucauaacgccgaggagcgacgcgcccuggcggggggccgagaccucuccgcugaccguccccgccuccagcauagcuuuagcuuugcuggguuucccagugccgcugccaccgccgcugccacggggcugcuggacagccccacauccaucaccccacccccuauccugagcgccgaugaccucuugggcucaccuacucugcccgauggcaccaauaaccccuucgccuuuuccagccaggagcuggcgagccucuuugcuccuagcauggggcugccugggggaggcucccccaccacuuuccucuuccggcccauguccgaauccccucacauguuugacucuccccccagcccucaggauucucucucggaccacgagggcuaucugagcagcuccagcuccagccacaguggcucagacuccccuaccuuggacaacucaagacgccugcccauuuucagcagacucuccaucucagaugacuaagccaggguagggagggacccccccccaugccuccuucaccucuccaccccaucucuucccuucaccuccccacccccuaacuuucccucaaaccccacauugauacauuuaagcucagccccuuucccagaacaaccuugguauguuacccuccccccacauaaggacaagucaauuuguugguagcuucuggcuugaaacccucucccuccauuucauagcccacuuaaccacgcauaacagaguuccaucuuuugucaguagaugccuuuuuuuacccccccccaccccccccggcuuaagccuuaagugccaaaucacaaaagaaaaaaagcaguaaccguuuacagaagcaacuuagugccuuguaaucuaacuuugucacugugacuacauuaccucuucaacgccagggggcacccgugggccucccagagccucugcccgugggguuggggguggggguggggugacccgcaaccagcagcucccccagcuggccacacaagugcaccuuucuuucggucucccgcacacucuuccucuuccuuauaguuacucaccucccucagagaguuguugcuggacuugggguuuuuuuggggggaggggucuauuuugacuuucaaaaccuuuuacuucccagcccgaaccccuguugacuaaucuugccuggguuuguguaggucuccagggacaaagguugaacaaguuggacgaagguuuugacauaagugggacuucgugauuuaauuucuuucuuucuuuucuuuuuuuuuuaaguggggaggaaggggaaacuagauggacuaugagagacuugauuuuggugcuaaaguuccccaauucauaugugacaucuuaaaaaugacaacaaaugagagaaaagcuaaaaacaacaaaaaaaaacauguaaggggugagcaguuaauggucugcauuccacauacaauaucuguguaaaacgauuuccuguagaaguagcuuuaauggauuuugcucuagaauaccuuaggucuaccuuagagcccccacacaaugcuuuuuucccuggguuuaaacuucaucuaacuuucagaaauuggagagcaaaaauguugcuuaucacugcacaucaauauaaaaaagcuuauuuaacuuaucaaaacguauuuauugccaaacuaugcuuuuuuuguuaauuuuguucauauuuaucgggaugacaaauccauagaauauauucuuuuauguuaaauuaugaucuucauauuaaucuuaaaauuuugugacgugucuuuccuuuuuuccacaguuuuaauauauuauucuucaacaacauuuuuguaacuuuacacuuuuuuugguuauuuuauuuuaaaaaaaugaaaaauuaauuuaaaaaaaugcaaaaaacuguuggauuauuuauuuuagaaauucuccccuuuguguuggacugcaaauugaguuucuuucuccuuaggccuuucacagguaggacugagaauguauguauaaguucugugacaguacagaaggaaaaccaccauuuuauguauagcuucuaaaagggaaaacaaaaaaagagaaaaacccuuugaauuccaugugcccaucucaagacauuccgcucgcagauuugugguucuggauuccagguuggaguuuuccaauguugacauaaacaacuggcgcacacacauaaagaugaauguaauuauuauuccucuugcuggucacuaccgucgcuuucuauuucucuuucuuugugugaauuuauuuaaaagaaaaaaaaaacuuuuuguaacgacuauuugcaguuuaaaaaucaauaaaccccguuuuucaagaaaugau

SEQ ID NO: 6714 - RNA, 3224 nt, Mus musculus
aacaauuauaaauauuuguuaauuacauaauuuaaaaguauccaucguuuggaagaaagcagacuucccagaacugagccuugaacggcucacagcugaaccaggagugccuucuaccacuguggucuguucccagcccuuuaguuuucaucaucuaagacagggucuugcuaaguugcccaggcaguccuugagcuuuugauccuccuugcuuagccuccacauuagcuggacuacagaucugugucacccaggccuggcagaaacaagaccuuaaugacuuggguuagagaguacucagcugugacaccaaaggcaugauucacagagauaaaacugaaacaucagacuucacucaaguuaaaaaccauuccuccccacccccaguggaagacauguuguuaaagaguugaaaaaguaagggggccggcuugagaaaucuuugcaaaucacaugucuaaggaacuguaucuagaauauguuuguuuuuuugguuuguuuguuuguuuuuuaaaaaaacaaacccucaagucuugauagaaaguuaauaauaacccaguuaaaaaugugcuaaagacuugaauagagacugcacaugucuaaagagacggggcguuguuauaggagaaaugugaguuauguuguaaugagaaaggugggcauagaggcucaaagcuggaauccuaacacuugggaagcugaggcaggagacaugccuugagucuaaggccagcuggaguugcuuuagucaguucuagaccaguguggguuauagugagaccuuuucuccacccaauccaauccagaugugaugggacagcacagcacaccuaguagaaugauuaaaguaaaaaugauaacuuacguacugacgcuguaaagcaacuggagacucaugaauacacaugcuagagaugcaaaacugcgaaaucuacuuuguacaauggcuugguagagcuguguguggcggugcaugccuuuaaucucuacaccugggaugcuaaggcagguggguaucugucaguuccaggauagcuaggguuauguggaggcucuguuucaaaaacaaaauaaaaggcuuaguaguuuaaauuuuaauuuaauguacaaugaccauauggcccuagaaaucucuauuuacccuagggcuguaagagcuaugcucacacacaaauguguguaugaacaucuauugcagcucuauuuccaguccaaaugucccauagguucaugguaggcaaacuauuauauacuuauguaccaggaagcuauuugucaguagcagggaaugagcuaucaauauaugcaacauggauaaauuuuaaaggcauuaugcugugaaguauuuauauguuguuuggcuuuauuuauauggcauucuagaaaagacacuauuauugcgauugagaacauaucaguggcuaccagggauuaaggauggagcaacgugugaccacaaagggacacacccagguagucuuuugaggguuggugaaacugcugugggugauggaacugugcugauucuucagugcaucuguucuuaaugcucauaaauacauauaucaaagaucacuuuuauuguaccaaaaagcaaaacagcucuaagaaggaccaugaacuaucaaacugaaacuacucaaggaaacaaacauuccaugaacacaugcuccagaggagacacuguuggugagguagguguguagccaagaauguuucccauaggaagugauguuugagcuagguucaaaauaauuacaaacuuucuugggcauaguccuggcaccuggugaaguuaaaaggccauccuuaguuaucacuuuaguuugaggccagucuggguuacauaaaacugugucaaaaaugaaaaaaaaaaaguagccaggugugguggugcaaacuuuuaaucucagcacuugggaggcagaggcaggaguguuucugugaguuugaggcaagcugguuuauacaguaaguuccaaaacaaccagagcuucuacacgaaguagagacccugucuuaacaaaacaaaacaaaacccaaaccuuggggcagcgacuucagacagaauuugcaugugcaaaggcccaggguaggaggaagaugacuuaauuuccuuuaaauaagagcacaaaagaauguccugggggcguggauguaauagugaaaagucgaaggccgugcagugagcagagggguuuguucuccucccgcccaggcaaguggguacaacccagggaagaguuuccaacuucucuucugggaucggaaacaauuaaccuaagaauggagguuuaaauacccaacuuaaggucccagcaagauauuuucucuccgcuagaagcaggauuggacuugcaguagccuaggagauggccuuguaucuucacuucuaaaggacucagaccccaggccauguuucauuuaccauaaaaucuagacugcccuguccuaggcggcacugcacugguucugggggaccaugacagcugaaugauacucugaggggcuuaggucuuggacacacgggagacagguuccuaccucuauucggugaccccugcaucuacuguuuguagaaacacucguggcaaucaucagaauauuccgaaaaguuacacaacagguucccgugccacauccuaacccacuucccuggcucacuugaauacacaaguuugaggccagccuaggcaacuuagcaagaccuugugucaauaauaaauaaaaacaaaucacagcuagaagacagaaccaauacucgaaucccgaacugcucaacgccagugcccuggguucauccuuagagggucugaaucacugugccuggcgucaacaauccugacagguaacccagguagcuucagggcuucaaucagccaauucucuuuuuaccuuuaacccagggaaaucgaggccacccucagggcucagguagcaaaggaccgggaagggucagauuucaauccgaagccuuugggagauuucgcaaaugaccaggagccuaggaggaaacgcaaccccucuaggcgcucugaggcgucgccuggcgccauugaccgguuccgccgucuggggggaggggggaugcgggcgaccccgcgccgcaagcuucccccucaacaaggucgacugcuucggcucggcuuuggcggacgcacaccgucgucuccgcgucuccgggccucccgaggacuuucacuuucccgagucgcccaaccucg

SEQ ID NO: 6715 - RNA, 3863 nt, Mus musculus
caauaaucccugagccuuaugcaggaguauaacuuuuugaggacccuccaugccgcccuccacagcagccgcaccaucuuaugagacugacugagcaguguggccugcugggcugaggaggcaccuaacuccauuuuacauuaccuccauguuugaaguacacuccgggaugcaaggaucccagaguccccaacauccuuugccagcucuccccauuuagcuuucgagaaaagaucacagaggcacuaaaaaagccauggcuacuuagaauaacccaacacaugggaauccauggugggucagcuucaacuucucacuaaucuuuaugaguuaagagcaccuaucccaacuauugaguucagacaggaaggggagggggggacuaagucugagucauuuacccaugucuccugccagaacugauggcucucaaccccacuucuuaguucuuuccuacuccaacucuaacaucaggccuauguauucucuucccccauuuccauacugaagagugaugggggaagagaauguuucaaaccucuaacuagugaccccuaaaaaaggccuugaagucacccuuucuuaccuagaaccugagaagggcugguacacacacacacacacacacacacacacacacacacacacacaccgcccaucuccucccagcugcgaugcacugugaccugugccucucuguaggcucacuuugugcuuucuccuuuaggaugauccacucacaaaccugaacacggccuuugauguggcagagagguuccuggacaucccuaagaugcuggaugcugaagguaagggcuuucuucacccucccccaccccagcccccagcagcugaggcaugaaaggagugggucuguccacugggaccucaguuugaagagcuugggaucccuccccugccggggauucugugugguucggaggaagaggcacuagcugacagcacgcaagcagcauagagcaaguuuuucuggagaagggaagguaggccuuccugcucuauccuugcccuuggaagaagcaggaaccauggccacuaucccuuaagcucuccuuaguccuaauguucaugugccuuuuacgugucuuagccucacagugaggagcugaagagagucuagggugggcaguguuggcagggggauuguccaagauugcccccagcucuguucuccugauaacccuuuauauuugacaauuucuucaagaagauuccaaacaugaacggaagcauacgaugguauaacaccuaccgucccaggaggacuuuugacauuccaucacaccuuuuuuuuuuuuccuguguccuuuugcugucuuuguuggacugugcugaaucucaaaccucaugucaccgcuaccugcuuccgaguacaugccuuaaagauaauggguauuuuugaauguaauuaaaauacuuucuacagaccaguuguagugacauguaccuguaaucucagcacuccaggguugagacaggaggaucaugaaucugaggccaaccuggguucuaucagugagacugucucaaaaacaaaucaacaaaaacuguuucacaccuagcaaauaugacagugauuccaauauauucuugucaugucaugugcaugaccagaguccccuaguuuaaaauggccacugaggguggguuggcugugcccgugcauauucuuagguggugagcucuauaggccacauucuccuuccuuuaaccccaucuauugaugcccuuaaccuugugauuagaggagagcugccagguaggguagccuugguugccuccugggguaucagaucauccaugccucugugacccauguucccguuacuggaaguugacucugaaagcuggcuagauucaggguggaccuucuggcaaggucacuucacaguaugccacaccccuugagagaugugcuaugugcucacuaagguagcuuuaacugcagcucuuucucugucucucuacagacaucgucggaacugcccggccagaugagaaagccauuaugacuuaugugucuagcuucuaucaugccuucucuggagcccagaagguaccuggggccccuacuccuucuaugcccagcacaccucaugccagauccuagccaugcuccugcccccucccuccuuccaucccuccauguuccagugcaggggucuggacagccugguucuggucuuguggguaguuagcuguguuucugaagaggucuuguuugccuccuccauaacucagcaauucugcugucucuuaccauccaucaguacugaaaacauaaagugcuaguccucugggaucagcuacaugacccaggcagaaggguggggugugugaaagguccugguugcaggagaccguaagccgaagucccaccccugugggauugacaggcuucacaguacugggggggaggggggcuuccguugggcugucguacacuuccucucuucacuuacccaguuugcaaaggugucauauaccuucccccucaggcacgauuuaacaagucugucuccagccuugagcccuguccugcuugggauccccauguggccacuguccacuguguucuuagacagcauggccugugggaggaggggagaggauauaagcggcagugaggccccuucugguacccuggcccagaaugcucugggaggcagaggguauaaagccagguccgguuccugcugugggcauuggaaaacccaaaguugucacucacuaccaugcuuaacuagggcagcagaugucccucccagaagcagcacauggcugugaccacagaaaccuucauggcuuuggucccuaggccugccacauguuccucgugaccucugagugaccugucggaagugcaugaugggagguucugcccccaccccugccucccuugcucauuucccugucugcucacugucccuucuggcccgcuccucuccuccugcgcccucaccuucugucucgugcucucugucugcugcugcuguuugaguuggcucuguacugcucuauucucuccucaaccucuucuccuucucugugcagauguguaggcacgcuaaggccggaggggaaggccaugugaccuaauguuucaugucacugccacgccuucucggugcgcagaaggugagcucgcccuuggccuugcccacucucccggcugcccuuuggcccaucuugucccccuccacggacagcaguaguaguucccgagugagaaagcguuagacgcucucagagcccugacaagcacacuuagggauggcagagaagcccagccucuuggcagccuuccuuuuuguuucggugaacacugggcauaguggacccuccccagaggggaaggcagacaagcugucagugccugaauccuaagccauucccuuaaauacccaugauuccugucacuucugaaccuuccuucuuccugcaugacuaaggccaucaaucuaggcagcagccagggcagggagaggucuucugccuucucccugaugucuaggccagaguccugaugccacucgccagccaggccuuucauggauaguuaguugcaaacaauauaagaauaccacuugggugccauagacuguggagcuuugagcauucauuacuaaaacuacccugcagagaacagggaagcuauucuuuuuucuuuucuuguuuuuucuuucuuuuuucccccauuggucuuuuuguuguuuuuguuuuguuuuguuuuuuguuuguuuguuuuuuauuuguuuuuguuuuuuaagacagggauucuuuguguagccuuggcuguucuagaacucaaugcguagaccaggcuggccuugaacucagag

SEQ ID NO: 6716 - RNA, 2676 nt, Mus musculus
aaaugagguugguccauuaggccucugcguguagcacugcccacccugguuggggccaggaguuucugcagugggugucccuuuggcugccagcuucuccuccuuccuugcugaauccugggggcacugcuaaggagaugaucuuucugcggggaccuugcaaccuggagagaacauaguugggcgguacaugguggucuguggucugcggugaugcacagaguugcugucaagaauuuacugccccccucugcuguucuucaagcacacauuggcaccagucccaaaggucccucaggagcaccugaaaagguggggccuuggguagcuuuguggcuggaggcagggaggagagagagagagagagagagagagagagagagagagagagagagagagagagagagagagggagggagagggagagagagagagagagagagagcccagaguggagccagcccuccuccccagcccugucaugguuuguggugguggugguggugguaucuuuuuccuucuuacuguuaauggcacccucacuacguggcaggcacuuuguaaguugguuuuuaaacccuguggacuuggaaguaccuugcaaucccuauuuuacugccaagggagcuggaguuccgagaacaguggauucagaucugguucacaggagagugcauucuuaacauuguauuacuccacaccccccaugccugggcuuuauggcuacugcuuguaggguucuuuaauacuuuggauggguucagagcacugagccuugaggcucuggggacuagggcuuuuauugacucuuccuugcaaagcuuauuagccccagagcuuuguccuggagaccugaacaaacacagguguuguuuuggccaccacagcuuccccaggaagugggguuugauagcuccuuucuacagcccuucgccuuucacaagccaucgucuucuuacaacagccccuuccucccucaguuccuccccccucuucaagacucacaggccucagcugggcaacuccaguuugucuuccaguugcuagcacuggccaguuucccuggaagcuuugggaagccuuuggcugaggguugaaggggcuaaagguuggaggaugggucuggacggggcuuaagaacaagggguuggcagaggcaggcagauuucugaguucaaagccagccuggucuacaaagugagcuccaggacagccagggcuauacagagaaacccugucucaaaaaacaagacaaaacaaaacaaaacaaaagaacaagggguugggagguggugaucguggaauaagacacucccaucccuggccccagagaaugugcagugugguggcucggguccaaagugaaguauggacagguggcaguugggagagauuguguagaaacagaguaacuguacuuacuuuaaagaucuacacauucuguguaauauuugaaauguaacucugcggggguggggagacaccuggcgggcccaugccaagaugcccuccugagaaaucacaacaugcaacaaaccuaauauaagggaggcuugggagaaggaaaggaagagaagggguagaggcagacagacaggagcagagccaauggggcagauaaugggggacaaagaacagaugggggcggggggggggacagagacaggaagacuggcugggaacagaaaaagaaaaacaucugggcuggugagcagucuuuucauucucacccaugccuggcagcagcagguaaagacggcaggugaugauguaagcugaugauguaagccaaugacauaagcuugcuagguuccugggaggagccuagcggaaguuccuguaagccaacauuccuccuuucuuauuuaauuaaaaaugaguagcuaggaggggguaacgguggggcaggagugagguuguccuguucucuagauuacuuccugaugacugggggugacaauggcuuuggggacccuaagaaaauuggagugcuggcugcuucacugcuguucaggauccaugagaauaucugcagcugggaaagugcaggccccguugaaguaucugccaggguagacugagcaccugugaguagcugcccuggagccguccuggaugcagaugcugaguaaacaccuggaccuggcaggacgauggggcagacauauauacuaagggcagaggauaaguuaaugugaccauauggaacaaccacacuaagagugacuauggauucugcugaguggguggccaccuucccuggucccuucacguggcuuauacgcugaggauggcccaagccuguugaaggccuuucguagaacaacuguuaagaaaguguggggcgaggacccuggaagccacugaggccuggggugcgugccucagagacuacgguggcccaugaggagacugaccaucugccugucuucccuuuguauuagacguucacagccuggugcaacucccaccugcgcaaagcggggacacagaucgagaacaucgaagaggacuuccgagauggccugaagcucaugcugcuccuggaggucaucucaggugagccggccccagcccaggacccggugguaucucuggguucuguccacguucacacuggccucccugggcaccaggcacacauguggugcauucgcauacaugcaagcaaaauuc

SEQ ID NO: 6717 - RNA, 1195 nt, Mus musculus
cccgaggaggucgccaaacccuccgacaccggcucugcccacugucugcagacccagcucggggcgcaguagucggggcagcuugccccuaugguacagagccccaggggcggcccaggaagcgugcugccaccgcacgccauauggaggcgccaggaaaaagaaggaaggagaaaaucgaucccgaguaagcagccauggagccuaagucucagccccagccucuggagcaucgcccccgcgccuugcccacggggagacaguuucggcugcaccgggguggcccggaccacccgcucugaggcgauuugcccuccggcggcgccaccuccccgcgccgcggcgaacuguucgcgggcuccagggcaggggugcuccgcucucccgcccggugccuguaacucaauaccccaccucgcaguggccgcgauguccccgccuccgcucuugcgcgccgggaauugguuuccaacccggagcccaggagugcagcggccagagcggaucagggcucagggcuguagcggguggggguggcugcuaaccuuccucugcugcuucucccaggccggauccaggagcaggucccgaucccaguccucuucaggcugcauguagucguuggucugcugggaaucauaaugguccaugauggugcgugcgugcuaggagcuggauuucuuccuccaccuucucuccaggcgacggcggcugcugcccggguguggggagggugucggcagggcugggcugggcugggcugggccgggcugggcugggcugggcuggcggggccgggcucgcuccccugcgcccgcuuccgccgcggcucuguucgcagaggcugcugcugccggcggcggcuggagcucgcggacugccuuccuggggcgcgcgcucggaccuaaucuccacgcacacugcucucagugaacacucgcgcugcgggagcagaggcgggcgggggcggggagaaggggcagagcccucccgagguucuccauuggccaggccgaguugcccaaacuuccccccagcgccucucauugggaauuccuggcauccgucaggcgggucucugugcauauagguggacugggcggcccccuccgggcgcgcacgccaccgcccacucccuggguucccacucccccgcagcucaugugacaccaccuuaagcugaaccggaguggag

SEQ ID NO: 6718 - RNA, 1195 nt, Mus musculus
cuccacuccgguucagcuuaagguggugucacaugagcugcgggggagugggaacccagggagugggcgguggcgugcgcgcccggagggggccgcccaguccaccuauaugcacagagacccgccugacggaugccaggaauucccaaugagaggcgcuggggggaaguuugggcaacucggccuggccaauggagaaccucgggagggcucugccccuucuccccgcccccgcccgccucugcucccgcagcgcgaguguucacugagagcagugugcguggagauuagguccgagcgcgcgccccaggaaggcaguccgcgagcuccagccgccgccggcagcagcagccucugcgaacagagccgcggcggaagcgggcgcaggggagcgagcccggccccgccagcccagcccagcccagcccggcccagcccagcccagcccagcccugccgacacccuccccacacccgggcagcagccgccgucgccuggagagaagguggaggaagaaauccagcuccuagcacgcacgcaccaucauggaccauuaugauucccagcagaccaacgacuacaugcagccugaagaggacugggaucgggaccugcuccuggauccggccugggagaagcagcagaggaagguuagcagccacccccacccgcuacagcccugagcccugauccgcucuggccgcugcacuccugggcuccggguuggaaaccaauucccggcgcgcaagagcggaggcggggacaucgcggccacugcgaggugggguauugaguuacaggcaccgggcgggagagcggagcaccccugcccuggagcccgcgaacaguucgccgcggcgcggggagguggcgccgccggagggcaaaucgccucagagcgggugguccgggccaccccggugcagccgaaacugucuccccgugggcaaggcgcgggggcgaugcuccagaggcuggggcugagacuuaggcuccauggcugcuuacucgggaucgauuuucuccuuccuucuuuuuccuggcgccuccauauggcgugcgguggcagcacgcuuccugggccgccccuggggcucuguaccauaggggcaagcugccccgacuacugcgccccgagcugggucugcagacagugggcagagccggugucggaggguuuggcgaccuccucggg

SEQ ID NO: 6719 - RNA, 40095 nt, Mus musculus
uuuaaacucauuuuuaaaaaaauuauguauauagguguuuuaccuacauguaugucuguguagcacuuguaugcugggugcccagaggccagaagaacgcacuggauuucuggaacugaaguuccugugugaacucccgcgcaaaugauaggaauagaacccagguccucuggaagaacagacagugcucuuaagugcugagucaccucucuagaccccuucuuuuguuuuucugagacagggugucauucuggaguccaagcugaccucaaacuuguagugauucuccuuucucagccucccaaguuccaaaauacaggcaugaacuaccuaccacuucugaauuaucucauuuuguuuuacuuacugguauguucaauggugagguucugugcuggggaaugaaccugggccuuacuguaugcuagcaagcacucuucuacugagccguaucuuuagcucugguuucugauucuuauccaggacuuaauacccuggugaccugaggagucagaucccaacugugccccaacauguugcagccugacaagggagaccuuggagaagcaaaauauaggaaaucaauccaacucaaaauuauccugaaccacacacugugcuugaaauaaugcugacuauaaacucagcagauuuuuuuaaaagggggagauagaguuuauuuagcuuauaauuccaggacaugguccauuauuauaggaauguuaaaucaggaacugaaagcaacuacuuguaucuaaaguccaagcagcaagagcacgugcaagaugcuacuuugugcuugucuuacuuuucuucguuuuuaaguaguccgggauugcaaaaccagggagcggagcugcccuuagugggcacuguucuuccuacauugauugucauaaucaaaauuaucccccacaacccugaccacaggccaaccugaucuggacaaacucucauugggaugcuucccaggcugugucuaauuuuuuguuuuguuuuguuuuuguuuucgagacaggguuucucuuuguagcccuggcuguccuggcacucacuuuguagaccagguuggccucgaacucagaaaucugccugccucugccucccgagugcugggauuaaaggugugcgccaccacgccuggcuaggcugugucuaauugacagugauaacugucacacucacuaugucauuuuuuuuugaauucugacuaauuggugucaaccugauguuacaccugccccuggccccuucccaucuuuucucagccaccaugaggaaaacagauuuuacauacccucucugcuaugaucaucugccucacuguaggcccaaagcaaugggugauauugagagaaaggcagcuaguuaccuuuucaucaagggagagaaaucccaggaaauggaaauuaaguguuuuagguucaguuuggaggauguacuaccuuucacaauaaaaaguggccuugagggcuuggagagauggcucagagguuaagagaaccgacugcucuuccagagguccugaguucaauucccagcaaccacaugguggcucacaaccaucugugauaagaucugaugcucucuucuggugucuuugaagaaagcuacaguguacucacauaaauaaaguaaauaaaucuuuaaaaaaaaaaaaguggccuugaaggcaacauauacauuagcaaagccacaaccuacgucgcagaaacuagguuauagaagcauuccuuagucccauauagagaaagucagaucuugauuaucucuaaaacaaugauccauuugguccaguuacccagagcauugggaccaccaaucagagacggccauaaaguaacaaggaaaugugaucagugccuuuccagcaugucaaauggcaugcggccucagcgggucaccacugcaucuccaugcaggaggcaggaaagggugcugcugcugugggucauggguugucugcuggcaucaccaucacugugcuccaggacugggaugggaagaguccaacauagggaacuuggcaagagucagaagaauaagcuagauccaaaauaaaagcugaaguaguuuuauauuacucauguuguguugucuuagcaagauucacccucuuucuagccucuuuuugcacauuucucucaagaaaaauggauuuuuuuuaagaucuaaaaauuaccauuguacaauuuuugaaaacaacaacaaugugggggaggggggaaucauuuauuuucuuuucgaugcaaaagcaagaggcuuauuuuccagcacguuuggguugaccuucaauuagucccucaaggcaagugacuagaagggccccugccccuccccauucguuucaaauacauaauaauuaguaagcuaucaaaucuuugggggaaauugcuccccuggcuccacuugcucacucccauucuuggggagugucccuuaauaaaccaugagaaggcucaguggcucagugggaagaggaaacuuagcaccaugccagcuggaucccagggacucucacagcagaaggagaggacuauccugagcuugucugucauacaugaacccaugcacauacaaacagcccauauacaaaaauguaaaguacauuuuaaaugagaccuagugaagaaaauuaaaagauaaacaaauggaaaaaaaauccuggaagcaagguaaaucagaauucaauguuuaaagaggucaaauaagaagcuaaacugaaguagucucugccugcuggguuccuaagagcugagaauggggguauuaagcgggcuuuauuucaacaaaacacauuuugucaucugauccguccgugacauggguaagaauaaguaacuuauggcuguauucuuaaaugguagaaaaucccuggaugugugcuucauucacuuuacaauggcaaguuauuaaacacagaucuauuuucauaaaagaauccaucuauaaccuuauuuuaaaauaaaaaaguuuuuaauugaaaaauuuacauuaaaauuuuuuuaauaaacuauguccaaaaaaaaaaaaaaaucacugacugcagaagcagggaagggaacauaguaaugaagaaugguagacaggaggaagcaagaaggggcccaaagccacuaacacgagagccagggcauacaggguccaucccaauucacagaauagcucaauccauauacaggacgcuuggagcuaaagaugaacucucuaagguguaugcuacucccaagcuaacaucaauuagugcccacugcaacagugacaccuccccucaacuccaguuuccagaguucuaucuuaaagaaauuaccaaguacagagucagaaauauacaagaaaguuuaucuccauaacuggcaaugaaagauucaaaacaaccaugcuuuugaacagaguguggagcuacauaaccaaauaagagcuacuggaaacauguuaacauuaauauucauuggucuucuguuguuuuguuuuguccugagacaaggguucacguagcucaaauagucuuaaacuuacuauguagcugaagauaagccuaaacuucuaaucuuccugccucuacuugccaagggcuaggauuauagccaugagccagcacacuuuagaacuuuauuuucaaagacuuaaagauaaaguaaauuacuuggugaugccauauuagcaaaugggaaaaaagccaggaugcauacaaacaucagacacacacacaggcaugcacacacauaugauaauuuuaacuuuauauuuaaauuuaaauauuauacauauacauauuuuaaaauacugauauuuuuucuuuugagacagggucucuuuauauacuucuggcuguccuggaacucacuauguaagccaggcuguccuugaacucagagaucuaccugccucugcuuuccaguacugggaugcugagauacugggaugguggaaucaaaggugugugugcgccaccaaccuggcggaaugaagauucuuaagcacaucaccaaagccuagcucuguuccaaacggaagggagauggaccacuguuacuuuuccuuuaggcucuucucuaaugagcauguacucauuguguaauccaggcuagcaucaaauccgacauccuccugcuuuuuccucaugcauagagacuacagaaaagugcuauccacaccuggcuuugcguauuuuauaucagaaaaauagguuuacucuaaaauuucucauugaagauggcaacuuucacucguagggaaaggcucaaaauuucaagauagacucagacuauagauuccaaucuacacagcaaugcucuucugaaaagcuaaaaggacauaaguugcacagacuagcuuucccuuugcugauggcucucuuacacuggaccuuguggggucuccacuggagugcauagcaaccaguauaccuuaauugucccucacaguauuucucacuucuuccuaugcaaaucaggaggacuaggagaacccaucucucuuguuccagaaaaaaaguuuucuuauaaagcuauagaagugacucaaaauuagcuacaaauauuuugaaacacaggucacaagucauauuaaaugacuacguauacaaaguugcucauuucuugaggauggauauaaaaaccaaucuaugagugccaucuuguggaagccugacaacuaccauggccaagaaccgagcuggccucccauuccucuuugggcuuuuucacugagcucccacagccaggugccgcaggcuuugugauaaucuacuauauuaaacauaaauuucccaaaagaagcugguacuauuuguuuauauggaugucuagacuugauccagaaacgccugagaggacaggugggaaggcagggcagaggggcagaguguaaaacgcacaaguguuuguggacugcaaacccaucccaaaggcuguggugcaguguguaugguguauccaugcuauauaaguaucacaguacugccacgaggcagggacucugcagaagaaguaguaacucuccccaaaauacuuacugauuucauaacguuaguaagaaaagcuucacauuuacaaucacugagcuuugugcuuugaaguuguuuuauuuaucaaugucagaucaguuauaagcaacuuggguacaauuccaaaauagaacucuuguuggauucugggcauaaaauucuuuucaaucuuguuaagaucuuauaaaauaagaaaguuuuccuaauaguuuagaaaaaauucuaauugcuaauaaauugauuucauacucaaaguaguagucuaacauuuugaaaggugaaacauuacccuuuuaaacuucuauuguaucagauaauuuuagugucucaggcucuaggggaggcgaaguccucauacugaaaccuggccaaauggcucugggagugaauuaaggacuaaggagagguuaguauugcaugaacaugaacaccaaaggaagugggcgcagacucugagaaaucaugguccucagaagcaggacaagagacaugcaaccagaggagaggcugagccaugugucaaagcucuccugggaaagggucagcgcuugucagcccagccagcugaacacccauuuccagaaaaggacuuccccugggacagggaagaagcccauagcaagcuggccuuugguccuguaugcauugaaugagaacauuuucaagcauguaaaauaaauccaaguaauacaguuggaaugggccccaaacaaauacauaugggagagcaagaaagauuaaaauagugaggcugaacugggaauaggaaagugacucuugggucacuucuucaacucuggaaaaaguucucccuggccuggaaaaaccaaugcagcagagagaauuacaaacgucuucccagggccugacaaguuacuucagagaagacuucucccucuuaggaaaagcagagagggagagugaaaaugaaggccaagcuucuuuugcacacaaaaauaggagagaaaggaggagaaaagaauagacuccccaacuaaacucaaaaccauaagcuccccuucaaacaacagccuugcuccaucagaaguaccaggggaucaguguagguuagcacucugagcugaguuaccagggcuucccccauuaagaacauuaaacaguaggaggugauuuugaccuuggcuccugcuuccugccuguccugaccugcaggcagcagcagucaugacagcuugaugggaaggucauccccguacuuucggagcagcuucugaugguugugguccacugaccacugcuggggcaggugcuuaggcugcauggaguccaggaagugcugacgccagcggcucuccagcugcaugagggagcgcagcccacccucggugugacgcuguaccaccuuuagcccaugaggaauauaacuuucauuguauauccugccaaaacaugaagucguaaaggguauaagcuaaacaaucacugggcaaucuccuaggcagauaaagagauagaccccaaaggacacuguguuuuaaauguuuuuaaaauaucuuuuuguuuguuuguuuguugagacaggguuucucuguguagcccuggcuguccuggaacucacucuguagaccaggcuggccuugaacucagaaauccaaccugccucugccucccaagugcugggauuaaaggccugugccaccacgcccggcaaaauaucuuuuuuuaaccucuauuuuuuucuuuuucuuuuuuuuuuaaaaaagauuuauuuauuuauuauuuguaaguacacuguagcugucuucagacacuccagaagagggcaucagaucucauuacggaugguugugagccaccaugugguugcugggauuugaacuucggaccuucagaagagcagucgggugcucuuacccacugagccaucuuaccagccccucuauuuuuuucuuaauguguaggauacaggcucaaacuggagagauuuggggguuuuaaguuauauuuaugggaaggucauauauacuuaucucuauagggaaaucuugccuggcugaugauagguuagaaauauugaucuuguauuuguugguucgaggcuacucagggaacaacuuacuucucuguaagccauuaauuauuaauggcugauuucucagaauacuggcagaccuggguguaaauuucaaggugauccacuucuuuagugccuucuuccucacagaaagcaugucagaccacacugguaaggaguguguuggucaccaugagaguuccuauggcugucagcuaugcaaacaguguacagcagaagauaacaccccccacccccggggccuaguccccagcuagacaggaaaccaugaaaacuucugguacuaugugaacagagccucccacaacuucacucuaccuccuucaagaagugaaaccacauuucucaaaaaagucccuugcuccaagcuucuuuccucucccaacaucuauauuuccaauccuucauccuaaacucccccaccagcucagcaacuuugggcucuccaaacaucugcagguguuucauauuucccacuguuguuuugggguuguuuuuuuguuugggcuuacuuuuuguuuuugagacaagcucucucuagguagcucugccugaccaggagcucauuuuguaagccaggcuggccuucaacucacccagauacaccugccucugccuuccaaauaccaccaaccccacuaguuucaaucugcccccaaacagcccguucucagccucaaucuauccucuaacucagcagccgacuuauuagaaaggucuaugguuagcuggacguggugguguacuccuguaaucccagcacucaggaggcagaggcagacggauuucugaguucgaggccagccuggucuacaaagugaguuccaggacagccagagcuacacagagaaacccugucucaaaaaaccaaaaaaaaaaaaaaaaaaaaagagagagagagagagagagauuugcugaucgugagguaucuguugacucuauaagaucacgugucaaauuaaguggacuugggacuaaugauuuuuuuauagagguaaauccuaaaaucagcacauaagaugaaaauaacagccaauuaauaccuuggaauaccuuaauugccacgaaguggagcacaugugguucugugucucacaccucacaccuagguuugugagacuugugaccagugcauucauucgcauuuccugucucacugcgcuaacuguccagauccacugaauagaaauuugagcaucggcuuuccuauuuaauuuuuuucuucuuucuuuucucuuuuccccuccuucccugagaguucauaguugaauucauagauauaucucaguguuccuaaacaagaaguuuacaauccuggagcaugaaugaacagguacauaguucaacaauaagaauugugagugacuaugcagcuaucaguuuagacaaugaucgaauugauaggauuagauguccauuaaacucugguaaugaggcuaaaugcuuacaguguuuuguuaucaauaauaaaaaauguaaaacuuuauuuauagcagcaaauaauuauuucuuuauucaagaagugccugucucacucacacuacugagcagcucagacagcaaauaucucuuaagcagauacuagcaccacacuaaaaggcucuauuaauugacuuuuuauuucuaauagcaacuuaaugacuuuucaucuauaucuuauauuucuaauuguccaaaguuuuuaagaauguauuuuuaaauuuuauucuacuuuauguagucauagcguaaaaguuacuuucuaaguuuuaauuaaauacugugagguuaaaguuaaguaacuugucaagaucacauuacauuaaggagauugcuuuugaccaauuuccaaaugaacuucuuaaauuguuuucauuuauuaguauguauauagccacaaaugcuuguguuuggguacacaggguuacaguagcauguguggaggucaaagaacaacucuuagaaauugguucuuuccuuucagcacaggcccaccagggagccagcucaggaugucaggcuuaugcagcuggugcucacgucuguaagccagcucagugacccccagaggagcuucuuacaacagcugcccucugcccugcagccacaggccuuucuuuugaaaguucuauuauuuuauuuaauuacuuauuugguuuuucuuucuuuugguuuuuuaaaauuaauuaauuaauuauauaaguacauugcagcugucugagacacaccagaagagggcaucagaucucauuauggaugagccacuaugugguugcugagauuugaacucaguaccuuuggaagagcagucagugcucuuaaccucugagcuaucucuccagcccuuauuuguuuuuuuaagucaggauugcccuguauagcccuggauguccuggaacucacucuggaaaucaggcuggccucgaacucagaaaccugccugccccugccuuccaagugcugggauuaaaggcgugcaccaccacgccuggcagcaaaucucuuuuuuaaaaaaaaaucaucacggggcuggagagauggcucagagguuaagagcacuaucuguuccuccagagguccuaaguucuaucccuagcacccacuugguggcuuacaaccaucuauaacgaaaucuggugcccucuucuggucuacaggcauacaugcaggcagaacucuguauacauacuaaauaaauaaaccuuuaaaaaaaaaucacacuuucuuuaggaauugguguguguguacaagugcaugcaagcauucacaagcacgccauggcaugaguggagguuugaggacagcuuuuagaaauuaauucucuugaucuaucaugcagguccuaggaauucaaguaaaguugucagacuuggcagcaagugccuuaaccugagccaucucgccaucucgccaucuuuuuuuuuuuuuuuuuuuuuuuugguuuuucaagacaggguuucucuguguagccuuggcuguccuggaacucacucuguagaccaggcuggccucgaacucagagauccgccugccucugccucccaagugcugggauuaaaggcgugcgccaccacgcccggcuucgccaucucuuaugaaaaggaaauucucagauuguuugauucugacagacaguggauuaguaagcacguggcuaagcacugugacugugagcagcauucucaugaagccgugaaagcugauguuacugagucacagcccauccucucugagcaguaugcuguaccuggucuccaggcuggcggccucgugaagcaucuccucuguaauaauaucuguguuguaaaacucccugagugcgugcagcagcucuucuuuccgaugagcagguaggcucucugcguugagcagggcucuggcuccagaacgcaccugucuccgcucuaagucuuccagcaggcguaggcccuccucugagccaaugggagccuggaacuccuuggccagcuguugcuucagaugguugucauaguaguuagagauggcauggcaggaggugcagagcaacagcacaucaugggaguugugguccuucaucucaauagggaaaugcuugcgguacucauguggaauuauauuuuuccuggaaugagcccaccccaaaagcaaugcucauuaccuuauaauacagagccuauauggaaccagcaagugagauacuggaaggcuugggcagcacaacucaacagaguuuacaugaaggcaauacuaccuauaugaccugcuugccuuaucuaccugcgcuuuagggucuucucccuuaaaguaagugcagacuacgugcugugaggcuucaacggcaggggcugauaacaacuaccguguuccuagaaaggagacucucagagaaaugaaaugguauuauacugacuuuugauaccugcacaguaaaucucaaagacaucuggugggcuaagcaaaccaauuuccuuuaucugaggacucuacuacuuugacaucgcuuccuggcucaccaaggugugucaucauuuucuaagcagaacuauacgcaguggcaacaguugucucacauagcagagcaaggagagagggaagugaaccaguaaagaguagcaugguggcacaugccucugauuccagcuuggaaggcuaagucagcaggacagccacccccaaggcuacacagcaauacugucucagccaggcuauagugguacacgcacgccuuuaauccuagugcuuagagaggcagaggcaggcagaucucugaguuuuuggucagccugaucuauagagugaguuccaagacagucagggcuacacagagaaacacugucucuaaaaaauacauaaguaaauaaaauaaaagaagaaauauucugccucaaaaugagaaaagugaucucugaaaaaaauuaagauuaagaaaaagaaaauaagaguaacaccagaaaauaacaaaaauagaaaaagaaaaaaaagagaguaacaaaauacaccaaaaugauggaaggaagagagggaaugggggagcaaggagggagggaaguugagagaaaggaggagagagaaugacuguacgggggccggggcuuggggggaguaugcaaauccaguggccagccucacauccacugugggaacccuaaugugaaaggacaaccuugggagacucuauaaccaacacuacaguucagaaagcucgagagcuucagggagggaucccaggauccagcuucaaagucugcuuuaggaggaacagaggccaugagagacagcagguagaaggcugaagcuguaaggaaaacugcgguguauguagaguaagacucucugccauugugggaaaacucaaccagggcaucugagggcucaacauaugacuacacaggcaacugccacaggaggcagauuagucuaauaccauacucaccggauguagguaucugucuugccacagacaacacacagauucucuuuaaccaucaaguaauaaucuccuggggacucaggucuuccugcagguucaaacuguagccugaccacaaaagguucuuuacucaccagcucuuaggaaaaagagaaugcaucagugcugggcacucccaagaagcucucuuaacuacuguucuuugugugcaagcagagaacuccagcuuaugacuacccagcccgaacaucucaagcccuccuggucuuccugcagucucccucuuccacacccuacucacaacaagacccuauguauaaacaagcauggcagacgagucucacaccuccaaugccuuuguccagguaccacugagcuuuccugcggucacaggugcacaagggcuguccaucaggagcuuggaggaagcaguuaucauagagaggggauuuucugcagggaaaggaaaucucaugcugaaagcuguuggucaagcuucccaagaccuuuccacacucuuuucugaaugacucaaauuauucacaacaucaguaucaaauauaauacaaguagaaaaagcaaacaggcaaaaaaccacacucgacucucaaucuguauuggcuaggaagcagagcuacaaaugauaccuggaauucuuauccucauggacugaggcacuggcaagugaguuaggugguauucacagaguucugcugugaguguaaacaggaacagagcaccaauaaacugcuaaaucacugaauucaacacuaaauuaaaaugguaagaguucaauauaaagaaacgagggccacguggguugauuacuggcucccaugcaacguuuccuucaacuuaaucaucuaauuucuuaaggugccauguuccagggauugcacuuccacucaaagcauccuccucgagaggugucagucacaugggagauucucacuagcuacacaauaaaguuggugugaggcugaaaucacgcuaaauuaacaaggaaucuuaaggugcacuucuccugcuaaguaugaggacuucauguucuucauguucauagcugucucaaacauaaaauguacaaccccuuaaauauuuuauuauagcuuguuuagucuggaggaggggcacacaugugcauguggagaucagaggacaacucugagagucaguuuugucccucuaccauguggguccggaagacuuaacucaggccauuagguuuggcggcaagugccucuaccugguaagccauuaaaguuacgggccuaagguugcagguugcacuaggguuggugacaaagcauggguaaauacuuucaucucuauuccaacugacaaauagaaaagugagcaaaggggaaaagaagaagaagaagagcacaaacagaagcacagcgcaaaugucauaaagguccauuaacgcugggucucugcugccugacucaggguaaagcugggcucuaacucuucaacaucagggaacaugcggguuaccuggcagaauagcccacccccaggggcuuccucuuaugcuuccuggggucucucccuugguuguugccuggcaccauucuaucagucuuagccuuccuauuucucggcuucagcugcgacuccagugcuuccccauuaaccucuucaaccagccggccaaguccuuugcuucggaaugggaugucuaccauauuccugcaucucuccaaggcuuuuugccaguugauuugguccguacuuuccucuucauaggaaucucuagagaaaggguauccaagaagauggagaaagagagccacugaaaucugcgcaucccuggcagcauaaguuaccugaagagaaaagccagaggucagugggauauggaagacaagccaggcagaguaccuucaaacucaauuauaaacgcuuuggaauaccacgcaggguagcuuuugcuuaguagcauaaaaccuuggguuuggccaaacagugguggcgcacgccuuuaaucccagcacucgggagucagaggcaggcaaaucgcugaguucaagaccaggcuuagucauuaagauuuauuuauuuaauuuaucugaguacacuguagcugucuucagacacaacagaagagggcaucggaucucauaacagaugguugugagccaccaugugguugcuggguauugaacucaggaccucuggaagagcagucagugcucuuaacugcugagccaucucuccagccccuagaaaauaaccuuaauaaagccauuuuucauucaccaccaccacuaaaaagaaaaaaucagaaaacaaaacaaaacaaaaaauaccaaguuugguggcacauacauuuaaucccaacagaggcaggcauuucucugaguuugaggcuagccuggucuauauacauuuccaggucagcuaagacugcauacaaagauccugucuguuucaaggcacaaagaaguaacuuacucaggguuacaaaaaaacagaaacugcuauggaaaacaaacuagauaauucauugccuagaauucugccacagguuuguauuaaccuaaaacacaaauuuuccuaaauuuucccuaacguuuugaaaggaugaacuaguaacuggcuugaagacaacugaagguugagaccuagacagaauaucugagaaaggucaaugaugagauggaaaugaccggaagaaaccaaaaccagaaccaaaaccaaaccaacuuucaaacacuuaccaacuguguucugcacaacagggccaagaaacuaccucuuccagcaucaaaauaguacagauguaaaucacagggguuggagagauggcucagugauuuaagagcacuggcugcucuuccaaaggauccaaguucaauucccagcacucagauggcagcucacugcuguaacuccaguuauagagagcugacauucucacacagacauacaugucagcaaaacacuggugcacauagaauaaaaauaaaugcaucuuuucaaaaaauuuauaucacauaauggcuaaacugaaggcccuacagacagcuauacaaaauccuaaaggauuaccucuaaggguaaaagauuaaaggauuccuuucuggagacacaagcagccagagggacgagaugcugaaagcuucuaagaaaguguuugauggucuaggaagguauuuugauguugauaaaugcaaguuaugaaggauuuaucuuuuuuguaaacuuaaaaagauuguuauaagcuucaggaaagacacuugagucaaauggauucaagaugaguacugucaaguaacgaccuguuucccucccuaccugccuauuccuggggguaggguaggaucuauuucccuuacccugguccugggacccccccaccccuccuccaauuaccaagaccauaggcccaagaguuucaaaauacacacccaagaaaaagguuuucucauaaacuccuuaacuuucucuccugccccuaacaucgagguguuuccucagagccugcauccaggaaagcucuaaaccaguuauucacacacaggugcucuggccuagccucacagacugcuucaacugggccuacacagcccuccccccagacaggccagucuggacagcagugaaacaaccaguucuuccuggacuuggcccacaucccauaacggugccccaauguuagcaggaaguaggggcugggauguuugguuuaggaccccggacaagggacugaggugcauauuuuacauaucaaagcagaccuggccuccauguucucccagcaucccucaguuccugucuggcauacccugcacccaacccugaacuuuacagcccggggggauccucccucuguaaacuagacauuuggucucauuuuuuccuucucggcucucucucuaugcacucuugcccuuucuccccccaacccucaccucucucucuucucauggugacucucuuagccucaauccuuggggccagugaacuugccacagagcagcuuccuaauaaaccugcacuuaauauauuccaaucuggcuugaauuggcucauuugacugguggcagagaaauaaccuaucagauacacaauuacugaccccugacuaacuacagcuacugaaaaggagcccaucagcccccaaaguccugcuguaacugcucuguacucaacccacuacuuuuguuuguugguucauuuuuguuuuuccaaaacaggguuucucuguguagcccuggcuguccugaaacuugaucuauagaccaggcuagccucaaacucaagauauccgccugcuucugacucccaagugcugggauuaaagguauuugccaccauuguucaacccaauucacuugaugauuuuuaaacauuaacuacugcaaggugguggugccuuuaaucccagcacucugggggcaagggcaggcagacuggaucgcugugagcugaagggcagccuggucuuguuugcugacaacugacccaacagagucaggucuuugugcuuggagagcucucucuaauugguccccaccuuuccuuccaauuuacuagccaacugggauuaacauuuaaaaaggcaacccuggguccagagagauggcucagcaguuaagagcacuaucucuucuagggguccugaguucaauuccuagaaaccacaugguaucucacaaccaucuguaaugggauccggugcgcucuucuggucugucugaagauagcuacaguguacucauauacauaaaauagaaaacuaaaucuuggcuaccaagagcugcuuuuauuuucauuaaauauguccucuaucuucugcuuacuccuaauuguguaccucaauauucuuggucaggagacaagaaccagacaggaagccaggcguggugguacacaccuuuaauuccagcacuagggaggcagaagcaggcggauuucugaguucgaggccagccuguuauacaaagugaguuccaggacagcuagggcuacacacagaaacccugucuccaaaaaccaaaaaccaaaaaaaaaaaagaaccagacagacaagaaaauuuccagcaguuacagcugugagccacccugcccagcuccaugugacaugauucuaucaauauucauccaugcuaaaguugagaaacuggcacaugagaaggagcucugaggaaaaagaggugaugcagggaacggaaggaaagcagaaacccuucccacucugugucaacagccugcagccuaagcagagacagaagcugucucaauagagugugcucagggugcagcuaaaggugcuggcucggcagcuuuccuaccagaccugugggaaagccaggggcagcuacagugagucuguauuccuacaacucccaccccaagacacgagacagaggcaggacacuaggagacugucucaaggaucaaugcgggggauccaauaauccaaaaagaauauguucuuuaaaaaaaaaaaaaaggaggauaguaaaugucaaagaaaauaaucuggcugggcgugguguugcacgccuuugaucccagcacuccggaggcagaagcagguggauuuaugaguucgaggccagccuggucuacagagugaguuccaggacagucagggcuauacagagaaacccugucucaaaaaaacaaaaaacaaaacaaaacaaaaaaaauaaucugaggauucuuuccugaacuggagacaagaacauccagacagaaaggguccacuaaguccuacuacugugcauaaaaucuggccucuacucauguuuagcaucaaggauuucacacaaggaaggaaagaacuuccagaaagaacagucacacacucaaauguucaaaaccagaauacaaggaguacagccuuaaaaguucugcaagaaaauggcuucugcccuaaacugcuauuaggcauacgacuggcuaagagagggaacucacuuguccuuucagacaugcaggguaacaagaggacagagccaugggacuuagacaaacuugggauccaguauggaagagaagugaagggagccauggacagacagaagaagcgaguuucagacugcagugugcagcagaucugcagagccaauaauccugagcagaaaagagcugcaggaagacagcagagggccauagagagacaauggugggucggaggaagagagcagagggcagagccauaggggaauaccagagggcaaaaggacacaggaggacagcagagggacguaaggacagaaccauaggaaacugggcauguguguuuagucucucaaugcauuucagagagucaagagcugggguuaagucaguagugugcagaaaacuaagagaacaaaaguacaaaucauauauccugggaaaacaaaguauuauucuugaugaacguggaguaucuauuuauacugcagagauguguuagggaacaaauucuuguuugagacucaggaacuggaagaacccuaagucauauauauguauaagaagucaaaacauacuacguaaaaauaagaaagaaugauacauggauauagucuaaaaguacaaugguaauuaccaaaaagaaauuaaaauggucaccucuggguagaagagcaaaagaaggaaggcgguggcaaaggcagagaacugcuuacuguuucuuaugagauuuauagcauuuuaaaaaauguuuaugcauuuguauuccuggaaaaaagcacauuuucugacacauuaaaaguaauacaccauagggacucuaaugucauuuaagcagcaugaccauuauugucuugagugucacuugacaauaagucuacuuuaaggccucucugccugaugcuugcauugaagacuagaaccaacuccucugaucacaaguaccuggucuucaguaagauucucagcaucccaguugcugcaacgaaguagaagggacuugucaagugggaaguucaaaauagucucagcaagugauuucaggcuaagcccauuacagaguauauuguuucuacaagaaauaaauaaaaccauguaucaaaaccaggcaaauggcauaggaaaaacuuuaaaugaccaauaaaaagagggcaaauaaacaugagacaucaaagaaaauggugauuugcuaucagauugcaguguuuuguuuuguuuuaaaacaaguacaucuaauaucaauagagcauaaaaaucaauuaggcucauacaaaauguguaaacuagacaucuuuaugauuguuaugaaaaaguuuaacaauauguaacuaucaaaaacucaaauacaaacauucucugaucuagcaauugcuuuucugggaguuuauccaaaggacaaugauacuuaaguagcuauucacugcaacacuacguagcaaggagaaguguaaacagacuaucuuuccauggugcucaugccuaauguucucaugugugaagaaaaaugacaaggcuguuuucccggggggggggggggggggagacgguaagaguauaaaaacaagcaauuguuuauuguuucuguucuucaaaacguccugauugaaacugcugcagggugcuggagagaugacugaggacccagacugguucccaacacucacauggcagcucccagccaucuguaaucccaguccagggagucugaugcccccucuggccuccucaggcacugcacacauguggaguacuuacacagaugcaggggaaacacucacacacauaaaguaaacauaaauaaauccuuuuagaaauugguaugggguaacagaaaggaucuucuuggucuucugagauuagagacuaacagagagauuuauauggaauucagaaaacaucagugggccagggagcuagcauagggcaaaggcaucucccacuaguccugacaaccugaguuuaacccccaauccccauaccacaccagaagagggcaucggaucccauuacagacgguagugagccugugguugcugggaauugauugaacccagaaccucuagaagagcaagcaaaaagugcucuuaacugcugagccaucucuccacauguccucgggacacacgcucucucauacacagagaaacuaaauuuuaaguaaagagaaugaaauucacauacacacagaaaacauuaagagagaguguggugguacaugcuuauaauucccagaccaagaucgugcucaguuacauggaauucgagaucagcagggcuacgccagaccuuagucauuuauucauuuaaaauguuuuaaaucuuugcacguguauguacaugugcguguacauucauuugaaugcaggugaaaguguaaagaccugggcuagagagauggcuuagaaaccuaagugagagagccaaaugauuauggcaaaauuauagugauaugauuauaaugauaguuaacauuaaaagucauauaaugcuguauauaacauauaguauuccucaauucuucauacugcuuaaucauuuaauccuuacaccaacccuauaagguaagauuauuaucucuauaaauaagagacagugggguuuaguaccuuauaaagcccacacagcugguaaccaacagcacuaacaauccagacaugcuccugacucaacuucuuacccacuauauacagaagaaugcagagaggccuagugaaaugcagcuuuuggcccauguggugguggcacaugccuuuaauuccagcacuccagaggcugaggcagauggaucucugugaauuagaaggcagccuggucuacaaccugguaagcuccaggacagccagggcuguucuguuacauagagaagaaacccugucucaaaaaccaaccaaacaacaaaaaagaaauaaugccacuuucuucuuuaguucaaacuucgaagaguuuuaauuuuuauaauaauauuuucauauaaaauugggaaaaaauauacuucacuaaaaagguuaaaaaggaagccaggcguugguggcgcacgccuuuaaucccagcacucaggaggcagaggcaggagaauuucugaguucgaggccagccuggucuacagagugaguuccaggacagccagggcuauacagaaaaacccugucucaaaacaccaaaaacaaaacaaaacaacaacaacaaaaaaaacagaauuaaaauucacuuaugcucaaaaauucagacaggcacagguuuuaauuaagucuucucugagauuacgacacucucccaccuuauaguaacaguuucauuuaagagaggacaggagguuguuucuguuccugucaguauaaaugaugacugugguuucuggagagaugguccaacaguuaagagcauuugaugcgccaggcgugguagcacacuccuuuaaucccagcauuugggaggcagaggcaggcugauuucugaguucgaggccagccuggucuacagagugaguuccaggacagccaggacuacacagagaaacccugucucaaaaaccaaaccaaaccaaaccaaaccaaccaaccaaccaaauaaacaaacaaaaaaagagcauuuaaugcucuugcagagaacccacauuuaguucccaacucccacacagucacucacaaaacucugaaaugccaguugcagaggucccaauguccucuggccuccauaaacauacaugcaggcaaaacacacaaauacauaaaaggaaauaaauaaauuuuaaggaaauaaauaauugacauaagagaacuguguauuccacgugaucccccaaaaagaugaggugaaauuggucccccagaaggaaaagcuaagaugggaaguuucucucuccaacucaagguuaaggcugaccauaauuugggccuaaagcaggguuugcacacuuaaaugcugacuagaaguuaggcuuaccaaggaguggugaggacuugggaaguuaaauugaguaugcacaggucuagagagauggcuuagcaguuaagagcacugacugcucuuccagagguccuagguucaauucccaguaccuacuggcagcucacaacugucugcaacuccaaagaucugacaccgucacacagacauacauacagacaaaacaccaauacacauaaaauaaaaguaauuaaauuauuucuuaaaaauugaguaugcacaucaaaaaggaaaagaccaaaccuggcccacuguuaccaccuacaacucuggacucugaggucagagguuauguaauuucugaaaacuuacacaaauagagauucuuauaucuagucuucuggauuuaaaacagauuucacacaggaaaaaaauaaacaaagcaaacaguuuuaacuuagccagugggucacugguuuauaaccuccccuuuacaggugauuacaguuucaucaaaaaagaaauuuuagccaacuaaacuuucucagacauugguauguuuccucacaaauccaguaugcauuuccaaagccuuuagguuucuaacaauuuuaaaugcuucauuauugaucgcuaguuaacuacagcucauaaacaaugcuugcccccacaggaauccuggcaugcaugcaaaccguaccccugcuucauggcuagguagcgaagguccagacauccccugacaaugagaccauaauccuguagaagcuuguuggcaucuucugaacaucccacuccuacuuuuaagauagcaccaucugccaauauauccaaaagcguccuggguaguguucugccuccauauaucagccugggcaagcgaaccagugcacagaagccacuuggggaagccaucuguaggagugacaaaggacuggcuuugccuuccaaauucaccuguaaaagaacaaaacagcauaguucacauccuugcacagcuguaugacaaaacaaaacucuggccaaagcaaaacaaaaaaccagcagcagcaacaacaaaacaauauaagagauacauccuuagcuuaccaaagggagcagcagaauggauuggaaguuaaacgcaaugagcgccuguucuaagagauauggggucuuauaaagcagcagucugaauaagcgucacagggccaacucugggcccugaaaucugaucagucuauaaauagagacuggcugacucaggagcucuggggcacacacuuucagucagaggaugugcauggccuuugcuucuaaucccagcauggaauaugggguauucuaugaguuuaaggccagccugaucuacauauugagcuccaagucagccaaagcuauauaguggggcccugauucaaaaacacaaaaccaauaucagugcagagcaguacacagcucugccaguauaacugauccuggugggacaaagucauaggcggaguucaucaaaacggaaacaaagcacaaaugcugaacauagguaggaccuuucucucuuaagagaagaaaaucacuaugcauguuaucucuacauuuacgucaaucuuuaaucuuuugggugucauagauaacuuugagaaaaugcugaaagaaugguaucccagaaaaacauacauacaaaauuuguuccuauuuuaaaggauuccuuuuaagguuuaaggauucugaaagcaauccacagaacagaugaaaccaaauaaauuccuuuucauuuuucaggaaaagaaaauuucagccuauaggugacacagcuuaccaacuauaaugggauuaacagcauuauaacucaaacucagugucuauaacaguaguucuaaagggagagugauuuuaccccugaagagaaauuucagccuggagaaaucucagucaucacagaggaagaagagccuauguaggaaucuagccgguagaaugcagauacuggugggcauccaacaguacacauccugcaagcuacucacaacacagacucaccugccaaccauggcgguacugggaaggcugaggaagccugccugcucugaccuuguuugaggcucacaucacacaaugcauacagaauuauggauggcacagcccuuagccucaggaacguuagaaccuuucaggaagaagagacauacagaccaagcucucacauacagaaaauggcaugauaaauaccuuaagugucauaaguuccuggagaagaacuauauuauacuugagacaaucaagauuaccaagagaaagcagucaacaccacaaagaauugcuacuaaagacaaaauguaagagucuuugcccuaaguucuaccuuucuauucagcauagcacaguuaaauuuggugacuuaacucaccaaagccugagaauuucuuucuaggcacuguuuuaccaagugggucauuuguauaucuccucaggagaaagcuggugccaugugugguaacauaccuuugauuccccuacacuuaggagguguaggcagguggaucucugugaguaugaggacaacccgaucuacauagcgagcaagagagcacaaaagaaaauaaauagcauaaaacaucuuaaaagaaaauuucuccagguagugguggugcacgccuuuaaucccagcacuagggaggcagaggcagguggauuucugaguucgaggacagccuggauuacaaagugaguuccaggacagccagggcuauacagagaaaccgugucucaaaaaccaaaaaagaaaauaaaaauuucaaaaugauaaaaaaauucuuuuuuuuuuuuuuuuuuaagauuuauuuauuuuauuaauguaaguacacuguagcugucuucagacacuccagaagagggagucagaucuuguuacagaugguugugagccaccaugugguugcugggauuugaacuccugaccuucggaagagcagucgggugcucuugcccacugagccaucucaccagccccgauaaaaaaauucuuauauccagacagcuuuaugaaucccaagcugaauccagacucaacuuagcacauucucacaguuauaaaaaaaaaaaaucagauuaucuacaaagaaucaauaaaauagaguggcaauuaucuucaacagcaacaauggaaaccagaaaacaaugaaauucagucuugaaaaugacaaagcuaaaauacuacacucagagaaaauauuuuuacaaaacuuugaaaaaaaggcauuuuuagaacaaugaguauuuuauuaucaauagguaccagaaauaauuucuaaaaaauuuggcauaaggauuaggcguaguaugugugacugucaucccaacacuuaggagguugagacaggaggacugcaaguuccagacaagccuuaacaauguaguaaguacuaggccagucauaacaauagacaacaucuguaucaaaagcgccaaccuauacccaagaguaagaacgacuuuaaaagucaggaauaaagaaaagggagaggacucagugguuaaaagcaccugcugcuccuacacaggacccaaguuguguucucaagugggacugacuguucauggcagccuauaacucuagccccaggggauccaaagccuucuucagaccacugcugguaccugcacacacacacauaacacauaaaauaauauaaauuucuuuuuuuuuaaaaaaaaaagaggaauagaggagaauauaauucucauacuaaaauggaaggagaccagaggaucuagacuuuucagcuugcaugggcuacaccaugaagcccaguuucaaaaaaacacuaggagcugggagacagcccaaagguaaaaguacuagaaaagaaaacguaacaaccagaggguaaccuggaacccacauaagaagccaaugcagcagugcguaucuguccucccagcuccucagagaggaaggcagagacagaggaccaccuggaaacuuuuaguguuauucuuugugauagugccuauuuuuucuuuauaaucuugguuaccuugaguauaaaauaucccuccuccuccuucuugugacacuguguuugauaaauccuuugaaaauaccuuuagagccaugguaguuaccauggcauuuucuacauguaugaacuuggucuguaugccuucuccugcauaagaaguucuaaguccuuaaggccagggccauggcuucccuauccgaaaaguuguccucugaccuacacauguauguacagcacagcacacaugcacuggcauauacauacacacacacacacacacacacacauauauauauauauauauauauaugagaauacacaaaccaccaaaacacaaauuuaagaaaaacaaaccucaaaaaaagaaaaacugucuuaagagcuaaggauguagcucagcugguagaucacuuggcgagcaugugugaaucccugggucugacccauaguguggcacacagaggacaugguggcacacacauauccauaaauagucuucuuuuacaagaguauuaacaaaccaguaguguaguaaacaccuuugaaccauacuuaggagguaaagguuacucccagcuacauaucaaguucaaggccagccuagauuuugccuucaaaaacaaacugaaaacaaaaacuaaaauagguagggagugugggagugggguuuguuuguuuguuuuuuaagacugagccuuucuuuauaacccagguuggccucaaauucacaauguagcccagcauagucuugaacuugcucugacucucuugccuuagcacuccagggugcugaggucacaggugugcaccaccacaccuagcuaggagcugguauuugaugaacacuugcuguaaguuaaaacuguacuuaaccuuuauagugauuauuuacuugaguacuuagagugugucacuagaagugggcgcccuuacauuccuauuacaaauaaguagaaagacuuggaaaucuaauuaauuagcuugcccaguucaguaaaaaugaaacucaugaaggcccaccugacuccagaauaacaacucuaaggucaccccuauccagaggacaucagcaucaccugcuaagguauacuuacaagaaagucgagaacaaaguaauucucuuugagcucagucuauucuuggccacccccccccccuggcccaaaucaggaaagcuaaugagauucuuuuucagcuuuuaaacucaugcuuuuuaacucacccauucacagucaauuccaaguacaggaaaaucuuccaacucucuuuuaagaaagggcuggauuugauuccacucugccuccugagauaccgucaccaccucugccuggaguauccucuccucccaugaggcucugggugcucucagggcaccaaaggguagcuggucaucuucuggagggggccacucccucccaccaggcacuugcugcuguggcuguggaugcucuggcuguggcuguggcuguggcuguggcuguggcugcggcugcugcggcugcuguggcugcugaggcugcugcugcaucacucugcuugucuuacuccaucuacgcuggaugccuuuccacaggacaaauccccccauggccacacccagaaggguggucacugucaaagccacuaaauuuugucuagacaucuuuagccuuucacuuuuuaggaaagcauuucacugauccuacaaucugcaaaacaaacaucaaaaauauauuuauaaauagaauacaaauuuagacauagacaaauuuuccccuaaaaaaguccagaucucugugcccauaaacuuaaaaaacaaacaaacaaaaaaaacaaguuuugauacaaaaguguuaagauuuaauuucucccuccacaugcgcaugagcaaccacucacacacacacacacacacucccacacaaauaaacuuaauuuuaaacacuuuuuagcucagugguagauggcuugcccagcauauucaaagucuucgguauagccuccagcacugaagauuuuuuaaauaauaaauaaauaaauaaauaaauaaauaaauaaaaugguagugauacacaccuguaaucccugcauuugggaggcagaaaagggaagaguaggaauugucuccaaagaguuggagagcacaaggcuggagagauaacucagugguaagagugcuuguuaacuucguagaagaccagaguuaauucccagcacccauguuuguacuuaagacagaguccaaguucauaucauucucauuaaaagggaauccagagacaagaagcucaacuaagaccaauucaguggggaaaucugucagaagcagggagagucaaucacagaagugauuuacacaguccauguguuucuaacacagaaaacaaagagaauuucuagggaaaaccagagccuagaauucaaacaaaccaaccaaccaaccaaccaaccucuaaagucaguaagaauacuucauagaagcuaggcacacagcuguaaucccagaaguauuaagacugagaaaggacagcaaguuugaagccuggguuaccuaccaaauucuagacuagccaggucuacagacacagauccugucucacaacaacaacaacaacaaaaaggcugguaaaggagccgaggucucucaauaaucuccccacacccagcugaccugagaacuuccacaagaccccaucucccacaggucacaccagcucccaauaguaccacacugggguacacuccuuuaccacauccaaacuacaguaacuacuuucuuucuuuuuuuuuuuuucuuucuucgagacaggguuucucuguguagcccuggcuguccuggaacucacucuguagacuaggcuggccuugaacucagaaaucugccugccucugccucccaagugcugggauuaaaggcgugcgccaccacacccggccaguaacuacuuucugagaauauucaagauaaaacacauauucaacauaaaccucauuuuaaaaauccuuuucaaaaaaugacagcugggugguaguggugcacaccuuuagucccagcacuugggaggcagaggcagguggaucucuguaaguuccaggucagccuggucuacagagcuaguuccaggacagccaagccaagccagagaaaccagaucucaaaaacaaacaaacaaacaaacaaacacaaacaaaaaacaccaaacaaacaaaaacaaaaagcaaaggaaagaaauuagcuacccagacauccccaacagacccugaagaauuggagaaaauauuuauuugcaagccauguaucuguuaaggucagguguuuagaauauaaacucuuauaacucaguaauaaaagacaagucaaccaauuuaaaaaaaaccucacuugagacuaugacuagaaaucugaaagacaacugagcaauggccaaauagcacaugaaaugcucuucaacaucauuaaccauuaggaaaauugcaacucaaaaccacaaugauguaaugcuucaaaaccacuaccauaucucucaaaaaggcagauaaaaagaacuggcaaguuugugaaaaaaugagaaacucacacacuguccguggaaaugccaaacggugcaguugcuuuggaaaacagccuggcagguccucaacaguuaagcauaaagacaccacagggcuccaaguuccauuacauccacgcauagaagggaaugcaaacacauccacagaaagugcacagcaacacugucuguaaccgccccaagguggaaagaacccaaagccuauuaacugguaaggcacauaaaacagcuuugcuacagguugugaguugagcugugucuuccaaaaagguauguugacauucuagcccccagaaccugugacugugcccauauuaggaaauagggucuuccuuguguuaucaagauaagacaaggucauacugguguagagugggccuuaauccagcgugacugguauccuacagcaaaagaaagacagagagucaaaagugacagacacaugggaaagaaggcuggagaagauggagacagagacugaagucaugcaaacauaggaaagccacaggucuuuaucacuagaagcuagaaggaaaggaacaacucucccauacccaacaccccaccaaggagacaguacaguccuccuaacaccuuaauccuuaauuaugcaccucuaauuuccugaacagugggagaauugguuuccauuauuuuaacccauccaguuugugguccauuaacacagucuuagagauggagagugguuaagagcaccuguugcucuuucagaggaccagaguuugauuuccagcaucccuaucagaugguucacaacugccuucaaguccaauacccucuucugguauuuucaaaagugcacacacaaaacacugugagacuaugccggggccuagcaaacacagaaguggaugcccacagucagcuaauggacggaucacagggcucccaauggaggagcuagagaaaguacccaaggagcuaaagggaucugcaacccuauagguggaucaacauuaugaacuaaccaguaccccggagcucuugacucuagcugcauauguaucaaaagaugaccuagucggccaucacuggaaagagaggcccauuggacacacaaacuuuauaugccccagaacaggggaacgccagggccaaaaagggggagugggcggguaggggaguggggguggguggguaugggggggacuuuugguauagcauuggaaauguaaauaagcuaaauaccuaauaaaaaauggaaagaaaaaaaaaacaaaaaaaaaaaaaaaaaaaaaaaaaaacaaaacacacaagcacaauuaaauuuuuaaaagaaagauauaugucauagaauagacuuuuauuaagcaauacaguccugauauauauucuacuaggcacaaaccuuagaaacauguuaaauaaagaagcuagucacaaaagacaagacagagagauaaggaguucccuacaaauggggcauaaggaauuuggggguuggggaaugacuuuuauauagaucagguuuuaugaggggguaauaaagguguucuaaaacuaaaauguggugaggguggcauaauucuaugacuauacuaaauaucaucaauuuguauacaauggguaacaaauugcaugacguauaaauuauaccgcacuaaagccauuaaaauacuauuuuuaaaaauugguucuaaaauuaaaucugaaaaagaaacuaaaaauagcccacuuauaaaauaaggccacggggacagagagaugacucagcagagccagugcucccugcucucccagaggcccugcaucaguuuaaagaaccugucaggcagcuuacaacugccuuuaacucagggccugcacauauacacaugugugcacacacacacauacacguaaauauuuuaaaaagcaaaagaacaugugagcagaugaaguagaccuuucaauaauauaagauaaucauaaaauuuaccuuaccagauaucaaaaggcauuaaugccaauuuugaaaacaggccagagaauaauacagaguccagaaacagauuuugugugucuauaaaaaaaauuaauuaauaaaugauaaauauggaguuucagauuuauggcucaaaaauaggccaaauacuuacagaaacacgguuugggaaacagugccacacacuacacaccaauucuagagaaaguaaagaaaaacuaaaacaccuaaaaaaucuuaggcgaguugaaccugauguuguagaccuguaaucccagcacucaagagaguaagguaggagagugagaguucaaggcuugccugggaucucuugaguucaaagccagccuggaaagaguuccagggcagccagggcuacacagagaaaucuaucucaaaacaaaaacaagaacaaaaaauuucaaaagaauguuuucucaacacaucauagcccuugcacuuacagaaugagaacaguaauggaaauaaaaugaguuaaauucaggcuggagagauggcucagugguuaagagcacuggcuguucuuccagagguccucaccauaugaaggcucacaaccaucuguaaugggaucugaugcccucuucuacugaagauagcuacaguguacucacguacauaaaaugaaugaauaaaucuuuuuaagggcuggagagauggcucagugguuaagagcacuaacugcucuuccagagguccugaguucaaaucccagcaaccacaagguggcucacaaccaucuguaaugauaggaugcucucuucuggugugucugaagauagcuacaguguacuuacauauaauaaauaaauuaauuaaaaaaaaaaagauuuuucuuuucuuuucuuuuuucuaaagauuuauuuauguauaugaguacacugcagcugucuucagacacuccagaagagggugccagaucucguuaccgaugguugugagcuaccaugugguugcugggauuugaacucaggaccuucggaagagcagucagugcucuuaaccguugagccaucucuccagcccgaaaaaucuuuuuaaaaaagagagucaaauucauuauacaaagguaugaaacugucuaauaguaaaaaacauuuaaacuuccuuuuuaaaacauucuuaaaaauaaacuacaggggacugcucagcaguuaagagaacugacuacuuuuccaaagguccugaguucaauucccagcaaccacaugguggcucauaaccauuuguaaugugaucuggugcucuucuggggugucugaagacagcuacaguguacucacaaaaauaaaguaaacaaagaaacaaacuagaggggaaagagccuucucugaacacagaauguuucauucuuagcacagcagacauuuagggcuggaagaacugugcuggggcagggguuggggggagaagagguuggaggggagacccuauccugggcacugcaaaauguucagcaccacgaucccuggcaccuccucacugaggcuaaugauagcaccacuucaguuaaccgaaacucucuggauguuguccaguggucucugggagucaaauaucucucagcugagaaccacuaggauagagaccaauagccacacagcacaaauacacacagccaaaaucaauagaggaaaacaaaaugcaaaacuuuauuucuaugacuauucaacaugguuaaagaacaagucuuaacuuuaaaaauuagugugaugggaguaaauauuaaaacauacauaucuggggacuagagaguuggcucaguaguaagacuauuuguugcccucccagaggaccugaguucaguuccuagcacccaugcccaguggcucaaagucaccuguaacuccagcucuaggggauuccaugcccccuuccauccucuccaggaaucugcacuuauguacagacacacacacacauacauacaauuuaaaauacaauaaauuuaaaaauaaagccagauacaguaguguaaaccuuuaauuucaauacucuggagguggaggcagacauagcucugugaguucaagacuacauagcaaguuccagacuagccagaacuauauagggaaaucuaucucagaaauaaaauaaggucaccuucuagucaccugccuugagaggcuaauugaagguugauuccauugcaucagaaaauaaaccucuugcuuuugcauugaaaaauaaaauaaaauagaauaaaauaaaauaaaauaagggccuagggagauggcucaacaguuaagagcuugcacuucucuugcagaaaaccuaaguuugguucccagcaugcaugucuggcgacucacaaucuccuguaaaucuagcacaagagcauccuaugugucugggucccuucuauaccugcacuuaugugcaaauacccacacaugaacacacaaauacaugguuaaaaauaaaacaagucuuuuaaaaauauaaaaauuuaaaauaaaguaaaauaaaauguacgcagcuacaugcccguaaucacagcacuggaaguaaagccaagaggaggaugaguuuaaggcuggccugagcugagauccugucucaaaaguaacuaaugaaaauauauaagaguaaaacugagaccauaaaacaccacuauaagucaauaagaaaagaucaguucaauuucgaugcaaaguaguauuucucuuuuuucuuuuucuuucuucuuuuuuuuguuugguuuuuuuuugguuuuucgagacaggguuucucuguguagcccuggcugaacuggaacucacuuuguagaccaccuggccucgaacucagaaauccgccugccucucucugccucccaagugcugggauuaaaggcgugcggcaccacugcccagugcaaaguaguauuucucaaaaaaaaaaaaaaaaaaaagacauacacguggccaacuaugaaaagacuucaaucccacuaguaauugagacuauaaauauaaagcaaaaccccaaugaaaaaucaucuuucauccuucagacugacaaagaacagugauauccagcaugugugguggcgcacgccuuugaucccagcacuuaggcagaaacagguagaucucugugaguucaaggcccaucuggucuuuaguaugaguuccaggacagccagggcuacacagagaaacccugucuugaaaaaaaaaaaaaacauacaaacaacaacaaaaucaaaaccaaagccuaggagaggcagguauuuugacagaugauuugaaggcaaaaugguauuauuagaucuccaaagccucccacccagcaauuuuacccacagggaucuauguccagaaauguccauaugggcacacagaaccauguggacggaugcuuauggcacuggguaaguggaaaacaagaaaccuacuaaauuucgcaugguauggaaugucugcaugauguggaguuuaaagaauaaguagaaagaguaggcuugucucugcagaugggcaaaaucauuuuaguaaccauuuuuaaaaauaaaucaaguuacagaguauguacaauaugucauauuuauaaaaguacacauuuguaagucuaaugauuuuuuucuuauucacuuuuuuauuaguucuuagagaaguucauauaauguacuuugauucuacucacccccuuucaucuccucucagauccaacccuucaauaaacucuuacauauauauguaugugucuauauguacauauauaugugugugugugcauauauauguguguguauauauauauauauguguauguauguauguauguauguguguguagauagauagauagauagauagauaggcugggcaugguagcacauuucuauauucccagcacucaggaagcagagguagaguucucuguaaguugaaggccagccuggucugcauagugaguuccaaggcagccagggagacauagagaagauccugucucaaaagcaaccaagagaaacaacaauauguguguagcaucugaggcagccagagagggacuggaguuacagaugaccaugugggugcuaggaauccaguguggauccuccagaaaagcacugaguucucucuugccucccaacugauuuuugugagccaggaucccacuauguagccccagcugcccuggaacugagagacccacaugcuucugccuccccacugcaggauuaaagguaugugcugccauguccagcaauaaaugugauuuuuuuuuauuuuaaaaaauuuuuaaauaggagcauuuauucccagaacucuagaggcaaaagcagguagacuucugugaguuugaggccagccuugucuacaaagugaguuccaagacagccugagcuguugcacaaaagacccuacucaaaaaacaaacaacagggcuggagagauggcucagugguuaagagcacugaaugcucuuccagagguccugaguucaauucgcagcaaccacaugguggcucacaaccaccucuaauggaauccgaugcacucuucuggugugugacugaaggcagcuacaauguacucauauaaaugaaaauaaauuaauaaaaacaacaacaaaagaauuuaaaacagggcuggaaaaaugguucagcacuuaagaaacuugccgcuugggcuggagagauggcuuaagagcacuggcagcugcuucauuuuccaguacccacauggcaguuuacaaccaccuauaacuccaauuccaagggauccaauacccucuucuggcuuuccagauauauauaugcagacaauacacauauacagaaauaaaaaagacaaaauuuaaauaaaagagagagacuucugcucuuucaaaggauccaacuucgguuucuaucaucuacacugggcaccuuacaacagccuguaacuccaguuuccggagauacugugcucucucugucaugagcuugggugcuugggcaugcucccucaugaucucuccucccucuccccccuccccccacaccaagguguacauauaaaagaauaaagguuuuuuucuuuuuucuuuuuuuuuuuuuuuuuuuugguuuuuucgagacaggguuucuguguagaucuuggcucuccuggaacucacucuguagaccaggcuggccucgaacucagaaauccgccugucucugccucccaagugcugggauuaaaggcgugugccaccacugcccagcuaagaauaaaaauuuuuaaaaacccagcuggacauggugguucaggccuuuucccaggaggcagagacuaucuguaaauucaaggccaucuaggacuauacagugagaccuugucucaaaaaacaaauccacaaacauuucuuucuucuuuuuuuuuuuuaaguaaagauacagaugagaagagaguauucaaagaggauguuuuguuuaaauauuuuacaugacuuuuaaagaucauauauauggacugcaauuuuaaaaaguauuuuagaguaugcuuugaaaacaaacuagccgggcagugguggcacaugccuauaaucucagcacuugggaggcagaggcaggcagauuuuugaguucaaggccagccuggucuacagagugaguuccaggacagccagggcuacacagagaaacccugucuugaaaaaccaaaaaaaaaaaaaaaaaaaaaaaaaaagaaagaaagaaagaaagaaggaaaaggaaacaaacuaaacuugacuaaauacuuuuucuuuauaacuuuuuuacuaugcuuuuuaauuuagauaauuauuaaaacuuuuuaguugcuaucucuuuuaucaucacaauacacauaaauagguaguauacauguaugaaaauguuauaauaaaauucauuauuguauauaauuauuucaguuagcacuugcauauagugaauauucaauuauauguagauauuaguuaagucaaugauaaccaagcuacuguccauagaaccacuaagauuagauauagaguugggguauaagggggauagaaagcucucguuaggaaaagaaaacagaauaguuauagauggaugaggugggggcuagaacaggagaaucaagugggaagagguagggaauaugggggagacaauuaaaauuaguauggaaaccaaauacaauagaagcuuccuacaauaaauaaauauauaaagaugaucuaaauauaauagccaaauaaugggggagacagagucccagccagguaccuugucaccaaaugaagcuucugguacuaggacuggguuacaccuaauugaauuguuggccaaagacgucucauccccaaacaacugagucuguugccaagacuauggguugcucuccagaaacuaacuccaaagccccacugcugaacucacugaacauggagaaacaagcuagcgcccacguagagccuucaccccuaugguuuagugccuuugguacaggaaggaaaguacucuacaugccaccaaaagagaaacaucaagccagccacaaauccucugaucuacaguggcguccugccuccaaaauaugcuagggcaguggugacaacaaagcucauggaauaacugaccaacaucucaucugacuuaaagcucccucucugagauggaaccuauacccaacauugcuuguggugaccaacagcaagaaacuagauaauccagggaccugggugagaacaaauaccacucuucauaaagggggaggcaguaaaaugacuccuaaugacauacugcuauacuccuagaucaguucagcuuuuaucaagaguuuucuccuguagcagaaugugaauacugagacccacagcuggacacugugcagagugacugugaugguuuguauauucuugggccagggaauggcaccauuuggagguguggccuuguuggaauagaugggucacugugggcgugggcuuaagauccucacccuaguugccuggaagucagucuuccacuagcagccuuuggaugaagacauagaacucuaagcucugccugcaccaugccugccuggauacugccaugcuccuaccuugaugauaauggacuuaaccucugaaccuguaagccagccccaaucaaauguuguuuuuauaagacuugccuuggucauggugucuguucacagcaguaaaacccuaacuaagacagugacaaaccucgaacacucagcucuaaauguggugccucccaucaaacccuuccccucagggcuuagggaccccacaccccaaagaggagguggaaagaguguaagagccacaggggaugaaggacacuaaaaaacaagacccucuacaugaacucaacaaagcucauaggaacucaugagaggcuggggcuucaugcccagggcccacgcaggaguucaacagguccuccacuaaguuacagcuuccaguuuaguguuuuuaugggaucccugaggauucaaacaagcaggucucugacucguaugucuucucuuggugucuuugcuguuugucuuguccaauuuugauuugaugguuuuauuuagcuuauauuuuauuuuguucgauuuuauuauaaccccuuagaagccuguuuguuuucuaauugagacagaaagggaguggauucggaugggaagggagguggggaggaacuggaagggguggaggaaguggauaccacagucggaauauauuaugugaagagaaaaagauguauuuucaacaaaauaauucaacagcaccagcuacuuuuccagaggacgcaaauucagcuccuagcacacucccucccaccaggcagcucacaggcggcugcaacuccggcuccaaauaacgcacacacauaaacaaaaauaaaucuugacuuaaucccagcacuuggcagaggccaacagaucccugaguuccaggccagaaagggcuacauagcgagagacccucccccuccccacuacuccaguucuuuaaaaaagaaaaaaaaaaaaagaaaaaaagaaaaaaaaguuacuaaaaacaaaacaguucuguguuucuaaggaaugguuacauaagggaauuugcguccaaucguguaccaaagcuuauaaauacuugaguugucugaauuuuggugaacagcuguccauuuuuaauaaauaagauuuaaaguucuaguuugaucugccccgccaaaaaaaaaaagccaaagccaaaggugaaaagccaaagccagagguggugcccagcaaaucgacgggcggcgagcgauguggccccgcaggucccggguggggcgggucccccgaagcccggaggaaccccggcgggggcugcuuuuuaacugacgaggucagaaagccuugaaggguugguggaugcuccugacgaggagacgggcggauggaaaggggcggcccgggaaggcuuggggaccaauggcgggacgaguccuccccgaaccugagggcucaaccgcccacaccgagagugaggggccaagaggccgcgccucagggcggggagaggggcagugccaacaacgccugggcaccucugcagcccaacagucgcccacgcgcaaaguggucccuucagcaucaccacccucucgagccgcgcuggaaaccccucugccugccacacaaccccagagaggacuuugccaacccgagcuucccuuaccugcggccuccagccucgaccgaacaccugcggcaccccacgcugacaagcuggaacccccgcggcggucugggcgcacccacccggaugcauaaaagccguagccacuuccggcccaguggcuggccaggaggauacaacccccguggugugugccuaugggccgcgccauuuuguacggaagccg

SEQ ID NO: 6720 - RNA, 39462 nt, Mus musculus
gcgcgacgcaaaaggaaucuuucagaccauagagagacacacguuucugguuucuagaguggauacugacgcuguuucagccaucuugguuaagggcgccgggauggguaagagacucuuucuccgcuuuaggaagaagaguucguuucgggauucugccuucuguacucuaauuaacugacaggcggcuaaagugauggggaauacaacagcgacaccagucgucuuuuuuuuaagccuuucuaaaaaaauggcggcaauauaaggaccuggccgauaggucgguuguaacccggaagugcccugcuaaagaggaggcugugagacaauccggaagugggaguaaugaagaggugccacuuggcggccauggcagcuguaguauuggcgacucagggucagggccuggcugagggaaguaccauggguagcaccggguguagggcagagacagcaucgugucgacuuugcuguugaauccuccgacccaagugagagacuugcaggacaucuugcccgacucuagacucggaagguaguuugcugggacuggugggcuggucccuucccugggggcguaucaccugcggugccaccccuaggaacagguacagcgugcgaagaagacacuuggcuuuaccccucuuuccuacugcuaccaggggccuugucuaggagcgggucgucgugacacucucauuccgacgauugaggucucuuucagcacaauuucuccaucugugaccgaccggaaucucaguggcuggcaaccgaguaccuaagauugcgcgaaguuuucucuggugcuagagucagcagaaggagcuugcuucuuaagagaguggcgugcuucgagaacaccccggcugguggcaaggcugaaagaagugggcaaauucccguuugcuuggaagaccacgcguuuaaacagccuaagcgccuuucgaaacugcuggaaucuuaaagccuggugguagagggugacuacgggagggcagaauggaugacuuucucuccauuagucugcugucuguggcaauguuggugggauguuacguggccggaaucauuccuuuggcuguuaauuucucagagguaagacguucuccauugucugccaagcguuaggaugaugcuagaccuagcuauauuugcaaagaagcuguuucucagcucuaaggucucauuaaggaaaagauguaacauuucacaguagaaacaaagcuuguguucaaccguauacaucuuaaccaagaaugguagauagaugauacacuggagaaccuggaguguucagaauccucugaaaauuauauacccccacgaccaccaaaaguuggggcucugcauuuuucaagagacaggaaccacaguuacauuucugaugauuccuggagguuucaagaaaucaagauaucagauaaaaccaaauggagacuuacuauuucacugaggugaaaucaguauaacaauuucugagaaaaaucaugaauguuuuuggagaaaagcuuaggaugucagcacuacaaucagugugagagaaaaaagcuacaguagguuguuauuaucauuuccuuucaaagaagccaagggcuggaauggauauucugagauuauuuucaaaucucuuuguuuagagauaaacuuuuugcacgccuuuaaucccagcucuggggaggcagaggcgauagaucucuugaguuugaggccaaaccuagucugcaaugcaggaugcacuuuggguuauuuguuagguugucauccacuaagcagagguuaugggggggggagagaaaagauauucucgucuguucuuuagaucaucagaguguccuagguacacagugcucaaagguuuaaggagaaaaaaacuacugcaugcaagagaauuccauaguuucauccccaagaucaguaguagaguaaacccuugccucaguuguucuauuccugaaaggacuaacuuccccagaggaaagaugaggcaugagguaggccucaaagagacucugaagggaaggcauugaugaagguggagaaagccuaugguggaaaggguggugagucugggcggggaggggaaauagggccuuuagccagagagaaggaaggcgucaccuuggcuugcgugugguccuuuucuauuuccuuuuucaccugugcccuuuggaaucuaaugauacaguaaguuauuuaauuuuauuuuuauuuauggauguuuugcuuacauguaugucuguguaccacaugcaauccuggugucauuggaggccaaaagaaguugugggguccccuggaacuggaguuacaaagugucaugagccaccaugucgcugggaauugaaccuggguccucugaaagagcagucagugcuuuuaacggcugagccaucauaaccauaacacuguuuaaaaaauuauauauauuauguaauaugacucacugaaaggcuugggguauagccaaaugguaguguuugccuagaauaugcaaagccuaaauuugauuccuagcacugacaaacaaaauccuagcaacacacucacucagccauauuacagacaaggaaauaggcucuguaacuugaaaaguucaaguaucuuggaauuagauagucugagucagagccguuuucagccacuguccaccguggcaaggguacauaguacauguacuacguagcucauggacaaguccagcucacagcucacaaacuuacucugguagcuauuuaaauuguuacuguuguuuccuguuuucugucaagguagcaguuggauagagcugggcagcaggucaccugucaguccuugaccaaugaaaccucucuuuuggguuacuuuccugccuaggcuuucuaggccacuuauuaaccaucuaacauaaugguuuuuguuuguuuguuuguuuguuuguucuuucuuuuaaaauauuuauguguguguguuuugugugcaagaguaucugugcagcuugugugugcuuggugcucuugggggccagaagagaacaucuguuucccuagaccucgacgugcaccaccacugaccacugaccagcuguuuguuuuuucaagacaggguuucucuggguagcccuggcugucccaaagucacucuguggaccaggcuggcuucaaauucacaggaguuccccaguuucugccuccuuagagcugggauuaaaggugugcaccuuuguacuucucuaaaggauuucucagaacagaaaugaagucaguugacaguuggagccaucaacucuuacagcaucaguguuagaaaugaucugaccucuaaaccggguauggcaugauuucucuucacuuucuccccaccugagaaccaccuuucuuuguggauggcuuuuuuuuuuuaaccuuuaggccuggaaacuguaccuucaugaauuuuugauuugugaaacaaagaagaaaauccuuaauugucaaaaucaauuguauauaacuaugguaauaaagaugcuaauuucucagcauaugggaaagugaacuaggcuuguaaggaggcacagcucacuuugagguccuguguggcaucuuguguuuuggauucaguugcuaaggagcuguuuucuucggcaguuaguaacaacgcugugggaacagccugugccuaguuuaccuggaucacacuccucggcuuuccugauugaugagugagauauagacagaaggccagagugggauuuuuagguugauugccugagaauuauuuuuguuucaaauuuccauucaaauccaaaaaugaaaugaaguggaaaaaaaggcauagcaaauaaagccccacugguguuguuuuuagagccagcagacacagaauucuuccugaaauuauaguaauauuguuucuaaauacaaguuucugaagacuuucagcuugcgaacuuuuguguugugagagagcaguuugagcuuucaucuguagacugugagucuguaguaggcaaacgaggauagugcugcuguagggaugagguuagagccuaguuugauuaaccaccagucucagagggauggagacaccaguucacuggguaucauaagggcuaccuuguaaucccaacccucagaaacugaggcaggaagauuacaguuugaggcccagccucugcugcauagugaguuucuauuaagccugagcuagaagcaccauguuucaaaaagcaaaacaagaaagaauacacacuacuugguuauucaaaaccauaggauuaauacugaaaacauacauacaagcaauauuauacagugagcagguuauauuugggaauauacaugguuauacauauguacauccaaugacaauuaaugaaaaaaagacaugaguuugaagagagcaaggagggauauauggaaggacuuggagggaagaaagggaagagagaaauguuguaacuguauuauagucucaagacaauaacaaaaaccccacaucaguguuguuugaaccagcuguuccacacuuagauccugucugugcuggucuuaccagcugcuguaaagaugggauaugauaagcuuaaccuaggcccaggacauaaggacauuugaaaauguuggggaggauuuucaguacugcuuauaaaaaccuuguaagaucuucauuugauuuauaauuuuuggggggagguggugugggguacagggaacuuuauugguggucuucaggagaguaggguucucugaguccuucccuucugggguucuggaaugaaacucaagaagggagaugcucaguguugggugcugaguugggacagagacuccucagcaucagagaaccucucucuucuucucccauucuugcugguugugugguccaaagcuucuuguuucuuacucauguaggccaugagguccaccaccauguugcuauagccauauucauugucauaucaggaaaugagcuuuacagaguugucauugagagcaaugccagcccagcauuaaagcuggaagagugggcaucaagguuaaagucacaggagacaaccugguccuuacuguagcccaggauguccuuuaguguugucgucauacuuggaaacuuucuccaggcagcaugucagauccaugguggacacauugcguguaggaacacagaaggcaauaucacugagcuuccugcucagcucugggaugaccuugcccacagccuuggcaaauggcugcaaggaugaugcucuggguagccccacagucaucaugccauagcuuuccauugacaagucuucuggcuagcagugaugucaugaaucccucuacaaugccaaaguugucguggaugacacuggccagagagcuaagccaucgguggugcaggaagcauugcugacaaucuugauuggucaagcuugauuuauauguuccuacaaccaaaguauaugcugucaccuaguucuuguggucaaccaacagccacaacaaaugcuuauauuguuuggggaucuucagagaccuccuugaccaaccauuaauagagaggaaucccaccugucuuaguuuggguuauuauugcugaugacacaccaugaccaaagcaacuuggggaggaagggguuuauuugguuuacaccuccaugucacuguuuguuauugaagggaaggaagucagcaauggaacagcaggaaccuggaagcaggagcagaugcagaggccauggggcuguggugugcuguuuacuggcuugcucagccugcuuucuuucuuucuuucuuucuuucuuucuuucuuucuuucuuucuuucuuucuuucuuucuuccuuucuuuuuuaagguuuauuuauucacauauuuuauguauaucaaaaauuacauaaaauauaucauauaucauuuauguauaucaugcaccagaagaggguaucauaucuuauuacagugugaugauuucuauaugcuugauccagggaguggcacuauugggagguguggcccucuuguaguaggugugucacugugggcuuggacuuaagacucucacccuagcugccuggaagugagucuucucuuagauggcugaagaugaagauguagaacucucagguccuccugcaccaggccugccuggaugcugccauguuccugccuugaugauaaugaacugaaccucugaaccuguaggccagccccaauuaaacguuguucuuauaaguguugccuuggucauggugucuauucacagcaguaaaacccuaaguaagacauacagauauuugugagccaccauaugguugcugagaauugaauucaagaccucuggaagagcagucaugugcuccuaaccacugaaccaucucuccagccaccaucuggaccaucucaccugcuuucuuauugaauccagggucauccuguccagugguagcaccacauacaauggcuggguccucccacaucaaucacuacuuaagaagauauccuaaagaccugccugcagcugagucuuauggaggcauuuucucaauuuauggaggcucccuccucucugauaacuccagcuugugucggguugacauaaaacuauuuaggguguugguaacccugguauugguauuuaauaaccuaugauuucugaaaaaaacuuuauuuauccucauaagugacuucaauuuaaacuauuuauuuuuuauuagcuugucauuaauuugguuuccuucuggcuuuucauauaugcuuaguuuugguugaucuuuccucuacacuucuuccucccauuccccugacccuucugaugacuuguuguuguggcaacaaacuucugaugaugagggagcuuccccucucaucuccuucacacucacgggaccgcuucagccuuuguuuguacuacagaggcuugugaugauggcuggccuuagcuuucagagcucauguuucccuuggagaagccaggcuuugcccuguagcuuuccuaccuuguggcaguguucuuggucuguaaccuucuuucucuuucuuuacuuaaaugguguuaagcuuuguuuuuguccuuucacauuuuggaguuuucuuuugugucugauuauaauaagugauucauucaaaauagaugucucuggcuauuuugacuuaucaccaaauaaaaggcuauguguuuaaagaacaaguuuguucaguuugcauuuucuuuggcaauugguccccuuugagguagguuugaccaaguggcauuucaaggacuuuuugcauugucuggggacuuaacgcuuuuauucguucgugagaaugcaauagcuuuugccccucuuuugaacuucauuuccaaauaagacuuuaaaguaccucaguagauuuacccuuaucuggaaagcggccauagcaugucuuuccucagagcagaauuacagaugauuauuuguuaggcucuguggcugauaaacuagguuuaagugagauaaaauuaggauauaaucagauccaauguuuuuaugaaaaacuuauuuucucuaagaugcuauauggauaugcauaauuaaaauuacuugcauaauaaaaauagccuuuuuuccucuuuucuuuucuuaagaaaggguauucauggccgggcagugauggcacacucacgucuuuaaucccagcacucgggaggcagaggcagguagauuucugaguucgaggccagccuggucuacaaagugaguuccaggacagucagggcuacacagagaaacccuaucauaaaaaaccaaaacaagaaaaaaaaaaaaaagaaagaaaagaaaaggaaaggaaaggaaagaaaggaaaaggucuucacuauaucugguuggccuggaacucagagaccuguaucugcuuccugaaugauagaaucaaggguauucgccacuacccugcuguguccuauacaucaggcacuguaugcauugucuuaucuaagccucuggacaagauccggagauaguguuaauguagcuuuacaaauaacuaauucggcaggagaagccacacacuuugguggcaaaagacuuugacucacagugucagaguguuuguccacugaaugacaccacuuuccugaugagcacuguagagauggcaugagaauaggaucuguuuaaguugguucuuuccaccuccuaaaucgggagcaucucagcaccgagaacagagaaccuucccaguuucccuccugccauggucuuaguugggguaguaagacuucagaccccuaguuaacauuuguaugugugcaagacccagauuccuauaauaucugcccaauuggaaucugaaguaguuacauuuugaacuaauaucaguuucaacuugauaucuucacuguguaaucauauuucauuuuuauggugcuaaaagugauaucuuuuuaaaaggaagaagagaaaaaccuauuuagaauguuucuaauugaaaagugugugugugugugucugugucugugugugugugugugugucugugucugugucuguauuccuuaguugcuucuucuccuuuugggggcagagucuuucacagaacauggagcuugccuucuucagcuagacuuccuggccaucgaggcucccucccugucagugaccugucucugccccaagagcuggugcuacagacacgcaccaucacucccuaauuuuuacauaaggauaaggaucugaacucagaucuacauuuuaccaaacccugggccauauccccaaccccauaauugacgaacuuagaaaugaggcuuuucugaaugaugagauuucauauccacuagggcucuguuugaaauuccagguaauaacgaaugguguaaaugugagugugguacuuagacccugugguggaauuucagaagccucugcaaggugagguacugcaucccuuucaucccaggugagauggguguucaaaggcaaguuugaguucaaagccauucagguguacauauuaggaacucucuuucaaaagaaaagaaugccaggcaugguagcccaagccuuuagucccagcacauggugggcaaagguagguggauuuuaugaguucaagcuugaccugaucuacagagugaguuacaggcuagcuagggcuacacagaaaaaaaaaaaggaagaagagaaugggaaaagaaaagcagaaagcuccucauuuacccuugaguacuaguguuugauuuccaguuuccugagccagaaguagcuggguuauuggguuagaaauccugucucaguuacaugggcugugaaguaacaaggucuagaugauuacauucaucagggaagguucuccuugcugccuuuauccuaugcauuuauuagaaacuagcuaauccugggcucuccaucgagcuauacacucagcuucauuucuuuaugcaguuaucaggcaaaugggagaacacuugcuaaaagcaagaaaacugucaaacaauaaaauaaguuuugcugacaggcaguuuagcauggugauuaagaguguaaacucuaggggcuggugagauggcucaguggguaagagcacccgacugcucuuccggagguccgaaguucaaaucccagcaaccacaugguggcucacaaccauccguaacgagaucugacacccucuucuggagugucugaagacagcuacaguguacuuacauauaauaaauaaauaaaucuuuaaaaaaaaaaaaaaaaaaaaaaaaaaaaaaagaguguaaacucuaggguuagauuucauagguucaagucauuguucugccacuuaccggcuauaugaggcuaggcaaauuacuuucuaggucucgguuucuccagcuguacaguggggauaauagaaguaccuaccucauaggauuguugccaggaucaacugagcugagacauguaaagggauuguaguagaagguguagauuacugaguacuugacaacugcugguuauacagugaugggcgaagaguauuggugacaccuuuccugucuagaacuuggcuguccagaaaccuaguuaauccaaagaaccagccggucugauuuguuagaccugagaguaagccucugguuugcucugugucgcccucgguucucauguagcuccugcuuuuucucauaaacuauugggccagauaccaguugagugccuuuuguuccagauucaaucuucaucaucuucucugcaaaaacauguaccuggaccuuuaaauaguuuguuugccagcuggcaggauguuaacuccuugucaauagaggaggcuggagagaaaguauaagagggagguguuacccuucuggcucuggcaugcuggccgagcagguuccugggcaguuucucuggcacugauuucuuuagcaugccagccuccccgcacaaugucuauuccuggcagggccugcagugugccuggagucuuaaccccucuggguaggcuucucugcauccagcucuuacaugcagccagcuguucagucuaggcucuuggggcacgcagcaggcaucaguuccaucggcaccccuccuggguguuuuauggaacaguccccagugagacacccaugaucagcuuucccaacacccuggagugcuuguuuccagugaguucuaccagcaugguaacucggaaacuuccgauguucaucgaacuccagcuaugcccucuugagcaggguguggaccucagucuucuuauuuauuuauuuuugagauacucuuaucucuguccuuaggugguggccacuccuuuuauuuguaacuuguauauucuuuaaaguucuuucuaauuagccaauuauuuuagcucccuguuaaaguucuuuauauucaaguuugccuguucaaaugacuuuaugguuucucuaucuugguuaaacucuaacugauacagcucgguaauuguucauaaaaucaaacaucaccaaggcuaagcagucacucucaucuggcauaagauccaacaguguaacuggggcaaaggggugugcuccuguagcuccaacagugcuggaggcugaagcaagaggauuacgugagccuagaaaggccagcuggagcaacauagcaagauccaugucuuaagagucaguccagcgcuauaaugccuggcagcugaccuucagugucugcuguggaauuguuagguaguaaugagagcugggagggacagaaagccacccauuauuugauaaauggugccagauacugcuggagcuuucuauuuuuccagaacuggaaaucuggauuuuuguaugaaaucuuccaaauguuguuuugugacuuuagaguuacacaucaucaacccauacuugaguugagggagccucuggagguccccacgguuuccucagcugucuacagacagaaggcagagacuagagaggagagaaaugcacauaacagagagcaagaaaccggaaagcauuccagagaacuacagaaccucaaagugcaguguuuaaaaccauucagcaaagagaacauaucuuuuaaaaaauagauuuuagggguuugcaagacaucacaguguucuugcagcauggguucuugcagauguuuggugcccagcaaccacauggugguucacagccaucccuaacuccaguccugggggauuaugcugccuucuggccuccacagguaccaggcaugcaccugguguacauacauacaugcagggaaagcauucauauggauaaaacaaaguuuaaaauauuuuuaaauuuuuauuuauuuguuauauguaaguacacugcagcugucuucagacacacuagaagagggugucagaccccauuacagaugguugugagccaccaugugguugcugggaauugaacuuaggaccucuggaagaauagucagugcucuuaacugcugagcucucucuccagcuccaaaguuuaaaaucuuuaaaacauuuuaaaacauuuaaauuaaauuuaaauuuaaucuguaaaacauuuugauccuuugagaauuucauucaauggauuuugaucacauuuaccccuaacuccucccuggauccacccucaucuggagaggccaucuuaaugaugacauucggggcauugcacccucugauucagccagagcacaauaauuguaauggcuuauacugaauuacauggcagcucuguguugaguucaguaguaaccuugaggaggaggaagcugagcuucagggguuaguaagugcaaggccuguuuauagagucucuaguuaacuuagcaauugaaaaaguguguguguaggugcccacaagaguagaaggaaguuacuggaucccguggagguguaguuggacguguuccuaaguuucucauguaggugcugggauucaaaccuucccaggcagagcaacaaguacucuuuuuuuuuuuuuuuuuuuuuuuuccugagacaggauuucucuguguaucccuggcuguccuggaacucacuuuauagaccaggcuggccucaaacucagaaauccgccugccucugccuccugaguacugggauuaaaggcgugugccaccacuucccaaaccagcaaguacucuuaacugcugagcucugucuggcucccaggaacuuuuguuguuguugagacaagauuuuacauguaaugcuggcuggccuggaacugucagagacucacuuguccucuguuuccugggguuuuccucccuugagacagaaucugauacuaaccuagagugaccuggaacuugcuaaguagcuaaggaugaccuuggauuuugaaacccugccuccacuuuaauggugggauuggggaugugugccaccgugcuuaauuguaugugauguuggauauggaaccccaugcuuuaugcuugccagccaugaauccuagcuacauucccagcccauaguuugcaauuaagaauaauuuauguguauggguguuuugucugcauucaugucuaagaaaguggcugauacucuggaacuggaauuacaauuaguuccgagcagccauguggguuuugggacucaaaccuaggugguccucuggaagagcaaacagaacucuuaacugcuaagucaucuucuguuuccagcauuuuagagcggggaaaggccuguuuauaguaacuuacagauaguuugugggaaauuuaauauaauguguagaaggaaaagaaaauaauguuuuccuacagccuaguagaacacuagugacauuuugucuuaggguugcauugcuuaagugugaagagacaccaugaccaaggcaacucuuaauaaaggaaaacauuuaauuggaucuggcuuacaguuucagagguuuaguccauuaucaucauggugggaaauauggcaggcagaugugcugcuggagaaggagcugagaguucuacaucuuuauccacaggcagcagaaggagacucucauuagacuuaacuuaagcauauauagugacacacuucuuccaacaaggccacaccuccuaauagugccacucucuauggaccaagcauccaaacacaugagucuauggguucauccccaucaaaucaccacacaguuuauguccauuucuuguccuuauuggugguaguggugauggugguggugguggcagcaguggugacuuuucaaaauaggguuucucugugccgcucuguccuggaauucaguuguguagaccaggcuggccucgaauuuagagauccaccugccucugucuccugaguauugguguuaaaguauuugccaccacugcuuggccuucuguuuuaauuuuuaacaugguugaguaggugauauauguauaauuuuauauuuuccuuuuuguuugggaauuauuuccuuaucauuucccuuuauuguucaaauuuaauauagccauuuucaaaugucuucacuagauucagucauuuauuaaugcugaaauucuuguguauucauuuguucuugaugugauagauugagugaauuuuuuuaugucuaaaacuguggccauauuucaaguuuuaagaauagaauaauaaaggugggaggugguggcccacgccucuaaucucagcacugggaggcagaggcaggcagaucgcugugaguuccaggacagccucuggucuacagagggaguuccaggacagugaggacaacaccaaagaaacccugucucaaaaaaacaguggaauaauggagccagguguuguggccuggcacaccccuuggaggcagaugcaggugaaucucugugaguuggggacuagcuugguguacacugaguucaagacagaagggcugcauaguggagagacccugucuccaaacaaaaaacaaaaagaaaaagagaaaaagaaaaaagaaaaaguaggaugaugggucagagggcauaaaugucucuaaaaaguuucuuaauguuuuaagaauauauuuguccaacaaaugcaaaugauacuuuauuuccauaguauuuguuguuuguuuuuaaaauaucuuugauaaggaagagauauuuuuauuguuuuagucuguucaguggacucucuagauuacugcuacaucuauugccuauuuuuucccaacuucuuugcuaguggcuuucugcuuuugcuuuuauggucuccuggaaaaaucuacauaggauuuuuaucuauguucaauuuuuguuuuguuuuguuuuguuuuguauuucaagacaugguuucucuguguagcccuggcuggucuggcuggucucaagcucagagaccugacugccucugcuccugagcauauuauaugccaccacugccgacuggcauauguaaacauaaaaguuuagaaaggaaaacagauuagucuuuuauuucaagauuggggaaaguggcuuuaaugaagugcauguucaguauuacuuccuggaagacuucguuggucuuuaugcuaaaugaauuagggaagagaagucuuagauggcccuggccauuguucauuuaagcugcuucaggcauuucccuacuacuagaagcuuucugugcaugaagcagaugauguugaagauaugagcuagcagagucucugcggagugugccagcucccuguuucugugcagugauaggagcaguguuugcuuacagaggacacggaagcguggggagguucauaaagcugccacauagagcccgggagcuuuggggcgccuuaugucaaacagaagaaccugaacaaaauuuagaucugaguuacucauauuaauggcagaucauguaguggcuaaauuaauauuaagaaacaucucuuugaagcaucuuuguagaguacggagaaaagcuuuguuguuugaacaagaauuauuccgaucccuugguagcucuucagugcuuggaugaaaucaguuuugcucuagcaaauuuacuuuuuuuuuuucuuuaggacacuuugaugcuuugaguacaaaagugggcuuggauacaaagauugagacaggaauuuuuaguaucaaaagcuucuaaaagcgauggcuuauauuugguugaacagaauaauuuguugacuguuuuuaugagcaggaaaauaaaaacuauuuaauuuucuugcugucugccaagaaaauuaaacagacuucaaagcuuugcauugauaguuaaugacauugaaugcaagcuguuguuuuaauuaauacagcuggcugauucuucagcccagucagcuacaacugugaaguuuuaaaaugaggcagcaaggccaauggcacugcacaguucaugccucucuugagaaaauaguucauuucucugacagaaacuguugcuuggggagcgcucuucccaucuugaaauauaccuggaauuuguaguucuucauuuaaauacacucuuuuagugauuugccacaggcaaaggagagaagcugccagcacuuuguuaacuuugauaaacacauaauuugagagugaaucccugguuguaaaguuauaugagagaauauaggcauauagacaccauggagccauuauuucuaggcuugaaauaaauuauguugcaucuaaaaugguucuggugguaugcuggcuaguuuuaaucaacuugacacaagcuacagucaucagagaggagggaaccucaacugagaaaaugccuccaugagacugggcuguaggcaaaccuguaagacauuuucuuaauguuugugugagcauccagccauugugggugcugugaccucuggacagguggcucuggguucuauaagaaagaaggcuggccgggcgugguggcguacaccuuuaaucccagcacucgggaggcagagguaggcggauuucugaguuagaggccugccuggucuacacagugaguuccaggacagccagggcuacacagagaaacccugucucaaaaaaaaaaaaaaacaaaaacaaaaacaaaacaaaaauuaaauaaauaaauaaauaaaauaaaauaaaaaagaaagaaggcuggccaagccagcaaacagcacccuccauggccucugcaucagcuccugccuccagguucuuuuccuaauaaaaauugucacugcagcuguugucaguggugcuuaugucguuuggcuguccuuucagcaguguugccucuguaauguuggucaccaucaacuggcucauggagaguuaucaagcuccaugcuaacacugucuaacucugugugugugugugugugugugugugugugugugugugugcgugcgugcgagagagagagagagagagagagacagacagagacagacagagagagagacaauguuguaugucugucugcuguauguacaugcaugugagaaugcuauauguauacuugugggugcuagaggaagagacaguuguccuguuuucucacucucugccuuacuccuuugagacugggucucucacugaacauggaguuaggcuugcugccagcaaaccccagugauccuucucuaacuccccacagcaucaggugacaggcaggcacauagccaugcccagcuuuuuacaugguugcugggauuugaacccaagucccaaauaguugugcagcaaguuucuuacaagaauucacguguuugagacuuuaagccuaaauugucaaauugugguccaaauaaguuguagcaguucacauucaugccagguuuagggaaaugcacucauugcuccuguucaugaauaauaacucuuuuccuaugucauuaccaaguuucucauuuuacuuuaaggguuguggucucccuggcaguugauauugguaaucccagcaguugggagacugagguaggauuguuguggccuuaaagccugcuuaagcugguaguuccuggccaagucagugggaggcaagacuuaccagucaguccccagaggaagugaauguuccaugagggaggaagagacauucucuuuucuuuuuuaauuuguuauuuuguauuuuauguguauggguguuuugcuugcauauaugucugugcaucacauguguauagugcuggcugaagccagaagagugagccggauccccuguaacugaaguuacagacaguugugagcugccgugugaauacugggaaaggaacuagguccucugaagagugcucuuaaccgcugagcaucucucuagccugagacauguuuuuccgugguguagccguugguaagaugcucaugcucuguaagcaagcccucacccaucugcucuaagcuucccuaacaaacccacuggaucauuuaaaaagacauggaaguggcaggguggcugguugggaagaggaaaggagacggugggacugaaaugggggagggacaauuguucagauuacauucaauuccuugcuggagcugguugugguggcacacucugguaggauuuacugaaugaggcagaggcaggagggucacgaguucaaggccaaccugggcuacacauuuaaauucuaugcuggagcagugcuuuagugucaugugagacucauuacuuuauaugcaaguuuuucaacuaauaaaauuuagcuauuuaugggcuggagagauggcucagagguuaagagcacugacugcucuuccagagguccugaauucaaauccuagcaaccacaugguggcucacaaccaucggaaaugagaucugacgcccucuucuggugugucugaagacagcuacaguaguguacuuacauauauuaaauaaauaaaucuuucuuaaaaauuagcuauuuauaaaacaaacaaguggacugggauguaguucagcugauagaaugugggaagccuucagguugguccccagcacugcauaaagccagguguggaucucaugucuguaaucucagcacucaggagaggggcaggaggaaaugcaaggucauuccuaauugcugucaacucugaggccagccuacgcuacacaaaacccugccuccaaaugaagaagcaaagagucaugaucuugugcugcccaggaucccucaaaccucugggcccaagcagucuuccugugccagccuccucagaagccuguacccagcuucugucuuuacuggcauuacuuacgaagccaaccauuuuucaugcuuacuagccauugcagcuguugguuucaugaauagaaaauguucccuuaucaucagucggccuuucuaaugguuucuucuguuguuuuucuaggagcggcugaagcuggugacggugcugggugcuggucuucucuguggaacugcacuggcggucaucgucccggaaggagugcacgcacuuuaugaagagguucuggagggugagagacaagccucacuugagacguguuggcagaagaauuuauggaauuucuccuagauauagcuuauguuuguccugagagcgugcuuaagagaugccuuuggacaucuuagauauugugcacauccuuagcaguuuugugaaugccauagcuugugaacacuaccuaauauuugcuuacauuaaugaguaauuucagucuuuuuaaguguaacaguuguugugagugugugaugcaugcacauauaugugugugagugugaguacauguuacuaugugugcacaugaguauggaagccggauugauauccggucucuugcucuaguucuccgccccuuuucuucuuccuguuguguuuacgguuuuguaugaggguggugcacacaugccaugcugcaugugcagaggucaaaggacaguuugugggagucacuucuccucuucuaccaugugguccuugggauugaaccgggcuugguugcauuuauguuuagccuuucggccgauauacucaaccuuauucuuugagacaaggucccugacaaaaucuggaauucaccaauuuggcaagacugggugaccagagagcugcagggauccuccugccucagcuccucagugcugggaaaggggcacacacuaccucgccuggcuuuuuacauaaguacuugggaugaaacucagagaguugaaaauuacucuggaagcagauacugaacuaauauuuuuuucuuuaagcguuugcuagaauuuacuggcaaauuuaucauuugggcaggugccuucugugguguuuguauuaguaauuuuucucauuacucuaaccaaauuccugaggaaaaccaacuaagggaagagagauauuucggcucacaguuuaaaggggucauguccauaguggcagagaaagccugggugcaggaguggcucaaggcuaugguggcaggcaugugggaugguugguaacuuguauugguaguuaggaagugagagacucaggcagagguagaucuaacccuuaaggccugaaccagcaagccugguuaucuauuuuucaguaaagaccuaccucuuuuuuuuuuuuuaagguuuauauauuucauauaugugaguacauuguugcuguuuucagacacaccagaagaagcuauuggauccccauuacagaugguugugagccaccaugugguugcugggaauugaacucaagaagagcagucagugcucuuaacugcugagcuaucucuccagccccaagaccuaccucuuaaaagucccauaacugguucuaaaauaacaccaggguugagaaccaagucuccaaacacuugagccuauagggaacaaacuguuacuuccaaccaucacuuucuaccccugaccccauagguucacagucuucucauaauacaaaauguuuuuaucugacuucaaagguccccauagucuugcaguuucaaaacuguuuacaaagccaaaguuuccucugaaauucaaggcagucucuuaacagugagcuccugcaaagucacacacaaguuacuucccccaaaguauacaguggcagaguaaacauuuggaagucaguauggaacggcagcucacaaccugggguucacaugaccuuuucacgggggucacacaucagauuuccugcaugucagguauuuacaucacaguucaucacuaggaaaauuacaguuaugaaguagcaacaaucaauuuuaugguugagggucaccacaguguaagaaacugcacuaaagggucgcagcguuaggaagguugagaaucacuuuccauacuucagaaagaucaucucaaagcaaacuggaauccuaaacaccaaagccugcaguucgugucuagcgacugacuagucaugguaggauuucaugugcuccaguggacuuggguagcccugcuccacaacucuguccccuguggcauuucuggccugucuuccaguggccuccacuucugugcuguaccuucccucaggagauggcuuguguuccagcaccuguaacaacauccuguagcaacucugccuuccccucagcuucaugcccagcccacuccgggaacuggguccugucacauguugcuuggccuuagaggguuucugggacuuuggugcaaaccuugaucaaauaaaauaaauauuaaaaaauuagagccagccaugguuguaugugucuguaaguaaccccugggcuaggagggauguuggagggcuugcuagccagcccuuggaggcaaaaaagguaaacuucuagcucagugagagacccaaaaauaagaugacaggccaucaagguagaucagcagauaaggguacuugcuguccagccugacagucuccugaguuccaucaccaggacccacaugguagaaggagaaaacugacuccccccuccccagguuaucuucugaccuccacgaguacaccauugcacacgugcauuaacacccccuccauacaaauaaauaaaugagaaaauacaguggaaagccauagaggaaaaugucugguguugaucucugacuucuaugugcauauguacaguugaacacauacaugcauaacacaugcacagacguacaaagauuuucagccuuauuuaugggguuagccagucuuuuugauuagauuuaagaccuacugcaugagauggaaccuauaauugacacugcuagaguggccaagacccugagacuagguaagucaugggccuaggggagagcccacugcuauucuucugauuaaggaacauaguaaacagaacaauuuguaguucuauaucgcucuaaccucgguggagaguguggcuuaacccucauuggcaaagcuacuuggugaaguaaauaguagcuaauaaagcgacuuugaagcacucagcccuaaaugggaggccauuaucaaagcccuccccucacggcucaaggaucuuuacagaagaggaggccuaaagaguguaagaguccgaggaggugaugacuccaaggaagcagugucuccagacacagcagggcuggugcucguuuggacucacggaggcugggagggaggcacacacaggacccgcacagguucagaccuggcaaaaucccagcagugaggaggagacaggacacaaaauagcccuaagugagagacuauuugcaacugaaaccuucugggagagggaaaauccauuuucuccaauagaaacugggucaacacacuccaggguaggucccauccccaggaguuaauaacauaaaauauaucuuauuuuguguguguguguuuguuuguuuugcuucaguaucucuuuaucuuuuaucuugauuuuuuucuuuuaguuuuaauuuuuuugucuuuguuuuuguuuuauuuagagagaaagaauauggaguugggugaaguggagaggaucugggaggagguacagaggggagagaauuuaaucaagauauaguguauaaaauuuuuccgugcgugugaauguguuugugugcucguguguuugcuggcugauauuuuauaaaagcugacugguuaccauucuguuugcuuuaaauuuugugucaaccuaggugugacaguagugacuuuguacuaccguugcuuuuacuaccacuauucuuucuuuaccugguuucgugugcuaucuugggggggaaaagcaggauuuagauuugggguccuuugagaugucacugcauucuugcauggugcuuugcuucuguguccaagaauuuaaguugauaggcagucagaaggucuguaugccaaaagcagaaaaauguuuuuaucuugggacuguuuuuauuacaaccuuuuaaacugaaggggguuaugguugccuagguuacaguauaggaacaagguguccuuaacaguagaugcaguggcccuuaaaauacaaauggaaguugucacauuuugugguuuguuuugcucuagggaaacaccaccaaaccagugaaaugaagcagaaugggauugccucagacaaagcagcagaaauaucaucuguucaugaacaugagcacagccaugaccacacacagcuacaugccuacaucggugugucccuuguauugggcuucguuuucauguugcuaguggaccagauuggcagcucccaugugcauuccagugauggugaguagcucucaggcauucugggcugugcaggcacuuuuguaauuugaaaauuuauaaauugaaugauucggucuacgccaaugagcuuacuuagaugcuaaacuccuguucuccuuagguauucucagguauuuuauucaacugugggagcuagugauuuguggugugaugcaacuguuuauugacauaucaacccugcugggcuuaaagcagucacauuugagugagaguccagggcagaagccccuaaccuguuuugugcuguggagcccuuaggcagccuaaagccuauagcccaauuacuggaauguugcucuuuaaauauauacacuuaguacauaaggcuacaagaaauugaggcuagcuuggucuccauauagaguuccacaaugagauacuaucgaaaagcuagccaaccaccaaacagaaaaacucagcccaaccaaccaaccaaacaagcaagcaaaaaacuugauagugaguaaauucugaucugcuuauuagacacaaggaggaaagacguaaauaaacaagaaguccaguggugcuuuggccaggugaucacaucagggucaccagcauucugcuuugcuguagcucaggaagccaucagaccauucuccuuugggauaacucuaaacccuggauaaaaguuuuaaaacuaccagcuaaagagcagagaaucauuaagagcaagcacguuuuacagagcaucaguaucggaacagagacgccaauuuuuauaggauauuaacagcauccuugugauagaaacuccuccaucuucccuagcauugcugcaucuguaauccuaggacuugggagguguggucaggaggauccagacucgucuccacuacauagcaaguuugaagucagccugaacuacuugagaccuugucucagaaaguccucacuguuugugagacagaacucugaacaaccagagcccgaaaaagggaggauccuaguauugugggguauccaccagagaauacuacucagacaugaguuuaagccaauagaaagucuuuauuagcaggugacuacacuggguuuuugggauuucaguauagauagcccugagccuuucucuuuuagcacaaaaccacacccuggguucacacucuucagcuagcaagaacaauuagccaaaaacagaacuguagaauccaaaagcaaaguauauuuagggacuuccccagaacuauggacuuuaauggauuaggacuuuguucaucuuuuggcaaguguugcugccugugugcuggguuccaaggccugaauggguacuuccaucauggcgucacuugugcuaagaucuggggaccuguuacacuagaacucagccccagugucugugaguaagcuguucaggucucuugcugacucccaagccaggcucauuugggcagacuccaagcaauuaagcuaaaauaauuaaaccuagcuguccaaaaaacagguuacaguuugaaacaaacuaacaugaauucuguagaaaaauguaacagaaccuagauuauucaugagguaguacuacuaacaaugucugguaugugauccaacaugaaaagcacccguggucagcagagguacaguuuucuaaaagggaggauuauucuuuaaaaaaaaaaaaaaaaaaggaaggaaagaaagaaagaggaaaacaagcaaacaaaaaaacccguggauacaaggaaguaaauguauucuccacuugaaugcaauaugugaccuuagaauugacucuuccuagaaaggaagugcucugaggaacauuaucagaaagcugacacaaguugaauguguaacaggaaucagaaauaaugcuaaauuugcugagguugauauccuuuaugauuauauuguuucccucaggaaauacacacugaaguuucuaaagauaagcaguuaugaugaguacaacuuacucuucugugguaaagauuuguguaugggaaguaugaaugcaaacuuggagcagaugguuccaaauguuuagauaguuggucaggaacauacgauucuuuucuuaaacuauuguuguagccuuuuucaagauuaaaaauuauuuccaaauaaaaguuauuuuuuuuuuaaucguggacugaauaaaugagcaaagcuuuugauguagcucugugccugaagaugguguggcuuggcaggcaaggcuuuaaucccaagccuuaagaagaaaaaaauaugguacaaaaccaaaagcagguugaauaggcagguaugguugguggcaugugauacgaucaggguucccacgaggcacaggcuggagcuuguaaguucaguagagaccagcauuggcuacauaguaacacuugacauacugucagaaacaaaacucugggugucaacaaagguucuccauuuccuuguauuuauuguaucuuuuuuaaaaggugcuuacuuugagauaaagucucauauauaccaggucagucucaaacccuuuauguaaccauugaugaccuuuaguuccgauucuucuucuucuaccaccucucaagugcugaaugugccgcugaggccauacugcaccuuuaaagaaaugucuccccauccuugugcagcacaccuuucaccccagcacuugggagacagggcagccugaucucugugaguucagggcuacucuggucuucauagugaguucuagaccaaccaggacuacauagaagacucgauuuuaaacaaauaaacaaaacccaacacuuugauuugauuugguuuugcuagggcuugggagauggaucccuaguacccaaguaaaaagucgggcaugguaaacucagagcuggggguaggaaguaaggaagaucccuaaaggguauuguuagccagccagccuagaugaauugaugaaagagucaguugaagaccuugucucaacaaaacaaaacaagaacaaaacaaagcaauguagagaaugauugaagaaagaccccaacauagacuuccuugggauacuuuuuuuuuuuuuccuuuuuuccuuuuuugguuuuucgguuuuucuagacaggguuucucuguguagcccugguuguccuggaacucacucuguagaccaggcuggccuugaacucagaaauccgccugccucugccacccaagugcugggauuaaaggcaugugccaccacugccuggguuuccuugggauaauuaauaaccaacccagcucaaucagucaauagggucucaagguagggagugaggauuaaaaagaaaagacauuuagacaauauuauaacaugacuccagccagugcugaagcugaagaaggguuauuuuuuuuuccagucugcucuuacaccauucuaggugcgugcaaagaauaggaucaauucuuuuuuuuuuuuuuuuucuuuaguuuuucgagacaggguuucucuguauagcccuggcuguccuggaacucacuuuguagaccaggcuggccucgaacucagaaaucugccugccucugcccccccccccccccccgccaccacgcccgacuaggaucaauucuagaucaaagacaaaauagucaaggaacaaacagggcauuaaaccaagucccauguguacaauacauuccucggauauucaucuugagucuugucaaugucaaaaucuuaucucacccuacuuccuuguccuagcccuugucaaauucuugccaaauuccuagcaccaagaguucuccaugacuuaauaugucuuaaguuugaccagagauaaucaugagucuaugcuguaauauuugggaaguaaagaguuaauuuuuuuguuuuuuguuuuuuguuuuguuuuguuuuguuuuuuugagacaggguuucucuguauagccuuggcuguccuggaacucauuuuguagaccaggcuggccucgaacucagaaauccaccugccucugccucugugcugggauuaaccacgcccagcuagaguuaaaauuuuucaaguaggccaugagagaucggguucauugacagaguacuugccuggcacauguaagaacuagacuugauccucaacacugaacaaagagaacuuuaaaagucacuuuuacuucuuuuuauguuauguguguuguguuuugucugcugguagacuagugcaccacauuuauauagugcccacagaggcagagagagcggaucagaaaauguccgcugcucuggaccuugaguuacagacauuuguuagcaucucuguggaugcucagaauugaacgcaaguccucaggaagaguggccagugcucgaacugcugaaccuucuucccauaacucccccuccucccaaaaagaauuuuuagugcccuguaaucauguacccagaguuaaauguaauguguuuauucuucuuucucuuuucuccggaggggugcuguuuuugcugccuucuguguguguaucuucgauuuucaguuuuuuaguuuuaguuaaguuuuuuuggagacagagucucccuguguagcucaagcuggucucaagcacacauuccuucugccuuuguugccaagugcuacgauuacucuuguuaugguggcacacauagcucuggguuuauguauuaccaagugucaggaaaaguuaauacacuuaucaaaauuaugcugaacugcaauuucuuccuguagauuuaucacaacuauuggguuuucuugcuugauuuaaaaaaaaaaaaaaagaaguacacacacacacacacacacacacacacacacacacacacacacacacgggugcccacacaggccagaggcauuggauccccuggagcuggccauagguuguugugaaccaucagauguuggugcugggaauagaacuuuauuggcuccucugcaagagcaaugggugcucuuaacugcugauccaccucuggcuccaaaagcacuauguuuaaaucccuaacguauuaaaaauauuuuuauuaauucuuugauaaauguauauaauguauuuugauuauauucaccccuucagcuucuccaagaucuuguguauucuuucucaccccucgcuccuccaggagccugguuugugaugcucaguacucugggugugggcuguagaggcugcuuuggggaguaguucaccuacuaggaguaacacccuuaaagaaaacugacccuuccucucccaggaacuaccaaaggcugauagcuccuuagcuagggguggaccuucgugcccugccccaaccccuacuuguuuccuauaaagacaguaauauauucauggagagagcuuauaaagcaacauggggggugccuagugcugcaccauauucuaugagacuguaaaaaggaagagaaagaaauacggggaauugguuacagccaaucuagggauggaggacagugauacagaaguggcacauuggucuccccuacacagaaucuugguugagccagggggcaauuguuuugagcugagauuauuuucugauccuuucuugauugaugugguccuaggauuugacuuggaacagugucuagguuuuggguugauaaucuggguaagcuugccaagaacuacaaguucuugggggaaaggagggcaagaaugguuagaaagugcuagagaaacuauguuaacuggucuagaaacugagaaauacuuggagacagcuaauacauaguuuaagaaccguccucaagccagguauggugauguggccuguaaucccagcuacuccggcugaggcagggaagccacaaaugcaaggccuguguggucuuuagaguaaguucaaggccagucugacccuugaggcugggcauuauaacccaguggagagugagugcucaaaugcauggacaagucccaaguucaauccucaacgccaaaggagaaaaccuacccaauagcauaggauaaagaucagagcucuuuaaaagagacagcagaaggguggugccuuuuaaagaugucugugacacuuccagcugagugauuuggggaaagugagcaaagcaguaggaaacuguuguaacuuggguuuaaauuggugaaaauagcugcauaguauagaaagaaaaauaugaccgagguugcaugaaaacagucgcaggaguuagaaguaaccagagccuguagagcacuuucugcagacugaggaguccaggcagcugggcuuaugcauuucagagcuaugcagggaagcccgggcaagaguucccucacacccacuucuuuaguacaaggagagcauugaagagaagagagcagugaggaaagcaguucaaagucugagcuuucagaaucuguagauagcuggaugcgguguuauacagccuuaaucccagcgcuugggaagcugagauguggauuuggagaucaaggccagccaggggugcccagugagacuccagcucuaaaauaacaaugaucauaagaaauggaccaucuucagacagguguuucuuuuccuuuuaugucauacuacuuagugauaccuucucauucucuguagauccagaaacagcaaggcccagcaguuccaaaaucaccaccacccuggggcuagucguccaugcugcagguaagucagcauugcagugagacugcuccuaaccucacagagacucuacacugaaugcucuugggcaaggguugcugaacagagcccucuagcgguagcauuagcccuggcauauucugcaucgagcuuacaagcuaagaguguguucuauauuuuaaauaccuaaacacagaguauaagcuaggcaugguagcauauauauguacuccaagcacucaggagguagaggcaguaggauccagaguucaaggccaacuugacuacuuaauuuuagccugagcuacauaucuagacccuguccaaaagagucuggggcuguagcucaaugacuaaacaucuguugagugugugaaaggccuguguucaauucucagcacugccaaacagaaagaucuuucaugucacugggaaacuaugguauggagugauaguguuguucugaagauagcuaugcccacauguucuauaucaccuguggcuuguuuuguacaguagugaccaaguuguguaguuacaagagaccaaguaacuuacaaagcucaaauauuuccugucugggcuuuaaggagauugcugaccucuacccuaagaucugucuggaaaagaggcugcacauaucagcaccaaacagcucagcugccaguguagccuaaggcaguaagcggaagacucaguguggcagaugggacuuggcuuuagcaccauaacccaaaccuagaccugaugggagauaggauucugucagguccaaauaaagguaugugaaaaguagcucacuccuaaccuccugguuucugcuuucuaacaaaaucaccucuaucacugcacuagaggcugugggaccugggagaagggagccaauaaaugagguggacugaagugucacgcaauagccaacuuuauucagagccccagaugauuuauacucgagaguuaagaaaggucaccugagaucucaugaguucaggcuguauacaaucacaaggacaagccacacauggcaaaaacauguccauaaagauaugugaaggaaaauauuuaauugaauaacaucagcauacaauaaugaguucucugaaguaaacucacuccuauccacuacaccugggaugagcaauaaaacacauucugcgagcaagucuguguuuugaagaaacugggguuacaagacuuguuuucuuggaguguucucaugagcagucagaauucuccucacaggcuccauuucuagacuguuccaacauacccauucauccaaagucccucccuugaccuuuuuuuuuuuuuaagauuuauuuauuauuuauuuuauguauaugagaagaguauagcuguaagaugguuauuguugggacuuaaauuuaggaccucugcucacuucaguuagcccguucgcucaggcccaaagauuuauuuauuauauacuuauacuuguacuuacuaguacacuguugcugucuucagacacaccagaagagggcgucagaucucauuauggauaguugugaaccaccaugugguugcugggauuugaccucaggaccuuuggaagagcagucagugcucuuaccugcugagccaucucaccagccccucucuugaccuuuuuaugucaacuuaaauacaagcuagaguuaucugaaagaaggaaaccucaauggagaaaauaccuguaaaggauacagcuguaggacauuuucuuaaugagcgacugaugugggagggcccagccccuuguggguggugccaucccuggguugguccuggguuuuagaagaaagcaggcugagcaagccuggaggaacaagccaauaagcagcacuccucuaugaccucugcgucggcuccugcuuuguuugaguuccuguccucacuuccuucagugaugaacagugacauggaaguguaagcuggacaaacccuuuccuccccaacuugcuuuggucacaguguuuuucucacagcauaguaaccgaaacuaagagaguccccaucaugugugagucaucuguauugaagcuucaagccuugaagacagaaaaauaugagcuuugaaauucuucguuagcacauucuuauuucagcuuggcucaucaaugguuguuuguauuucauauuuuuuuuuuagcaauaaagacagcuaacuuaugggugacuuggggccagaugcauuuauucuuauucuuuuacuuuuagcacucacgaaccccuaagacuacacauuuaauuguccacaucuuccccccuccacccccccuuggcuuuuccagacaggauuucccuguguagcccucuagcuauucuguaacucacucuguagaccaggcuggcgucaaacuagagaucugccugccucugcuucccgagugcuagaauuaaagguguguccaucaccacccagcuuauugaccccacccugaaggugguugugaaguucauugagaucgaauagcuugccgagauccaaguccagcugugccuagcuuugaagcccauuuaucagcccggcauugccucccuucauagcaucuuguuuccuugucucccaauuuagcugaugguguagcuuugggagcagcagccucuacuucacaaacuaguguccaguuaauuguguucguggcaauaaugcuacacaagguaagccaagauuggauauugaacaaauuuguaauuaaaaauuuucuugacuuugaugcauuucugaaaugugguaucuuuuuagcuuuaaaaguauauuuauagcuggcggugguggcaccugccuuuaaucccagcacuugggagucagagacaaacggauuucugaguucgaggccagccuggucuacagagugaguuccaggacagccagggcuacacagagaaacccugucuccaaaaaaaaaaaacaaaaccccacaaaaaaauuguauuuauuauaugugugugcacaugagcacacacaugccacuguuagcaugauaaaacucagagaacagcugugugaaauugauucccuucuuuuaccuuuaucugaguccugggguuugaacucgggucccaggucuugcagagcaaacaccuugacccauugcagauucugauagccaccaccacccccuuuuuuauaucuauaaaugcucuguccucauguccuccugcaugccagaagaggggacagagucucauuacagaugguugguugugagccaccaugugguugcugggaauugaacucagggccucuggaagagcaagcagccaguccuccuagccgcugaccaccaaaucucagcccccaauuucugcuuuucguacaguuguguucacauagcugacuagacggcuccauggguaaaacuacuugcuaaacaaguuugacaacccaguucccaaaaguugucuucugaccaccacacacacacgguggcacacagguggcuacauucacacacacaaguauaguaaguaaaaauuaaaaauucaaaagccgggcgugguggcgcacgccuuuaaucccagcacucgggaggcagaggcaggcggauuucugauuucgaggccagccuggucuacaaagugaguuccaggacagccaggacuacacagagaaacccugucucaaaaacaccaaaaaaaaaaaaaauucaaaauaaucuuguguacaauacuaacaagaaagauaucuacagacacauguaggguuuucuugugagaacauugguucuuaaaaggcaaacuugcucuugaugggaugccugggucucucauauucagauagcaucaccugcauuucuugacgugaaagcaagcccugcuugucaagugauacaggggcuacuuugucauuuccaggcuccagcagcauuugggcugguuuccuuccugaugcaugcuggucuggagcggaaucgaaucagaaagcacuugcuggucuuugcauuggcagcaccagccauguccaugcugacauacuuaggauuaaguaagguaagugugagccucccucacugugcagucccgggugugucugguucucucauaggcuccgccugcagccugggagcugcgugggacugagagcuaggaaugugacccaacacaaaaucauaaacuuacugaaacaggacacaauuuuuuauuucuuauguuauuuuauuggcaacucauuugucuugucuauguaugccacaacauucugucacaauaucaaaaggcucaacaaaucugguaggguaucuuagggugaauuuuucauggacaguauuuucucaacucaugacaaaaauugaaaguaaaaaucuguagaaaauaagugucuuaauuucaaguuagucuuuuuuaugacuuuaauauucauauaaauugaauaccaguucuaagaauaucugcauaaauauauaguagcaguucaguguuuaagaucguaucauuuaaccagucaugcuuauuuuguuuggcagauaacagucugccacgcacuccggucgagucaggucugccgcaacagucuguuagaaucauccaaaauuuuuaauuuauuuuuauuucaugugcauugguguuuugccugcaugugugucugugugagggugccagguccccuggaacuggagcugcagacagcugugagcuuccaugcagcugcugggaauugaacccagguccucugaagaguaguuggugcuuuaaccccugagcucucuccugcccaccacccaacauuuagugcagacauaggaagcaugcaagacaauccagucaggggccuccagagcuggagcaaagauggcuguaggcagcugugauuccauuucucuuaguucuuuacaccugagcauagcuucagaauugagaugucagucuucagcuuagagcucacaugcucccauuuccacaccuuauaauucucuccacaucaaccacccuuccuaguuucccuagagucagugaguagaaucuacggggaaaucuuaguaucagccuagccaggacugcauggaaggaacugcuuucccccaugcuuccucagaaggucacugauucaucaucauauaagacaauaaauguguuaaaaggaauacugacucuucugguuuucuguugguuggcugguuggugggaaugaacccacggccucccacaucccugcgaagcacucuaccacugagcuauauccccagaccacuuuuucuuucuuugccuuuuuccuuucuguucuuuucacauuuaaaaaaauaaaaaggaaggaaagggaaagauuuaagacauuauacguagauaaugaaaugguuaacgagugguucgauucuguuacucagggucuguugguuguugagucuaacaaaugagucuuacacagggccuuuugccuuaagagcaauggauaguucuuuauaggcuauccccacacacacaccugcuuuugaugcuaaggauuaauuaagcccagggucuugcauaugcugggcaaauacucugucaccuccccacccgauggucccuuuaaaaaccacacgacaccagcacuucacugacucucaugaagaaaacuccugauaauucuggaagcauggagugauaugcugcgucugggaaagucuguguagcucugacugucccagaauucacaauguagaccaggcuggccucaaauuaagagacggcugccucuauugcaucuugggcagucugugucuuaagcgccuggcuugguaacacagaggacacuggcuaaauaauagaacaaaugccuaaaauucuaagauuccaucuuagagaugcaagugaggccuccuaggcagugcuugaaagcgcuuugaaaagcaaucuagggaauaaagcuuucauuucaaaaucuaaggcuaaauguucuccuugcaaaucaugaacauuugaaguaguaaauauguuaauuagcuugauuuuauuauuucauuauuuucucaaaucauaguaucuguauaauaaacauugugaauuucaaauaaauuuuuaaguugugauuguaugugucacugguguucuuaaaccuuuauuuaagaccuccccauaaaugacagaauuuccaaucucaagacguauccauguaccaagcagcacaagguauuaauauucagauuuaguugggacaucuuccugucucuaacuuugagguggcuuguuuuaauucuaauucuaaucucuucuaauucacagagcaguaaagaagcccuuucagaggucaaugccacuggaguggccaugcuuuucucugcugggacauuucuuuauguugccaccguccauguccucccugaaguggguggaauggggcacagccacaaaccugauaccacuggagggagaggccucagccgccuugagguggcagcccugguucuggguugccucaucccgcucauccuaucaauaggacaccagcauuaaccauucagguuccagccucaguccacggccauugccaucugggaagaagagcaagugugugacgcuccucacuuccucagugucuugucucgccucgcccaucuccacccguguuccuagaguccgagggagaugagagucaaucguggagaaguggaacagcguacagcaggaacaucagaauuagacaaagacuuuguguugucuuuuaaagggacuuugauauauugaguuuugauguuucucuuaacccuauucucagggaagauggaauuuaguuuuaaagaaaaguggagaacuucauacagugaaauaguaauuaugaaacugcaguguucuguaaagcuaaaguuuuuccccuuaguuuagaggcucugccacuuuacccauugguuuuuaacaugguucucaccauguaagacuggugcuuuagcaucugugccacaugccaugagagaaggugggaacacacaucccuuagaugcuaaagacgauggcaacuaauuugagguuagaauaaggaaaauaagggcaggagacauaagcugaacugaacccaaaaaagaaacauccaucaaaagggguguuuagagucuucaacaacuccuuugcacgugccucccuaaacaaagccugcccuuccuucuaaggggcuggcuuuggaagaggggucuguuaucauauagcauuuuuuuuuuuaaaguguccuuugcagaauacuugucuacagcacacucuuaguagccagauucuguucaggcccaggguuuccaucaagaacaguauguucacaaugaaauuaagggguguuaauuuuucugggaauuuggauaguuacugacaucuuguaguaaccuuuuuaaaaaguaacacuauuacaaaguauguuguccuuuucuucuaagucggugguuggugguucucaacccucugaaggcugcauuccuuuaauacaguuucucauguucuggugcccucccagccaugaaauuauuuuguugcuacuucauaacuguaauuuugcuacuguuaugaaucauaauguaaaugucugauaacaggauaucgauaugccaccccuuugggugucgugacucacagguugagaacugcuguucuaaguauuucuuuuagcagucagcagucccucugacugagcccuugcccaggguggagagcauuucuuccuucucccuagcuccugugcaggagacgguagggcuguaucagaggggaguauccgcugcuggcuggucucaaucuccuugcaaucaugucugcaucccacucuucccugcgcucucccugcccccauuguguaguacuacugcuccuggugaugucaguccugugugagguggauucucacuacuugaaccaugaugaugaagacagcacugucuauucuucauuuccuguaacuaaguuaccuuugugucaaguacaaccuuauuacacccucaaaaaugucaccuccuggugggaguugacacagucacuaguacucugauaauuuaagcaauugagacagcaaaaguauccaacagagguaauucuuccauguuugccaaaaucugaauaaauccuagucagauaaguguauaauacuguauuuauauuuucuguaccauuucaaaaacacuuuacauaaagagggagccaagacuaguuucuucagaucagugagugcagucauuuguauuuuucuaugacaccuaugccagcaugccuguaguuuucuuucuuucucuccuaaauugucacuaggucagccagcaguuaugggauuaaacaugugugcccucugcuggcugcagugaagaaagcagaaaugggaugcaguucuguguggagcuggugcccauugcaucccaugcuaaaguguuaaugugugcaguguggggugugggugacucucuugauuaggcacaaacaggugacucggaaagguuugggcucaucuaguccuuccaaaguacagaugucuugaucucucuagaaguucccugugucugguuugauuuggguagauguagcuucugucaucucgcuccaugcaguggucagagauguuguccuggccagagccucuuucguucagcagugccuugccaucucacucuaaguuuggccagaauaucauguuggguagggccuuggacucuggcaaggacugaaccaucaaacuuccaaaucugccuuccccuccgggccucagucauagugaacuuuccaaagcuggggccuuuccaggccuggaacuauuuauugccuguggacagugcaucccuucccugcccagcaggcucagauagccaugugacucuaaauagggcucaaaugcauuagaggcagcaggaaccaugcagaggccucuguuaguggggggagguugcucauguggcaggcagugcccccagagcagccaccuuggucacuuuacaacacauuucaguuccauuuucuuccuccuuaagacucccucuggagguguggaugccuuaaugcgcaaacacauuugaacacauuggugauacuuaagcugcugccacaauuacaaguggaauuaugggcuaccaaagaagcaacugaugaaaagcaugggcccuccuuccucaugaccaaagcagucuuaauugggcuuggagucccuuucucccagaaucuagauggucuucagauucggagcacccuccccuccccaguucccaguguugccagucucuaagucagcagggcagugaugucccauuugacucugcuuucugugugcacugucgccagcuugcauccuuacaagcagacuucccggccuggacaugucagcaguuggaacgguacuacccacugagacaguguccucuccccugcuucaccucaguccucagauucucaguucagaagagccaguucuacugaccuggggguuggaucauuagaagaaaaggagggucuguucuuauagaaagggaaauagaacuggcugguucuguuuucaaggauuagagauaggagggacagagcagugacaguguuguuugcccugcuccucaugcuagugaaguucugaacaugggacuguaugucaauagcacaagccucuaagacccuccugucuuuuuugggucagagccccagaccauugcaucacagucauucggcaagaggguccuugcggcagacuucuguucauugcagagugggacucaccccugaagaacacuggucgaaauauuauacaacugcaacccuuuucuacuugagacauugaaguucagcucaggagaccugaagauggggacuggugggaaaggaccagcagacauguaggacuucuuuacauguguucagucccccacaguagcuaagcacagagacuggcuuugcucucugucucgugugucuuccuguaaacugggacucuaaugggaugguaacaccacgauuccccugguuugguggccuaaacagugauuuuuuuaaaauguccccuuuucuggauccuuuguacacauaaacucauuccauggauggcugccuuauaauuuugugucuuuccacuuuaauugugaaugguuuaaaaucgcuguuuucugauuuguuuuaugauauuaaauuuuuauuagcgcauaccuuau

SEQ ID NO: 6721 - RNA, 3049 nt, Mus musculus
aguuuuuuaguuuuaguuaaguuuuuuuggagacagagucucccuguguagcucaagcuggucucaagcacacauuccuucugccuuuguugccaagugcuacgauuacucuuguuaugguggcacacauagcucuggguuuauguauuaccaagugucaggaaaaguuaauacacuuaucaaaauuaugcugaacugcaauuucuuccuguagauuuaucacaacuauuggguuuucuugcuugauuuaaaaaaaaaaaaaaagaaguacacacacacacacacacacacacacacacacacacacacacacacacgggugcccacacaggccagaggcauuggauccccuggagcuggccauagguuguugugaaccaucagauguuggugcugggaauagaacuuuauuggcuccucugcaagagcaaugggugcucuuaacugcugauccaccucuggcuccaaaagcacuauguuuaaaucccuaacguauuaaaaauauuuuuauuaauucuuugauaaauguauauaauguauuuugauuauauucaccccuucagcuucuccaagaucuuguguauucuuucucaccccucgcuccuccaggagccugguuugugaugcucaguacucugggugugggcuguagaggcugcuuuggggaguaguucaccuacuaggaguaacacccuuaaagaaaacugacccuuccucucccaggaacuaccaaaggcugauagcuccuuagcuagggguggaccuucgugcccugccccaaccccuacuuguuuccuauaaagacaguaauauauucauggagagagcuuauaaagcaacauggggggugccuagugcugcaccauauucuaugagacuguaaaaaggaagagaaagaaauacggggaauugguuacagccaaucuagggauggaggacagugauacagaaguggcacauuggucuccccuacacagaaucuugguugagccagggggcaauuguuuugagcugagauuauuuucugauccuuucuugauugaugugguccuaggauuugacuuggaacagugucuagguuuuggguugauaaucuggguaagcuugccaagaacuacaaguucuugggggaaaggagggcaagaaugguuagaaagugcuagagaaacuauguuaacuggucuagaaacugagaaauacuuggagacagcuaauacauaguuuaagaaccguccucaagccagguauggugauguggccuguaaucccagcuacuccggcugaggcagggaagccacaaaugcaaggccuguguggucuuuagaguaaguucaaggccagucugacccuugaggcugggcauuauaacccaguggagagugagugcucaaaugcauggacaagucccaaguucaauccucaacgccaaaggagaaaaccuacccaauagcauaggauaaagaucagagcucuuuaaaagagacagcagaaggguggugccuuuuaaagaugucugugacacuuccagcugagugauuuggggaaagugagcaaagcaguaggaaacuguuguaacuuggguuuaaauuggugaaaauagcugcauaguauagaaagaaaaauaugaccgagguugcaugaaaacagucgcaggaguuagaaguaaccagagccuguagagcacuuucugcagacugaggaguccaggcagcugggcuuaugcauuucagagcuaugcagggaagcccgggcaagaguucccucacacccacuucuuuaguacaaggagagcauugaagagaagagagcagugaggaaagcaguucaaagucugagcuuucagaaucuguagauagcuggaugcgguguuauacagccuuaaucccagcgcuugggaagcugagauguggauuuggagaucaaggccagccaggggugcccagugagacuccagcucuaaaauaacaaugaucauaagaaauggaccaucuucagacagguguuucuuuuccuuuuaugucauacuacuuagugauaccuucucauucucuguagauccagaaacagcaaggcccagcaguuccaaaaucaccaccacccuggggcuagucguccaugcugcagguaagucagcauugcagugagacugcuccuaaccucacagagacucuacacugaaugcucuugggcaaggguugcugaacagagcccucuagcgguagcauuagcccuggcauauucugcaucgagcuuacaagcuaagaguguguucuauauuuuaaauaccuaaacacagaguauaagcuaggcaugguagcauauauauguacuccaagcacucaggagguagaggcaguaggauccagaguucaaggccaacuugacuacuuaauuuuagccugagcuacauaucuagacccuguccaaaagagucuggggcuguagcucaaugacuaaacaucuguugagugugugaaaggccuguguucaauucucagcacugccaaacagaaagaucuuucaugucacugggaaacuaugguauggagugauaguguuguucugaagauagcuaugcccacauguucuauaucaccuguggcuuguuuuguacaguagugaccaaguuguguaguuacaagagaccaaguaacuuacaaagcucaaauauuuccugucugggcuuuaaggagauugcugaccucuacccuaagaucugucuggaaaagaggcugcacauaucagcaccaaacagcucagcugccaguguagccuaaggcaguaagcggaagacucaguguggcagaugggacuuggcuuuagcaccauaacccaaaccuagaccugaugggagauaggauucugucagguccaaauaaagguaugugaaaaguagcucacuccuaaccuccugguuucugcuuucuaacaaaaucaccucuaucacugcacuagaggcugugggaccugggagaagggagccaauaaaugagguggacugaagugucacgcaauagccaacuuuauucagagccccagaugauuuaua

SEQ ID NO: 6722 - RNA, 7398 nt, Mus musculus
cagcgagagaccugcgguaccuuggcgguagagguggagauggaugcagaggcgagggaagaacccagcuuccuuuuuuaagaaucaguugugagcaagggagcagagcuacguuauuuuagggagacuuugucgcacucccccucccccggguagguagcgucugggaugugugcucccaguucguagucucccauggagagacgcuggcugcugcagccggcaguaacccgaccccgccggcgcagggacugaagaggcgccggggagagcagcgagaggcgaacaaaagcccucggcaagggggccggagcccggaccugggguaagugaacccgcucggagaccuagcagcucccagaauggagcggcaggguuuacggcgcucuaagagcccacuccccugagaugcggugcggaaacuggugagcaucagcggcugaugucugaguccaccauacugggguugaugguaccuuuaacuacacauucggccuuggagaucgggugcaucugggaggauucaggugccuugugcaucuugagcaaacaccgggugggggcuggaggaagaggaaggcagagagcucccagcaagccccgcuggagaggcuggagaaagaauccaucacuccacucggagaagccuuuggagacucuuuucagcccuuccaucucccgggggcccugcgcuccggguccuuuugguagagagaaaucaaccauaaacuucuuccuaggcaacuggggcccucgcagcaaugcacuuuggcaugcacaggccccuuccccuuuuguguucuugcaaagcugcaucccagcagcccgccuaagcuacaaacaaauagcuaauccuccggggaauccuccagcgccucccucgcuggcugcagccuuccuugcacuucaaucuuugcaggaaggggaugcagcuagugggccucacgccaauguggucuccugaaaggcccugcauucuaggucugagggagacugaggcugcugucuaaggcccagcguccccccaccgcaacugcccagccugaguuuuuggggcaucaguuuuaggauuuacguuccaucaggccccugagccuaaucugaaaucggauuaaguugggagggguaaauauggcugaggagggaggaacagcucacagauccucuauguccccccgccccucugucaucucagggacuccaacaaagaacgagguucagcuaugguggacccggugccagaagaggagaaagagggagcggagcccgguggcucugaaggggaugaggccacagcguccgagccccccgaugcccagggagcccagcagccggcugccuccucggccuccgccuccgcggcggcgccccguaaggcugaaguccccugcggggcagaagguggacgucgggagcagucuccguugcugcaccucgaucucuucaauuucgccugccccgaggcagagggcagccgcuacguccugaccagcccccgcucucuggaggccugcgcccgaugcgcggucaagcccguggagcugcugccucgggcccuggccgaccuggugcgcgaggccccgggccgcuccaugcgcguggccaccggccuguacgaggccuacgaggcggagcgccuggccaaacugcagcagugccgcgccgagcgcgagcgcaucaugcgcgaggagaagcggcgccuguucacaccgaaggguccggcggcagccccggccucggccucagccucagccucagccucggcccugagcgggggcagcagcagcagcugcagcagcagcagcagccucccggccucgcccgccucgcgaguugcucgaaggacuucucccaguccccccgccaggagccggccuccgcccgccgguucucggacagguagaaagagccacucgcuggacucgcucucccgccggagggacggugcccugagcuccgaguccggggccucgucgucguccuacagcggggagagccuucgggagcuucgcuggccaccucgagcuuccgccaggaacagcugccccgcgggcucggcgucgucugcaccuaacccacugggccgcccuucggcccuugcucugguuccgcucacggcccgcagcuucagccucggagaccugagccacucgccgcagacagcccagcauguggagcgcaucguccgccaagugcgcgccgagcgaggccugcgcgggguacccgagcgcgaccgcaagaucgccgcccucaugcuggcccggcaccaggaagagcgccuguugcuggagcagcgcgccgcggcccacggccagugggagcagcagcgcgugcgcgccgaacagcggcgggagcgcgaggagcgagagaagcagcgcgcgcuggagcggggccggcgggccugggcggcgcagguggaggagcggcgcggucgccggggccgggaggagcgcgaggccgcgcggaggcggcagcagcagugcgagcgcagcgaggagcggcggcgggagcuggcggagcgucagggacugcugcggcgggagcggguggaacgcgccgcgcgggacgaccggcugcgcaagcugcagcaggagcagaaccugaagcagagggaggagggccggcaagaggggcgggagcgcgcggagcugguccgccgggagcgcgcccagcgggcggcgcgcgcccgagagcggcaagagggccaacugcagcgcgagaagcgcgagcugagccgggccgagcgggcgcgccacgaggcgcugcuuagaggccgaguccggcagcagcaggaggagcgggagggccugcggagcucccuggaggccagcuugggccgcgcgcaagagaacuacgagcagcugcaggaacagcgcgcccgggagcugcgggagcgcgcgcggagagaggagcuccagggucggcgggcgaaggaagcggccgagcgcaaagagcgggagcaucaggcgcacuuggaggcgcuggcgcgggcgggagaacgacggcugcagcacgcggcgcagguggccgaagaggcugugcagcagaaggcccggcgcgugguucagacccgccuggaaaaggagagggcccagcgugccaacaaggagaagguagagagagacgaagacugccgccgccgcgagcugcugcaggccauugggcgcaagcuggagcgcagugagcagcucucucgagaacggcgaagcgcgcuggagagcgcucgcuccacggcccgggccuccuuccaugugcgggagaaggugcgggaggagaccaacacgcgcucuuuugaccgcauggugcgagaggcccagcuacaugccagccuggaccgcaaaugacagccgcccuggacagaccgugcugcuggauauggccagguguggccucucucuuagucaccuugaccaaacuccaggcuucuccaguccaguugccacacuaugaacucuccagacuaaugaaccauuaaugaggcacugagaaggcagacaugguauuuuuccaucugucaccauuguuuuacagacuuacuccauuuggaaacgacauggcacaaucuacccacauccacuggugucuuuggguuggaauagaaaguagcugggaggaggaaggucccuguaggagagagcacagaggccaacguggggcucucugccacagcugccuugggcaucuuucuaacaauuguguucaagacgauuuaaguagcagcagcggagggaauaucucccagacuuaccucucuaucuuugaaaauacaaguugcacaggacuugaaaguuucccaagaaagcacagcucgucuaagauguuaguucaugcacaagcgacuacaaaagcuaucgcuagacugugaauuggacacgugaacaaauuauccuguucccaaaauauuuucaguugagucccuuggcuuucuaguuagacaaucaucuacagauaauaaucccuuauucucccaagugguguagggaaggggcuggaucggugaggcugcuuagcuuuaauggaagcccuccaaccuccagaccccuggaggugaugguuuccuuaggcagcaguguuccaccccaugaggcuuccauggaaggugaauacguaaguggaggcagugucugaugcccacuucccuguguggggccagcuccugcagacagaagccgcugccuuacgaaguagagcuaccuucugugccugcccaggccacucuugcuuaaagcuccagccuugaaugcagucuggagggcgagcccuggaguguguaggauccccucugugacuuaguucagcguucugaagacaauuuaggauccuuggcugcuugccugugguggcugaagggcuagaauugccuguguggagcugugcuauuguugguagggguaucacucuuccuugggggcacugggaaaaggagucuucccucuuuaaauuccugguacccucucacuuauaccugaaguauucaaucagucucuuggugccucaccuuucccaucuucuagauggggccaucaacucuucugguaccucaaggucucuuggauccaaagcaucacuucaguguuauuuguuggucuccuuugugccuuucuugaccuggaguugggaggcaggaggacagcuguuagccuaguuuguuucuggugacauggauugcuggcauuagacagggcagugcaucacagacaaauggucauuuagcauccaagguguguguggggcggggagggguacuugguacuugcaauaccaagccgcucccuggucagaagguucaguuaucacucagcaauuuuaaccgguagagcgcucuuucccccacucagauccacccgucagcuuugucuucaccagggaagguggaaagucaaccgucuccuuuuacauuacaucaaggucaggaaguaaaaagaaaaaaaaaaacuuaccaaaaagaaaggaaucaggguagagacguacugcauuagacguguuagugugucuuuucugcuggcagaaccaucccuaaagugacuggcuguugcccacaccccucuucaacccuaucccaucacacgcuaaggggagucuuguguagaagaaagcuguguuuaggugucacgugugagauaaugugguaccaggaaaggagcuauguacugaggcuuguuucuugaguggguggguucucccuuaauuuccuugucagugagcugugauaacugguguugucucuaagacaggagcauuuaacuaaaaaaaaaaaaaaauuaaugugauuaugguccuuugaucuuguggucccuggguugcuucugaaaccuccauggaaaguucuacccuugaaaguacuuacuucaaagcaugagcauugcuugaggaggcaaucggguguucugaaccaagcacugggaagcacgcgagcgaucucacccggccucuuacccaggcugcuccccaccuuacugagcgacuucagguuggucaccuuucuuaguccucaccgacguagaacugagaucaugguuccugagcucuaguuugugcaaacgagaaugacggugauauuuccuguuucugucaccuuggaacugaaggugcaguugccguacacggagcuccauggcuccugcgccguacuguacaguguaauguaccaucaggauuuggugcagaaggaacagucuugagaagcucauucagauccagagucacaugugacguaaaggcccaggccagaauguugacaaauuagacacugagagaaccacuauguaaagauacaagcaguuuauagauuuuuaccaaaaaguccuuauagccaaguauuauuaaaacaaaaacagaauucagaccuagugacaguaagaaaugguaccuucaaguuccagaccauauacuaggauacucuacugaaguuggacaugguggcucacaucucuauaccuaacccugaggaugcugaaguagauggauaauuauauugagucagcccauaccagauagcaagacacugucaaaacaaacaaacaaacaaacaaaaaugcaaggagaaucaccuguauauucuaaagaaauguucauguuucuuucuaaagauaaugaaugccuaaagucucuuuugggcccuuaauuuaaauuuccacagaggagaaguuuuauuuuacugugacaugcagcaagaggacauugggccagagcagagaugauggauggaaaauugccuccaaacagcauucuagcagguguccaggacugagcaugcugggaauuucuugccaucuaggagaccccaaccucgaaauggccacagccucacucuuuuggaacauuugcuacuucaagaaagagagaguguaaaauaauaugagaggaugggaaggguugggaaagcuuuaauucaguugauauccaagaaaacaagccaaaaccauuccagaagaaauuauugaugaagcuaguccaacaucgugcuguggcagggaccagagucuauacucaucucgacagauaauggaaguuuccuuuuggaagcacgaaggcuggguuuugauggaacgguaacaaggauuugccaagggcaaaaggucugcaggguagugaagacaggaaugucuuggucuauuuuauguugcucuaacauaauacccaaggcuaaguuaaaaauaaaagagauuuguugcugacaguucuggaggucuaagaacauguugccagcaucugcuugccuucugauaaggacuucagggggacaucacauuucagaggcuccuggggaaggcuuuacacauaagaugggaagcaagagacaggagaagccagaggcacuugugugucaacccaaccuuaaaaggaacucagccacucccacaagacucugcccaguucugcaagacuagcauuacauccauaauguaauuaccuuucauuaggccccaccucuuaaaggucccaccaccucaauacuaucaccauggcaaccaagaccccagcauauaaacugucugagaggcaaacuacauccaagguacaacaaugaaaauauagucugaauucuggauauuauguagucuuuaacagucucccuccauuacacagucuguugagacagaugcagcucuguagagggacuacaucuuauuuaacaucaaaucccauguagcccaugauauagaaucucaccuagauaaguacauaaauauugggcagagaggaagcugggaguauggaugaauggugaccagagaaaaucgguauagaacaguuuaugcaggccuccauucagucaacaaaucuucacuaagcacauuacuacaugacaaauacuauuguuugauuguuugguuuuuuuuuuugagacagggucucucuguguaguccugucuguccugaaacucaaacuguaga

SEQ ID NO: 6723 - RNA, 90592 nt, Mus musculus
cuuccuugcaaaugacaguaauuaaaacauccaaauaauaaccaaacaauaacaguaaaagaaccggagggcccucuaggaagguggcuuaacuagaguauuacagccagagcaguucgagugacugucucuuuaagguucccuccccccgccgccaggggcgugucagacaaggucagaggcgcgugcgcgugacuccucggggcggucgcagcggcgcgacgccugcgcuuguugcgugcgugccugaccccgcccaggccucgucccugcccugcccccucugcggggccucccccgcccgcgucguacagcugggccagugacgcuggcgcagccgucgccaccgccgccgcguuccauccucaggagccggccaccgcucgcguccucguccucguccuccuccuucgucagcgcccggccgcgugagccagaccagggcacgcgaggcgucgcgggggacccgacagggagugcaggcaggcgggcgcgcucagcggcggagcggguucggcgacgcgggagcugcuagcgcccccuuucccggaggucucggcgccgcucccgggugaguugucaccgccgcccgggcuggaggggccggcuuugugucagcggcgcgcggggccgguugucagggcacuggcgggcaagcacuuccucagggacgcgggccuucugcgcggccgccugcuaccgcgccggccggugucagcacugcgagccgcgcgggaguagccgggucgggccgcuccgagggcggcggcgugguugugccggugcccgagagcggagagcagaucgggcucgguggagcgcgcugcaaggcggaggcccuccaguccagcgaagccgcgguuccgcacggcgggaccggcuuggccgagguggguuuccugaggaaaccuugcagccgcucgccugugcgcgggagcguucuggagccccagcgccuggucgccucuucagucgcaaaaacuuuucuuauuaugugggcugaaacuugccgaacccauuuccuguuuuguuucgguuuuacuguaacuacauauagacuuucuuacuugugagacugauggucccucccgggacagccaccaugguggaaaaacuuaccuguaacggaauugggagggcagcaaggccggggaucccaaagaggcauuaaguucauugggaacuuuacauuaguucagcagaggcccaauguuguugccacacacuucuuuggugacaagguagugugcugcccuuuguugcucuuguugguugggguucgaagagaggugcggggacauuauccuuuucaguuaagccauggguauuuaguccuuucuagaucugcaagauccgcagugacuuuccacuuuucacuggucaaucgguuuuugguguuagaaucccuuugguuaauaauaauaauaauaaaaucacacauacacacacacacacacacacacacacacacacacacacacuuuugugcucugggaauucuacacccaggcugucaccaucuaguggagacuaguagagacaugcccuuggcuuugacuucuuaguuuucugagcuuugcauuuuucauuagaugcacauucaaguagaaaugagaacugucuugaguugggggugggaguggauuccuguauuucaauaaaggaaucacuucauaagguggugauacuguggaaaacuuguugaggguuuauugugucccaagcuaaauucauuuagcgugugugaguuugagugugugaacuugugcugguguggaggucaaagaacaaacugcaggagccaguuuucuaccucccagcaauugaacucuggugaucacgucuggugcuucuccacucugagcuaucacacuggcccaaguuucacuuuugaucucauguaauaauauuugagguagggccgauauuauccuuauuuuuucaguugagaugaaaguuacacauguuaaauaauguaagccacaaauguaaguucuggagugucuagauucuucucaaaacaccacuguuugaggcucuuucucugaugauaagcaucccuaacuugcuccuggaagcccaguaaugguagguugcacaauacuaguucacuuuuuuuuuuaaauuucauaucauacacagcauaugccagucguuaccugguuuuauagauacugggaugauuaaaacugaaaccagacagauuuucauggugcucaacuuuuaauuuaguuuauuuugauuuaugguguuaguuuucauuacuguuugcugcuuuuuguuuguuuuuuguuuuuucgaaacaggguuucucuguauagcccuggcuguccuggaacucacuuuguagaccaggcuggccucaaacucagaaauccgccuaccucugccucccgagugcugagauuaaaggugugagccaccaugccuggcucacuguuugcugcuuaaggaacuuuguacccauuaaguuuaaaaggaagaacaguuaucaguucgagacugacccuguagaugggauuccugucuacagagggacucuggauauuguaguaggaaugagagaggaaaaaaauccucaccuucugcuauagaaaaggcucaggguaugcaguccugagagcaagcccaccaggugucaguuugacuuguugaguccagcuucuccagagccagcauucaagcucacugaaaagagaaagccagguaaaaagguccugcagccugguagguggcaagaccucagcacucugugguuuccugcccggucuccaugguguggcgauugaacuggagcacuuauguaaugaugcaucuucugacaggggauuuccuccucuacugugucuggggccucgguuccugcuucacugcuuccuacacacacacacacacacacacacacacacacacacacacacacgagaacacgugcccuccaaagguacuaauucacuuggcuucuaaaaguaagacuuuuuacaaguuuauuauuacuaguaagcauuauuuuacacacauuauguuuguccauuucucacauuaaaacuugcuuuugguugugcaugucuguaaucaguauuggggagaccugagguagggucaugacuuccagccagccuggguacacauacagugaaacccugugccaaaaucagaugacaaaaaaaccaaaaacaaagaaaccaaaaaacccccaacaaccaaaagacacccuugaccaccaaaacauccuuuacucucauauuucuccugugcuuuuuuucuguauuuuuagcucucuugacaccugcucacuacugguauccucuguaggcuuagagaaacaauaaaguaucuuaaaauuucaguuagggagcuguggagauggcuuagugauugagugcuugcuguucaauguccaaauuccgaggacuggaauuuguuuuuuagcacccagccaguucacagccauucauaacuucacaguuuuaggguacuugaugcccuuuucugggcugaaugcacacagacaccugugcauaaucauuaaaaucuuaaaauauuuguugagacugggcaugguggcagaugccuuuauuccagcauugggaggcagaggcagaguucaaggccaguuugaacauagugaguucuaggacagccaguacuaaaaagugagaccuuguguaaaaaccaagagaaaaguuaaagauucaccggggaacaugauuuuccucauuucaguaccaaccaggugauuugggagaauaaaguagaaccucugcuggcagugaaggaaagccaaagaacacggugggugcuugcuuguguuuuaccuugcuuuccccuuuaccaagugauaguucaugagaggaaguggugguccagauagcccacugucugccacacauaaaacauuuuacugagcucuuggauuggcaugugaucuaguuggagcugaugaacaaaauucauuuuccuuccucuaucugccuugaacucaugggauuccugcugggaacauucucucaaguaguaggagaauggaggaaaaaagugauaaaggaaacacacacacacacuuuaaaagcaagaauugcuguguugcagaguugaaugugaagauuaugauauuuggguuaagggcaaacauugaaacaaaauaugugacaagaaauucuuuugguuucuuugaagauucuaucuaugccgagaucacucucagucucaguccauuuucuguuauuguaacaaaaaaaccugagaugugguaaaucauuaagaagggaagcuuagcugggcgguggcgcaugccuuuaaucccagcacuugggaggcagaggcaggcagauuucugaguucgaggccagccuggucuacagcagauugaguuccaggacagccaaggcuacacagaggaaaaccugucucgaaaaaaaaaaaaaagaagggaagcuuauuuggcucacagcaaguugaagagcuuggcaccagugucuuacaucauaacauggcacaggguaucacaugguaaaaucuuggcaacugcuaauguauccauccaccuucuaguccuaccuccaaauagaauaugaauacaugaauuugaggauuuucuaauaccuggacuuuuaggacagguucaaaccauggagugaagaggaaggaggaccuuaaauucaagguuugcuugugcuacuuagugaguccuuguuuccaaaacaaacaaaaagccaaucaaagccagaauaucuacauauguaauaacauugagucuucaccuaguugaaugguuuuuagaaaauucaugcucauagguauaugagcacauuguaggaugcuuaaaaaaguuaaagcagugacaaauacugugguuuaugugggaggcgguagcuugcugaugggaaggaagaaugcagauuaggaucuugagacccaggaagcagucaggcaaaacuugagguggcagaccuuggauaugaaaaucuauuuucuacaucauggcuaagauucaaguaaguagaaauuguuucuuugguugauguaugcucuggaguguuacccuguaaaaagucuuuuaugugagaaaggagucuggcaggcaccugucaucuuccagccucguaucugugcuugucugcccccuuuaaucuugggggugggagcuggaaaccagcuggaaaccuuugcucuuuugucuucugguucucagcugagucuagaggucuccagaaucugauagaucuggaaguaguguugagcuggguugcuguugcucugaaaggcuagcugcuacucccaagguggagggacaguugagucugugaagguacuggguuuaagaguagcagggaguacagcaguugcagugagaacugagugggguuucagacucuuguguuaucuaugaugugucucccuugccaaaaauucaugaaguacuuccaaaacaggaucuuagugaagcauucucaagcagaaacagauacacuugcuuguuaaugugaccaguguugagagagcucuaaaauuaccugguagcugugugcccugauacacccccuccagaguagcaguugguacaaguguuuuguuuuuacuuuuugugacuugggaaauuagccugggauucuucaugacagcagcagagucagugcuugugcagacggacaguucuuuauuacuuggcucuuuuauguugaaaagaaaauaguugaggauucuuuuuuccucuaguuggagaguaggagcaaaaccucaagagaagagauuugaauagggacucuuccaaacuuccuuuuccuaccaacuuuucuccaggagggacauguaucucaucugcccaaauccaaauuaccaccagcagugacaugccuguguauccacagaaguuuaagauuagaguggaguuaucuuuuuuuuuguuuuuguuuuucgagacagguuuuccucuguguagcccuggcuguccuggaacucacucugcuguagaccaggcuggccucaaacucagaaauucgccugccucugccucccaagugcugggauuaaaggcgugcaccaccacugccuggcagaguuuccucuagacuuugcugaaguucucuuuggcugagcuagguuuugacuuuugauuaggcuaugaaugagagugccuucugggcauuccguuaguccaguucuucucugggcugcucucugaagaucucugagaacuuaguggauggaauucugaaaaagggaaccaagaaaguggguugcuuauuuucaucuuaaauuguaauugucucugcagacugcuugagggaagauugagggguauuuuuucuuuaauugccauuaaagugagagaagauugcagacagauuagaauauacaagucaaaauaaaauaauuauuguggggcuggugagauggcucaguggguaagagcacugacugcuuuucugaagguccugaguucaaauuccagcaaccacauggugguucacaaccacccauaaugagaucugaugcccucuucuggugcgucuggagcaaguagggcaaccagaguaagcagagguccuaaaaauucaauccccaacaaccacaugaaggcucacaaccaugcguucaguuacaguguacccauauacauucaauaaauaaauaaauaaauaaauaaauaaauauuguguaaccuaacuuaucuuuucuguguauucuguauauucuguuucuuccgucuuuucugguauacccuaaacaucuuguuuugaauuuuguuuuuuuuuucccagcauuauuccauaagcauuuuccuaugacucauccuuaauagaucaaauggcuucauaugguaauauauauauauauauguauauacacacacacacacacacacacacacacacacacacacacacauauauauauauaaguuuacucagggagauuuuuuuuggcauuuagcauuuuacuuugucaauaaugccuuuuuaaagaaauaguuuuguuggcuuauaauuuguauaucauaaaaauucaccuaugugguuucuuuuacuuagcaugcuuuugagguuugagcauguaucugugcuuuauucuguuuauuacugaauaauauuucuuuguauagauguaccauuuuuaaauuuuuucuuauuuuuugagacaagggcccacuauguagcucaggcuguccuggaaaucaguauauagaccaggcuggccuugaauucacagagcucuaucugccucugcuuccugagugcugggauuaaagguguaugccaccauacccagucuauacauuaauugauagauauuugcauaaacaaugcagcuguuuuuaguauauuugcgggguugaauaagaucacaccaauccaauuuuagacuauucucaccuacuuuguuuguaugcuuaccuacucagacauuucgugguauuguaauugugauauguauauguagucuuuaguaacuggcuucuuucacuuccaguuacuuuuuuuuuucuuuuuaauguguguggguguuuuugccuguguacuguguucauacaguacucccagaggccagaagaugguguuauaucuccuggggcuggaguuacaaucaauugugggcuaccuugugggugaugggaauagaacuagaguccucuggaagaacaacugauguucuuaacugcugagcugucucuccagccccauuuacuauuguuaagauuuauugcuuuuggagcauuugcuggcuucagucccaguuuauuuauuuccuuuauaccuuacuuaucagcugauagauauuugcauugcuuuccuuuuggguuuugaacaauguugccaagaacauuguuuguuucuuuguuuuuguuuuguuuguuuuaaauacagucauguauucuagucuggcuuugaggugguccugcuucaaccucccaagugcugggauuauagccaugugacaccacagucaacuaaaaacauuuuuguguaaguuuuuguguggauguguguuuucauuucuuggggcuuuucauuauuaaaugugaucuguaguucucagaaguuuuuccuuuccuuguaaaaauuguccugcaguucuguguaccugcuggggagaaaaaccucaagauaggggaagauggcuaugagagaauguacaaaucugaggaacugagcucuuuagagcagcuuucacugcccucagacagguggacuggcuacagcugaguucaggcuagacaccagaaggagcagauggugcugcugagagugucauuuccucuaugggauuuaaucugagcauuuacaucaaaccagccaccuuacuggaauaauguaauggcuucucucuccuuucacccuuguccuaauuggaacuagccuucauuaucaacagcagguuuugcucuucuuguuucuagaucauuauaaaaagcucuugaaacugcacacuuacaggucaccuuguuguuuuaucagagugucaagacaguuucuuucuagagaaacagagggaagacaaaaugggguacuucaguuagccaucucuugguuccuguaucuggaaccaagccaaagugaguccuggaaaguucuuuagauguguguguauaaauauuuaugacuauagcuaucuauaacuuaccugguagaguucauugacuaaaauguugggauuugaaguagguccuauuguuaauacaaauucuauuuccaaauucuagaguuucaagaggcccaaugaggagucaaauuauuuuuaauuugauuuuuuuuuuuugagacaaaguauuuauuucuagcugucgggaacucacuauguaaauuaggcuggccuagaauucucagagauucacuugucuauuuuuuuaaagauuuauuuauuuauuuuauguauaugagugcucuauuuucaugaacaucaacagugggaaucagauucuguuauagaugguugugagccauuaugugguugcugggaauugagguuaggaaccucuggaagagcaaccaaagcacuuaaaucucugagccaucucuucagcccccgccuaucuuucuuuuucucucucucuccuuccuuccuuccuuccuuccuuccuuccuuccuuccuucccucccucccucccucccucccucccucccucccucccucccucccucccucccuccuuccuuccuuccuuccuuccuuccuuccuucuuguuugguuuguuguuguuccaaacaggguuucucuguguaacagcucuggcuguccuggaauuggcuuuguagaccagguuggucuugaacucacagaaaugccccugcaugggccucccgagugcugggauuaaagaugugcaucaccaugccuggccucccaccugccuuuuuaaucuaccugcacuguugggauuaaaggugugugccaccacaccggcauacaauuuuugucuguagauagguuucuggauuccaucugauucuugugcaacaaacaaguauaugaagagaaacuguagguucauuaaaguugaaagacuuggacuuugaauucugagauccucuuuaccucuuauagaaaagagaaaugagaacuggaggcuuaaggaucaguaaagaagccaaguucccaccucaguaagaucaccuugucucuuuguucuugcucuccuugggccccuguuuacaaaguauauuggguucucagccagguuucugauucauuauuuuguuuuguccugaauaaacuuauguuuuuccaugguauguuguuguuuugagacaggauaugcuuaugguacuagggauaaaacccagggcuucaugaaugccgacaaacauucuaucaucugaacuacccuagcaucugcaguagugagcaacaaagggggaugugucuuuacaguguuugaaggaauacuuuaaaaaagagaacauuuuuaucugugugaggaauacuuuaaaaaagacaauuuuuauuuauuuauuugugcaugcuugcgugcaugagugcgugugcacacauguagcgugcuuacuugagugcaggcacccauagaggccagaaagggauguuggaaucucuggcccuggauuacaggugguugugagccauccaaugugguugcuggggaucauucucuggugcucugcaagagcaguacacacucuuaacuccugagucaucucuccagcccuagggaauacuuuucuuaaaauggguagaguugcaugacaacuaggcuucuuaacuuuuuucccccucugugcugugccuucuuccuuccuuccuuccuuccuuccuuccuuucuuucuuucuuucuuucuuucuuucuuucuuucuuucuuucuuuuuucuuuuuucuuuuuuuuuuucccuaugauucaaaaaugucucuugacuccaggcuacuggauugucuccuguuguuuuauuuuccuuaggucauccaggugagacaguggcaggugcuguuagcauccuagauaugguggaauuacuugaagacugggagacaguagucaucugaugaauccuauacccucuccucuuuauuaccuguuuugucuccccacccuaaucccuuccuccuguuaucugacaaccccuucauagcuguggguuugacuuccuugggcuuacuguauaugcagucagucauccacuuaaaggcaaugugaacacacaucugaaacuguaugucucuagucaguuaggaaagaaacagcucauauauuuucauuuuucccuaucccugaaagcuagugaacaauguuuuguauuuggugggugcuguuguuuugguugguguucugacagcauuuuuagaccauuagugaaugauaugcuggcugguuauuucucauccuccuuuagguaugccaucugcuguaggaaggccaccuuccuccuuguuuacuccuaugggggauuuugcuuguuacacagcaguauagcaagaaaaacaggcuccggguuucauaaaaauucauugacucaucuuuuuuccuguuuacguguacccucaaguuaggauaauuuaugaauggauaaucagcuugggacugguaagaggcagguauaguuacugcagaaaccaagaaguaaaucuugguauuuauuuggcauguagugaauacaugguuggauacauuauauacauuuuguuuauuuguuuugagacagggucucacuguguagcuacuauguagcccuggccauucuggaguucacuguguagaccaagcuggccuuaaacucacagagacccuccagccucugccuccaaagugcugggguuaaaaauauacuccacuaugccuggcuuguuucuguuuucuuucuuuuuuguuuuuguuguuuuguuuuguuuuuugagacaggguuucucuguguaaccuugccuguccuggaacucccucuguagaccagugcuggaauugaaggcaaaugccaccacugccuggcuuugauugcuuuuuuuucuuuguuguuguuuuguuuuguuuuguuuuguuuuuauuuuugagacagggucucacuauauagcucauucagcaagggcaaucaaaacaaacuuuagggggcuggagagauggcuuaucaguuaagcguacuggcugaucuuccagaggaccugaguuagauucacagcaccuaccugguggcucauaaccaucuguaacuccaguccgaugggucuaaaauccucuucuaaccucugcgggcaccaggcacauacaaucaugggacuaaaacuaucaauccugcccuaaaacuaauguauacauuuguuuuugcagcuuggaggaauaaauauauccagcauagagugugaauucaguuguagauaaggaaauagcuaauacggggugacuuguuucuuuguucuuuagaaaugaauaauuuuguuggugcuucucauuaucccaugaaugcuugucuaaaaguacauguuuauuuuuaggaauauagguagagagugguagcaugagcagaugucagagccauugguggcagcuuuagggaugauauagagaggguggugcaaaggugacaaggaauuuuuuaaguaauguguuuaaacucauguguuaauuauacaagaauuuauuaagugcccucucccagauucuuugcagcacauuuuaacacuuaaagaugcauuauuugaguuguucgcuaguguucuaguuagucuuuucuuacacauuucaaaccccuucaaugugcuuuaaauuucuccucuuuacaguaugugcuagacaucuauauuaacauauauagcagcaaaacaggcaaaaauuucugcauuuuacagguucucacauaagacauuucauauaaaauauaugugcccucccuaaucuuggggguucuucgucuguggauucagguaaccuugcacugacaguuuggagggagggaaaaaaauguaucugcauuggccaacauguagacuuuuuucuuguaacucuaaacaauacagccugacaauuauuugcacagcauuaggacuuacaaguaaucuagagaugauuuaauguauauaagaagguauuuguaaguaacuacugugcuguuuuuaaauaagguacuugaauauccucagauuuugguauccacgggugucuuggaaccaauaaucuuugacuaccaaggaauagcuguacuuaaauuuuaguucugguauacaaaugggaaaaguaaaaccuuugacaaugaguugacauuuuuuaaaaauauuuuauguguaugaguauuuuaccuacauguguauauauaugugucacauguauguguugggcccucagagauauaaagagggcauuggauuccccuggaacuggagggaaauuaaagaugguuguaagcugccaugugguuccugggaaucaaaccuaggucaucuucuguaagagcagcaguauucauaacccuugaccaucucuccaccccacccccuucccugaaggcauuccgcagcuacuguacugagcucaugcugggaaauggaaacuuccagggauuuuagauccauaacacuuacuugcugaguaacagccguguaauagcaguaucuccuuuguuguuccccuugcucagcacagaaguccuaaacucaguauguuuuuuauacugaugggacaaaaauucaaauaugaggacugggagguggcccaacauguuggacaguucaaaacugcuuguaauuucagcucuagggugaucuagcacugauacucaggcauguacauaccugugccccauccccaacacaaacacagcacacagauaaacacuaaaaauggugaaaauaaaauuuaaaauugugaauauguguauaguuugaaaaagcagcuguaauauccuuaggaagaguguuuccauauaauauaaagguuuuauuuuuauuuuuauuuuuuuggaggaggaggaaaguccccagagacagaaauacugucucaaaaucuaugugguugacagaucaaauaggaauaaaacaaagcagaaauucugagcuuauugguuccaaacacuuuuugaguggcucagcaagcucaccccaauuagguauguugaucccuugguucuaacugucccuuugcagucaucugauugacuccucagccuggugguguuuccaagcuugagggcuuuugaagauacuuccuucccuuugauguuaccagaaggaaaucagcuuggucucugaugauaaacuauuguccuauuguuuccagagaugagacugugcaaggacauuauagaagaauaauauucuaggucguggcagccuagaauagaaaagaauauggagugccagcguucuuggaccagagauguaauugggcagccugccugcuuuuuccauuuaguugggaaaguggaggaguaaaacuggccaugggccaggcgcauuuucccuauuccucuguccuuugagaaugacaguuguuuuagaagagaguccuuaggaggaggcagcagagaagcuaguaggcuuagagcaaccuugcuucagucucagcuuuucugcuucccagcuauaugaccuggaacaaauugaacuuugauuuucaggguuuuuaacauuuguuuagaugaggucucacuauguaguagcccgcccaggcuagucucaaacucuuggcauucuuccugccuuagcuuuccuaauucugagguuauaggcauucaucccuaugccuagcugauccuucaguuuugugguuaguuuugaaauaaaaccaauguuaaugugaucucuagaaagguaccuuauuaacauauuaaugauuaccuagggagagaacucuaggucauaaagauaagagaaacaauaauuuaaucuuccuuuuuucucucucuuuuugagacaagucucucuguguguaacucugacacucuuagaauuugcuguauagaugaggcuggccucaaacucacaaagcuugccuuuaccuccagagggaugggauuaaaagcauguaccaccauucuuggcuaaacuauaacuuuuuuuguuuguuuuuguuuuuugagacaggguuucucuguguagcccuggcuguccuagaacucacucuguagaccaggcuggccucgaacucagcaaucugccugccucugccucccaaaugcugggauuaaaggcaugcgccaccacugcccuggaaacuaacuucuuaaacuacuuuucuguguuacuuggauuuuauacuagugguauguauaacuugaauaacguauuaaaaccacauuuaauaaaauugauaugagaaucaaaaggacauauuuaaagcagaaggcacaguccugauaacuaaaagauauucgaauagcaguuugggaaagauaugauaaaaguaacgggcccuugcugucuuaguguuaguuuucugaguacauagcuauggguaagucuuuuugcuaagccucagcuucuucaacugaaaguagaaguuaacaauugcauguacuguaggcuguggguuuugaggguuauaugaagugagaaauguaaagugccuagaccgguaucuagcacgugggaaguuuucagcuaauaauguugguguugccagcucuuauucucaugcuuauggguuaaagcaaggugggaauuacacuuuaaaguuacugaagugagacacagaaugaauaggugacugccucccuucuucacauucucccucucuauuuuuccuccuccucuuuucuuuuuucucuaccccccccuuuccuuuucuuuuaugcuaggaccuuguuacauagccaccacaccuagcaucaugcuaagggggcuuggguuacagcagaaauagcauugauaccuaugugauuggugucugaaaacaccugcucuaucaguguagccucuagcaaacgggaggugucugcucaguaguggccaggacuguggacagugccauagcagagcaccauuggucuguccugaggaguuaacaugacucaaguuuggucaauuuuggauccuauuuuuuucccccacuuucuguggcagaugggccacagaauuacagaaggguagggcuuguuucccucuccucauuuccacaucuacuuuauuugguacauaucaggcuaucauugucuuuguuuguagcucaaguuucugaccugucaaguucagaacauuccaguuuauccuucgcugaaguuguucuugcugcugcaggccacacuacugacuugugcuuacauucauuuuuuucuuuguuccaacaggccugcauaggacagguugagcuucucuaguggaagaccuuucuuugaaucccgugauuaucuguauauuguuggggacuguaaaguuuuaaggggcuacccuugagguacccacuuuuucauacucgaggcuauccagguuucuguaccucuuuagacaaguauccuuuugucuuggaucuaggaggauguuaaaaccucaugaaggagaaccucuuaacugguagcuaauuucaaaauaagaauugucuguggagaagcacccucuuaccucuuuguugaaagucccuuuaaagcauaagcugcuuaggauuuguauuaauuuuucucuaguauugauccggguuuugaagauaguuuguuuuuaagggugaugacuaaaaauuuuggacaaaguucuuauaaaagaacuagguuguggguuuauuucaagggcaaucauggguuugcagagcagcaucagggcacuaggaagagaccugacaugcuguuuuggagcugucaucaaggaugccaccuuuugggaaucaaauuauaggcaguccuugaucucugaaaacucaugucugggucuuaucagaauuaacuaaguggggaccaguaagaugguuuguaaguaaggugcuugccaccugagugcaaucccuggaacccucuuaaagguggaaagagggaacugagucacauugauuguccuuggauauccacauucauguccccucuuacaaauaaauaaauaaauaaauaaauaaacauuaaaacuuuuuuuuuuuuaaagaaaugaaccagauuguuuuucuaacaaaaaugacugauaaaauuagucuguaaaugugggauugugggacucucuugugcguggagcuuuggucauaugugacagaucuguucuuaucauauagaggcuuaaugacucuucauuucuaucccuucuaauuacuaucuuuucccaaauaggucauuugugggaggcaggugcaaagugaccagaagguugcuuuaggaguacagagauaacguuacagagugaagucacucuuuuaggcugacuuugggauuuucaaagguauaauaccuugagugauuauaucuaaguaguggaguaaaggaggaagggaaguccccuggggaguaggacagggcaggguguguuggguggcacugugcuggguguuuuauuuaggcaagcuuguuucacuuuauagaucaggauagaagccuuagcaauauggaauacuguaauugacugugcuggagcuagaaccagauuugcagugauuucagagcugguguuucuuucaugguagacagagucugugggauaggaauauugaagugcgggaugagcuggagagggagacaauuaucugggggggggcggagaggguagagguaggaucaaauaaggguguuuggaauuggauuuagaugaagugaaugggaaggaaagaccaacaaaaccagacuaaaguagaaaaagagaaguugggguguauuucuuggggugaauguguacuauuggaggauaguucucgucugagggauguucccuaggguuugcuugaggcauaaaggaccagauagggaagggcaguuaagccccuaccgaaagccuuuugguuccuguuauuuauugacuggccuaagcucuguaaaaggcaacucccauuucaauuagcaaggcagcauuauaugcaucugaaacaucuauggauccccauuuggccugaugggagggccuguauaaugucucauuacauuagccuggcucccuacugcuucagaggucauuugugcagggggcaauacugacauuucccucugagugaccucuggcugcucccuucccuuucaggaaugaguuggagucuggcuugggaauaguaccccucuugucuguucucaaguuaggaaugcccaggaauguugauuccuguuuguugcccauccucuggcuacagggcuggaguuguucuguucauagccugacagcuguguagucagucugauuuaacauggauuuauugaguuucugcuagugggggugggaguggaggugggaggauauucacagaugguggagacaggucccugaccuaaggagggggauugcuguguauucaguuccuauccuuuggcuagugguuuuuccuuuuagcaggaucuaauuuaacaugguuauuaugagguuugaauuaauagauauaguggacuaagacacauucaaaagggugaagucccaaauuuauacagaacuaaauuaauacuauaagguaagaugauacaaaaggcuuagcauguauagaacagugcuuuuguuuuguuuugaguccacauuuugacauguugcccaaaguggcuucaaacuugcaguaccaucaagacugguuuuaaguuccuuauccuuuuguuucacucuacugaauucugcagguaugugccaucauacuauugaaagcuuccuuugugucaaacauuguuuuuacuguuuuguacauauuaacuuaucuuccuagcaacuuugaaauuguaaccauuugguaucuauuuuacaguuuaaagauuuuuuuuuuguuaguauugguuguugagcccagagucuucuguaugcuaggcaaaugcucuaccacuguguuacaucucugagacagagaggcccauuugcauuauucuuuauagcugaauauacuaacauuauccuaauaaaugcucuaccaacuauuaucuucuuaggaccacuacacuacauuaauuuaccagaauuuuauucaacuaauuucauaacagaaacucuacuguuaucaucaacauucuuaugaauuugagcaucauauccccacuuccauuaugaucaacuuauacaucuaugaaaaaacuuuuugccacuaacacugcauaugaggguagcuauaaacuuacuauauaaccaaggauagcuuuaaacuucugauucuccugcuucuucccugccaagugcugggauuacagguuuagaccaucaugcccugcuuauguaguguggaguauuaaaaucagaguuuuguaugugcugaaaugcucuaccaacugagcuacaucccuaaaccuccaguucucuuuugacuuuuuauuuugacaaagagucucacuaaguagccuagauugaccuugauucauucuuacagcccaggcagggcuuugaacuuccucaggcucccagguagcuacuauaauaggccugugucccaaaccuggcuuaaaagaggacuuaaaaaucuugccuguacuggcauagcuuguaucagagucagacugugaacucuuggccacaugcuguagccccuguaauaauccagugagcucacacgugguggagauuuacuauuugcuggcacagagaggcauagccuugaagugagugcauuuuuacucagguuacaaacaagugaagagaccccagcaacaugcuuuauguuuagacuuuuaaagaaaacaccacuccaaaacaaaacuacaaaacuucuucccucuuagccauuucuauacaaguucuuauuaagaauaucugaauuggaucauaacuaugcaguguaucugucuuuggcagcuaauuucuagagaaaucaggcucauuagaaaaggcaaaugcugauagaggcauaucuguuaagagcuauuaguaucuaugauuuuucauuacauccccuucaugugucagugccuuuaauaaauguacuaucuaugacuuaaaguuacuguccaucucauuugcaguucagggaauuacucaucuagugacuaauauucccaagucuuaaaaaggcuucagagcccuugucaucugaggugugcuuuaaaaucaccugcccauaugauaacaugaacauagaaaggaaauugucugggugguggugguagucugugcaaacaaggaacuuuaguauaaauaagagguucaaaaacaaggaaggccuugggagcuuccauaauuuaacacuguucaaaagcacagaccauagcaaggaauggugguaugggauuugaacugggcuggugggccacaacccuuccuuguccucucaacccaaggcauugaggauuugagcuguuggagguugagucucuuccaggagugaccaguuacaugcuaggacagggaugucguuaauguuucagaggaauggguaaguggguggaggacaaggcugaggccgcacaggccacuagaaaagggggauuauuuugggagaggaaaugugccaagucagaggaggaaauggggggaggggaggguggugaugcaagauauaauaguacaugagaaugccauaaugaaacccauuuaauaaauacuaaaacagaacugcaggaagauauaaccauagacucuagccuuuccagucccucaugauaaguaggucccugucauccauauguucaagauuuccuuugcucauucagaagugucuggcaccucaggaggcugcacagcuguauacagcagucugaaccauugcuauaacuuccuguuugucuucuuaugaagguucccccugauaaucuaucuguauauuuauuuuagauuuacucuuuaaauguguaucuguguguauaugaacauauauguaugugguugccugagauugccagaagaggguguugggcuccccuggaacuggaguuaaguaucuugugaguuguuuuacaucagugcugugaacugagcucagguccucuagaacaacagcaagugcuccuaaccccugagccaucuauucagcccagaaauaauguuaacauuuaaaaucaauuacaugaaacaaauuuauaccucuaccaaaauugcaugcuuuggggucagacugcuuaguuugaagucucacccccaccucuuucaacccccacugcuagguuucccugccuauaaccagagauaauaauagcacuuaggucagauaguaagugugaagugcuuaguuucguacccaacgaauaagcagucagaugcuaguuauaauaaugaugguguuauuagcuggagggcucauaauacuaggauggaauuacgaucaccucaguuauagaaaaggacaaaaugucccuuucucuauuggaaccaugauuuuauaaaggacagauugccaucucuaggaggccugauccuggaaaagucauauaguaagagauauucuugggucaccuccuagauuaaguuuucugaggcccuuguguggaagaauacagugugauuguucuggagugcuugaaucugucacuggugggaggcaaguucuuguuuagaaaaugucaccaaguuauaaccaacacuuuguucuucauucaaucugcucucuuucccccuuauguuuauuuaauaguuagaaaagcacugaaauguacuuuuccuaugugaacaugcacaucugaaacuuguuuuucccagaucuugaaaaucuuuuaaaaaucacagacggagggcuagcuuuguuaguaaaguacuugcuuaaauuaacacgcaugaaaacaugggguuugauccccagcaccacauaaagccuggccuggucauggguuccuuuaagccuagcacuugggaagcagaugcaggugggucucuuugaguuugaggccagccugguuuauguagcuaauuccaggacagucaucguuacauagagagacccugucuucccuacaaaaaaaaaaaaggaaaggaaaaauaauucaaggucauuuucaguuaaauacaugaaaucugaaauauauaccucaaagagcauaagagaaaaaaagcccuauagguaaggcuuguuucagacaaggucuugcuguggccuacucuggccaugaacauucauucuuccugucuuacuuauguccuggcucccucagagucaccacugugaaaggcugucauucaguuuuggaagcauuuuuuggucuuauauguugacucuugguuccuugguuugugcucauuuuucacacagcaaggcuguaaggaauuuuggguuccucaucuuugcaggaaucagucaggacucaggguuggaaaauguuggguuuucucccuuguucucacuaaaugcauucugggaaggcucugccaaaaggggaaauugauuguguaagaagggcauuucccuuauuauagcuuucaaauuaagaugcuuccuucuccuuucucuucuucccauaaucggaguuaccaguaaaacgguugugcaggacucuugagauguguuugucacagugugauggacagaggaguugccugagcuuguccuuaucuucucaucgaucccuauacacaggaauuacaggaaaucacagcuagcauauaaaaccgcagacagaugggaaggauggaauguguaacccccauucccagaaacaagcagagugccgagcugacugaccuuagcauuuggcaucugucagcagagucaaagcauugaggucugaagauaauggcaccaucugggaauggaaaccuuaucuuccagcucugcucaguacuccuccuccuucacaacccuccuugugccaucgucugcagguuucugucaccauuuuccuugcuaggccuuuuuguaguuguucugacuggcuuugcaucuugcuguaguuguucuggccggagucaguuagcucccuuucauggugcuuaucaucucuggggauuagguaaaagaauaaaagcuguugucagggugugacaccccuauucuuuccuuccuguguuccuggagggccucuagcugaugcuguggaauuagauuaggucagguuucuugcucaagaacaguuguuucccacugccugcugacccaaggagaaguuuccaagcuggccuuaccugaagagucaauugaaugcuaaauacuuuguaaaauaaccagaacuugccagguggcagaaacuguggaaaucaguaagaauugugccuuaaucugaggauuuuagagugcaauuuauuuuguguaucuuauaucuuggguauccuaaguuuccgggcuaauaucacuuaucagugaguacauauugugagaguuccuuugugauuggguuaccucacucaggaugaugccccccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauagugaagcauguguccuucuuaccgguugggacaucuucuggauauaugcccaggagagguauugcuggauccugucuuuguuucuuaauacuuuuuuauuacuguuuuuaagauauggcaucauuauguagcucaggcuggccucaaauaugugauccuccugucucagccuccugagagcuggauuacagcuauauaccauuguugcauuuucccagccaucaaagcuuuuauguccagcuuccugacuuuccuuuagaaggcccucuuugauuaucuugguucagaguaauuucuuuuuucucuuuuuguuuuucauuauuuuguucauaacucauaaguaguuguugcucauuccucguuuucauacuuuacaguucaacauuauugcacccacauagaguauuaagauagauaugccugcuuugguuguuugcuaucugaaucugcagucaccuuaacucuguugaaaguucugaugaguuugaggucugugccuucuauguauuuuacaaacuaucuagagaagacuguuaggaaaugauaaaacagcaaacaugggucuuaacagaauuucagguguucucagaggguagagcaaggaucgggagacugggugccauuuggaguuuuuaggauauuggggaccaacaccuaagagaaacuggcaagaacaggcacaguauuacaaguuuguccuaccuugagauuuuucuagaagcugaaagguuuggguagaaaauacauuuauuuuagauugcuaggagcucuuagcaggggccucuauuugcucuaguuccuuuuuguggugaaucaccccaauagaaggugugaaaaaaugcuuagucacagggaaguuuauaguucaaggaacuagauaggaguaccaauaagcagagcugucagacuaaguaaggauuuacguauuuguauuauugacauugaauugcauuuaucuggguagcuuggagauuugaacuuguuauacaaaggccuaugcuagguuuuuaacaacuaauagaaucuugcauaaaauuaaaaguaggccgggcgugguggcaaacgccuuuaaucccagcacucgggaggcagagaaagacugauuucugaguucgaggacagccagggcuacacagagaaacccugucucgaaaaaccaaaaaaaaaaaaaaaaauaaaauaaaaaaaaaauaaaaauaaauaaaauaaaauaaaaguaguaccuucuacuucugacuugggaguagaguuuuaagcaucauguugacccaucccuacucccaaaccccauuucucuuaucugaacuggcuaugacuguggaacauuuguaacaacugugagcaaggaccaacuucagccagauaaauuccuuggguaccuuuaaguuugcugaauuuagguagaaaguguaguugcauagacagaacucagggaguugucguuuacauggaaauaaaacuagugucaauuuuuuuccucacaagacuuucuucaacucuuucuuuaccuuugcagauccuuuauuuuugcaagugcacucuuggguagcagcucuccuacuguuacguagauaagcuagugaaugauuaucagaaucccgugucuuugaaaaaugcugcugccucuuccuguacuauucugccuaaaaagagagugacuugcauuuaccuaaauguugcagcauuuugugaugaaguuuaguucuuuaguaguagugaugauuauauauaguaucagguacacugauuaaguugugaauuagacuacuacuuuguaaaaauuauuuuucuuaauaauuuaaaauguuauaagcaagggaggcugcaaagauuucugaucauuaagauguuuucaucauaccuuugcuucaaggucuuggaguauaggaucaccagccagaaugggauaguaaauagauuugaucuuuauuggccucuuucugcacauuaaaaaaaaaguauuuuaugugcaugggguagggugaauggaggucagaagacaacuuugaguagguucuuucuaaauagugauguaggucugaggaaucaaacuuagguugucaagcuuaguagcaugcuugcucuuuuuaucaacugagccuuguugccaguccccucucugcacagauauugacauguaauuuuguuuuguuauaaucagaacagaaacugugcuuuggcaguugaacaacuguacuuccugucuguuuagaugugugugugugugugugugugugugugugugugugugugugugugagagagagagagagagagagagagagauacucuuuuccaccuuaccuuacauauacucugauccaaaguaggcagccugguugagagcuggggucacagaguaauugcuguugaaaguagagguugaggugacagggcaguugggcgcugacauuaaagacuugucugcuagacugauggcccacccccaaggguaacuucucuauagugacugcuucucauagcuaaguuaauaugacuagcuagacaaggagguaggcuccugggaaacaggcuguggagucuuaauuaagccugccugcacauauccuguuauguacuaacagauuucccucagucuuacauuucuaagggucccauuuuuuaaauugugugugugugugugugugugugugugugugugugugugugugaugcaucuguacagacagagacagucuaucucauguucuguugcaaaugcuugcugcuuucuuuccagaagagaagguagguaccuguuacuauuuucucaugagcucuucgugccacacuggcgcuccuaaugaguuccuuaucugguagagcggccucagcaagugcccuuccaggaguguuuagaauauaccuaacccagggagagcagaccuguggcugauauguguccuugaagauuuaguuagcagucacauucugauugggaaacaccugagaaaacuguugagugagagaacugggcucugguuuaggcacucaggccugugucccuaggcaaguugcagcucaugcugagguuauaguuucuauuaaauugaauagauaggacaugauaagauggccuuauaguucauuuuagguaguaaugguuagggucucaugcuagcagcaaaggugggagugauucccaauucucuuuugccucuuaaguuguuucuuuuuggaaugauccuuauguuuuucucuaccucuuucaugucuguuuagguaacaucuauaaagccagggucuguuuggaucacugcauucugggugucucuggccuaccuuacuguuuuugcccuggacucagcacuuccccacuguacugccaucuguuuacuuguuugcccuuacauuuuagagaacuuccugagagcaccaccuuugucacugugacaaacuuccuuuuguccccaccucugucaucacuguuucccuaguugcugguacacugcuuagauugugguguguaugaccacuccugggccaguuugagaguuguacugggucuuucccuaacuaaacucuuuacccagucucuuuaugagcucugugggugcuggagaaccuuggaugcugcugcugauuuugagcugugccaacccccaggcacuuuuguaaucagggaugggccuuaguuuuguccuguucauauucagccaucugccuagggcuagggccaucugcugccugugagugaccugagcaagggaagcgguugugaaucagugugggugagcagcagccuauuuuuuaagggacuaauuauauggaugagucuagggcugccuccccaacucugacuucuguguaaugcauguuaugucucauuuuauccaggucuuaguuuuguucuagaugcugccuucuaacuacucuacuagagagccuuugcugaguuuuuguuuacuuugugagugcuuuguccuuuagcccugguccuugagaauaaucuucauguaauauaaauagcacugcagaaagaaaaaccagggaaauaaaaaccuuuagaaaugaaccuuugggucucuuucagauguaaaugaugagccucuaucuaucaucuuguaacuuuagguucaucacccuguuuuccauuuuuccuccugagacaucuucaaacaacauguauggacugaauuacuuacuuggaagguugugggucaagcuugcauuucuucagcuuuguacagagaaggaaaaaaugcaagaagaaaguaaugugcccucaucauucuuaguaacuucugaguuuggaggcucucagcuggcauaaaauuaugaaugaaaacuacuaagagguagggauaguaugggaauuuuaauuuuaauuuuuuuaaagauagggucccaugcguuucagguuggccuaggacuugauauauaggugaggaugaccucaccuccuccuaagugcugagauuacugguauguaugcuccgucagaccauauuuuaggcaguguuagggagcccuauacuaaaugagugagcuacaucccccaccccaagaagaggaguaugcaucuaucucuuucucucucucucagucugucucugucucugucucugucucugucucucucucucucucucucugugugugugugugugugugugugugugugugugugugugagagagagagagagagagagagagagagagagagagagagagagaaagagaacuuuuaaacaaccaccacaacaaaaccucagugguaggauuaaccaguagaaaugagugggauuggcuacugugcuaucuaucuuuuaggacuuccuuaaagggcugcuggggaccuuuauguagugaaagauaaaguggcugaagucugcuggcaggggaauguuguccuuggcauucaugauagugcauugugggugaauaugucacaaugcuaugaguauaauaaaagaaaaauauacaagucuuuucauuuuggagagugauacauaccauuauuucauuuuaacuuacuuguggauuuccuucuggguugcucauuuccuacuguuucuaacauagaugcugaggcuguuuaacucagacuuugccuaauuuaucucucuucucuugucuaauacucuuaaaaagaaaaaugggagaaaaagaagagaaaguaacuaagaaucacagaauuuagaacagagaugcucuccaaauagagcucaccugucccaacccucuauuucaaaugaugauaacaauaauaaggauagguauuagugauaauagucaugcucuuaacugcugagccaucucuccagcccuguauuaauaauaguaacuaucauuuuugaugacucaugccagcauuaugcuaaguguuuuguguuccuuuccuuauauagugcagaaaagccauguaggugaaauaaguaagcagaagaggaaccggagguucaggcagguuggauaguuaugcugggauuaugacuggaagcccgucuugugcagcgaugaauuaucuuugcuugcucaaggucaguuuuuccaguuaguggugauacauaaguagagcccacuucucuugacuuugacuuucuuuuuuaagacuuauuuauuauauuuauaugaguacacuguagcuguuuucagacacacacuagaagagggcaucagauucuauuacagaugguugugagccaccaugugguugcugggaauugaacucaggaccucuggaagagcagucagugcacuuaacugcugagccagcucuccagcccgacuuugacuuucauugagcacaguuuuuguuuuguuuugaacucaaagauuccuucucugauuauuuucucuccuuuauugcucucuuaccccauuuaauuucagugaaacugaaugaaauaaaggaaaggaugguuuaaguuuggaguuuuuggugagcuuuaaagguuuauuuuuaaauaggcagucuucccagacagacugggaauguagcagaaggccugagaaccaggaagugacacagaccuguuuauaucaucccacuugagggccuuuggaaagccauccacguagaugcuaaaaaguaaacacaagggcagcagccuuuucuuugcguuuucuauuucugacauggaggagguguuuccugcacagcuauaacuacucugaacacuaaaaucugguuccuaaauauccucuccagugacauauauagauauguauuuauuucuuguuaccagacagaaacauucugugauucuaggcagauacaaugaauugcuccccucuucguccuaaaaggugacuugguauucugaguuuuuguucguuuguuuguuuuguuguuuuuguuuuaucacugcaaauaaguaauuucugccugcaaaagauucucuuagaagugugaucaccaguuuguacuugaguucaggguacagcucauacauacccaacccggacauaauuauaagucuuuguucuuaacuuaguucuucaucacuuuuuaggauaaagaggggaacaauucauugugucugcuuaaaaucacagaauguuucugucugguaacaagaaauaaauacauaucuauauaugucacuggagaggauauuuaggaaccagauuuuaguguucagaguaguuauagcugugcaggaaacaccuccuccaugucagaaauagcaaacccaaaggaaaaggcugcugcacuuguguucauuucuuuguuuccucuuagcacuauaaaauauuuuuuuucuuuuagguccuuguaacaauuugaaugauguagauaaggauguacuucaccagcauauuguaaauucuuugagagcaagauaucacauuugaucucugugauuacccaaaccuuguauagaagacagcuaguacauauuugcugaacugcaguagaguugguuccuggaaacauagaguugugaggguucagauugagcaaaucauuuucuugaauuucuauuugcaaaaugaguauuggagccuguuccuuucagcucugcugugaaucauguagaagguauaaugacauauaagaucuaucucuggggccuagaaacuaaccgcugcuguuucugucaagcauuugcuaucugccucaaacuugaacucaguacacccccuucccuccugcuuuaugucuguugcugcuuugcccucuuuucuguucugcacaaacuguuggagguuuuuaucuccuucuuccccugaguucaacaagcauuuuuggagcacucugagugguggagagaaguagaauuggugaaacagucacuaccugugguagaugcagcauguggaagaaaccugucucuguaugggcuucaaggagggggauauacuugguuaucucaagcuagaauugccucaggaggcagggacagguuaauuaaucucugaguucaaggaucacuugguauacacagagauccaggccagccaggguuacauagaguggcccccccccccaaacaaaagagcagguuacucuuuucaagcaggcaaauggguauuuaauuuuucauauaugcuuaguuaagugccuuuaaaauauuuuggaauuuggaaagagcuuuguuuaacguugagaaaggaagguucacuuguuuaauuaacucauugguuguuuugggauuuugcuuuuuuuuaaucugaacugaccucaugcuuugagccugauuucgggauguuucuaaaccacauucaaagacugcccuuagggaauccaguggguaucagccacagccugauggaagaaagaacccucaccaucaugaacugaagucaguuuccgauauagucuacagcucaugcuugcuguuuucuaccucacauagucccggaagauuggugucauccaguuugcagaugggaacugaaaauacuuucccuagaccagccgauuaaaaauaauaauaauaaaaaauacuauccaaguggaccagagaucugcccuggucugcaaugcuguucuugagagauacuuagcugaaccauuuucuguccacuggcaaggaaacagaagcaaaggacgugaaguuucuguuguaguuuggccuaacaguccaugguaaagcucugccuuaaaaaaguggcuuccuggcuacagauuagacauuuauggcugaguuccuugcuuucucuuguuuuccugucacagucauuuuugcuuuguucuccuuuuuuccucauuucuccuacauuuuuuucucucuuccuaggcuacuacagugcuacaguguuccugguguguugacuccuggggugguuggcuuuuugauuuuuuuucccucuccuuuguuagauguuuguuauuuuuggaaagugcauuaggaacacugugugcuagaugauggguacaaaugugcugauggauugauuaagcucuaaauggaaaguagacucucuuaaguuuacugcauugcagagggagauagauagaguuuggucuuagaagaugaaggcagaagggcugcuaggauagauuuaacacuucuuucuuuugguuagaauagaacauuugaagacuuuuucagaggaaauacuuucgggucacuucuagaaggcuuugaauuccuuagcccugaaagggccuugggagccauccagguccaucccuaagcacugggaagacuggguggcuugcccgaggacagaaccacugccuaaugcugaagcuggaccuagcugucuacuaucagcucccugcuauagccaagacugcugcgguccuagaggacugagaagacugaacgaggauaugguagugugucacugguugguauuccugcuugccuggaucuugggagaaaguaugaugcccugaguauaucaacagcaguucuucuggagcagcacagguuguaaggaguagcaaagcaauucaagaaaaucccuggcacauuccaguaacuuuuagguggcuuaagaggaaagcugagggugauuuuuauaauuaggagcagguuaaauuucaacaaaaguuauuuuuaccuaggagugguggagcauagcuauaaucucagcauuugagagguugguugcaaauucaagggcagccuggauuaccuagcccuccccuucucucucccuucccuucaucucccuucugcuucccugcucuggccugcagugaaauggguaagguaauguucugucaaauguuccuuaaaucccaauagaagaaauuguggcuguugaagcacugaaauaaauguuaguggcucagaggaaauagaaguuggugacuggaaauauccauaggagaaagaaauagagugcaucuacaaaaccucauauuguuuauaggggaugguaggagguccuaaggguuugaaggugaaugagaggggaaaauucugcaauuccuucaaagaugguaagaguuagcgaagggccuggauagucacuuuuugauauucuccucuggagacuuuggacuucuuguaauuacauuaugaaauguaaucaggugcuuacauucuguucauacuuuaggaaauggucuuuguccuuucccuuagcagugagaggguugguguagauagucaaaggaauacacuaucuuguucuacacucuuacucucccccaccuucuguauuagucugagauaagaaaagguuucaaauuguuuuuuucuucccaguucccuuuccuuccugauuaauggauacaugauucguggcuuauuuaauaauucguccuagccgggugugguggcgcacgccuuuaaucccagcacucgggaggcagaggcagguggauuucugaguucaaggccagccuggucuacagagugaguuccaggacagccagggcuacacagagaaacccugucucgaaaaaaacaauaauaauaauaauaauaauaauaauaauaauaauaauaauaauaauaauaauucguccuaaauaauauaugugaacugaaguuaacauuccaaugccugggaauccaggccuucugagucaggcccuuuugaaucaggagaguaaagcucggugugacaugaccccgaaacuucagcaagacuggcauucuccgcaggaguggaggcaucuggucaaguggacuaagaugaugugugcccgaucugccuagugaauagggugccugcuguuucauguugucccaccuguugcuacuuucugaagcauugagauacuuuugaagguaacucuugggcaccuucuuagcagguuguaucauuaaccuggaagcauuaaugguaacaguaagcaaacaaaccuuauaaacauugggcucaaguugcagguucuggccaagacuauacagaagcccuaggucuaguuaacagaauuuauucucaguuuucuuuuuggaccagcugagcuucaucagagccuaguaagauaguaaagucaauaaugcccccccccccccccccccccccccguacagaggaagaaacaagcagaggugaggugagugacucccuagaguuagaguuguagcuuagggacaacaugaaaguuaggggcagaaaugagugcuugucacacugagcaggaugcaguccccuagguuuuaaugucauugguucaugaauaugaaaggcuagcaucuuguccuuguggggcugaccaucuauaaucuauagcucguggggcuuauugauacugcccacuuugaggacaacagcuauguuuccaagaaacuaaaccagaacaaugaaugcaggugacuuuuuagugacuauacuacuaaagaaagugauaccccucucccaauuugguguuguuugaaacagggucuuauacuguagcccaggcuagcauuucugucucacuguuuugaguucugagauuauagguguauagaaccauacccaacugaagacuuuuaacauucuauguuaaagcagauaauuccuuauuuagaucuaauuuacuguaugacuuuuuguccaaauuagcagaguuuucuuguagcuggugauacucuggggucuugcaaguugacuuuccucuguuauuuugaaguaguaaccuuagaccauccuuuacauaaauacuccauugaugacacucuguuuauguuuucccuguuuuguaaaguccacauaccacucucugcauuguacuugaucaaguacuagguuuuauuggucucuugguucaaguagcugccuaagcaauaagagagaagccagcaguuggugagacagaauaaaucaggagcguguacuccuccaccuucuccccacuuucugucuccucccacaguuuggcaaacauuagcaaucuccugucaaaugcaagggccuaugcuuuucucuuaaagauuccaaaaugagugauuuacuaucucugccuucaaggaacuuucaauccacuaaggugaggcagauaaacaaauagauacacuagccaguucaagcugaaguaguaaaggguuccaaggagccaguucuccugggaauaggcacgguaggaagugucaggaaagggacucuuucuggagauacgcaucagacugaccccuuaaagugacuauuccuagaaguuuguugaggaaauagacaaaaaggucauguuacaugaaauugauuuguauuuuaucucucugaaaaguuaauaugaguacaaaguacagugcucaagaauauugagaaagugcauauaguaauuguugguuuuuuugccucuugauuuuuaaccauuuaguuccucuuccuaacagcaauguuuguugugcauuauuccugagugauuuuugguguauauaaguguguguguaacauagauccuuuaaaaauccaagcaugggcuggguauaauggcacacaccuaacccuagcacuugggaggcugaggcaagaggaugaagaguuuaaagcagccugggcugccuagcaaggucaauaccaaucugagcuacagagauuauaucuuacaaagcuaacauaaauuaauaaauuaaaaaacuacaaguguaggggaacacccucauagaggcaggggguggggggggagggaagggauaggggguuuccagaaggaagaccuggaaaggggauaacaauaaggaaaauauccaauaaaagaaaaaacaaacaaacaaacaaacaaaaaaacaaguauacauccauuuuuuucagacauuaaucuaagaaggcauuuuauauuagcaagguuuagaugccccauuuuuaaguaaccaaacaguauuuuuaaauguacuauaacuaauuuagccaaccuccuucuuaacuuucagauugucccaguauuuuccuuuucuaaacaauguucuuggguguccuauauaugucuaugcuauuugcacacuugugauuucugaugauagaucuggaauuagaaucaauaagucagagaauauguucuuuuugggaccuguguuauuaaguugccuuccaaaaaagcauuauauauaacauaaaaauguugacauuaucuucugucuugaccaauucuuuaaaaagugagagugaucuuaaaaaauaaaauugguguccugagacuaaagagauggcuuagugguuaagagugccuaucaaguagcucacaacuguguuccuccaguuccagaggauuuaacaccccuccuccaaccuccacauucaauaugugcauaccuauacacagaaaaaaauauauauauacauaauuuaaaacaauaaaauuuuuaaaaauuuugcucuuguaacuuccauacuuaauauccuugucaguuuuacuuauuuuucaaguacacauucaacuccuugguuuagccuucuucugaaccuuugucaggaguagucuugauucaccuguaugugguaaaaccuuccugcuuccucuacagcccccuguccuccaauacaucauuuaggacucagacuagcaucaagcuccucugggugguauuuuuuaacuccugauaaucaugugcagaacaccuaaggcacuaccuuacaugaaugcacucaccacuuaaauauguauugcacaugugcagugauauggcacaugcagauggcauucuugaugguucccaguuguugccuuaaagagaugacugaagaauuccucauagggcuaucuacuguggauauacugaaaugguagcaccacaaggcucauuguuaaucuuuuauuagccaccuagagcucuggucauauccuuuaacaucuuuaaccucuuugacuuuaaacaccaccaccucuuuuuacaucuuauagaaaagcugcuuggcuguagcagcaaugacaauaagguuacugaggacuuaaauagguugggcacuuugcuugagucaaaaccuuucacagagaggaaacugggcuaagagcuacaaggaacaaauauuucaauauaggcauucccagucucccguuuguagcuauauaaaugugaacccaucuacauaugcauagacauacagacuucucugugagccacucugucuacagcuguaaaggcucaauuuagagucuggguaaaagccaagaaucaaagaggcuuuugucacaauugucagaggaaaagaagucaagaucaguuauuggcuagcucuguucuugaucccugccuacuguuuacugaagagucucauaacugcucuauuuuauacugagaaaacucauguuacuucuugcaguugucuucucuuggggggaaacaugaguugacuucagacauauauuaaaguugagucugguuaucuuuggccaagacucagggaguccuuuauaaggguuauaaaugggaggcccucugaucugugcuuuuagagcuuuacauugaauguauggagauauuuaaaaaauaaauuauguuauuuugaauaccuccuauaaacuagaguauuugaguagcugauaaauaacugaauaaaauaggccuauuuuauguuuuaucaacccagcaucuucucuaaagacauuuagaaaauaauccuuaaauucuugacuacuacuugguuuugauuguuugagacagggucucacuguauagucuugguugaccuggaacuccccauauagacuagguuggccuugaacucacagagaccucccugccucuuccuccagaaaacugaguuuaaaggugugugccaccacacugggcuugauuuuuauuuuuuucuuuaaaugguacuucuuacuauucuucauaagucagccugaaccagaaugggugguggggccauuuagcaacuacagccugucuuccacauccucaucauuuuaaaggcuaguuaauagaaugucaccccucuggucacaggcguguggguugagccuugaaugguuugagauucggugcuguugaaagagauccucagagggaggcuucuuagccucugauaagcaaggccucugugcccuuggcuccugcugcugcauuccuucucuaggcgguguaguuauuccuuuaagacaugugcucacucuguuuuuccuuuugguuagcugaaguugcuuugaggccaagugacauaggcggagcagcucugugucaacagcugcuuucugcuggagcccauaagccagugguccugacagagcaggcaauuucugaaagggacucugaccuggcuggcugggcagguaaugcacaggugagcuggaucuguccucugucccuuuuugaaagggucugccuccuagaucagauuuugacuacagcuggcggcgaacuuuggaagcucuccaggaggagcuucugugcuugucucuucuuggcaguaaggauucaguugcuagaauucuuccaacuuugugugugauuguggcuuccugacagauugcuuucaucuaaccaacuuauagcugaacuuuucacauuacuuaaguucuuuuuuguuuguuuguuauaggugaagcuacuccuggcuggcuuuaggauucuucuggauuuuaaagucguucuuuuuaaaaauaaauaaauaaauaaaaaccuccgacggauaaaagaugugccauggcaagauagcaccaaagagcagcucagaguuuguugugacuucuguggggcauggaguguuucuucaacuggugauccuuugcgcucugcugggagauggauuagccucugguaaguucacaucugccuuuuguguuugggaggggaagacuuuauaccaggauuucuuccuggaaccucagacaguucaggaagagcuguuuguuuguuuguuuguuuuguuuuauuuuauaaucugguauguacagcacaaagccaguucuuugaagccuaauagagugagacgggaagccugcuggugauuucaguaucucccuucccuccagcuguuggcaucuuuagcaagaggaaaacuuaggaugcagggcaugauauucagggaaggaaaugagcugaguuagacuaccuggguuuagagcccauuccuauuacuaccuaugacccugagcaaaucacuguuacugugaauuucuggcuuccucagcugcagaguagguuaaugacaguaccuaccucucugaggguuguaaagguauuauuauuauugcauaguaaaacacuacuuaaugauguucacucucuuguuguuguuuguucauuuuuuuccuuguuuuucugugccucuucucagacuagguauauaguugagauacuguaucuuagugaaaauagggccugguaacuggcauuguaauuagagcaaagccacccaacuguccuguugcucaguuucuucauguguucaaugaagaaguugacugucauuucuagcuccucagucuguucuuucaugauucugagagcuuuuuuuuauugaggaugauaagauggaauguuccuaagagaggcugagaaugcaggagugagccauuuugaauuuguugauucuugaugcguuaacaguacucuaaagucccuaaucgcuucauuuugugcaauccagaccuggcauccuuuccaaaaaaaacacauacuuggauguacugagcaggccauuggauggcaugccagaagcaucuguguaucugaguccuggugugaacauugguguuugacaauaauggaauccuugccagaguucuuuaaaacaaccaggauggcaauuuuuuuggauuuguucccuggagagagauugcaguuauccuggaauggggcuuuagugguaauaaggcacauuauauauggcuguggacuuuucauaauucagugcuuucucuucuauugcuuaucauuucuauuauccucuuacccauacauacugauaggagggcagguucgucuacuuguagcauuauucugaacuguugagagaaacgguuauugauucgguuguuucauuauagccuucccuauuguguacauacuuccuuuucugauucuucuccuucugcccuuuccuuccuagccaugaggaaggaaccccaguucaaccucugguaccauugaugauugggacuccauaguauggggucaugcuuguaugaaaaggaaaacaagacuggccuauacaaggucuccagaagugauagguacagaaacacaguguaaaaguugucaugcucacugcucuuaacuguagagcagaagcuagcaaguugcuccacgcuaaccucccucuauguagcgagagcuagucuggagaacuugaucuaaugcuguaacacagguuggccuugagcuugaggaccuccuuccucuaacucuuuagugcugggauuauaaauguguaccaccauuccuggcuucugccugcuuuuguaugaccugaaugcuaacuguauuuuuaacaugcuaaaaaaaaaagcagaaaaguaauauuuuguuacauguaagaauaauaugaaauucaaauuucaauuccuauaaguuggauuugaguggaacguggugugcucauucuugaauauauauugucucugguuacuuuuguucuguaauggcaaaaaguuaaauaaguaugguaaaaaccaguggcuaaaguguuuggcucuuugucuauaaucccagcauuuaggaaauugaggcaggaggauuaugaguuuaaggccagccugggcugcagaaugagacccuggaucagacagacaaaagauuugguucuucauagaaguuuuguauuccucuguucucauuccccacaguuagccuagaacaaaugcugcuuaguagguaugugcuugaaugagacaacugucagcacuagauuaggggugaacuccucagccagauuucagaaguuauccauuugcccgaggucuuaauagcuaaugguagguccaggaacagaaccuggacuagugccuaggaaccacugcaaacugcaucuccccggauuuuuccugggaagcugcccuagcauguuaagcugcauuguugcuagcagagaauuggaagucuuuagccccuuuaguuucauuaagccaucucauccucuccaccuuccuuuuuauuguucuaugcuuucuuccuuccauuuuccaccuaccagacaccuccccaacuuucuacccaaaguuucauacuggcuagauaaagggauuauuauucuuuacuguggaaaaacuaucuguuuauaaugugggcccagacuagaauggaaaaguugaagcuguuuucuuucccuuccccacugcaaagaaucuuuccuaccacccuaacauucaagucauuuuuauuccucacaacauauguacuaucugggagcagagugcauacagggagaaggggcuucaccaucacuaaaguccagugugccaacauugcugccaauguuuucccucugugaaguggcuucuaggagaagacgauacccaccccuuuggccugaaaacucagagcacaccugcauggcugugauugccaugagcacugugccaaguaugcucaccaggaaaccaaaacucucagauaaacagucaagcuaaagaaaggcaguuccuuucaggaagagccccugcuucccccuugugaauuugagugugagugugagagagagagagagagagagaguguguguguguguguguguguguguguguguguauguauuaggggcgugcaugaaugugaaugugaguuccuguaccuaaacauaugcaugcggaggccagaguaagacaucuggugucuucuauuaucuuaacugccuugagacagggccucucacugaacuagaagcguuguuuuggcuaccuggccagcuagugagcucucaggagcuccuuaucuccaccccacaauauagauacauguuuuauaggcuuuaauguggaugcuagggauucuaacuucaguccucagguccucaaacuugaauagcaagugaucuuaaccuacuaagccaucucuuccagacccuaaaucucaauuucuuacguguuuuuguagcugcaccugaauacccauuucagagauaucuuaaaaugaguguuuguaaaauauauagccuugccaccauuggacucuaguagacaauagacaugcucacaugucaggcacauuuaugguuaugagaaucccauuggaccauagacaaugcguucccuagaggcauuaugugaucauagccucugauuauaaaauuacacagagccuugacuauaaucucagguuaaacaaagaagaaucauguguaaagggucacuugagaguucuaggguuaaaugacauuguuugggguuugauuuccauagucaucuugccugccugccugcccuuucuuccaucuucucuuccucauccuucaggauuguuuguuuguuuugguuguuuuuugaaggaauaucaacuauguagccaggcugaccuuguacuagugaucuuucugucucaaccucucaagugcuaggauuacagauguguguuuucacaccuagauguugucucucccaucuauagcucaagauuuggaauuauacuaacaaaaguauuagagaagcauuaaccaaaggccagauuuuccuuuggucuuuucuauaaacagagauuuauuuauuggaggcuccauuuuaggugugacagaggaagcauaucuuguugugcagaagcacaauucgugaucuucaugggaagaucaggauuaaaaacaaacugugugugugugcuacucacacuaccuuucuuggacuagaggaacuaggaccccacugugggaagucucuuccagcucugucugcuugauccgaagaaacuugaguuaugaccucacuugaccucuuucaugcugcuauuaaagaggaacaacaaucuuuaagaaugucagguugguguguuguauagacuaauaaaaaugauuggacagcacaugacauauaaggugugauguaacuucuaaauaacaacagaguuguuaugugaccuacuguugagucacacugcacaguggacuuugugaagacaacaccuuugcucucaugaaaacaugaacugaauacccugagucacuguuuguccagguuaagagauuuggagcagguguuaaaucugacugaugaaggauugcuuacuugaggaaucccugauguuuuccacaaagcucauuuuugcauauuuugaugaucucaauugagguggccugcugacuuagaucaaaugcuuugcguucucaguucagaagauacugacaacucaguguucuuuguuucugauacccucuccccauguugccaugaugcauaauaccauguuaagcaucacaguucacacaaugcaauuuugagauagugggaaaagcagccaucuguaucucuauacagcagagugagaaaguaaaguacuuaguuuuuaaaagauaaaaauuguuggggcuggugagauggcucaguggguaagagcaccugacugcucuuccaaagguccggaguucaaaucccagcaaccacaugguggcucacaaccaucuguaacaagaucugacacccucuucuggagugucugaagacagcuacaguguacuuauauauaauaaauuaauaaauaaauaaauuaauaaauuaaaaacaauuguugagaaccagauucuuuaugauaggauguagcuuuggcccuaagcacuacuguagcagagagauuuugucagacuucuuuggcucgccucaccaucucaggaggaccugaguuagauaauguauaccaagcugggggugguaggacagcagauagauaggaaauguacauaaaggacaccauuucugugccuaauggagagaggaacuuagguggauguuggguagcuuaccugggcacauaauugcaagugcuggaacuggcugauauuuauguucaucugacucuguucaugacuuugcuggcauuggccuaccuguacugaaugggagguguccuuggacccauuucuuaaguuuccugauugaagggugaaggccagcucucagagacuuguucugauaaugaauaaagacccuaucuguguucuuuccuguaucaaaaggauacaggagucaucucuagguuaccauguuuucuucugaaguuguguucuuacccacaguggcucuugguuguuugguuccaguuuaggcacagggcuugccaaggcaguucuauucuuagaaaggaacaaugggggccauagcaauguguuucuaaaugaggauguaguucccaaaacauccgcaaagcaucuuccugucagcugcaaacccuacugacagaagugauguaaucucuccgugggguaauuaccugugacuauaaaaagacuugaggauugugguaggagcuggauaggucaauugcuggguuuguugaacccugguaucaugaaaagacauugagaaauuauucucugcagacuaauugugccauguuuagaacagguacaugucuuucuaauaaauaagaccugagcccaccaaacugauuaccugccugaaucuuaguuuaaaauccucauuaaacagaaacuuauaucuguucagcaguggguaucccuuuacuguggucuaacuuguuaacuuggaagguguuuuguuuuguuuuguuuuaaaucuguccaucuuuucaucaaaagaagaugacaacauacuaaaaacaaagagaaaaaaagaaagaaaaugaguugguauucagagucucuaaugauuguggguagguuuauagaugaacucuuuguauuaccuccuacccacuggaagauuccauucuucuuugucacuuggaguauaaaccuuugaagggugugagcagcuucccacucuagguggcuuaugcugcuguggcugggugccaggacugugguaagguaggcaugacuuuggccugcccgguguuuaccuuuggaggccagagagacagcaguguuuaaaagacagccuuuccaugguuccaugugaauaagacuucauugauagcuuagcucuuccaacucacuugagcaaauuaaauacaaggauaucugaauucaugagaggauaagguuaauauuaaauucuuacaauuuauuuguauagaagugugaaugggucagauagauucaguucauguguaccuucaguagugacugucauagagccacugaggucaguaguguagcuuuguauuuauuauauguagcugccguuugguucaccucccaccuuguguuuguguguguagcaugcauguauguggggucauauguacauggaagccugaaguugaccuuuggagucuuccuugaucacuguccacuuuauucauugagccaaggaucucuucucacuugaaccauagcuuaccagucugaccggucuagcuagccagcuuguucuagggaucuucuauuuacccccccuuuuuccuuuuuucaaacuaaauuuauuucuucacucuacaucccaauaucagauccccucaccuuccaguacccccucaugcagauucuucccucauuccaccuuccccuuugcaaagaggaaguuccuuuaguguguuagcgccccccccccccccauuacccaagccucacaaguuaaguugcugugggacuaacugcauccucccccacugaggcuaaguuucugucugcaagcauaacuguaucauuaauagcauuaggaauugguucuugcccaugggaugggucucaauuuggggcagucauugguuggccuuuuccuccaucucugcucuaucuuugucccuguacuuagacaagacacauuuugggucaaagguuuauggguagguuacuguccuuauuccucaacugggaguccugccuggcuagaggaaguggccacuuccggauccacaucccccauugcuaggaucacccaauauauccccuggggccucuaccgggucucuuguauguccuagaaauugccuccuccccucucccccgccccccgucccccccccccuggcccccggcccccggcccccggccaauuugcauucucucuucccugcucucccuacuucugauuuucccacccccaauucccuccuucuaucagcaucugauaucuauuuuguuucccuuccugagaaagauucaaccaucuucucuugggcccuccuuguuauuugucuucuuugaguccguugauuauugugugguuauccauacuuuauggcuaauauccacuuauaagugaguauauaccaugcaugcucuuuugguucugguuuaccucauucaggauaauauuuucuagcucuauccauuugccugugaaauucacgauguccuuguuuuuaaugacugaauaguauucaauuguguacaaugaaccacauuuucuuuguccauucuucaacugagggauaucugaguuguuuccaguuucuggauauuaugaauaaggcugcuaugaacaaguugagcauaguugaucaaguguccuugugggauauuagaacaucuuuuggguauauggccaggagugguauagcugggucuuaagauagauguauucccaauuuuuugagaaaccaccaaauugauuuucagagugguuauacaaguuugcacucccaucagcaguagaguauucuccuuucuccaaaaccacgccagcuugugcugucccuugaguuuugaucuuaggcauucucagagucauuuuuacuuacauuucccuggugacuaaggauguugaacauuucuuugggugcuucuuggccauucaagauugcuguguuaagaauucucuguagcucuguaucccauuuuuuaauuggguuauuugguuuguuggugucuagcuucuugaguucuuuauguauuuugaauauuagcccccugucagagauaagguuggugaagaucuuuucccaaucuguaggcuauuguuuuguccuauuaguaguguccuuuaccuuacaguagcuuuucaguuucaugaggucccauuuauuaauuguugaccuuagugccuaagcuauugguguucuguucaggcaguugucuucuguacugacaaguucaaggcuauucccgacucucuauucuauuauauuuaguaugucugguuuuaauuugaggucuuugguccauuuggacuuaaguuuugugcagggugauaaaugcagauuuauuuguauucuucuacaugcugacauccaguuagaccagcaccauuuguugagaugcucucccuuuuccguuguaugguuuuggcuuccuugucaaaaaucaaguguucauagguaugugaauuuauuucugugucuucaacuugauuucuauugaucagucuguuucuauaccaauaccauguaguuuuuauuacuauuacucuggaguacagcuugaaaucaaggacggugauacccccagaaguucuuuuauuguucacgauuguuuuagcuauccuggcuuuuuuuguuuguuuuuccacaugaaguuuagaauugcucuuuuaagcucuguaaagaguuguguugcaagccgggcaugguggcacacaccuuuaaucccagcacucaggaggcagaggcagaggcaggcggauuucugaguuugaggccauccuggucuacagagugaguuccaggacagccagggcuauacagagaaacccugucucgaaaaaccaaaaaaaaaaaaaaaaaaaaaaaaaauuguguugcaauucugacaggucuagcagcuagccagcuugcuggggggagggggcauccuccauuucuacccucccaauucuagaguuagguaggccuucaugcucauucagaauuaacaaggauucaaaagauccaaauuccaguccucacauguaaacaacaaacccuuuaaccacuaagacauuuuuuugaugcagaauuccuaauuuuaaaagccuuuucuaccuagauucuuugacaucuccagagauggagauuucuccuuguuugacuuauuaacuuguuagcuuugcuaauagcuacauauuaacauauaauuguuaaauuucuaagcagcaauacaaggaagauagguacaaguuuucuuuuccgcaaagcuuuuuugaggguagaaaguauuuuugauauugcaauucuuaugggggguggggcauaaguggguuucaggagguuaagacuaaguacagcaagcaggguuacaaaaucugcuauagcauuaauuauucugacuaacaaggaacacuuuaugaaauguagagggugaggucaguucuucagguguagcagacacacgucuccuccagagcgggugggacauauguugucacuggcuugaguucugacaguucagccuuguugacuuaggaauggcugagagcacaagacuguagcugagauuauugccugcagacgacuuugagugguucugauggcagccuguccacauuuccuaagcuuggggauaggugcagagagauuuagggucauagggaaaaagccucucuucccuuuaaaguuguucacauuacugcuggguuacaguaguaauguuuugaguaaguauauauacuuagacuuauugacagcuaugcacaguuacucaaacuugccaauuccuggacugagaaguuagcuagagacuuucuuaggcaguguagaucucugcuuuguauccuuaaaaggagacuuuuuuucugagcuuucuggcuuuuugagguuguuuauacuuaaguuucucagucuuuaguucuuuuuucuuuugguuguauaugcauuugcccuuaaucucauugaaggcagggacaaaauuauauguuguuccuuugcuuaccuaggccaauaauaacccuaaggguguccuggggaaaguccauuugggugguacuucauuguggguuguccucuguaggaggacugacagaacuaauucuaaggcccauaaguaguagcagcauggggaccucccugcugauuuauaguuucuggugagaucuuuguccccaucuuuauggugaggaaguuaagaagcauaugaaaguauuuucagacugcaggaauguggguggagaggaaaagagaggaccuagucagaucccagaauccauuguagaaugggcugauuuccagccugggcagggaucugguggcccaaagugggacccuuuagauuuggaguaaagggaaggaggggaggagagaggagaaaaaggaaaaugaacagggagaaggaagacuagaguggaggggagagaucaguagaagaauguaaaugaaaaccauggcauuucuaaacucucccuuaggcuggaguaguguuguuugaauggguuugacuuuauacuuuauccauagccuccucuucuucuggccaccuagccuuugucccuaaaggucaaggcuaaaggccaucuuuauuccuuuuugcuugaagauuagcaucuucaagccuauucucauuuuauucuuccuguggcuagaaucccaccugcuuucucacccucccacacuucccuuuaucaugcaagauccaguucagucaccucuuuagaggauccauccgacccuuaccaguuauggguuugaaugaggaauguuacacauagacuuggguauuugaacacuuaguuccuacuugguuaaaggagguuuaaguggugcagucuugcuagaggaaguacauuacugcggugguacaugcuaugagaguucuuccucaccauucuuccaguuugccuuuucucugcuaugugcuugugauaaaccaugugaucucucagcuuccuacuccuucugccaugccugcuacuuaguaccuucccucuggaaccauaagcucuuccaugcauaacucuuccaugcauuguuuauguucaugguauuuaucucaacaguagaaaaacaaucuauuaauuuuuaaggaaggaaaauaggcuuuguuguauguacauaaguggaauuaacaagagucuuuaguccugguccuuuuccuuaggggaaugucagcauuuuccccaggaauagaagucuauugccuggcugucuuugauuugaaaaagucauccagauuguggccuuggaaaacuggaacucuuuguuuugaagauuauaaugcauuguauuaaaauccuaaaaaacgugcuccaaacucuaaugaccaugugaugauuaguuacuugguaggauuuagaaucaccauggaauuaccuggauguauuuaugagggguuuucuacauuggguuaguugaggugggaagacuugaccuaaaugagaguagcaccauuuuguaaggcugagguuccccaaacugaaaaaaaaaaaaaaaaaggagaaaggaaacuaacugagcagcauggcucacggcucucugcuucugacuagcugccugaugugacuguuucugcaacugccuagaugcaguauaagcagcuucacauucuugccaacagccacaguggacucuucccucagugugugaacccaaagaaaucguuucuuuauguugccuuuguuagauauucugucauggcaacaaaugacuaguagagacccagacuuuccaggguuuuugcugugaaacaguuggguuuaguauuuucauaaucagcaucaaguccauuauuuagcaaguuuguguugacagaagguaagcaggaagggaugcagcaagaguaauggcauggagggcuuucugggagccagauacugagcugguuugugauggaagcugucacuuggcagcguaugagaucaucaaugguaccaggaacaguaccugcccugagauucagguggggcugugguauagcacucugauuacaagaauguaacgaguacauggcuaggcuuuggcacuacucugaacuaugguaguuccaugugacaucugcucuggugaaggacucaagcccuacacuggaauacacauaaaaaggucuucugaaaagauugggauagucagugugagacuuuuuuugggggagagaccuggaggcaaacaggaguuaguaggcagaaaaggcaggaaggcauagggagguuuaacaugccuuuucagucaggcuggcuuguauaaauaaaucauaguucagucaugaacauggaguguuauuuugagcuagauuuucaaacucuguccccagugguugagucuauaauauuggaaugguacuauacacaccagguaggguggugacagauuaaauguugcagaugucaucacuguuacaguauggaaccuuaggguggcagaccacagccaggugguggggaccuuggaaggauagaaaguaguguaacaucugcuguguguccuuugucagagcuugucagguugcuuugggguguagaauggugcauguguuugugugcacauaugcuuguggaggccagacgguuggguaacucugagugucuucuuuuauuguuauugacuugucuuuuuugagauggggucuuucauugaagcuggaauuucauaaaucaacuagacuggcuggccagugaaguccagggauuuaccuguuucuguuuccucagcaauggguuuauaggcacauuaccacaucugaguuuuugauuggguacugcaaucugaacucagacucugauuguauaccaaugacuuuaccuccucagcacuccauuucacuucuguuaaaacuaauauucagaaaaacaaaacaaaaccccagcuggaaucaaagauacuggauucccuaaacugguacacccauuacuguggacggugaauguuugaucaccuucacuuugguagaauauguucagaaacugaaguuuccaaaaagaaaacugaugccuaaccauagucuaaaguauuaaugaguuuagaccacacagcaccaaaagaaaaguuuaguguccuguagagaggcaggaugcugcuguagagauagacucccagugagugucagaaguaaaaaagaggaggaacaaacucuccuguagggucugaaggauuaaaacaugcaaaaaaacaaauacuaagggauugauucuaagcagggagguaggggggcuagaggaagauaaauuuaaguacaaguugugggagaagauugaggaugauaaaauugguaguuggucuucuauuucccuuugagacaggaaucgacaggcucaucuaaucgacagguucaucugugcagccugcuuauggagaagagugcaaauaggucccccuucuccauucuguccuaccacagcucagcuagccuauggagacaugucugacagaaguuucuuauuucucugauucaugguccccuguggaucuuggcuagugucauggauuucuuggggaggccaaaggaugugagagguucuuacuugauuagggaagggagaauagugaaagugccaucuggcccauguggauucaucauuugagaucugcucuacuggaguaauuguggaaauaggguggggacugcucuauuugcuguauucuagguuucagagaacuaucuuaacagagauauaucucagguuucuuuagaauggcuuucaguaaaggaacccauuaguucauauauuauucuuagcaucuuguuaggaaguucagaggcuuugugguucaauuagcccuucuccuugcauugagaagauugguuauuaggcaauuuuuaaaaauauaguguugacuuuuuauguccuagaucauaaugacuuucacugguaaucauuuuuaaaguuguauguuuuacuuaaagguuauuaaaaucaguuuauaauguuuaauguuaaaaaacagguugguuccagguaaguguaggaauagcuaaggucguuguauaaggagaucuggaguguguguguguguguguguguguguguguguguguguguguguguguguauacaggugccugcagaggccagaggauaagauucuccuggaacuggagugacaggcuauauuaugaguuguuagguuuggugcugugaacuaaucucagguacucuauaagaguaauauaugcccuuaacugcucauccaucucaucucuuuagcuccccaaauaauuuuuccacagacaguggccauaucagacaaagguauuguagucaugacugugaaucugacaucuguuuuuucuauugagaaugaguccuguuauagacuagagaaacaagaguccaagaagagaauguauggagcgaaggacagagaacagagguaccaacagaguuuagacuaugguugacagugucugagaugcugaauuguguaucacaauacugacuuccuggcauauaccaauagaaacccacuccuuccacuagugugugccaaaaugugucagagggcccacaguguuucccaugaugaaacaccccuuauagguaggaguaguacucuuuaucaguauauguccuaccccacuuuugcugaaaaacaaauccuuagccacuacagauaggauauggacagaauggcuucauguuaaaucucuagucauucuggagagugaaugaaccuaucuuaccccuuucagagcaaguuuuggucaagugagcagaggaggguguaaagguccugaauccacuuaccaacuuaauuuuaucuuuuauuuauuucguagguagguugguuuagguuguuuguuuguuuguuuguuuguuuugagacaagguuucucuguguagcccuggcuguccuggaacuccaucuguagaccaggugaacucaacagagaucugccugcuucugccuuccaggugcugggacuaaagguaugaauuaccacugcccaacaccaacuuaauuuuaaaacuagaaaaaucuaaauauuaaaggaggaucuggcaggccuuugcuuugucuccuccagauuuguugguucuuggaaacuauccaacagaaaggggugggacuugguaaauccccaggcuggguuaccuugaccaucucaucccacuacuauucugcccuuucuggcagacugaguuguaaaaggcagcguuucagggaaccuuuccugagcuugcacucugugguaugaaggaacaagaacaugaacugggguacuggccaucaaucccauuuccaaggacacuuucuuucccaaggggaaugaugccucuaaugcuaagauagaucucuuucucugucagaaacguaagcaugauuguuuaacuugcuuugauuuuguucugugaggagggacuuuugauaagcggcacugaaucggaauggugaaagugaaaaaauuguguguugcuuuccuagcaccugcuuccagagaggagugacuccucacacuggucauaccccaccccuguacucaaggucaccacacugcacugcggaguuucaugggcugcugcccuguucucauuuccagggugcacagcauugcuagucaacauucuccacuguccggcacaguguggcuuguguugugauggauugcagcugcaggaaauuauaucuaugucccuuuucuuuacuguaguuucucccuuaauaagccuugguugucuuccucugcccugcucacuuccauccuucccuccuuacccaacaaacuccauaaugccuuccauucugucagagcugcauauguguguugaguguguuaguauacacauguugaucaucagagaccauguauaacuguaugacaugucccuucagggcucucaguccccuuuucuuuuuguccauguuauguuauucaaaguagcugugaguuccagaauguuuuguccuaagggaguuugcuguugugcaaguugaauuugacccuguuuucugccuuucuuuccugcuggagccuggugguguuuauauuggcaagcuaaaggacuucugacuuaaaaggaauuaacauacugccucagaaccauugucuggcccugucuuucuacccuguggcuagggagccaaagaagauuucccagcccuuguuaauuguuagccucucugauccagccugggcaguuuucagggaacucaagcacugacuagcccaagaacucuguugaaacagggaaagacugagguugguuugauucauuuuaaguaaaaucaccagucuuuugaugauuccauuaauuuccucccuucuaaacaugcucuuguuagcaguaauuggaaaucacgacuguuucucauuuccuuuaccacacugcuuuaaucuaggcagcuggauacugcacacugccuuuucaucugcugcaaguaugguuugaagaugauuuuaaugacuggcuuuggcuggauuuccaaaagcugagacuguugcugugaugaaguucauauucaccuggagucugggugggacggguggggaaggguccuaccacagagggcucuccuuggucuuaggaaguauaugaggauguuuccagacccucguggcccagguaggaaugcacaagcuucagcaucagauugcagccggccugugguaacaccuacaaacacuuucauagauguaguucuaguuuuugugcuuuucuauucuugacucuaaagaaaaauaaaugauacaaaccacuucaggaggccagagaaguaacagauauuuguagcuacagcuaugauguaaaucagauuuguguauauuaucuuaucuuauuguuauccuuguaagaagcauggcacaguucauacaggaugaaacugaaauuugaaccuacauccucucauuguaaaucgaauacuuucuaaaaaauuuauuuauuuuuauuuuaguuauaugauuguuuugccugaguguguagauaugccccauaugcauuccugguaccuauggaagccacagaggauguugacaugugaguaauaggggcccagccuuaguuuucugcaagagcagcaaguguucuuaaccaccaagccccucaaauauuuuuaugcuguauaauuuugucuauuuuguuuugaacacugaccucccaugccauuguccgauacuguuuuuguuguuguuguuuuuuuugguuuuguuuuuugugugugugguuuuuuuuuuuuuuuuuuuuugguuuuucgagacaggguuucucuguguagcccuggcuguccuggaacucacuuuguagaccaggcuguccucaaacucauaaauucgccugccucugccucccaagugcugggauuaaagacgugcgccaccaugcccagcugucuaguacuguuuuaaugacuuaaaauaguuugcuauuuugagacacagguuggucucaaacuuguuccagccucuuaaaugauaggacugaagcaaugcacuccuaccucuagcuaacuugacuaguaaaagccauuuguguauauacuggguccucucaugggaagaaggguccuacagucuaauugaagaaaggaugagauagaggaaaucuuaguuuuucuuguaguucacacacugaauggcuucugucuagcaaaagaagagcugaaacuuuaacugggccugguagacaggauccaaaucagaggauuuugaagaaggggggaguugguuauuaguugaguacuuggcacucugggguauagacaagaugcugagauuuguggggguccuuuugcucuaccugaauagaaauuguggguaaagaaauguuggucucugccagcaagcugugguaccaggcaggugguaguagcaaguggcacuuuguauuguugcagggcugugacguuuggacuguuaacucuacaaguguuauuuugugugguccuaggaagaugggaaacugguauuugaauccauauuaucucaccugugaaaguguuuugucugcauguauguauguucaccauguggauguacauacaguauggccacacaguucuuagcuguggcuggcauugcagcuuccaggaaggccaugguaucaggauuccauaccacuuagcagcagccaauacuacagcacuucucuagucugggaauugggaugccuuagcccguaacacugaccuagguuaacaguucuuguucuaaggucuaagaccuuuagccuuuugacagcucucugaacucuucuggcaacuugagugugcaguuucucccuuuuggcuccuuacagcuuaaucguucagccucaucugucuguccucacuugucaucucucuccuucugucuccuuuccucuugcccugguuccucuugaacuguuaggcuguuuuguccucagcuguuagccgguggacuugcuguuuucagagcuagucuacaacuguuucucagccugcacuacuaaaaggaggcaagaaaagaccacuugauaaacuuauuagcccuggugcagcaaaauuaagaggaggcagcauaggaaagguauuccagcuggcucacccugcuuauauagccaagcaagggauggauauuuggacuaaucacaaccauugaggcuuguaugucgcacuaaucagcugugccuccuuagcaucaguagucucugcuaggucaccagaaguacuuccuuuuuggccuaggauaucaaggucaucuagaguucacuagggcuguggaaacagucuggugaaacuguuuuaaacagcccuugcugaggcucugccuuuaggagccaagcauuuaguugcaguuuucucaaggcuggagcauuguagauggugggagcugguaugagguaguugggcuggcuauuugacugacaguuuuuuuuuuuuuaaggaagucagggcagaaagagaguuuaacagcugcuaauuggguugucaaauugcaucauccuacccccaccacacaaucuuugcuuauuuauaggaaugcuuuuaauaagaacucaaagaacuuacuguuaauacuaacaaugacuuuaacacuugccuggugccccagggagugguggguccuuuccaucuaccccagugccucuuuucauuugcugugcuuucaaaaccagauucccaucccuguauaaaaccugaagaacagaccagcaacccacauccuuaaaaaaaaaauaauuaaaaaugugaaacaauuccuuagauccccaguacuccucacagaagaggcaguagaaacuuuacucccuuguccccaucauucuguggcaguuggugaggguggacugcacaaaaacacuaauacaagagcauucuggugccuucugugguuucagaaagcaucaugaaucagggaucuggguuuugacgucauaaagcuugccaucaucuaggccuaauugaagucaggggaagaaugaaugugaggggagugggugagaaaggauguucacuaaguugacuacaguagcugagucaguugcuagccucacuugaaaggcaggugguaggccauuaaguucuggccugcuucuaguuacucuugcuacucugacugguaagaguuccuuuacagaucugaucccauuuggggucuuagcuuuccuaugagaguguuuugaagaagggcaagguuaguuucgucauuaauggaaacaggucuaccaugggacuugucaguuuaagugaguucuuaggauuucugucuguacuuggagaccaaauggaaccuuagaguacugaagauuagaaaguuuucagggcuggagagaugguucagugguuaagagacugaaugcucuuccgaagguccugaguucaaaucccagcacccacaugguggcucacaaccauaugagccguaaugagaucugauacccucuucuagggugucugaagacagcuacaguguacuuacauauaauaaaucuuuaaaggaaaaaaaagaaggugaugagaaaugauaugccuuagcuuggggacauugcaaaauacugccuauaaagaauguucaggucaccucugguagccugaggcaacagcugaagcaguuguuaaucccuugaaggggcccaacccuggccucaccuuaccuggacuugguucuuggaagaacuucacagaguuguggcaacauugccugaaaauauaagaaauuauuggucaaaaauauucuaguagccgggcgugguggugcacgccuuuaaucccagcacuugggaggcagaggcagguggauuucugaguucaaggccagccuggucuacagagugagggacagcuagggcuacacagagaaacccugucucgaaaaacaaaaaacaaaacaaaacacacaaaaaaaauguaguagaaggaagaacacuuauuuauauguaguaucuuugagauccuagccacuuuaaaucuguuaccauuucuccaaaaaucuguaaacauugaauaagcaauguguguauauauauauuuuuuuuuucuuggagucucaacgugggaaaugagcugagagaauugcuuaaguccagaaguaagagauaugaucucaaaaauaaaacaacaauaacaaaccaauuugauaauacuuggguuguaggcuauuguguacuuaaacauauauucuuacgcaauauagaguguauguguguuuaaauuuuugucagauuuauucauguauuuuauguaugauuguuuugccuguauguauauauguguaccacaugcauuuuugguguguggagaggucagaagaggguaucagaucuccuagaacuggaguuauggauguugggaaucaaaccuaggucgacagcaagagcaacaaguuuucuugauugcugagucaucuuuucagcccucuguauguguuuuaaaguauaauaagcguuuauaacuuuuucacuuuuuuuagauuuagauuuacauguauucugcugcauuaauacaacaguuguagcauuugacuuauuuguaacuaccauuaacaacuaaauuuuaauaguaauauguaauuguguuaauaaaauaaaaauauugucauugguugaucgguaggcauuuuuccuacuguuuaaacaaugccacaaagaacauacuuguacauauguuauuagauguauuuauauauaggucugggcuugguaguaaacaccuuuaauucuugcacuugggagacagaagcagguggauuuguguguuugaggccagcauggacuacauaauaagauguaggccagccaaaauuacauaguaagauccauuuuuuuuuuuuuaaagcuauguauacaggccuuccuagcauauaccucuagcagcagggcuguugaaguguggaaagugugugacuccaacacugugcgucuugucaaguacuucuacuaaauacuugugccaguuuaugcuccugcugaaagaaaagaaaaucccuuuuucucaacaauaucucagcaugcuuguuauaguugauaaauacugaguguuguccaccuaaugaacaagaaaugaaaucgugaugugacuuuuaaguuuuuuauuuccuuuaucaucuccuaguuuauaaaucauuuaaacauuuuuaauuuucuauggcugagguucuuggaggggccugacaagguuggaacuguuuucuuauuaacacagauguuauuugcccuuuuuguacucagcauguaugaagcauaauuugcagaggcaacaugaugucucuucaugaucucacuaguguuaauaucuauuuccuguuauuuuuaaaagaauuuauaaauaaauaaauaaauaaauaaauaagcuuuuuucuccaaauaugguaauaggaacagauucugcuuuaguggcucaggguccuucauaauuauuuuauuauuuucuauuuaagaggcauucauucacuauguuguucagacuggccccaaauuccuaggaucaagugacuuaccuagcuacuuuagcuucuguguagcaaggacuacaugcacaugccacgauaucuggccuacacaugcaugcauaguacuuuucccccuacugcuaaugccuuuaguaaugguaaaggaaccugagaauaaagaguuuaagaaccaaugcuguuuuaacuauuauuuuacuaguauuuuucccuuugguauaugcuuucuuuguacuguuucacacauauaacauguauaaacacacacuaauaaccauuuuucaauguagaaagcauauucucuuauucuaguuuuauaaaaauagccucuuauauuuucuucuagaaguuuuagaguauauuuuaugaugggcaccuucuauuuuuuaggacuuuaacuacuaaagauaauauuuaauuuuauguuuuccccaaaauacccagguugaauauaacauuuucuauaauuucuuuauggguagggaaugggaggaggguaggcagagauucugccacuuucuccagacugucuuuguuguuuaagggagacaucuagcauuuugcagauugcuaagugacucccagaagugguacauuaucacuuuggaucccugguuuuguagcuugcuguccagagaccagaaucuaccagugacagagauucuagaagcauccacuuuccagaggcaaggguguucuuauuccuguuguaucugcgaggguggauagguaggauacagccaggcaguuaacuguagucaaggguacaaaugacagccuucuccaagcaaaaacaauagcugauauucaaggacuuuuuaaaaaaauaaaauaaaauaaauuuauuuacuuauucacuuuacaacccaauaacagcccuuucuuuccucccaguacugucucauugcaaguccuccccccaucccaccuuccccuuccaagagaaaaggaagucccucucugggaaucacuccccuccuugcucaccaccgaucucccuucucucucccuugcucuccuaauguuaugaauuuuucagguaaauggauggaacuagaaaauauccugagugagguaacccagacccaaaaggacaugcaugguauguacucaauuauauguggauauuagccauaaaguauaggauaaccacacuauaaucaacagacccaaagaagcuaaauaacaaggagaacccaagggaggaugguugaaucuuucucagaauuagaaauaaaauagauaucagaugucaauggaaggagaaaacuggguaggaaagggaauuggaaagggaaggggucugggaagaucauauguaaagauauucaaggucuuauaucuuauaaugguuuuccugucuccaguaucuucucucuuccucucuccacaaaucucccuucuauuuugcugcuaaaauaacucuuaaaaucucacacuuggagcugaguggcgacggcacaaaccuuuaauccuaccacugggaaggcagaggcaggcauaucucuguucaaggccagccuggucuacagagugaguucuaggaaagacagggcuacacagagaaccccuguauugaaaaacaaggacagaaaacaaaacagaaucucagacuuggagucauuacacacaaaauaguuucaguaagccuaugguaagauccacauuccauagcaucagaacccccaucuuuccuuccaacuuuuguuccagaacuuacaguuucccaggcauggaguuguccccgucauauaugauggccuaugccuccaguaccuugcuuaugcuguuuucucuaucuaacucaaagucacucuccauuugucucucagaccccacaaaacuagcucucauccugagaagaugauucccuuagccucucuguuaacucaaccauuccaauuaaaaagaagguuucgaaguuaguacccaauacaggggguggggcagaguguuugugcuugcuaagcaaacacucuaccacugaacuaaaucccugacuccuucaaguuaacuucugucuuugcuauaguuguggcuuuguuagaggaagaaagauaugucucuagcccuucccuaaguuccuuccccauaaauucuguauauuggguuggccccugcuguuuugcagccugauuuuuuuuuucuuuuuuuguaguagcugcaagaaaagaggauuucuuaacuugugguuuaagcagcugauggaggcacccuaauuaauuguggugccuuucaacaaacuagccuucauggaggggacccacugaacagacucaaaaauacuuaagcccuuuccccacuagcucauuuuuaaaaaaguaauaaauagcuaucugguauaaaagugagauaugaguugugucuguuaaaaugccuggcugccugaaggaaggcucaaaucagagaaaggauucuggaugguauagcaguguucaaaguaaaauuuaauaaacucagacaguaaaauuaaggcagauuaacuuuugauuucugaaauugcuuuguagcaggaauccauauaguaccaagaaaggaaaguccugcuuuauggugcagggcccaaauggcugcaguagaggaaaggagaggaggaggggggauacuuaugggauuuuuuuuuuuaaauguccaguagaguugggguuuauuagcagcucguuuauggccuuuucauuauuguuaagaguagcuaauguagaaaugcagugaguaggacagugaaggggagggagggugacauguuccagccaccaggaagacacuugggguuguuggauggcaggcuaccuuucagcccaggcaaacaggcuagaugggaugaauucucagguuuaguuaagauuuaugccaaagaagugugucggagcucucacacaugcuauaugaauguacuaaauguugucaagacaucagguuuuguuugcagagaggaaccugaggaagucuccuuuguggaugaugguuuucuuuuuucuuucuuugaagaguacuuccauuauuauaguaauguaguuauuuuaaaagugaaaugugggaaauugauaagccuugauuaccaagcaguuugacaggaauuuucugucuuuccuaguucauacaugucccucuccugaagccagcugcucugaucuaagugagaaacuggggcuaaagcaguuaggagcacuggcugcucuuuucagagaucuggguucaauuccuagcacccucauggcagcucacacagaguacaugcaggcgaaacaccaaugcauguauaauaaacaaacaaacaaacagagaagaaauuuagaagagaaauuuaccguauagucuaacgaagugugugaaaugcaaaauguaccaugccuuuuuuugucuuuaaaaaaaaaaaaaagugugacuauaacaaaaguauuuuuucacccuccaaaacagucauuguccaguuguuuuuaaguaauaagugcuaugauguaucuagcauaugucugcauuugcauccaaguuuuuggaccauguccauuguucagauauguaaagaggaggaaaagaagaggcuggacuucagggaucacguaggaucagaugaaucgccugacaguguuaguguucuggaaaugacacugaguuccuguuuuucccccgacaagccccaugucuucuguuccuguauagcagcuuugccaagaguaaagggccuggaugucaaauccuuucucucugccuuggcaggggaacuguugugguuuccaagaagccauuuuugcaauggggauuuuuuuccccuuucucuuaugguaaguugcuucaucauuucccaaaaauguacagcaccucuuguuuaaacagggugccuuucaagagcuuuagagccugcagcagggguggggugaugugagaucuuuuguuuggugcuugaugcaaguuggaauguggacugagugcagaagucucaacguucuacagcaauggccuguagaaaggagagacucccugggaagcaagaaccuuggguguuuuugaaccuuuggcuuaucugugaagagguaccagccuucugaacacagguucuaucugguuguugcccagugauuuaaauguggugaauguagguuuucugucauaaguagcacauggcugcuggauuauuuuaaaauagugagcauaauauuguaggauuauguuugauugcugguguuggagacgaguucagagaaggaacuuucuaaacacacagcuaguauuugguuuggguuugaguugaacuguggagaggcacauauuuggcagaaaucaugagacuuuuagaaagaaauuggcggaauuuggaagauucuggaaacaucgugaggaaaaguguguuuagagaaggguugccuaugagaguaaaguggaguaugacuccagguaggagcaagaaagaccccaacuguccagaguugagaaggaaaucaugaaguaggcaucaagaaagggguggcagacaggcugcugcuuuuaccuuggcuugggugaucauguaguggugguaccagcuucuccagugggaccuagcagcugaagccuagguugucaugccugagaaugaucaguuguugggugccgccagaguaaaucuuuuaaccagguggaggugaaguuccuaagugaccccaguagaguucagcaugacauaucauuuuaggauaagacugacuaaagauugcugcacaggccauggggacaucuguugcaucauauuuaguuugcagugaaagaguguugcuucugaaaacccuagucaauauugagugaaauagccuuccucuguaucuaccccguuacaaauuuucaauaagaaacuugggaagcuuucgauuuuuacuaaaauaaaagagauaagucaaaggguguuuuaaauggcgaaucuugcucuugguaagaaauggaaauagaaaaaauuaauaauuacugggagauucugugggaaugaauaagcauaaacacacucaucuuaaaauccuuuaauuccucauagacuuggugaagguaaaaugaaggugaguacauuucccuuccaucugcuggucuggggaggagcugccacuccccauagaccuggcucagguguuggcagagaucauggcguggccuguagcucugaaaagugaaucaggccaaucuguuacaagaucuggcugaggcucagaacaccucagagaagccuugguguucuccaccaaggaguuuggggaaaccuucccugaguuuugaacaagcacccuguuuacugcccuuaauuaaagaucaaaaucuucuuccccuugucuugaaagcuacccauugggguugcgaugugaaguaucucauaguugaguaacaguuucccuaaaacagccgucgucugccagaguuccaguagagugguuuauccuuuuuuuguucagcaaugagaagauugggggagcucaggaagggcuguaggagaaagcaucagaccuagaguucagaauuaguccuacaguaucuaugcccuuuucagcugaaugguuuuguuugguuuugcagacaaaggacugacuuuagaggacauugucuacuuguauggagaagugagcauauugauucuguuuaccauaggcugagcugcucucagcuggagaagaagcuauugugcugcuauuaucauuccauugggagaucuggcuugaagcgucugugaacucuucagggcccuaucugcagggcugacaggacuuuuucaacaaaguguagggacuggagaaguucaggaugagcugucauuugugcaguuacugauaaauuugacuuuccuugugcccuuggucauagccacauuccuuguuugcagaugaggguacccaagaauauguuuucuauaguuuuauuacaauaacucugagcccuugggagugagggccuccagagcaaaauugaaccgugugcuucuggacauuuaggaacaaccugcuuuuuggucugucguaaaucaacacccaaugcuucugaguaauaaauaaauuuggacaguuguacaucagcugagcauacugugaaagcuauguggccaucuguguuguagcaggaacuuuuagaauugaaccuuuauuuuguaagauuaaacuugaaaauggaaaaugaaauugcuggguuucuaguuauaagaagaguaggucuuauaaaguugacaugcuuggaaaauaguguagaauuuagucaguaaaugugccagggguuggcuaggggaggugucagugugugcaguuuauuuacuugaguguaagucagcaguccugcucagauaagaagaaagcacauguacagcuacaaacuauuguuugaaauacccagauugcacuguccaggguuauaaucaggaggcagaauauaauuaggcauuuuagugucuuuuuccuggcugugacuuccuuauaauauguaagcccauuuuuuacuuuguuggaccauucaggaaauagggcagguucuacuauaacuuuaagagucauauagaaauaaaacuucuuugcaaauauaaaagacccuuccagaacugugagaguauuuucugaaauauauugggagaguaccuagccucuucauguauuaauggcugcacacuguacucauucauauauguucauuucuaucauucuuuauuccacuuagauauauauuuaauauguuacuuuaagucuguuaaauaaaagcuacccucuucaaacauuguuguuagcuuucucuaacuugcaaagucucaaguuuggaagagaaccaccaaacuggaaaccaacuucuaaacugugaacuuuuuuuuccuagcccuguuccuaacuuugugaguauagaguuguuaagaauguacuuggggcuggguggugguggagcacgccuuuaaucccagcacuugggaggcaaaggcaggcagauuucugaguucaaggccagccuggucuccagagugaguuccaggacugcuaggacuacaaagagaaacccugucuugaaaaaccaaaagagaaaaaaaggaaaaaaaaaggggagagagagagaauaugaaugaauaugaauguacucgggcuggaaagauggcucagcgguuaagaguacugacugcucuucugaaggcccugaguuuagaucccagcaaccacaugguggcucacaaccaucuguaaugagaucugacaccuuccucuggugugucugaagacagcuacagucuacuuagauauaauaaugaauaaaucuuuaggccggagugagugggaccaaacaucucauuuuccuagcaaauuccaggcaauuuaugugaaauuagauuuuauaauacucuuaucuucuauuaauuuacaaaugcagucuuuuaaaauaaguucagagugagcaaccuucauucacagcaaccacaugauggcucacaaccaucaguacagcuacaguguacucauauacaauaaauaaauaaauaaaucuuaaaaaaaagaauguacuuaaaauaauaagguuuuuagggaaaacgaauuaacaucccacacuagauuaccauuaucucucuaauuacaauaguauuuccagccuuuucaguggcuggcuggucacugaguaaguugauaagcaugcaaugucuuuuauacuugcuguuacaacauuuuaauuaagagaauucagcuguggcaccagcuggggaugugucuggcauuguggaagaucguaauuagaugcuguauauuauaucuccuuuuuccccuuucaacucugguagaaugucuuugagaaggggcuuuuaguuucggcaguauaaauacuuuaauaugccuaauuauguaaucacacaguuauauuucuuuacacacacauuuuuuuaaauggauucuuuaauuccuuuucuaauacugaacugucuagccugcucuuugguuggaggcaaacaugcauugggcaagaaaaggaggaccagaggcauuuagugauuuuccucugguuaugcucuguccuuuugucucucuacuuuauggucuuguccuuuuaucugaaaugauuaacaucucauuuuccuagcaaauuccagguaauuuauguaaaauuagauuuuauaauacucuuaucuucuauuaauuuacaaaugcagucuuuuaaaguaaguugauuuuuuucccccaguucuguuucaaguagauguagaguauaagccugggauaggagaauuugacaugcaggcacaauaggagcaauugaucucuggcauugagcuuaugcaaaaagggccugucaccccagcuguuagagcugggcccugggagcagcugcuuucugggaucuaguccucuagggaugcccuccaucugcugccaugguccagguccugggaaagaccuugaccccaacucaucucuguauuuuacucaccaguuccuuccgguuccuucugugcugcucugcaaaccugagaagcaagaugauuguacuggaaaacuuccaugauuuuccuguucucucccucuuccucauuccacgacacugcacauccaauuccacugggaagcacuuguuucaaggguguauaccccuggauucuucaggagaauuagcaccauaaagcagacuuucauuuuucacuuuuauacuuuagggcuggacggauuuguagaacucauuucuuggaagaagaaccuaagaguucacauuuuuagucuugcauuuagggccuucccuaauuuucugaaucaaacaccagccugaccuuucuccuacuguuuucccucagaguaggccuaucuuggcuugaauuuguagccugguugaggcuucuaagugcugagauuagagguauaagcugcaacacccaguuuaccagucugauuuucuaaaucucuaucuuuugcugguacuggacacauuuguuacuuuccauacacaaaccacccuuuuuuuuuuuuuuuuuuuuuuugcgucucugccuuugcccuuauguccauccacaguguguuccucuuacucugcuuauucuugucacaaccccuuuuccuauggucacagguucuacuaacccucaaauuggaacucuaauuucuuccaccucuucuucauuggauuaauccuuauucaaaaccucuuguaucccauauugauuuuugccauugucacuuacuagauaaaagcccccaagagagucaggccacugugguuuucaucgcucucccugccuuccuccauugccuagcacaggccuugguacuuaguaaaacuuucaagggaguagauggauaaaugcaauccuuacaugaacucuaaagcuuaaaccgacuugagacucuuuauuuguaacccuggagagacuggauucucuucaaggauagaugcugucuuauuuacucuuaaaaaccuagggcugccuuggagcauaguacucaacagaugauuucuaagucaaugaaagaauuccaguaacaagaugaagacuuaauuuuuuucauuguuuucuagauaaagguuauuaaaucuagauuaaaggauuuuuguuuauuaaauguagcauuuguuuauuuguacacacauggagaguaggggcuccaucagauaauaucucuaaaccaagacuguuaaacuggccaguccaaaaacaaaaaaacgucucucuagaagcuggguacauggauacacacauacucuauguauguguguauauauauaauaacauacauacauacauacacacacacacacacuauaauccuagcuacuuggcagguugaggcaggaggaaucucaagguugacuguauagccaggccucaucguaaaaccacaacaaaaacuuuuccaggacuuaagaguugccacagaagggaacagggucauggucuucagccugauuuaaaacaaaacaaagcuagcugggcauaaugaugaauggcuuuaaucccagcauuuaggaggcagaaaccaaccuggucuacauagagagcuccaagccagccagggauacacgguaagacccugucucaaaaauacuaaguaagacagguguaauggugcauaccuuuaauuccagcucucaggaagcagaggcaggcagaucucugugaguucagugccagccuuguguacauaauguguuuuaggauagccaaggagacauagagagacccugauucaaaaccguauuaauaaauaaaacacugaauugaaacuauuauaauuugucagguucaaaguuucauagaucaguugcagacgggcauaggugauuguuugauauacuguguaaguguguguguguauguguguauguauauauguuuuguuuggagacaaggucuuacucuguagcucaggccaacuuugaaauuucuaucagccuccucaaguacugaaauuacagauauaugcuacgaggcuaggcucacaaauuguuguugugaaguugcuguaugugauggucaaggaacugagacguagcagagcuagacugauuauaagcaaauccuagaccuuucaguaaagaucaggcacuugcuuuggacuuuguaugaacuuaaauggcuauaguucacagcuagccuagucaucacagcaaguuucaggcagccaaggcuacaugaugagacccuguccuuuuuuuuuccccucccccuuaagauuuauuuauuuauuuauuuauuuauuuaauagauauaugaauaugcuguagcugucuucagacacaccagaagagggcaucggauccuacuacagauagugugagccaccaugugguugcugggaauugaacucaggaccucugaaaaaagagucaguguucuuaaccgcugagucaucucuccagcccaagagaugucuuuuaaaaaaaaaagaaaagaaagaaacuuaaguggguugaagacaugggucaguaguuaagaacacuguucuugcagaugacccagguuugguucugagcauuccacuucaauggggaaauguugccugucugauguaugaacguaggaggcuucuauguacaagcagauacccaaaccuuuauucuccagacaacagcuuguaucugugucucuuaccccauguaauacauuacaguugggaggaaauuuucuugugcuauuuguaaucagggagguuccauguagcacuuaagggcaaaucagaguuugaauccagauuccacaguuuaguagccacaggauaucaagccauuacugaauguagcagagcuuuaguuucuuagucugacuaaauuaucauuaagccauccuuguaaugugggagaauugaauaaguucaguguagcgccuguugauaaauguuaauucuuuuucucauuuuuacacuguggaacaacagagauuaaguuugcuuuacauuuaaaugugugcuuccuaaauggauaugucuagacuuuacauuuagaugcuagagaaaaugaaccuacaacuuugaccuuuauacccaggccucuaacucuauuuuaaacuguggaagcccucaguuuguuaucauaguuacccucugagguaggauggacagagagcaguugucuagggcuuccuccugcagguggaauucugaaggcuacagcauaccauuagacagcuuacuuaggagguagggucuaagagaugggauugaguagccauugcuaaugaggaaaaaguaaaugccuuggguuucucuucaccuuucucuaccaccccaaaguggcacaguuauauauuaucauacccagaauauccugauucuuuagauuugugguuacucuuccauccugggcauagaggagagcuaugagcugugcucuguagcucacugaacugggagacugguugcuagcacugcaugagccaggccuaaaccuggaguagcaggaugaaggagaauccucuccugccugccccuucuuuuagcagucauaacgguaggaggggggaaggacagagucuagcugccagccuguucuccccuccuucuuagcugugaaaacaaggagagauaaaaggguagcagaccauauggaggccauuugucagccaaguguagccagagcucuacagcuaaaaaaggaaauggaaaagggugcaaagagcaagcaaagaaggagcucccauagugcuucauuucuacccauccccucuaagcaucagggaaguucugaaacagucuuuucuuuuuguaaagucuuugcccuuccuuccccauucaaaggucaaaaauaaagggguuugauuugcucugugaaaguaaguggggaaugucuucaugccuauuguaugugcagcaugaugcaggugcuuucaugaaugcuuuuaccaguugacuugucacacucguagaacuaaaugcugcugucgaguaaggcucaaaggagucagggcaguugacaggacagaguagacccuuaggucaaacuuagauucauuuguuccacacuuaagaccaugcucugauucccuucuggccugauccuguuaggcaaguagugucuuuucaugauuagcuggauacugguuuggagaauuagagauuuucuacuaaguauuuacuaucacuucaaauucaugaagcacuggggaccaaacaugagcagaacaaauuccuauccuauaguguggacaccgaguggggaaauggaggaagagugacccuguggaaaaauaaaugcaaaaccaguaugauaguaguuucucaagagagaugaaguuguuacgggaauacagaagaaaaauaauaaagcuacuacuuacuaaacaguauauaacagacccuguacuggguacuuguccuauauauugauauuaaucuucacaguaacuuuuucagguagauaccuuuguguccccuuguuuuaggaaacuggggaauaaaucuucauaagacuauguaacagguaacuuuuaaaggcaacaaacaagcuaggcaucuaauuccgagcccacacaggcaaacuccugaucucuggcaguggcuggagagaugcucagaagcuauagccuuaugauucugaagugcagagguaggaguuucagcuggguuugugugcuuuaaggucaggauccuuggccaaagauaagaacacuuuauucuuaacgacuaaggggguuuugugguucucuccagguaacaaggauugccauguucagugcaauaaaagaaaaugcauuuccuucuccaucagaggcuacugguuaugagaagacaggaggcagaggaguccagcucuaaaacaaggacagucucccagagagaccuaucugccaguugcugauguccuagaacugggcuuggguuaggccuuucuggggaagaugaugugugcugcagggaaacagccuaggccugugugguuccucucucugcucucccaucccagcacaguaccacacccugagaaagacuugagcuauggcagacuggcccuacccccagcgcgugggaaguucuucuaagaaaagagauucuggcuggacaauggccuuccugucugcugcugggaagguuuguuuccuaugagaagguugcaaauggcaugagacaucaucuugauucucucccaugcagccuguuuuagacuuuugacuacucaaguggugacugguaaugcaaaaggccaggagacccauucagaagcagcccuggugucuucuaaguaauaauauugcuguccauugaaggagcucuuuccugcacggacacaagauugcugucagccuuucauacucugaggucaguuuaaaaccacauagcuguaggauuuucaaaagugaaccucucaaaaagcuguugaggcuagccacauacacauuugacuucagacagauuuuucagagugacuucagauguauuuuaguuuagugaugacauaaguguuugcuuacaguauccagguuguccuuguugcuggacucacugagacaccuaugaccuggugagguuuggaagagaagcuaggcucugagacccucugauauguugcaccacccuugccuucuggguagcauugaaccucuaaguaucuuaaccucucuuucuuaauuugcucgucuguaucucuauuguguuuggagaguauauugagaggggggagggggaaauguauauauugggaaacauagggaguuccacauguaaacuguaaacugcuuagaguagugcuuggcauauaucaguaagcaugaacuguuaagacucugcuuuugaaggagagucuucaaagaagccuuugaccaccaccagaugguuacccacccccaaucucucugucucuccucccucccucccucccucccucccucccucccucccucccuccuucccucccucccucccucccucucucccucccucccuuuauauuuguaaugcucuaauucuaacuuguuugggauacuuuucaccuucucuuugaacaagguauggacagguccaccuuggagaaaaucacucaacucaaaugaacgagccuccuuguccuaaugugaaaugguucauguagaaggaacucaggaaaguggugcaucuaggagcuguguacacuaccuacauacaaaaaaaccacgugaacaaguuuacuuucuguaauccccuugucuuuucucuggcucuguuguuaacaaacuggaacuagaaauugaaccuuuuuaucaagaaagaguuuuacagugaguaaaugucccucuucuaaauaaccuuaaaggguccucugcuaaauggugggguuuuuaccugccugccugccugccugccuuccuucuuucuuucuuuuuuucuuuuuuuuuuuuuuuuggacaaagccuuacuguguagccuagacuguucuugaacccagaauccuccugaugcuagaauuauaggagugagguaccacaccuaguuaugucucaugcucuaucauguagaucuuucuguuuuuggauccacaaaccuaucuuccaauacuuccaagaacucuucacaaagacugcugaccauuaacaguagccuuuacuagcccuauguuauuuagcuuucuguuauugugaagaaaaaaaaaauaaccaagaaaagcaacuuuaaaaagaggaaaggaguuuauuuuggcuaccuuuuccgcccagucacuugagcccguagcaaagcagaacaucaugguagaacacaugaugacacagagcuggcuuuaccuagaguuagccaaguaaaggacagaugggaguagagugagggaaggggaggaaagaggacauacugugaacaggccaaggaauuaggacuguaggcucuauucagugucaugcucugccuuagugugaucuuuauagcccuccuuaaagacauguggaaaggacucgcucuaauuguuugcuggaauuauagccagguaggacaauuacaguacuauuucagcuccgcuccagugaccaccucucuagaacugaugcuugggccugggacccucuuuuucuccccuccccuacucucaguccuuaggagaguuucucucuggccaucuugucagcaccuucauuaaacacauuuuuuuuuuaaagauugauauuuacuuauguauuuauauuauuuauaugaguguuuugcaucuguauauguguuuugaacccugcagcuccugucuuugacaguguggucuuuucuuuguagcuguuagccagaaaccucuuuuguuaagucuuuugaaaguauacuagauauuuaaauauaugccugccuacaaaccuccaaucccuuagagacuggagccuguauaccccuauuuucuauaacuuauacuuguuuugaaagaguuggguaucuuuggagggagcugagugaccagagcagaauaagacaucugucuuuucauuguacauguuauuuuuagcucuauaccacauauauacugauauccuauguauuuaugggguuuacaagggaagaaaauguguagcagaguaggcuuggcucuagaauucuagcccuuucucugagauccucuuccauguguacuggccugcuucuguguggguccugccugcuuucaggagcuggccagacuguucaguauuaauuaugccaaggaaaugaaccaguuagacacagucuauagagcgccaagagucagucagaaggucugagggacuuacuacucaauggacggaaaaugaaaaaugaaauaguaaagcaacuguuugcuugccagcugucugaaugauuuggccaccacuuagggaacuacagcaauauuuucacucacuucucuccuguuuaggacuuugagccagguggguggcagggaugucagagguguauccuuuaaggggacaaggacucauacuugcauucaucuucuggugucauaguuucugcuggacuuuuagauccuuuggcaacuuuuaaaaaauugcugagcugaaacaguagcucagcggggaauguauacuacuaugugugagguccugggguugaucugcaguacugccgaaggaucaaauaaagggaaagugaggggggcauuugggauagcauuggaaauguaaaugaagaaaauaccuaauaaaaguaaauaaaaaaaauauuuauuaaaaaaaaaaggagccgggugugguagcgcaugcuuuuaaucccagcacuugggaggcagaggcagaggcaggcggauuucugaguucgaggccagucuggucuacaaaguaaguuccaggacagccaggacuauacagagaaacccugucucgaaaaaccaaaccaaaaaaaaaaaaaaaaaaaaaaaggaaagugaaugaaauugucucugauggcaugcugucuagccagcauggauaagucccuaauucagucccaaacaccugcccaaaaacaguuauaaccgcacuuaaaugaugaaacaaaagaaaauggcauauuuucuaccuaccucuagggaugugcaaccugagggcaggauuguuuuccaucugacacuuucccccagccagacuugauauuaacugcauaauagcaucugggucaggugggaggcugcaagggcacagcuacagaaugugguccaugggauguucacaugggaagaagccagggccuuuuccugcuagucagacacgccugugugauucccagucacuuggagcuguuagaggaagugagaagaggaaauggccauucugaucccacauagauggaugaugucucugugauacgagggacaggcuggcaaggagucagcaagaugaauuuccuuuggaaaaagcuuuguuguaucuugugauuauaaaagauuuggaaaguuggagguaaugagugccugaucauguugccuucgccaggcuagacuuuagugacuccuuagugcccccauugacuaggcaaggguagcuagacacaccaccuuguauugccuggcuugggauucaguucuauaaucugucugaaauagaaauaguuuuccaucuccuaagagcugcuugguccuuccagcuccugugacacccuuucuaaaccaacauccuaccacaccuguuugccaucucuuuaguuaaccaauuugagguggugaaaggaagugaucuugguauacauaaauuuauaaaccgaucagcucaugggauagggauuaggacucaggggaagaagagcugggguuagaaucaaagggccugacucuggucccagguugacugcccccugccugccccaaucuuggcuaaaaguugcuucacuuuugcaggacuuaguauccucaucauuagagggaagagaugauaacuaucucacagaauccuaaaagaugaugaugacuuuaaaacuagauugucauaccuagagggaaaaugugggauaaaggcaagugacgccuagcagacaaaagaagaugcacaggacuuuggaagccucccaggaaagcucucugagaucuucacagaagccaaacucauccagggagucuuuccuggaauugauguuguaaacagccuaaaacuuagccuagugaguugcccguacuuuaucccacagucugacucacuguuaguggaugcuguuagaaucaagugcaaauuacagcagguacagaacuuuucuggagucugcuggccauugguagggagagaaauacugugggcaaccagacugaccaauugcugguacauuucccucaccgucagugacaacuggaauuccacacuaguucaguaggcuuucccaaggacgggucuaugucccuuugugauuuggggccaugcuacuaagacaagauacccauuugaaagucucauuguaguaccaucucccucugucuuugcaguguguccucugcccccagagccagagaaugguggcuacauuugccacccccggccuuguaaagaccccuugacagcaggcagugucaucgaguaccugugugcagaaggcuacauguugaagggugacuacaaauaccugaccugcaaaaauggcgaguggacgccagccauggagguuagcugucaucucauugaaggucagucugcagauaaaaacgggugcugccuggguucugcuuuuucccuggcuccuggggaguagcacaugcuuucucgagagcucucuuaggcuguguuaaaagccauuuggccucucagccucugugguaauuccaugucuuguggaaguccuuggguuugcuggcgcaugccauguugcauuuacucugaaccauugaggggcucuguuucuuuauugaggcaucugcuugacuguguaaaacuccucugaggucaggauuucuguuugacuaaucaggugcugauacccuuaggcugggcucugcuagcgcagagagcagugagcauagcacgaacacauuuuccggugucucuuccauuucauuuuuucccuuaaagaguccuuuuuccuuccugccuccucuugucuuacaugacaggaaaaugcagguuccuaaagggaagugugugucgcagagccaucucugugcuucauucacaguugggcuucaagaccagaacacgcuuaaccagugagaccucggaggccgugggaacuguaggccuagauuuuuuaaaucuauuuuuaauaaggguuuuuaaauguuuuaaugucccuucuagcccaucgcccaccugagguaguggaaagaaagguuaauagagcaaaggaggauauggaccuuuuuaaaaauacuucuuuggagcaaaucuaaucuuguguugucaggagaucaacaguaaaguucacacaaauuaguagcaacucaauccauuugcaaacaccauuuacaaaucagcaacagcaggacucauaaacaucauuuaugaacuagcuacagcaugccaaucuagaagaaagcacaagucucuaucaguuggcccaaguccucugaaaugggaagaagccacggaaauaccaccagaaguuuuuugguguguuucucucuaugaagucaugacaaaugaugaccaauaaagaaugaucagguaccaauaccacccagaguugucagugaaagccagugucgaccagcaaagaguggcaaggccaccaaaccauagagcaccauccacugucaaacaucacgucuucuuucaaccaucugcucuagcaaaauaccauaaugcccuuuuucugggcugccuacagaaagacaccacgugucugcuucagaauaugguggaacucaaggugguagaaaaauguggcccuuuugaugguugaaauucaccagcuagcuagugaguuuagauaccagauggacuucaaaggcuagaaugaggaggggucuuuuauucaggaaaaggaaauguuucuaaaacaccauacaugcauaaggccacuuuauaagauuucccuaaaaaggcccagcugucaaauaaaugcaggggauaauuaacuauuucauuuguagaguucauguuuuguguuuaugaugugcuuaugauggcuuguuuucuuagacaaagaaacccaugcacuuggggucccugcgcuguccauaguggcuuccacugccagcucuguggcacucauucuccuccucguggugcuguuuguacugcugcagccaaagcugaagucuuuccaucauagcaggugaguuagucaagcauccccaugaugucaaccugggaccaguuauaagaagcuacuaguuuauagcuucugcuagucuguaucuuugggaaguagagaggaggguccaguuguguguuaaacucaugcaugugacuggcacugcccuuuuagggugcacauucuuuacuuugauucuuuugggaacauuacaggcaaagaaacugagacauucaaauaauaucucagaaugacugcagaauugagauuugaaccuacacaucuguucaaucucaaagacguggcuuuucugucucaucccugucucugguguuuccagcagcaucggcaccacuccugagaugcuuuggagcuuagacacaguaauagaaaguacagcccucugcguggugcugauacaugcuuguguuuguaagcuaccucuucuugcuccuggcuucuaauccuuagugcaccucagcuucccuccuauccucauguauuugguuugaaguaggauccuggucuuaucauuuuuuagaaagcuucucagauaguuaugaugugcagugagaauccaggacaugauaccauugugaaauuagaaggaguggguuuucuugucuacauauucuccuuuuucucuuauaguacauugucuguuguuuaucaucccagccuugggagauggggguggcagauggugggccccuggugggagugacccugaguauaucucugauaagagacuuuuuuccugaccugccuuggcuucuguaguugcuuaaccauuauggguacuucaugccuuugaagaauauagaucguuuauauucauucauagcccuacaucagucauugucuuagcucucaggaacagcuguccagacuaaaccacauucuguaaaaugcuccagaugugaaacuuauagacguagacuacccugaagugaauuucuauacaggaaggagauuuuuccuuucuccuuuuuuguuuggaaggaaggaggaguaacaauuuuuuuuuaaaagauauauuuguuaauuuugugagugcucuaucugcauuuacaccuacacaccagaagagggcauuagaucccaguauagauaguuaugagccacuaugugguugcugggaauugaacuaaggaccucuggaagaauaaacgauguucuuaacuacugagccaucucuccagcccaguaacaauuguuuugaaagugauauuuugaagggaacuauuuauuugaaaacagugagcuauuuccauggcaagucacacuauucuaaucuguuuucccaucuaggcuaggcaguuuaauuuucucuguaaccagugaaucuguuaaaaguaaccaguugagccgggcgugguggugcacgccuuuaaucccagcacucgggaggcagaggcagguggauuucugaguucgaggccagccuggucuacaaagugaguuccaggacagccggagcuauacagagaaacccugucucgaaaaaccaaaaaaaaaaaaaaaguaaccaguugauucuuuuuugcuuaaguauaaaauugauuggguuugucugaguaccaaaugcauguuacaagcacuacuuuaaaaaaauauaccauccgggcagugguggcacacacuuucaaucccagcacucaggaggcagaggcagguaaaucuuugaguucaaggccagccuugaaauuucuuucccauccaaaaaucucugguuauuuuagggaugcuaauuuucuuuauuacauauauuauuugaguugggcaauauagauugugucugccaaguacaggaaaagaaaguuacccacugagcagugguaguauaagcugacaucugacacugugccucucagagugauagauagaugaaagaacacauccucaucuauguagagcucuuuaugaaauuuaaccuaaauuuaguuauauauaagaauauauaaauacacauaucuaaguuggugggucauccuauuagaaagcuggcauggacauuucaaaacugucagggucaaggcuggagagauaacucagcaguugagagcacugacuacucuucuagaggugcuggguucgauuccuaacauccacaugauggcuuacagacaucucuaacuccaguuccaagauaccuaacaccuuauucuggccccuggggguguugcacccauguggcauauagaacagccaugcacaagauauuuuuaauuuuuuaaaaugucuguguauaaaauaaaacuagugaauauucuaaguaauucuaaauuaauggaaaugaaagggacaggacaacuaggcauagaguguaugugucauaguuuggguuacuugcugugaugaaacaccaugaccaaaagcaaguuggagaaggguuuacacuuccccaucugucuuaggguuccguugcuaugaagagacaccaugaccaaggcaacucuuauaaaggacagcauuuaauuggggcuaauuuacaguuucagagguuuaguccauuaucaucaaggcagaaagcaugccaugcauucaggcaaauguggugcuggagaaggagcugagagcucuguaucuugauucauaagcacccaggagugacuggguucuaagcagcuaggaggagggucucaaagcccacccccacagugacacacuuccuucaacaaaggucauauuuaauaaggccauaccuccuaaugugccacucucugagucaaguauauucaaaccauaacauccauaguucaucacugaaggagguccggagaggauuucaaacagggcaggaaccuggaaacaggagcugaugcagauggaagauugcugcuuaauggcuagcuuaaccuacuuucuuauaaguaaaacccagcaccaucagccuagggaugaccccacacacaacgggcuagaccuucccucaucaaucacuaauuacccgcuuccuaacuacccagucuauggaggcauuuuuuucaaguggggaucccuuuucuccuaugccucuagccuguguuaaguugacauaaaauuagucagcauuguuuguuugauucuggauaaaaacaacagagccacaguggauaaguuugcagacaguuugggaagucuguauuaacacaccauuguuaaguuucuggaauacaguguuauagcugcaugggaaaagaaguccugaggcuaauacaaauuaugggauggaugugcaguaucuaggcuacaguuuugaccucagcaggaguauauacaccagugucaccgcuagacuaugcagggggcuuuauguagacuuggccacauguucuuuccugcauuuguguuaaaauucuuuuuuaaaggacagauucuucuuauguagaccagauugucccaaaacuccuauaucugccucccaagugcugggauuaaaagcaugugucacaaggcccagcagcguguucuguuuuacuuauguauauggguguuuugccuacauguaugucugugcaugauauaugugccuguacguacugagacuagaagagcauaugggauucuuuagaauuggaguuacaggugguugagcacugcuguguggauacugggaaucaaaccgcgaguccuuuagaagagcagccagcacucucaaccaccgcuuuccaucccuuccaaccccaagaacacagucuuuugaaguauguaaaacuggaaucaaucccaaguccacuccugaccagcuuugugacaguugagcaguuccuuaacuccucugagccaagccuguguuuuuggugaaacccuagguggaaggguucaggugaggguccaguguacuuaguguuuaaaguaccuuguacuuacuggcauauaauaagugcugggaaaugaugaguuuuguugauacaacaucauuuauucaacucuguguuacucagguucuucuuuuguucuuuucuuuucugauccaggcgugaacaggggguuucuggggaucaagucuccauuaugguggaugguguccagguugcacuaccuucauaugaggaagcuguguauggaaguucuggucacugcaugccaccagcugaucccagaguacagauuguucugucggaagggucugcaccuagugggaggaacaugccaagggaacagcagcugcaaggccaggaggccugcucuucugcagguggagaggacgaggccccgggccauucugggcugugugaagccugggguucccagggcucagagacugugauggugcaucaggcaaccacaucuuccuggguggccggcucagggagcagccggccgacacacaaagacacugcagauucagaaaacagugacauacaaagccuuuuaucccucacaucagaggaguacacagaugguaaguggucuuugcuaaauacaaauuacuagcuguuagaauccuuacugggagugaggaagcucugugggccacucuaacaauuugguguauuuucaggaagugagagcuaauagaguguuagccuacaaaguaggacuugguccucagaaugccagguagagcuuugggcucuuuucauuguuaucugugacuucugauggcugucagacuauucauagccauaggcucugcuaaaccaacuggaugggguucaggguauaggacuguuaaaaaguuuuauguucaugaaaggcagaaaauaagagccuggugugguggcgcacgccuuuaaucccagcacuugggaggcagagacggagauuucugaguucgaggccagccuggucuacagagugaguuccaggacagccagggcuacacagagaaacccugucucaaaaacaaaaaacaaaaacaaaacaaaaaaaaaacaaaagaaagaaaggcagaaaauaggagaccuuggugguacugcagagaaaacaguagucugcuuaucuuauagagaagacagcugcuucauucuacacagaaguauacugcugguuuccuuguguuguccauugcagucaagcuggcaguuaagugagugguagaaauuuaugacuguccccauuuuacagauggaaaauaugggaccuaguuucacuugucuuuucuccacugguaauugacaggugagauuuaaaacuaaaugacuguggcucuaaaccagcauucuuaaccuuacagugccauauugacuccuagauaacuaguuccuuuugugucaaagugaccauggaguacagugguuacuuauuggcagucuuccuuugccagagcauggagaguguaacuauaauuugaagcagucacuuuaaagaauaucuguaggugaaaucccaguguaguuccugauucagacaaaaccuagaagcuucauguugacuguaacacucugccuucauaaugccuuucugaaggagcccagaggauggaggccaugucuaacacuuugaaaugugucugucaguagcuugccgccuuuucucuuucuuggagagagaugacaaggaugcuguaaguaacugacccaguuuggaugcggcauucaguuaccucuggaccguuaggcauguauuuuaugaaaucuggcuaagggcacauagguucccagcucuuucuugauggcuacuuauuuguuuaguaaacaaguuuuugguuugggagcuguuguuguaguuguugaugauguugauguuuucagagucagggcuccugcauagcccaggcuggcucagagacuacuauccuguuacccuagccacaaguggcugauugcagguguuacuguguaaccuuggcuaucugaaacucacuguguaaaugagaacuggucucaaaacucccagagauugcucugcuucugccucuaauuaaaaguauucugcuggaauuaaaaguauguuccauuacaccuggucugagcaaaacuuuuugaaagccauaucuuguguuuggugcuggaugagguuucagaucugaugcaaauaggaaguacucucucuguugcaaggaguaucaguaggaaagucagugaggccugcacuagagaaauaauggaaucaauaauuguggugcuagccagauauggugccucaggccugcagucagcauuucagagguuaagacaaggaccacagucaaggguaguuuggacugcacagaccccggcucucaaauacagaaauaaggccagcaagaugacucagcagagagaggcgcuugcuaccaagccugaugaucugaauuugguccccaguccccacaugguagaaugggagagcugacucccagaaguuguucucugaccugcagguauagaugcacgucaucaaguaguuccuguaguguguggauguacacauguuaaaaggaaugauaaauauauaaugaaguuuuuaaaaguacaauaaugaaaagaaauugaacucaugccaugaugaggacaccaguguuguuaagacagauuccagaucuuaaagcaugggucuagcacuucuccccucuggugacaugagaagaccaaaacccacugguuugguccaaaaugauuuguccagguucacacagaugacagguagcuuuuuuaaaaagguagaacuuaaagagaacuuugaaacuucuuagagcaagguuagaaaagaaucaaaaguuacuagaccagcagagaacagaaucaggguuauguuggugggaccagaagguguuuggauaccaggcuuagcauugggauuuuaucguacaggcagugggagaauagaagcagaaaggccagaaauagaaagcaggaaaauuugacuagcuuagacauguacagcagaacguuuuauuucuuuaaaugagcgcuguuugggacucucuaggguggaguuggaagagauacugagagacacccuuagguaacugcuguacuucccucccugucucuacagauaucccacuauugaaagaagcaugagggcugccgcuggccucuguccucucugcccguccucucucuuccuguggguuugaguaccauguccucucuagcugccccaccuggaugccugaacugccaccuguguaucucuguguaccugagagccugcaggccaccucgauggauacucaagaaagauucucaccaucugcccacuggacagcuggaggaccuggcccuuugccuggcccagccuucccaucugucugucagggaugugucugaaugcgcuggauugaaccuccccuuccccucagccucugggucccuuccagccagcucuugguggcagccccgcagccaugagggccugagcacugcuguguuuacuugugccuuccccacccuguccagguucccuguugugcagguggguugcuauccacaggccuuaguggcuacugccaccuguacccgggggccaggccugaggcugcagaaacagauugaagaguaguaaggcacucaaagcaggaauagcucaugcuggguccagaaugugggucccugagcuugcccuguguguugacacugauggcggcaucuuccuuaacugaggacagagguuugggaagucaugccaaagccacccagcacucgcugaccagcucucgugcagguuccuggcucuuuugagaguuucuaagaagcacccagaagaccugugggaaggaggaaaggugucagauaaugauugucuuccuaauacucaaguucucacuuccugcuuccagcacuggcugccuuggccuugguuucuguuccuggauaaggggaaguugcaugcuguuuccuggacuuuguccuagguagcucuggcuuccuugcagcccacagaauccugagauuugcugagaugccaacaaaagcucaucuggcuuuuggcagucugggcaaguugccccuuuuuagguuuguggugauggaggggaggcugauagguacagaccaaguccccgguggcugcaggcagcuccggcagguccugaggauccuccucaccacggucaugugccuuaguaacugugcccaggaaguggccugcugugccacugcucccacucuguucucuccucccugccuuuccacacgucaucguugaaaagccacuccuuauuuucccugccagcugauagagauggugggcacccagaaaccugagauacagguccugggagugggaacguacuagccuagaagaaaugcuccagccauuuccagccuccuauugcccuguacugaaugcugacaagucuggguaacugagccccaccaggcuucuaccaucuugagaagacagaugugguaucaaggaauguguguguuuuuuuuuuuucuucucaucuuucuuccuuucuuccuuuucuuccucuucuucuucuucuucuuucuccuccucaagccuuggggcugggaaacucuucagagccaguccuggacugaaccugugaugagccucucuggggugguaaaaauaauaaaagcccaguauauuuauaguuccugacacaacaggguuagcuccaggcaucuguggccucaaaaauaggggaauaacuucuccuagccaacugccuccauucacaaugcacuuuagucccugucaugccuggcuuccugacacccucaucuccucucaggguaagggcagugucugcugucccugcuggccacucccacacuaacccaggaggccaguccagugugcccaguguccagacaaguaugguuggcugaggaaugagcuggaaaaggugcuuagacuagacgacuagaacaccccuagcaggugcugccauaggcuuaccuggggguggguuccaaggccccaagccaccucaccauggcgcuucuucagcuucagugguguccaccccccucaagggagaacugggcaaggaacacgagucuucugaaugggccugccucuuuugcuuacugcucuucuaaaaucugaguucuguuuuaguucugugucguuacccugggcuuuugccccuuacagauugcacuucuuuggcuuauuauuuagccuuguaggugccuggcuuuggccuugggaaaaagaaccuccuggugccucguuuucucucagcauucauuagccugcuguggggaaaucacaggcccaggcuugccuaacugaaggauaaagggcacccguguuccccauccucuugucacaggcuuuuagaaggucuguucuugaggucucacaccuguugcuggcaucuguggcuucuuccugcauuguuuucuucuacagcaauuucuuaaccauuagccaugugcugugguuucuggggcaucugggcuuuguccauuacagacggacuggggacuuaauugccuugaaguggagccugcuagaaacagggucaguggcagguggcaggcggaugggcaggaagaagcuucgagcaagugggaagaaacuaagcagccuacuuuacugggcucaccuccagggacauccugagacuuguccaaaagaggcagucagcaccaaaggacuuuuacacaggguuuuuugguuugggagauguuuuugcuuuuucauacuuacacugacucaaugcagguuuuauauccuggugacuugcugucacauucuaucaguuuucaagggccagaaugaugaaauaaauaaauagaaaauuccguccuuccaugccuuaguuuaacaggugagcucuaccugcccaguucuguguuuugugugagaacugugaaaugggcggaguccugaccacuuuguggguucguuugguuuuauaaggcauuucaauguacauucuucaagcacuccauuugcaaagagaacuuaaagucauacugucuuccccauucauccugcccuccuugcacccccagcuuuacaguucuguaaagaagccaggcuacaagacagacaaagguauauuuuuccugcuuugagaguggccaaguugggauagauggcaguuggccuuuuuccucccaguccuaucagagcucuugagucacuuggcuuccugcauaacaauaucuccucuguucugaggaacauucuagcauagaaaauggaauaugcugcaaacauuucuagauccuuccucccuucccccuccuuaaagaacaaagaagggacacacagcaugccuaccacacagcuucauuccagguaugcuugcgccugacaguacagcuagagccuucucuguggggccugcugggucuccugcagccuuagagaauauuuuacuuggcauuuuacuaggcaguugaaaaccuaguagaguuugaacaaagcgcaccccaccccacccguccuucacccagcagcagagcucaccaugagggugcagaguagagcacuuggauugccaaguagggagaggaaguaguugaggguugcauggcuguauccacacuggccuggcuucuuaaggcugugcaccacuaugggauccuuugcagaaugguacucauaaaaugguuuaaacaacacaugcuuaauugacugugcaggaugucaaucaaucuggguuugcuuuauuuuauuuuauauauauauuuuuugguauccuguacauugcaguggguaugaagauaguauuuuaauauuuguacaaaguuuaauuuaauuuuaauuguucuauguauauaacugcauuucuaaauaauaauaaaaauucuuaugaaggcagau

SEQ ID NO: 6724 - RNA, 11453 nt, Mus musculus
guuuaccaaaccacugcccuuucuguuuaggguuaguaaccugaugguaauucaaguccaguggcaacaggaaagaauugaaggaauacaaggaacugucacucaacuuagcuguaguuuucaauccauuugcaggcuccuucacuagcuucaaauagcaaaauaauaaaauacuuuaaaaagcuuacacuucaggguucuacauguguaguuuuuaacuuaaaauacacaaaugugauagaauaaauaauacagaacuugagagaaacagaccaaaagcaguuuuauaauacuuaguauuuuauuaucaauaacaaacagcugcuuuacuuuaaugucuaucuacagcuguuaaugggcaagacacccuugacccuaacaaguaaaacucauauuaagccuuuauauacaagcaaauuuagagcucuuuuaaaguguccaaaacuauucguuaguuuaauuaaacuaaucuugaguuaacauaucugaacaaugaacuaaaauauucaaaaguuuuucuaguacaaaaaauuaaaugcuuuaguuauaaaagagcucuaucaauauacacaaacuauauacuucagacagucacaaaagugugagcagaaggcuuaucaaaagacauuuaauacaauuaguuuucaacaaccccuuggugguccacaucuacaaagaaauccagcccaacccccuccaaaucccaccccacagaaaagcacauacuuaccagaacuuuuagcaaguaugguuugggaauuuguuuuguuuuuuaaaaaaaggcccccagggcaaguuauuuacaguuuaauugccacugucaacugaucuggaccuggaccgggaucgggaccucuggcgauccacagaugcuggagauuuagaucuacucgaagaaccacguuucuggcucuucucaggcacaggagaccuacuaccagaacgggacuugcuccggcuccggcuccugcuccuugaucggcuguaagacuugcuccuucgugaacgggaucggcuacgggaccuagaggaacuucugguccgagaucgugaccugcuucuugaccugcuaugaaaaauuggcaagaaggaaagagagaaaacacacauuaaccuguaugacagggcucuaaaagccagcaaguaaaaccuuuggcuuaaaaauauaaacgaaagaguaccugugccuuuugcugccuucaauuaauuugauuuuucucccguuaauuuccuuuccagaaaguuucucaauagcauucuuuaagucaccauaagaggcaaacucaacuacccuaaaauggaaggaaaaaaaaaucccuuuaaagguuauaaauccaauagccuuguagaccaccuacacagaucaagauaagcauaaguuuaucccuguuguuauugcuguuuuaagucauuucugauauauacagcacaauucuguggugugccccccuauguacuguggaauguugcaggugccuauuaucaacagucccuugugauagucuuucuccccaaacuuagccaaaaucaagcacaugcaaauuuuagaucauagcaaugccacaauuaaaauucccaagguaauuaauuaagacucacaauccaggacaugcuuacccuucauuuaguuuaggucgaugugcauccgcaaagguuacuuccccagcuugucucaugaaaucuuugagauccuuaacacaagacaauuauguuaaggagagaaagggaaaaguggcacacaaacaaccacauggcauaaacaagacuacuggaagagaagguguuagauaaaguacaaacauggcauauaccacacuuguauucuaucagaauucaaaaauuaugccagggcacgaaauaagcaaauagcauauugcuuuuaagcaaaaugcuagagggcauuccaauuuuuuaacauuauaguauuagucuaacugagcucaguacaaaagggggaaaaaacaaaaaacaaaacaaacaacaaaaaaaaacaaaaaggaacaguacauccuuuaaagacuaguuuuauauuuaaaaaaaauaaaaaauaaaaaaauaaaacaacauuuacaaagacaccaguuauuuugugccccauaugucauuaaaaaauuuuacuuuaccuuuauuaacauuucccuaggcuagucaagcagcaaaccauuaagcggucggagaaaccuucaugacauaggcccgacuggcucuucgccacccacuugaaggauacuacccaaucgauggaagccuuuaaucgcacagcccucccuauuagcagacuacuggcgaugcagacauguuuuacucuugugcaguuaccaaggaccacuuuacugcgaucaggauuccaacgaccaacuaauuucguaucuuucaacucuuucgaccaggaccucuuauucggaagcguuacaggaagacagcucucaacuuagggaucagaucacguuaucaacgguucugggaucgcugcaacccggcacuucaaguaagugcaccgauuacgucuagaccggcaaacacagaucuagagguggccaacugaucacuguaggagcugacuggcaaagucaaccaggcccaaccaagagugaccaagacaacgauuaggauaacccacaggcacuccucgucauaaggccaacgacacagauaggcuggcaaauaaaggguuuaauauuugguuaaaauugauuuuaaaaaacaugaaaaaauaaccucaaaacauuuacauuugaucacuaauauuaaaaucugaaacaucccccaguuacauuuaacuaaaguuuaaaauuauaguucaauuaaauuaauuuaagauaaagcauuuaauaagauauauauuaauaaaacauuaacuacccauuaacacuuuuaaaugccacauuaaaaaauaucucaaaacuguauuucaacaaaccugccagcugacucuugaggauaaauucucaacuauaagucgauuuucuguucuuacagguggagcauuucugaagaaagaaaaauaagcauucagugucagauguuaugucacaaugucaaaugcuaugugacaaguuuaagccaagauagugauuccaucaaguuucuggguucucagcauguggacuaacuagacuuaacuagucugagaaccauuuaaugcuaacggacccuaacccaaccguaacagccaaacccaaaccacauaccgucuaucauuucgaggucugcgacugcuaaaacggucggaguaucguccucuaccucuuccaccucgagaccgagcccgggcauguucaaucgucacccuacaaagagguaaaaaaagcauucacacacuacacaugagagcacuuacauaugcaaaugucuacucugcucuacuucccugggagaacuacuuauaaaccaaucaugcuuaccuuucacugcaaaguuccuucccaucaaguucauaaacagcaucaucugcaucccuuggguccucaaauuccuaaaauguagcaguaagaguagagcuuuuggacgugcaugcauucuacagcacauuaagaucauggaagccgagcgugguggcgcacgccuuuaauuuaaucccagcacucgggaggcagacagauuccugaguucgaggccagccuggucuacaaagugaguuccaggacagccagagcuauacagagaagcccugucucgaaaaaccaaaaaaauaaaaaauaaauuuaaaaaaaaaaucauggaaguguuaagauauaccuuacacucagauacuauaacccuaagcuagggaugacugagaaucaacuccagccagcaguuacuuuaacuucuuaacagaagccacugcuucuuggccacuucuaacaucuuucugggaaaacaauucacauggacucagaguccaugcucaucacaagagcucuacccacuuuguuuuuuuuuuuuuucuuuuuuuggagacaggguuucucuguggauuggcuugccccugccucccaagggccagagaccaaaggcaugugucaccaccacaaaguuaccuaacuucucgacagauaauucaacucaguuucaaguacuuaccacaaaaccaaaaccucuuuucaagucaauaucucggauccguccguaacccuugaagaaucuuuccacaucuuucucccucgcugcuggauuuagucucccaaugaacacucgacagccacucaugaugcccggcuaguguuuccuguuaggcaguaauugaaucgagacaauaucaacgauugacaccaugggggugggggauguucagucaagcagucaaacacaccccacguuuaccaacucuacuaacaaggucgccauguaccuuuuaagucguucacgaccaccacauucaaauuccaaguuaaaacuuaacucuccaaaagacccccuucccagguuccacacggcagcccaccacaacgccaguagccaccuuucuagacugcgcagccgcacacgcuguccccggaucccgggguuccccucccaucugccgcaguuaaggccaggccgagaaaugcgggcggagccgagcccgcccucugccaggccugguccaauagcagccggccgcgcccgcgucgcggccuccccgcgcgucacaagccggaaucucgcgacgccaccaccgagccugcgcagugggcgacggggcgcguucgcagcacaaaauggcgacggccgaaguaugcggcggggugugggggggggaggagcguagcgagccgagcugcgugcccccgagacacgggcaagcccggggcccagagcgcugcgccugcgccggcccacggggggaaacccuaagcugcccugggccaggccggcuccccggcguccgggccucgaugagagccauuaagggcggcagggaggggcgcgcugcuucccgacacaaacgcccuccccacgcccgcccuuccgccucgugucccccucacgcaacacccacagggagacgugccccagcgcccaccucaaaucaacugcgcucucugagucgccguccuccgcaaagagcgaagccccggccacuugcgacccgagcggccaugaagaagccucgauccgagaagccuugcccucaaagcgugccacucaccuaccggacagggucuuuggcggcugagaccccggagagguccguagucugcgacggagcugucugccucccuacacaaacacacacacaacacacauacacacgaacccaacucgucuacagucucuccacaacugacgcacuuagcagcucggacguugcacaaaauggaagggacguccuggcgucacuuccggggcggugccagaagcucggggaccgcccacuuggagcugaggacagacgguuccugggagccggaaguucuaguagggcggggcuuccuuaccgcgaccccuggcgagagcaguggguggugggaggacuagaaacguucguucaguuggcaggauacaccgggacacuucuuuggauacgaaaagauguauuuaaacuuuuucuuaggucccucgaagauuaccaagaaacccaggcuuuucaaaaaucaccuguuucuuuuaaaaauucauuuacauagucggucucgcuaagcaguccuggcuagccuugagcucagcgauccagccgguccgccuucagugugauaggauuauuggcccgagcaccagguccaauucuuucuuucuuucuuucuuucuuucuuucuuucuuucuuucuuucuuucuuucuuucuuucuuucuuucuuccuuccuuccuuccuuccuuccuuucuuucuuucuuucuuucuuucuuucuuucuuucucucuuuagccucuucugcaaauuguacuuaucaauguccuucaagagaggguucuuagccgggcgugguggcacacgccuuuaauccuagcacuugggaggcagaggcaggaggauuucugaguucaaggccagccuggucuacagagugaguuccaggacagccuggucuacacagagaaauccugccucggaaaaaagagagagagagaggguucucugaggcucaaguaagugaauucuuucaguguugugguuuuuguucugaucagccuaaggaacugaauuguuuucuacuaaaggagagauuucacguggugaaauaaugaaauugguacuguggguaaaaaaaaaaaaaacaaaaaacgcuccuauauauugaaucccuagggccaaucuuggcucagcuagcugggaaagauuucaaguuguuucuaaauccaacuggccauuguccauuccuuucuguccaggucucaaucucaauaguuagguggacggugguagcuucagccuuuaaucaucucugugaguuccaggccuaccuuaucuacaaaguccaagacagccaggaaaacccugagucaaagaaccaaaaaaaaaaaaaaaaaaaaaaaagagucgaaaucaacaguuauugagaaauagaguuuaugcuuccagcauggauguaauacacagcaguccacaucgguaacucuauccagccuuccccagugagguugggaggucuagaaacauugacaauaaagacuguuguuguugugaaaaaggcuacuucucuuuaauauuuuuaucuguaaccuaaggcaucaucuagauuuugagauguaccuagaauagagucacacaauuucagcuagggucacagggaugaacugauagcucaagaaggagcagagcaacccugggucugaccucauucacguggaauaagcuugucuauucaguuaacuaugcaaauaaaaacagcaucaguggacccauuaaaaaacauguagcgggcagugguggcgcacuccuuuaaucccagcacucgggaggcagaggcaggcggauuucugaguuccagaacagccagggcuacacagagaaacccugucucaaaaaaaaaacaaaaaaacacuuguauuaucccagaaaugucugggggugggggguacucucuuuuggauaaauauuuuccccaugucauucuuuaggggcaagggcauccuuuccaaagacauucaaacaaauaacauauauguaguagaggaaaagaguuacagagaucacagauuaagagaacauuuauuguccaucacagaccugcuagcugccuuccucuccccagaaaucggguuacacccucccugaagguguuaggaguugauaagaaagcuuacuguagccaggcaugauggauagguauguuuuuaaucccaguguuuaggagcagaggaaggaaguagccuacucuauguagugaguucagaguuagccggagcuacaccgugaaacacugucugaagagagagagggggagagagagagagagauucuguuucugacucagauucacccuauaagcccaucuuuuacuuauuaaauacugauuuuuuuuaaaugccugcaugauguuuaaaauagcaaugucucuagagucauucaauacagacauuucauuucugucgacuguagaccacaucauuugcuggugauccucucugauuauuguaaaacuguuucccccagauuggacauccccaucuugaaucagagcagcuguugaccaaccacagagccucuggaagucaggccuaucagcauuccugcauggaagacugaggaaagcuccucccagaagcuguaucagcagugaaugaugacugggaagagagauugcugguaccauaggcugccuuugacucgcccaaggcccuguaaguaaccccagcaaacucaucgacucaccaagcuggagcugaguggguucuguccucuccccuagguaacaagauguuucuuuuucuugcccccaggaaacaucacacaacagagcugaaauuuccuauugccuaaugacaauguggccgggacaucaucucagcauaaugcauuccucacacguucguggcaauggucuccgguguaaacaagccugcccuucagccggccagagagaacacacaguacuguacaguacauaauacuugauaacuaaaugacuauauauuuacuauuauuguuuuagaguauagggguuuuuuuaagauauuuuacugugugucuuaguuugcuuuuauaaauguaauaaaacacuaaccaaaaccaaccugggagagaaaggguuuauuacaguucagaguccaucaugaaaagaagucagggcuggaaaugaagcagagaccauuacucauccgggaaaacuugcgucuguaguuuaaaguuguaaucauucacauacaagaaauuugaaaauacuuaggaguuuagagcauauuucucagucacaauggagguggcuuggaaaauauucagagaauaguggaggaacccaguauuggccuccaguucuacacugacuugcucuugagacccugcucagucuccuuucuuaaacaacccagaaccaccugucuggggggucacugccuacaguggggcuaggcucucucauaucaacuauuaauuaacauauuaauaccccacagacuugccuaaagcccaauaugguggcggaaacaucuucuccguuaagguucccucuucccaagugaaucuaguuugugucaagaagacaaaaccuaaccagcaugcuguguaacugcauagcaugccacccugcagcagcccacacaucuguucuuccaucuggguuccuguaagaacacucacugguguucacacaguggccaaaccaccugcugaugugguucucauaugacaucacucuugcuaugcuuacagcauccugccaccuggaucccuacuggcagaaauauugauuuaaauggucugaugaggaguacaguuuguuagaaagggcuugugugggaagccacaugugccguugcagaguggcacugacuacugcuggccaccacacauaaguuuggacaaacaaccaauguguacauaugcaguaaaguuuuuugcaaagacacugccuggcccgggcaugauaaugaggcuuugagaguauaaccaaucagaugugggacaugcaaaugagguacgauaaugaggcucugugagguacagagagagagagagaguagccaaucagaugaggaacaugcaaaugagguauagugcauaaccaauccgggugugagacacgccucuccuaggccuauauaagcagcaccaguucugggcucggggucucuucgccucugcaaucaagcucucccaauaaacgugugcagaaggauccuguugcagcgucguucuugcuggucgaguccagcgugcgcaagaggcuuggagaacugcuguacucaaaaagcauguaaacugugaucugccucacuuuaucuucuggcucugucuugucuccucacacagauuugucugaggcccaguuaagacagucauagaggggcuagagaaauggcucagaggguaacacugacugcucuuccagagguucagaguucaauucccagcaaccacaugguagcucauaaccaucuguaaugggaucugaugcccucuucuggugugucugguguacacaccaguauacucauacacauaagauaaauaaaucuuuaaaaaaaaaaaaaagccaggcguuuucagaggcugggcagugguggcacacgccuuucauuccagcacuugggaggcagagacagaggcaggagggaaaaaaaagacagucauagggaacaacuuuaacacugaaaaaaaaaucuguucagggugccuaaguacuucuuccccaacccuccugauuggcagcugccaacucuuaagccauuauacaaacgcaccaugcuaaggacauuacaaucucaggaccuccugucucccacagaaguguucuaagauguuugagaguagaaaauaaucuuucugcccaacuauuccuauuccucauuucccugauuuccuaggcccugucacaaaagcagcaacaggacaccacaugaccugugcacuaaaggggcccugggaauccaaacagaaaccagcacugacaaauuuucaguguccuuaucaauaaggccagagaagucugggugguggcagaaauucaaauaagcagagccucuuuaaaggauugaaacugaggaagaaauaccauauacucuacagagaaugggagaacagagguuagaauuagggagccugaaaauacuuucuuagcagacaagguggcgaaugccuuuaaucccagcacuggggagucagaggcagguggauuucugaguuugaggccauccuauucuacagagagagucccaagacagccaggacgacauagagaaacccugucucagaaaaaaaauuaaauaaacagaaaauaagagauagauagauaaacagacagacagacagacagacagguaaauaaagaaaaagaaaagaaacaucaucuuaagcagagacagacagcaguaauuccaccuaauucagaaauuguugacaaaacucaaauucuuugcagagccauacauaguguuugguguuaaauuuugcuaugaaucaagaccauuugauugauuaagucaucucuccagucuguccuugaauucauaauucucuggcuucugccuccagaguacugaguuuacaggcauagguacccgagacuugguuuauuccaugcuagggaucagagccagaacuuccaccugcuaagcacauacucuauccaaugagcuacacuaccaucccaacaccgauuucaacucuugcuuuagcuuuuccuucugucccacauuugacucuaauuuaaaagagucauuucaggcuggagggauagcucagcaguuaagagcacugacugcucuuccggagguucugaguucaaaucccagcaaucacaugguggcucacaaccaucuguaaugggacucuucugguguaucugaagacagcuacaguguacucauauacauaaaauagaaaaauaauucuuuuuuuaaaaagaaaaaagucauuuugacacauaccaaauacagauuaccuuccuagaagagccagacucuggaaucacuagcucuuaggccugcaggguuaacugccaccguuggcugucaggacuucaguuuacauuguccaguucacuccuggacaguucacaucagucacucuaccuaugacucaggaagaacucaggagugacucgggugguucugguuugaaguggucucacccaauuuccccauuuagagugaaaucugcuuccaggcucacccagaauaugugagcaccucaccucaguccuugcuggccauucacuguugaucacugcucucacgugggccuuucuguaagcaaccugagugucuccgcugugucauagcuggcuguccacagagggugccuucuaggagacagugcaucugagacagaagcugcagugacuguauucuaauuucaggaacaauguccucacgcacugugacuuaguguauu

SEQ ID NO: 6725 - RNA, 2747 nt, Mus musculus
cggggcuuccuuaccgcgaccccuggcgagagcaguggguggugggaggacuagaaacguucguucaguuggcaggauacaccgggacacuucuuuggauacgaaaagauguauuuaaacuuuuucuuaggucccucgaagauuaccaagaaacccaggcuuuucaaaaaucaccuguuucuuuuaaaaauucauuuacauagucggucucgcuaagcaguccuggcuagccuugagcucagcgauccagccgguccgccuucagugugauaggauuauuggcccgagcaccagguccaauucuuucuuucuuucuuucuuucuuucuuucuuucuuucuuucuuucuuucuuucuuucuuucuuucuuucuuccuuccuuccuuccuuccuuccuuucuuucuuucuuucuuucuuucuuucuuucuuucucucuuuagccucuucugcaaauuguacuuaucaauguccuucaagagaggguucuuagccgggcgugguggcacacgccuuuaauccuagcacuugggaggcagaggcaggaggauuucugaguucaaggccagccuggucuacagagugaguuccaggacagccuggucuacacagagaaauccugccucggaaaaaagagagagagagaggguucucugaggcucaaguaagugaauucuuucaguguugugguuuuuguucugaucagccuaaggaacugaauuguuuucuacuaaaggagagauuucacguggugaaauaaugaaauugguacuguggguaaaaaaaaaaaaaacaaaaaacgcuccuauauauugaaucccuagggccaaucuuggcucagcuagcugggaaagauuucaaguuguuucuaaauccaacuggccauuguccauuccuuucuguccaggucucaaucucaauaguuagguggacggugguagcuucagccuuuaaucaucucugugaguuccaggccuaccuuaucuacaaaguccaagacagccaggaaaacccugagucaaagaaccaaaaaaaaaaaaaaaaaaaaaaaagagucgaaaucaacaguuauugagaaauagaguuuaugcuuccagcauggauguaauacacagcaguccacaucgguaacucuauccagccuuccccagugagguugggaggucuagaaacauugacaauaaagacuguuguuguugugaaaaaggcuacuucucuuuaauauuuuuaucuguaaccuaaggcaucaucuagauuuugagauguaccuagaauagagucacacaauuucagcuagggucacagggaugaacugauagcucaagaaggagcagagcaacccugggucugaccucauucacguggaauaagcuugucuauucaguuaacuaugcaaauaaaaacagcaucaguggacccauuaaaaaacauguagcgggcagugguggcgcacuccuuuaaucccagcacucgggaggcagaggcaggcggauuucugaguuccagaacagccagggcuacacagagaaacccugucucaaaaaaaaaacaaaaaaacacuuguauuaucccagaaaugucugggggugggggguacucucuuuuggauaaauauuuuccccaugucauucuuuaggggcaagggcauccuuuccaaagacauucaaacaaauaacauauauguaguagaggaaaagaguuacagagaucacagauuaagagaacauuuauuguccaucacagaccugcuagcugccuuccucuccccagaaaucggguuacacccucccugaagguguuaggaguugauaagaaagcuuacuguagccaggcaugauggauagguauguuuuuaaucccaguguuuaggagcagaggaaggaaguagccuacucuauguagugaguucagaguuagccggagcuacaccgugaaacacugucugaagagagagagggggagagagagagagagauucuguuucugacucagauucacccuauaagcccaucuuuuacuuauuaaauacugauuuuuuuuaaaugccugcaugauguuuaaaauagcaaugucucuagagucauucaauacagacauuucauuucugucgacuguagaccacaucauuugcuggugauccucucugauuauuguaaaacuguuucccccagauuggacauccccaucuugaaucagagcagcuguugaccaaccacagagccucuggaagucaggccuaucagcauuccugcauggaagacugaggaaagcuccucccagaagcuguaucagcagugaaugaugacugggaagagagauugcugguaccauaggcugccuuugacucgcccaaggcccuguaaguaaccccagcaaacucaucgacucaccaagcuggagcugaguggguucuguccucuccccuagguaacaagauguuucuuuuucuugcccccaggaaacaucacacaacagagcugaaauuuccuauugccuaaugacaauguggccgggacaucaucucagcauaaugcauuccucacacguucguggcaauggucuccgguguaaacaagccugcccuucagccggccagagagaacacacaguacuguacaguacauaauacuugauaacuaaaugacuauauauuuacuauuauuguuuuagaguauagggguuuuuuuaagauauuuuacugugugucuuaguuugcuuuuauaaauguaauaaaacacuaaccaaaacca

SEQ ID NO: 6726 - RNA, 15523 nt, Mus musculus
uguuugguaaguuagaacuaccaguuguaguuuauuuccuuuugaguuacaacaugaagcagguuguggaugcuuaaugagcaaaacaccugcuuauuggaaagucuagaaauagugauaauguuuaucagauguagcuguuucauagagccuucauaagaguucauagcugcugaaaguguucuugguuucuugagacagucuugcuguguacucaagguugaccuugagucucugagcauuggaauuauagggaggaaccacuuugccuaguucuuuuuuaucuuuuaaacaaauagcagauuuuuggggauggaugaugguuccuggauagaugcccuucugccucaguucauugcuucaugauucugcuguugaagguuugcuggaagugcuagacaaucuggcacacuagguguuacuuuccuuguugcuucuaaguuuucacauucuaauuugccaucugaccagaguucaggccauuaggggaaaggccagguuguguaggaggauuauucccguuguggguaccuuuuuccagagcugcuggaguagcaucuucuguugcagcagccuuguagguaauuuuuguuuggucuguaaaguaaaaagagaaugagaguaaaacuggcuugaaugagggugggucccuauuugaaugcuuguuuuucacugggaggaguugcuugagaaggauuagguauggucuuguugagaugugucauugagggugagcuuuugagguuucaaaagccugcauuuuaugucacuccuaauuaaccuuugugugccuauuugugauuuuguggaucaggguacguaaggucauuuacugcuccagugucuugccugccugccaguugccauguucccucucaugaugauaaugaacucuagcccucugaaauuguaagcucagcucagcaguagaauaguagcauguacagacuuucuugggaaaagagaguuagcuaagacagacaaaacuuacucaaaugcaagaacucaggggugugcucuguauuuguaucuacuaucacuccuuucagaaagauuugcuuuucuuuugagaucccuggugugguagcacuaacagaugcuuugugugauauuuucaucacuguggguuuaggugaguaauaaugacuuaaauucugaaggacuuagaagcaggaagcuuugaucaggccucaaacugccaaccccuaccuucuucagucugagugucccuccgccccauguggaaguggugagggacuuugaaggugggugucaggguccuccaugcucuugcacuacaguagaaaucuguuuugggugcagaucauaaguucuuggggucaaaacaaaaaaaaaaaaaacccaaaaaacccaaaacccucagccuugguuuuggaaauacauaguagaagaaacuggguuaggaaacggauuaauuuuuauuuaaaagacacaaggaugcuggggauauagcucugauugaaugcuuguuuagcaugcccaagguucuggguuugauuucuaguacuaaaaagacaugacuggucacgguacaugauguugaauuugaguacuuguuggcuggggaaucuccaguuugaggcuagccugagcuacauacagaaaacaaugcucuguaccauaaaaaaccaaaaugguuuauaaagaguacuuugggugagaugacucagcagguaaagguucuugcugcuaagccuggaugacucaaguuaaaacaguccacauggaaagagcaucgauuccuuggaguucucugauuaaauggguuuguauacauaaagacaaaagcccuuuaaggacugguauuuuuggcgguggggguguaugaguguuucucugcauguaugucuuuguucugcaugaagucucuggaggaaaagagguuacccuuuaggacuggaauuguuggcuucugagcugccuugaggguccuguggaagagcaacuagguguucuuaacuacuccagccccugcaagugcccuuagugguugagaugugucucaguuugagggagggauucugggcuuuuuugagaauagcauucugcagauaaugaauuugcucugaacacuuaaaguaauaaauuauuuuuaaaagaaaaaaguaaaauaauuugaagauuauucuaguaauuaguauaaaucaugccaguuaucugagauuaacugaccagaguggaaucaugguuuggauucuguuguauuaggccuguuucaaguuuucccuauguugguacuagggcucugaccuuuuuuuuuuuuuuuauuuguuuguuuuuguuuuuugagacagggucucuguauagcccuggcuguccuggaacucacucuguagaccagcuggccucgaacucagaaauccaccugccucugccucccaagugcugggauuaaaggcgugcgccaccagcugggcucugaccuugcagaaagcugaacacuaaagaaugcugaagcuuuccaaauuaaagaaacccuagacauguuuuaguuucaagaucguucucuguaauauugaagcuugucuuacaaagucaggcccaugagaacaacgccagaugcauuaacuuggaguaguguuacuggugaaaaugaccuuuacucuucaaagucgcuggcaugcuguuuuaccugguuccaguuccuacuuggaaucuuuuguugguagcucagguccagagcaaauacucauaggagaugaguucaauacuuacccuucugagguuugauuuucaaauagcaccggaagauaauaaugaagagaaguccuucugcaagcugaaaaaucauauaaaggagaggaaagaagaacagugguccaaugacuucaggggggaaggugacauugaggaugguagaacagaguuggacguuuuggaauccuguuuccaugcugauggugcgucugcagcugugugagugggaagaaacaagacaguggucagcucuggggccuguccuuccccuuucugaugcuuuagaccuacagcauccagcauuggaagaugggauccaacccuaagaagauagugacaaaaaaggcacaaaguuuauaaaggcugugugugugcaugcauguguaugcacauguaugugcuuguaucucugcaugcaugcguaugcuugggacuaugagcauuguauauacuaggcauguguucuacauccaucugacccuaaggaggccuuugaauaguuuggaaauuuugucugcuuuuacagaauugcuaaguuaaaauuugaaagugacuggcagauaggugacacuggaaguguuagcuugucuuuuucuuuauuuuuuuaaaaaaagauguauuugcuuacuauauauaaguacaauguagcuguccucagacaucccagaagagagcaucagaucucauggaugguugugaaccaccaugugguugcugggauuugaacucaggaccucuggaagagcagucagugcucuuaacugcugagccaucucucuagcccuuagucuuuuuuuuuuuucccccuuagucuuauaguugcacuuugagcagacagugggagauugaaauguggacuucauccuguguuucuuuguagcuuaacauauuuuuuuaaaacuuuuauuuauuauauguaaguacacuguagcuauucucagaaacccuagaagaggacaucagaucuccuuauggauggcugugagccaccgugugguugcugggaauugaacucaggaccucuggaagaguagucagugcucuuaaccacugagccaucucuccagcccuuaacauaauuuuaauucuagaacuggucauuauguaucuuugaaaccugcuccccuaauuuugcuuuccauuuagugcauugaagagcagaauguuuuaauugaauacauugcaccuuucuaacucccaaguguguuacuuguccuauuuagcauguuaggcuuacugugauggcccuuggugcuauggccauugugaucuguagcucccagaacuaguaagacuguaguacuaugguaaugggcagucuuuugccuguguaauacaagcacaguuauuuaauuguuaucaacuagguuguaauaguggauuuuguauuuuggaaaugaguuucucuuaaaguguaggggggagaugguacuaaugcagcagcucucaacuugugggucacugcucuugggggguggaugacccuuucagggguugccuaagaccauugggaaacacauauuuacuuaaaauucauagcaagauuaguuacaaaguagugacaaaauaauuuuaugguggggucaccacaguaugaugaagugcauuacagggucacagcauuggggagguugagaaccauuguaccaauguuuagacuccuauguaauuuauuuaggcugacaggaggaaaggacucuguuuccauagacccucagguugaauguuacuuuacgauggcuuuauuuguuugcuugcacuauagcuaaaggcuuugagcuuagcauggcuuccaucugacauuguccuuguuaaggauucaagccuuguuagaauaagagugggcaaggaaaaaaagcauuggcguuaaagcuacuacaaugacaucaaacuccauggugugauuuaacaucgggagagggcagacuuugccuuuaccaccuucccauccuaaguccuccccccccagccccccaaguauuucucauugcucaaagcccucggucaguuggugccuuugaacacaugcuuuggaaaugcucugcccuuaucucaagguuccuuauuucuaaaaagacuuaagagacacccugaggacauugggaccuagaagaccuaccuuggauuuagucggaagagagcagagagaauguagcccaucaggaagccagugaaaggcaucagggaggagguagccaguaaguguggugucaugacgaacaugaugcuguugcccacauugaugacagacaggacugugacagccacagagagggagaaagugaugaucaugccugccuggacauggggacagaagagaccaucagaagguugggagugggcacaggaguggggagacucgguaggaaauaggaauucaaaaaaccuuuaucuugggucuuuuuggauuuauuauuaguagcuauaaaaauauuuggcuaauacguuaaugacuaaaaccucaaccaagcacagccagcugcuuuugacauagcuccagacugcugugaaauucucaaguguguaacuuugaagggaugaaucugguccuaugaagcugauacagcauuuucagucuguguauacauuugcacaagaugacauacacauauuuuggagcugguuagaaccagucauacuuucucagcuuccauuacagggagagacugaaauguuauggaacagcaguucucaacuugugaguagcaaucaccaaagggguugagcaaccccugucccccaaaucacugaaaaaauacggauauucgccgggcgugggaggcagaggcaggcggauuucugaguuccaggccagccuggucuacaaagugagguccaggacagccagggcuauacagagaaauccugucucgaaaaaccaaaaaaacaaaacaaaaaaaacccagauauuuaguuacaauucauagcaaaauuaguuaagacguagcuauacuaaaaacaaaaaaagccgggcagugguggcauaugccuuuaaucccagcacuugggaggcagaggcagguggauuucaguguucgaggccagccuggucuagagagugaguuccagaacagccagggcuacacagagaaacccugucucgaaaaaaaaucuaaaagcaauaaaaauaauuauuguugggguucacugcaacacaugaucugaauuuaagagugcaguauuaggaagguugagaaccacuguuuuaggguaaacuggauuucuggaaauugccaagagucauuuaaagcaaagcagauacaaaaggcuguugguugaaccagguagccuauuuuugaccccaaaugauguguaacccuaaaaagucagcucgcuugugugaccuggaaacuagaugagaaaauucuagaagugugucagcauuauaucaugccccucccccagguaagugcuguacaagcauuuacugggggguaauggcauguuuuuagaauaaaacuaacuuuccaguugcaucuucugaagugacugcuuaacgauuucgucgugagacaugaggaugugaguuuucagaguguacuucaugcucuuuuguagcauguuccaaaaugacaaaaauguguagauuuaagucuuuguuuuuucaucuuuugaauaaagaaauagcaaaaaaggaaaucagugcucauguuacuuuguagugauuaugcucccacaugguuuuaaaguuuccuuuuuuuuuccugugugggauguucacuuuuuugagacccggucucacuauguggcccuggcuggccauccugagccugcuauguagaggaggcugacaagagccgagcucuuggaggauuauggacagucucacguucuucuagggcaagcagugaucuuucuuccuucacgcuggccaugaaaugcugggaguguuuauucucuucuagcuauugaaaucuaccaaguuugcccuguugcuuucuauuuggccuccaggcuuauaugagucccaaccuuugugacuggcaccagccccuccagaaaagccugaccuuucuggucuucgguagucgucuuaaagacugucagacuugauugucugcuauugggaucuuauuucucuugugugcgacuuuacuuuuuucagaugacaaacucagaagacagcccucaaguguauggcagagacuuuaagcaucaagaaacauaaguuuaauuuuauuuuaauucuaugaaggguguguguuuguguacaggguucaaaggcagguucccggggugaugcugcagggaaguccuguggcuucaggauauagagccuuagaugugaagguucucaggucauuggggacacgauacugaaaaggcacagggguccagugcuauccuuucuucuacucuugccuugguauauuuguacccgacccaacacaugcucaugcugugaugagcugcccuugccaaaugacccaacauucaacucuaaccccuagggcagcuagucaaaguaaacuucccuaaguagacgauguggugguagcucgguugccauguucuaucaagggcccugaguucuuaccuugaggacguaggguacauaguguggccuuuuggacuucaggaagaucccuauggcgcaaggaaugagaaccaugacgagugauaacauaaugccuuuguagggcaccuuguccuuaagaucuccgucguagauuccuuugcuguagauguauaagaggagaggcaucaugcccaaggcagugaagcuggagcagguggucaucacaaugcugaguggccaauaagggaaaaacaaaggaaaagccaauuagagguuugaguuccuuccaugugccugacacuaugcuucauaucuuuuugggcaguaaacauacuggugugugugugcgcgcaugcgugcgcacacgugcacuuauaaaaacacugaauacuagaagaguugacuuauuccggauuggacauaguaaguggcugauagaagauauaagaagcacaagccuuuccaacuccuucaaaccacauauaucauuggagaaggugccaucugauucaaaaaaaugccaucuuuaagccgggcgugguggcgcacuccuuuaauccuagcacagagaaacccugucucaaaaagcaaaaaaaaaaaaaaaaaaaagccaucuuuucuccuuccuuccuuccuuccuuccuuccuuccuuccuuccuuccuuccuuccuuccuuccuuccuuuugguuuuucgagacaggguuucucuguauagcccuggcuguccuggaacucacuuuguggaccaggcuggccucgaacucagaaauccgccugccucugccucccgaaugcugggauuaaaggcgagcaccaccacugcccggcagccuuugaggucguauagccugaccccacuccccguuugcuuguacuaauuuuuguaaugcagauaaaauugaucauccagcuucccgugccuuccuaccuauugccaugucuuccccuuuaugguggauuugaucccucuggaaguauaagccaaauaaauagucucaaacuuuuuguguaaaugcuagagaugucuccaguuagcaccggcagcuuccagaggaccuggauucaagucucagcacccacauggccacucagauauacacgugacggcucacaaccauuuguagcuucaggucggggggggggcgggggggggcgaucugacucccuguaaggagggcaucaggcaggcacaugguucacagacgcaaguagacaauguacccuacaacacaaauguguauaaaugcgaugcaaaaguuuaaaauucuuuugauuuaaaagcugauucugaaauucaagugcaaaaguagaaagguaaagauuguuaauguuuucaugaagauaugucgaccuguaaagucacugaaauuaagaaaauguacagguagaaagucauagcgauaagaugguccagacauaaacucaaguguauuucacuaauaagagagguauuggaggaaagaagugaaugaugcuuaauauguauuuauauggaaaaugcaagucuaggucacucauaaaaauaaguucuaaggugacuuaagguuucaaugugaaaggcaaauauuuucaagauuuuuaaaaaacauagaggaaauaucuuuguagacaguagaggauuuauuaaaccucuagucaagccaggcggugguggcgcacgccuuuauaaucccagcacuuugaaggcagagacaggcggauuucugaguuugaggccagccuggucuacaaaguaaguuccaggacagccaggacuauacagagaaacccuaucuccaaaaaccaaaaaucaaaccaaaccaaaauaaaaacaaaaaacaaccccccaccucuagucacgaaaaaaaaccaaaccaaaacaaaagccaguagaguuaaguuagaagcacuguauaaggcaucauuaagaauaugcaaguaagccccaugcugugaagagacaguauauucaauucacuuuggagcccagcuuagucuacagagcaaguuccucgacagccagggcuaugcaaagaaacugucucaaaaagcaagcaggcaagcaaacaagcaagcaagcaagcaagcaagcaagcaagcaagcaagcaagcaagcaagcaagcaagcaaagacaaagccugaccauucuaaauaaaaagaugcagaaaaaccagguucccccuccccccuuugaagugugaaguggagcaaguccagcuuccuugcugaagaugugugagucccaucaucuccaguuccugcuuuuacuacagcaaggggcugccuacggaagcaggccaugaaaucagggcugucacacaacagaugaguaagugccgcaaacugcacgcagcucagguacacgugguaguuuauugacauucuagcugugcuggcuaguuuuugugucaauuugacacagugagggucaucugggaagaaggagucuuaauugagaaagugccuccauagaauuggcuuguugacaagucuguaggguguuuucuugauugaggauuggugugagagggcccagcuuguguguggugcaguacuggguguuguaagaaaccagacccacacauagacacacacacacgguacaaacauagacauacauaugguccagacauauauggacacaaacacauggcacacacacacacacacacacacacacacacacacacacacacacacacacauuaaaaggagggggcuggagagauggcucagugguuaagagcacuaacugaucuuccagagguccugaguucaauucccagcaaccacaugguggcuuacaaccaucuauaaugagaucuggcacccucuucugauguguaggcauacaugcauacaaaacguuaucuacacaauaaauaaaucuuaaaaaaaaaaaaaaaaaggagccaggaaugguagauagaagcuuguaaucucaucagucaaguguggggaggaagauuagaaguucaagguugucuaugguuacauaguugaauucaaagcuagccugggcuacaagagacuccugucucaaacauccuaaaacauaacaaaacagaaauguauuaaaauguccuuggagaugggggagccaaauccagggacguauucucuuagaggugucacagaaugaggcagaagcaaagucugaaggcuucugugcagacuauuggucucucuguggaagacugacuuauaaauugucucucugucuucauguccggagaaaucaugcuugcuuuggcuuggugugucaggaguucuggagucuguucugagacucucuaucuuguacccuuugguguauggagcaauauuccucugcaaucacugguaccccagggcugucaaagguauccguccccaacccacuggcaucugugacuguugugaucuucaguuuacccugaugagccuggaugggagaugaccuccagguuccagccucugagacuggaaucaccacacacuguggaccuggugucugguuauggugggauggaugacguguuuguauuuugauuuuuuuuuucuuuucuacauauguuguucuuguuuguuuuugcuuuuucagacagaaucuuauguguaguggaggguguccuugaacaccugaugccucugccuuuacuuuuccggggcugguauuacacccuugugcugcuauaccagccuuacuuuauaaguuaguuugaguuggacucaagcauucuccugccucagaccccagguagcaagggugacaggcuuacaccacugcacccagccccuugcuuaagauugagugcauugccuaagcccugcuuuagggaaucuguaaacucagaaggaauagaaagaucagaggcaacuugcugaggacacugggaggugaccagccagucccuaccgugaggcaggaaauguguuaggaucccaguggcuuccugugugauacuggggaacuuguagggauccuugggugguguccaggccuuuugcuucccuagccacuggcucugggcucugcuaugggaucagcagauuaaaaggagcuggggaguuugaggauggcaagaguaacccaggcuguacccuaagaugcuuaccucagcuaggcauuuucuccugccugagcaucuuugaggacggggcugcccugcuugguugccugguggucucaccucggacuuaauccauuuggaagacagaauaaggaugagagaggguccugagcuggcucuggacacaacuuuugcucagauauugggagaucuuugguagguuuuuugaccucugucuccuaaugaguaaaauggaauaagagucucaucauuuacuucuaacucugggacauaauggccuuaaaagagaggccucagaguaggccuuggagccacacuugacuccuggacacugcuugcuuugcacagccuuuuagauauauacguaugacuugaugcuguuugaaaauuuggagauuucaccuaaaaauggagacucaagucuucucuugaagagaagaaaucuuggggcuggagggauggcucagcugcuaaaagcacuggcugccguuccuggggaccaggguucaacucccaggacccacauggugacucacagccaucuauggcuccaauuucaggagaauccaguguccucuucugguuucugugggcaccaggacacacacacacaugucuuuacauacauucaggcaaagcacucauaccuauaaauauauuuuaaaaggaaaagcagcuaggcaugguggcacacgccuuuaaucccagcacuugggaggcagaggcauguggaucucugugaguuugaagccagucuggucuacaaagugaguccaggccacagccaggguucuguuacacagagagacccugucucaaaaaaccaaaccaaaucaacaaccaacaaacaaagcuaaagcagaaagcugugaugacaguagguucucuccuguacaaggcauaugucugaucagagaggccagugccuuugagacuggcaggcagccuccauucacucugucaauauacaggauagcucucaagacgucugcagacauaccaguucuaaagccagccagccagccccuggcugaaaguguuaagcccuaggacuuuccuuaucugugaauguggucauuuauggcacucccuucuguauguaccccuucaugucagccgccgaaacaaggaccagugcaggauguauacagugggcaacaagaguauuaagaaaauaaaauugcuggguggugguggcacacgaauuuaaucccaacacuugggaagcagaggcagguggauuucugaguucaaggcuagccuggucuacaaagugaguuccaggacagccagggcuauacagagaaaccucucucgaaaaaccaaagagagagagagagagagagagagagagagagagagagagagagagagagagagagagagagagaaagagagagagagaagaauacuagcugcucugacagauggguuugauuccuagcacccacauagcugcuuacagaacuuacuagaacuguaacucuaguucuagggggauccagugcccucuucugucucccuugggcacuaggcacacacgucguacacagagacauacaugcauacaaaauacccguacacauuuaaaaaaaaauguaaguuuaaagauugacuuuguugaaaagaauguuuguuuagugaagguccuuagcuuugcugucauugcuguaauaaugcauguagucacuuuucaggacaacagggauucaaagucugucuggacaugauaauuauucccgcucagccagguggaucggggcaugguuaauguguaugagaacgauaaguuugcuuaggaggaagagacugggucacacaguuccaucggcugcuuccacagauccccagauuccccaccgugcccccuuucugacuaaugugacuacauaguccugcaccagagcugagguuuaacaucuugggacguauaaggugcgaccaaccuugcuuacaggacagcaugacuaaugccuugccccuccuuccaguugcccuccugcuguuuugccucaccaggagaggcuucuagguaaguuuucuuuguaaaguuuaggcacaggcaagguaugcucccuuugcggucccuucucuacuugacacugaacaacuccacugagaaucaggccuagaggagacuggcuuugugucuggagugaguucacccaugcugugcacugcccgagcaggcugagaggggccccucuccuugacauucacugccacagucacagcugugugaaggacagauauuccaccaagcccaaggagucuggcgcuucacgagugcuaccugaucaggaugcucuaggcucaggcuggucuuuuuuuuuuuuuuuuuugguuuuuugagacaggguuuuacuguauaguccugacuguccuggaacucacuuuguagaccaggcuggccucaacucagaaauccaccugccucugccucccaagugcugggauuaaaggcaugcaccaccaccaccuggcugcucaggcuggucuuagccuucucccuucuuguuagacugaguggagcccagccuaaccugggcaaucgcuggggccucaauucuacauaaaguuucuuugguuggcaaucucaccacaucugacaacucgguaaagggucuuagcagauaccuuggaugcccagauacuggagaagagccuuuggagucucuucucugcaggaaauuuaagaugcucguuugguuccaagucaccuuggccuuccuggaauguucuggacccauuauacccuugcuagauuuucagccucagagcugacacccugccagucagaugacugugguucugaggaacucuuucaucgaaaucuauucuccuuuacagugauccuguagagacuucugggaguucaggggugucuaacauaccucuggaccagcuuaauguuuuuuuuuucccccugggauuuaaaccaaagagauuccagaggcugccccaauuuagcauaaaccuuugacaaucaaugccaaacuuaauccagcuccuacgucccuccccgcuccuggcuccagccuagaucuucucuagaucaugacaucucggcagcaccccaucccacacccuuuccucuuaacccucgguccuaccugagguucaugucccccuucauggccagggugaagagguuagacagguuccccccaggagagcagccgcagaugaggauggccagagccucaaugcuggucagaugaaagaccuugcccagaaggaaagcacugaggggcaugauaccguacugggccacuauggcgaugaucaccccuuugggcuuccagaagugagccuugaucuugcugaacuccauggugcagccaagcgagagcaugaugagcagcaacauaacuaccagaaugacgcugagcgcagugucuguggcccgguggccaaagccaggcggcagggagaaauugaagggggcugauacguugugcgccuccauccuccgacccagugaacaccaccucacucucugcuccugcccuuccuugcccagugcuggcuggauguuuucuucaguccucuuucaggacagaguuucuggacaaaauguagcugugggcaaauaaaagauuaugcaaccugcagaaccacgguugugguuauaagacagcccauaaccucaucuccccggauccccuacuuugcuuaaguuuucugaccucugugccugccgaguggagcucguacccagcacaggguucauucuuuacccugcugagcaugcuucacuauagcgucucugagacccauccaggaccugcaacaaaacauguccaccuuucccuuuaguuccugcuucuagcucagucucggagaccucagguuguuuccugggaaaaggugccuucccuauccucagugagucaccauuuguucccgagagaaagagacuguuucugccuuugccuuccucaucuaaguggcaaaggccagagggccaugggacaggaugggggggcgaugugguguugcugucuucaggagaggcuguguccaugacuguccuccucugagaccuugcuuugugcccauaucuagaccauacguguccuguggggguugggguugguugggggguggcaccaugaaucccugaaagacuuacuuaucuccagaggggaaaaaacuuucugggguacguugggcucuuggaagccuggagauuauccaaagcccagcucacgagaaacuccagcugugg

SEQ ID NO: 6727 - RNA, 174062 nt, Mus musculus
cgguuuccuuuuccggucugaccgcugaggaaacuguaaaagcuaugcuggggaggcagcgcggagcuugauucaccuucaccugcucuggccacccgcugacccgggguuuccggccggagagcagucagauaugaacggacggguggauuauuuagucacggaggaagagaucaaccugacgagaggaccuucggguaggcgcgggacauggagggaguaauugcugcgucccuugcuuuggcggagccggguuuaccuggcuggagagcaggcaggccccgaccgagcggcuucccagaacgcuaucgggcacggagcaaagaguccauuggcaucuuuuguuagcuagauaacggacccaaggacucugccccauaauccagucggauuaccacaggcguuuauggccaggacggguuucuugcuguugguggcaauagccaagaccaggaaaaagcccgcuguuuagccagcgugugggagccgccguauccguuauucaguugcuugcuccauccuuguuucuucgccgagggcccguucagguaaaaacaggagcagcgaacggcgguguguguguguguguguguguguguguguguguguguguguguguguguguuucugagugucucacaguuucuccggugcuagggucccugccugcauuuuugcggaaucaauuuaccauaucaacuggaaugcuaaagcgggcggagaccuuuuacagaaguuuucagaccuggccacacuugaccaccauuacuugggcguuuucguuuuuacuuuuuagcaaaauauugaaaugaaaauguuguuuucuagucucaccuuuagaaauuuggauucaguguggaucaaacaauucuugaaacaaacacuucaugugauucugacaggaaaauucccauuuagcguugcuguguggucuuccucauggaugcucauagcuggauuacuacaucgugucacugccuuccuuaggcuuugcaguuuucuuuauggccuuaacauuuuagguuuaggguucaccacuuagagccaagauuuuuuguuuuuguuuuuuguuuuaaaucuaacaucuuaccaguuuuuuguuguuguugcuuuuuuuuuuuuggcuuguuuuaauguauuggcagaauaacuuaacugauggauucuuguaguuucuuuucuguaacauggagacaguuaugaaaugaagcguuucacauauaguguuaggaugaagccacuugcucucuggaaaauauuuaggacaaugucuugauauaugguaagcaguguguauuuguuacuguugucauuagugagugaauggcuaaacugacuccaguaaguucuguuagauacuguauuccaagaguugaauaaaucauugguuacugugaauuucuauucugauggccacuacuuagcauagucuguuaacuuuccuuaucuauaaguuugcaauagcuuaaucacugcugacuauucuguguaaagcacagcuuucagaacuaaucauauauuuugucuuccuguuaugagaaaauuggaaguugaucauauuuaugggaauaacucucugcuaaucuuugugguuuauacagaagcuuugcucuggguaguucuuugggggugcugagguaacuugacagaagcuagaguuaaucugggaagacccuuaguugagaaaaaacgcccccaucagauugcuuguaggcacuccuguuggccauuucuuuuuuuaaagauuuauuuauggccgggcgugguggcgcacgccuuuaaucccagcacucgggaggcagagguaggcggauuucugaguucgaggccagccuggucuacagagugaguuccaggacagccagggcuacacagagaaacccugucuugaaaaaccaaaaaaaaaaaaaaaaaaaaagauuuauuuauuauauguaaguacacugaagcugucuucagacacuccagaagagggcgccagaucucguuacggaugguugugagccaccaugugguugcugggauuugaacuccugaccuucggaagagcagucgggugcucuuacccacugagccaucucaccagcccccuguuggccguuucuuaaguugaugauggagaugggagagcccagcucacugugggcagugcuaccauggggcagguaggugguccuggauuguacgaaagcaggcugaguaagucauuaggagcaagccaauaaguagugcgguuucaguuugugucuccaggccuguguugacuucucuucaugauggucuguuuaggauucaguaacuccuuucaucccuucaugcuuguaucaugguguuuuuuuucauagcaguagaaaccuaaacuaaacucagaaacuuuugcccaaggcuuuucaauaugcccaaguuucuugaaucuaauuuucuuauuuuauuuaauucuucaauccaacuuugagauuaacguaguagagauggauuuuuauuacauuugugugucuauguguuuuuguuuguuuguuuguuggggaaggggcccguagaggucagaggacaacuuucaggagucaguuuucuccuccuaucauguggguuccagggauugaacucagguugucagacuuaauggcaaauacuuccuacccgcugaguuaucucacccagcagucucagaucuguaaauaaaagucuguuuuuuuuuaauguguuuuuuaaccuuuugcuaaugaacccauaggaucaaugagauacacauuucugauucccuuugcaaaugcauuaaggcaucuaguucuuuaaccuaaauaaccuaccaugauacuacuuuuugugauguuugagauugucuucuugccacauagcaagaacccaauauacuuggauauagagucuuagcugugguaucacaguauuaccaggucuucugacaagagcagacuucugauauuaaucacaguauuaccaggucuucugacaagagcagacuucugauauuauucuugcuuuaagcauaaaauuugacauaauaucauuguuuaaacuuuugggcauuugaauaggcauugucuaauuucuaagcauugaacuuacagaucuaaaguuucuagucuuaguauuuuccuucaaagauuagagcagggaaaagcuucaaaagacuaaauaagaggaauacuuauagcuaguuaacauauuuuuacacaaaaggguuuauuuuugaauuguauaguuauuuguuuaaaaauaaaguuccauugagugguuucuggacuuuuuauaaaauauuuuaaaauauuagucauugucauuagucaggauucucuagaggaauuaagucaauagaaugaauaucuguaucaaaagggaauuuguuagauuagcuuacaugauaaagucugagaaguccagcaauggcuauuugcacagugaaggcugagagccugguagcugcucagcagacccaacuuggugcugacaaucuggaggaugccuugagaguuacuggccuuuaguccauauuggaaucccagugaugaaugguucugauagcagggcagaaauguggcaacagcaggagcagcagcaacaggguagacuuacgcacucacuaacagggugauuaaacucaucagggaagugugaaggaaguacagcuuuaaaaagcaagcuuuuucccuugaacugccuaucugguugacacuggaaaguacugucuacaauuuagggugagucuuuccauuucagauaaccucaucaagaaaauccuuuauauuuuguucauggcuaaucucuuaguugauuccagauccagucaaacugaaaacuaagauuaaccauuacagugauguaaaucauugaacuugcugggaaaaaguaauuacaaauuuaggauuaaauuugguaaaaaaaaaaaaaucguuggaaguuuguugguucaguaaacaaggaaagguuucaaguuccugcuuaucacuuccucauuccuggucuguggcaccguuggucucagaaucuucauggagaugucauggagagacacagggaauaagucaggaauuaccacugacaacuucuagguaauuuugauagugucauaggagucuuucuuucuaaaggagcaauauaagaagccucugauucggaguguacaauacuguuugcaagcagcacugucugguuugacggggugaauguguguaugauuacuaucugugccaguauuguaucagacaagaaucuuggauauuuacaguuuaguaaggcaaaugaacugaaaacaaauaagcccacaaucauaggaaagucacaacaaugaaaugagugacuaaggggugaaaaggaaaugguauguagcuuggccuuugcccugugcuugcuuccucgcccuaguaaggaaaaucucggcggccuuugauuucagaagacuguuuugcuuuuguucuugggcucauuacuuauguuauuuuaaauaauuucuaucauuaaaaaaggauuuaaaaaaauuauccauaugaguguuuugucugcauuugaauguguaauauguguaccugguauuuacagaagccagaagacugcuaaggaccccggaacugguugugagccauaagguggguacugggaaaugaacccaguccugcgcaagggcagcaaaugcccuuaacugcugagcuaucucucugguccccagguuuuugacaauuuuugauuagcugguaaucuaaugguccauuuuuuauccucuagaacaagacuuggagggucucacuuugucucauaucagauuuagagaucuuaaaguugugaagacucacuauucugaacacuaugacaagaccaauuuagcuuuuauucucuguaccagagauugaacaacugaguauucuuaggguuccaguauccaaauauaagggcucaauggguuuuagcaaucugccaucuucagagaggaaagaagaaauacccauaucuuuauugucuguagaggcccuuuaaaggaagggauaguuagcacaaugcuuucauaaagaguaauuaaggaaguaucuuucuggaaguguacuaauauauauuuuauacucauuuuuuauguuuuguuuaggcuaaaugaguaucuguuuauagucacauaggcuuauuuagaucuuauagaauucuuuuuuuuuuuuugguuuuucaagacaggguuucucuguguagcccuggcuguccuggaacucacuuuguagaccaggcugaccuugaacucagaaauccgcuugccucugccuccugagugaugaccuuauagaacucuuaaauaguagguguuuaauccacauuauuagauugggaaguugucugaaggagauuaaagacuugcucaaggucuaaggccagcaagaguccuaagagucuacuccaggucuguugauucuacuguacuacauguuuucucccaccacaguaccuaugaguuugacuguuaaccuuuuccuuaacuuucuuuuuuguuuuuguuguuauagcauaccuauuccuuagagggauuuaaugcauguaaaaagauguaaaaaugggcuggagagauggcuuaguggcuaagagcacugacuguucuuccagagguccugaguuuaguucccagcagccauaugguggcucacaacagucucuaaugggauccgaugcccucuucuggugugucugaagagagcaacaguguacucacauauauacaauaaauaaaauuuaaaaaaugcuuaaaaaagcuguaaaaauugcauuguggaaaguuuuuaggugggcaugucaaggugagaaccugagacugcacacucgucugagcauuuaguuuucaguccugugcuucccacuuaacugcagaugcugcuaacaguuuucugacuuauuccuuccugcaccuauuaaauagacuggagacuauagugcucugccuuugcucuguuuucucuggcugcaggaaauccagcccuuuauggaauuuguaguacaauagagacauguagucacaugcaaaggguuaaaucugauuacguagguucacgugguuaaggacugugaguguauccauguagcaggaaggaaaaggaagagggcuucaugaaagagcaugcuagucugacccaguauuaguugugacaaauaacugacaaaaacaauuuaggggagaguuuauaguuugagggcaaccuccaucauggcaggaaagacucagcaacuggaacgugagggucuggucacguugcccugcacaguuuggagcagagagaugggugcugauguuccacucauuucccguuuuuauccagccuaggucccagaccauagaacaccuccauucaggauaaagucuuccuuucuguuaagguuuccaagaacacacucauaaauaugaccagaaguuugcuucuguuucuaggugauuuaaaauaaauuggcaauaaagauaaaccaucccagacuccauccuggaaaaggucaaaggaagagggccuuuuugauaagcuuaaagaggcuuuauagaaaggacagguuuuagugcaggauuauggguaaaaagagccuuagccauaauaauaauaagaauauuaggaaaaaaauguauuucuagaucagugaauaaaucagucuggguauaggaguaguuuaguuuaggagauucaagagagaaaucacccagguaagcagagaucgaauuuuugagacuauucaguauaaaugugaaaucaaucuuucuaagauuccaucuuaaugccucuuccuaucauuggucaagacgcaggcuaagaacccucuccucugaagucgucuuuuuuuuucguaauauuuuuucuuuuuucuuauuuauuaauuuauuuuauuagauauuuucuuuauauacauuucaaaugcuaucccgaaaguucccuauacccuccccccccugcuccccuccccacccacucccgcuucuuggcccuggcauuccccuguacaggggcauauaguuuguaagaccaaggagccucucuucccagugauggcugacuaagccaucuucugcuacauaugcagcuagagacaugagcucugggguacugguuaguucauauuguuguuccaccuauagaguugcagaccccuucagcuccuugggugcuuucucuagcuucuccauuggggccccugugcuccaucuuauagaugacugugagcauccacuucuguauuugccaggcacuggcauagccucauaugaggcagcuauaacagggucccuucagcaaacucuuucuggcauaugcaauagugucuggguuugguggcugauuaugggaugaauccccgggugggguagucucuggauaguccauccuuuugucuuagcuccaaacuuugucucuguaacuccuuucauggguauuuugucccuauucuaaacaggaaugaaguauccacccauuggucuucccucuucuugauuuucuuguguuuugcaaauuguaucuuggguauucuaaauuugugggcuaauacccaccuaucagugagugcauaucaagugacuucuugugugauuggguuaccucacuaaggaugauauccuccagauacauccauuugccuaagaauuucauaauuucauuguuuuuaauagcugaguaguaauccauuguguaaauguaccacauuuucuguauccauucuucuguugagggacaucuggguucuuuccagcuucuggcuauuauaaauaaggcugcuaugaacauaguggaacauguguucuuauuaccaguuggaacuucuucuggguauaugcccaggagagguauugcuggaucuuccuguaguauuaugucuaauuuucucaggaaccuccagacugacuuccaaagugguuguacaagcuugcaaucccaccaccaguggaggaguguuccucuuucuccacauccucgccagcaucugcugucaccugaauuuuugaucuuagccauccugacugguaugagguggaaucucaagauuguuuugauuuguauuucucugaugauuaaggauguugaacauuuuuuuagguguuucucagccauucgguauuucucaguugagaauucuuuguuuaacucugaaccccuuuuuuuuucauauuuuuuuauuggguauuuguuucauuuacauuuccaaugcuaucccaaaagucccccacaggcucccccacccacuccccuacccacccacccacuucuuggcccuggcguuccccuguacugaggcauauaagguuugcacgaccaaugggccucucuuuccacugauggccgacuaggccaucuucugauucauaugcagcuagagacacgagcuuggggggggggaggcuugggggggaucccuucagcuccuuggguacuuucucuagcuccuccauugggggcccugugauccauccaauagcugacugugagcauccacuucuguguuugccaggcccggcauagucucacaagagacagccauaucuggguccuuuuagcaaacucuugcuaguguaugcaauggugucagcguuuggaagcugauuaugggauggauccccggauauggaaguuuccagaugguccaucuuuucgucucagcuucaaacuuugucucuguaacuccuuccauggguguuuuguucccaauucuaagaagggguaaaguguccacacuuuggucuucguccuucuugaguuucaugaguuuagcaauuguaucuuauaucuuggguauucuaaauuucugggcuauauccacuuaucagugaguauauauugugugaguucuuuugugauuggguuaccucacucaggaugaugcccuccagguccauccauuugccuaggaauuucauaaauucauuuuuuuuuuuuuugguuuuuugagacaggguuucucuguauagcucuggcuguccuggaacucacuuuguagaccaggcuggccucaaacucagaaaucugccugccucugccucccgagugcugggauuaaaggugugugccaccaugcccggcaaauucauucuuuuuuuuuuuuuuuuuuuuuuuuuuugaaaaaaaugaaacuuuauuuuuaaauuaguuaagaauaauauuaaagacagaauucauuuggaaaauguuaaaccauuuuuuacccuaggagaaaccaaagacuaugguuucacuaaagaagcauagcaauuaagugacuccuaaaaccacucugcuguacccauagaucagcauuuuucucagccaucaucagagaagcuuccuccuauaguagaugggaagaaauacagaaacccacagcuaaagaaugcagagagugagagaucuuggagcauuccauuguaaaugggaggucccuaucgaucuccuucucucagggccagggaauucuacacaggaggagccaggaagaguguaagagucagugcaaauggagaacaccaaggaagcaggaccuuccacacacaugaacucacaggggccgugaaaugugcacaaguccaagccagauggaaugccagcacugagaggggaaaugaacaaaagccccaucccuaaccaagaagcuaucuccaauugauaacccucauaaaggaaaaauucauuuucuccaaccaagucuugcugggcauacaaacaaaauuuaggggccccacaguagaugaccgacccaaacaaacucaauaguacuuuugaaguguuugguuugauuugguuuagguuggguugguuuguugguugguugguugguuuuucuuuuucuuuucucuucuugucuuuucuuccuuccuuucuuucuuucuuucuuucuuucuuucuuucuuucuuucuuucuuucuuucuuucuuuuuuuuuuuucccccauacuuauagauuuauuagauaauuucuuuuuuuuuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggauguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcucugaacauaguggagcauguguccuucuuacugguuggaacaucugaaccccauuuuuaaugggguuguuugguuuucuggaguccaacuucaugaguucuuuauauauauuggauauuacuccccuaucagauuuaggauugguaaaaauccuuucccaaucuguugguggccuuuuugucuuauugacagugucuuuugccuuacagaagcuuugcaauuuuaugagguuccauuugucaauucuugaucuuacagugcaagccauugcuguucuguuuaggaauuuucccccugugcccauaucuucgaggcuuucccccacuuucuccucuauuaauuucagugucucuggucuuauguggaggucuuugauucacuuagacuugagcuuuguacaaggagauaagaauggaucaauucgcauucuucuacaugauaaccgccaguugugcccacaccauuuguugaaaauguuguguuuuuuccacuggaugguuuuagcucccuugucaaagaucuagugacaauuugcaaauucaucuggaaaaauaaaaaaccuagaaucuagcuguguggauucauuucugggucuucaauucuauuccauugaucuaccugucuguuaccguaccaguacuaugcaguuuuuaucacaauugcucuguaguacagcuuaaugucaggcauggugauuccaccagagguucuuuuauuguugagaauaguuuuugcuauucuagguuuuuuauuucuccagaugaauuugcaaauuguccuuucuaucuuagugaagaauugaauuggaauuuugauggggauugcauugaaucuguagauugcuuucggcaggauagccauuuuuacuauauuaauccugccaauccaugagcaugggagaucuuuccauuuucugagaucuucuucaauuucuuucuucagagacuugaaguucuuaucauacagaucuuucacuuccuaaguuagagucacaccaagguauuuuauuagauauuuauuuuuuauuuacauuucaaauguuauccccuuuccugguuuccccuccgaaaacucccugacaucucuccccuuccccuccucaccaacccacccaauccugcuuccuggcauccccuacacuggggcuuagagucucugaagucuucuuacucagucuagaagucaccuuauuaucaauauugcauaagauugccuuucauguauugccaaaggaacaggcagaauagguauugugggccaguggacggugccacaagacagaaaaacugguaaauucaagcagauuaagugaccuggacaauucucauaauugaaaauuguaggcauuuaaauuugcucccaaccagguuccuguccagaagcaugugaccaugacacccuacuaagaaggccaugacaacuggucuuguagcauagaaacccagcguuuuccguacuaaugacauaucuagauaggccccaggguuuagccauuaaguuucccuucccaggcauuccuuccuacaaaagguauuuaaucucuauuuuacccuguaagucguaugcauccuuauccgcuaugaauaaacaguuuggacaagcaaggacugucuccuucaucaggggagccuucaucguacaggaccucaccuaagauucagcagaagggcccuccccacuccuggcacucacccugagcuaagccagauucccaccuccucaugcccccucgucuccggccucccccacccccucauucccagcagcagagucuggaugcacaggaguuugagaaccacagccucugucucaaucccugcuguuuaucaccuggagaaacauggacugggaccccuaucguaggcugcguuuugccuuccuugagcagcaugugggcaucccgagagccugccagcccaguggcuagaaaggaacauagccuagagccccuguguuuugcuuccccaaguggcaucuaggcggcuuuaagacaccccagcugcaaagcgaaacacagacccacugguuuccauuuuacaaaugaggaaaccuuggauucuauugucacauagcuuucuggggcagauuugggauauggacuuuguaacauuaaaaucuaaacuaaauacuguagguuucgccauuauuauuugcuguuuuacuugugucuugucuuuauacuuugaagcauucucucucucucucucacacucucucucucucuuuaaagaacauauauuacacuggauauggaaguguauuccuuuagucccugcaccugggugccggcaggcagauuucugugaguucaaauccagcuuggucuucauagugaauuucagucuaguuagggcaauguacugagaccuugucuaaacagcacaauuguuagaaaaugaacauguacuuaauuucuuuuuuuccuagugcuuucuuuaguucauuauacaaaguggucaccagucugauagauauagaauauuacaaugggaugcuuuuaagagaauuaguaaugugugcuauuuaagcuuucaaagucauaaaccacaguccucacuagauauaaucuaguuggacuuaaguuguuguuauaaggcuaggaaacaguuaagauguuuuaaacaagaggaaggaauaacuagagagcccugcaaagaaagaaaaauauaugguuaugucuuuugagauuauguuaaggaucaauuuuaagaaacaauucuugaaaaaauguuaaaguauauuggcauuauuugggguaaacuggaaagcaagucaguugaugcuaaacuauagaaacauuugacuaagcagaaaaguggcuagugauuauauuugauuaaaugcaauaucaaagggaagauacucuuaauaugcuuagaugauaggaucaggauuguugcuuuuauaggauuaaaaaauaaagggaaaccauauucauuauguaucuacauuauaauuaggaauugcagacauuauaauaaagaacaagaagucaucucugguucuaauaguuuugcagcacuaaaggagacuguguuagcuuucuauaacugucauaaaaauuucugauauaauuuacauggaagguucauuuuagcuuacgguuuuacagguuucagucuugguuuguugguucuguugcuuucugucuuaagguauauaaauauguaagaaaguuguucauuucaaaggaguccacauaucuccuugaaaggguauuccccuuuagugacauaacuuuaucacuagguuccaccucucuaccacuucgcauuaauggcacagucuggaaacuaaguaaguaguauuugaauccuuggggaaaaacauaccuagagcaugagggagaguaguggugggcaugugcuaaaaguauccuaauaaggaaaguaacccaagagcuuagagccuucauaagagauacucuguuucuuacagauucagauucagugcuauacugcaagggagaaaacaaaaauguaaaauccaaguuuucccucccugccccaggcucccggaauaacaacucugagacucaaaauacaccuuggccauagcuuuggcuguuccccaacuagcuuacaaguuaaucaucccauuauucgauuuuaaguucugccauguaguugguuaccucugcucagcuaccugcuucugucuuucucccuguuccagggcuaaauccacugcuccuggcucugucccagaauuucaucucccuacccaugucucaccuuguauuuccugccuaagccuauaggccaaucagcauuuuauugucaggugugcugcauacauagaggacacaagagauuuuucuguacacaguaaacuauaaaaugccuguagcagcaaguguuuuggaaauaaguuagauaaugucauucuccccuuguaucacaaacuauaguuccaugccuacuacauauaaaguuuauuauauguugaguaagaaacagaaaaauugaaaagagggcaguuauacaauuaaagaaaaaaaagaaagaaagaaagaaaaaaggccaugauuuugagaguuagugauggguguuagagggaggaagggaaaagagggugugauuauauuuuaauuucaaaaauauuuaaaaaguuuaaaaagguagucauagugaaaagaauccagauuguaauaugaggcaaaacuaaagaaaguaaaucauuucauuguggaaaauaagagaggcaggggaagcgugaucuaauaccugaaaggcacauagauagucagugucugggcaguugcuuauuacagaauaagagaauagcauguuuacuuagauauuuggaagacagguuuucagagccacgaaaagaguuuguacugcauguuugggaagaugguaccuugaaacaucuuugcuaggguguacauuuugucagcucaucagauaagauaaggaaguuguguguaaugcuuuuuaguuguggcaucauuuuucuguuuucugaaguaaaguggauucauuagucaaaauaaguaacaaacaagaaagauuuuauauugggaacagagaauuucuugaaauaauauaguaguuuggauuuaagaugccuuaauuaaguuaacucccugaguucauaugaaauaccaguuuauucuuuucaauucauauauauuuauuuauugagcaauuacuguggggauagguuucugaacuagucacagagaauugaguuucaauauaaauucacaguguuuaagaaucagaaugggucuucaguacucucauuuaugugucccaccgucaaucuuaacaguaauuauuaauauguauuaauuacuguuaauuaaucuguauuaaucuguacuaucauuuugcucccaacaaaguuaucuugcuccuuugggggcggaggggagagucagaaugagugaauacagauccuaacuuuucuauauaauaauaugauggugcaagucauuccccuuuguaugccuguuucuuugguuacagaaauaaaaguauuagaacuuacugauacacuugugaaaguauauauacaguauauacuuucauuuguuuuauagcuuuauaauguuaauucuaguccagauacuucuuagcucuuuaaggugcuuuaguggugccugaccuuauaacuguccugccuggaauagacauuaguggggcaauagcuggugccauguaccccaagaaaugaggccucaagcacuggaaacagagaaggggaguagaauucagaagauccugagagguuccauggguguggcuucccugucaugauuagaagaugcaacuucacagcagacauacugguucucugccucuuacaguuuuuaugccccuucuuuugaaauguuuacugagacuuaguuguaaguguugguugcagauguaucaauaggggcuaggcauagccucuauuuuucucugcauuuuaaucagugaaaaugccaguguggauuggggaaaucucauggagcuccaccccuaccugaagagcuacaggcaauuugaucaguacugagagagggaaaauuagucuuucccagggaugagcuucaugauugguuaucgaauaccaaguggugagcccuagaagcauuauacaugcagucaacacugaauggacucagcaagcuguauuugcuaguuuauauuguauauguaauaacagugguuaaagaagaggaggucacauggauuucagagggagugagguagaggccacaugggauggguguaagggaggaaaaggaggaggaaaugaugugauuaugguuuaauaaaauaaaaauagucacccauuaaauacugaguacuauuucauguuugguaauaagauuaaaugauauagcaugcaugugaaauguaaagcauauuauuuagcacauauuaagcagucaauaaauauaaacgguuauugcuauugcucuuaaugguaaacuggauucagaccuagagucaggaggcagacagaagaagguaugucuuguuuagcuuuacaagucucuucaauuggacauacuuuauuucucuuucucuccauacugaugucauccuuuuuuuuaaagagucuuauuuauuucuaauguguacaaguguuugcuugcauguuuuuauguucaucauauagaugccugaugccccuggaggccagaagagggagucauugucuuuuaaacuauaucauauauauacacacacauauauacacauauauauaugugugugugugaauauguauauguauauaauauauaaugauauuuuauauuuauauuuuacauguuugcucauguaagauaaagacuaaacaacuuacuuuauuuuugccaugucuuaaaauuuauuagcacauuaaaacuagaauucacaaugcaacguuucuucauuuuuugaagaaaaccaguugagucucacuuugcccuuaaccuauuugagacccuaugugcugagacugaauuaauuacacccuucagcuucagaggauaauuguguugucaguauguccuuuucugguguucuuuuuuuuuuccauauuuucuuuuuuuuauuagauauuuucuuuauuuacauuucaacugcuauccccaaagcccccuauacccuccccccuguuccucaacccacccacucucgcuucuuggcccuggcauuccccuauacuggggcauaugaucuuugcaaaaccaagggccucuccucccauugauggccgacuaggccaucuucugcuauauaaugcagcuagagacacagcccugggggggggggguggugguacugguuaguucugguguuauucuuacacucuguguaaaugauacaauguauccucucauagcuauucacugcaauguaucuuuacacauccuuaaauaugcaugccuuuuuguaaauagauaauaaaauuuugucuguguauguguucuuauuuaucagaagguuuuguacuaugaauaacauuucagaauucuacccauguuacuuuguacauguuuauuaaaugauucuaauuuuuaacuuuuaaucuauucucuaaccuagauaauucuuacuuccaugcuauuguguguugcacugaauauauucuuguauuauuuuucauagaugggaugaucacauuugcccuaauuaggauguuuuugaaauuaaaaaguguaucuuaauaauacuaaggcaguaggugcauaucuagauucccaacacaccagaauaugugccugcucugcuuagaaaagauuuuucugguguguauucugguauauaacagcuguuagcugauacagacuagauuuuuuuuuuuuuuuuuuuuuuuuuuuuuuuuuuuugguuuuucgagacaggguuucucuguauagcccuggcuguccuggaacucacuuuguagaccaugcuggccuugaacucagaaauccaccugucucucccucccacgugcugggauuaaagguaugugccaccacugcccggcaauaauauauuaaucuauccucucuaguuguuuuuagcugauaccuguucuaguuaauugguacaugugcuggaaaauuacuguagauuuuaaauguuacccaugcuaaaaguuuaucuuuuaaguguaucuuauuuguguguguguguguuuugucugaauguauguauuuauguacaacacaugcuagccugaugccuucagaggucagaaggcuucuggaacuggaguuaugaaucaaacccagguccacuggaaaaguagccagucuuguucauuuaacucagagccaucucuccagcuacucuaaguuaaauuagcucugaaggggaugucuaggaaaucaaugacaagcauacuuaauuucagagaauuuaaaauguaauugagccuuuuguauuuguagguagguagauuuuuuuuaacuccuuuuuuucucauuuuuaaaagaauuuucaugacuacaucauauauucuuccuugccccaucagacuuuuaauuggaaauuaaacagucgcuaguuccuugacaggaacuccuagugcuuugucccaauguaacaguuacuauguuuuacaaagacauuuuucagauuuuguuacaagagucuaacaguuaccuuugagagagagagagagagaggguagaauuuguaacccuuauuuuccagaaaagaaaggugauuaucagauuuccaaacucauuugcuucauuccucaucugguaaguuauggaguugaacuuaaaaccaaucugacuuaugaaauaucaaaaagagacagaaagaauauguuuguuggugguuaaagucagaacugaacaguuuaguacagguuagcuuuuugucuucaucaggacauaacaguugccugacuacuaguaaaucgucagugauuuuuauugaacaaauggauuaggaaauauauauguauauguuuaugcauauguuuauguauauguauacacacacauauacacacacauaauuuaaaacaugguuaaguuuuuaucuguuuauugguagugcuggguauuacccagcaugcuagcuagguaaaugcuauauugcuaagcuauuucucuagccccaaguacaaacuguaaugucacuacucacugcugugguaacugucauucauucuaguaaaguuuuaagguauagauaaguucauuuuguaaauaugguugaaaggcuaagaguucuuauuucaagugguuugguucacugacaacagaaauaccaauguguuaaauaaauguaccucuaugaugugguauuaggggugaauaaaagacgguacuuucaaauaauagaucucagguuuuuuuguacaacuuuuuaaaugcuguucuagaguuuuaaauaaccuguaacaaagucccucuauguaaucacuguuucauuuggcuccuuaacaccugauuccucauuuccaagcucuucaaagacaguagcuauuucaugagagacucauaccauagugaagauguuaaauuucacugcaagaguuuucucugguuugucucagcauugagagaacugaucggccucagcccccuuguucaaaccugccacuauuuuuaagucuaaauuuucaaagccuuccaugaucugguuucugcuauuuugccaguccccuccacauuuaaacuacaaucauguauaauuuaaauuuggauguuauaaaaaaaaugaauaaguaauuuagaguucagguuuuuccuauucuacucuucaggguuaugaaaauagucuucuagaaguaauuuuuuccuguuguguguccuaaguccccaaauaaacacaaaguuaacuugguggcaaagacuuauguacaagguaugcuauuuagaucacaaacuuucugauacuuccucuuugguucugucccucauuacauuguggauuauuugguaugcugugcuaguacuuugagucuuagcuuuguucuacccuucagagaacuuagaaagcccacauguuagugauacguuucuacugagaucauuaggggagccaugacuggcuuccccuuccuguugcaccaauacuuagucuuuuaaauuaaucccaccugucuuucuucucuuuguacugugucccugaauuaugccuauaguuacagaaagaagagauuacuuucuuuguuuucuuauuucuucucuuucccuuucucuuucacccuuucccuuuuucuucuuuaccuaaguuuaaaaacaauuuauucaagaaaaucaaaugauuuuuguagacaaaauacuugcuacaacuuagugguuggaucaugaaaauuuaaucagccaggcgugguggcgcacgccuuugaucccagcacucaggaggcagaggcagguggaucucugaguucgaggccagccuggucuacaaagugaguuccaggacagccagggcuauacagagaaacccugucucgaaaaaccaaaggggaaaaaaaaucaauuagccagcuaacuuguuugcuugcuauauuuuauuauaauaaguauacuuaugucuaccauauuaaccaauuugaaaguauaccauauuauacuuauuaauauaacuggguagacacagucuuguacagcagauuucuagaaccuuucuccuguaacugaaauuuuuacucaugucaacuaaugaaacucguagaaacuaagaauagaauggagggucccagggacuaggaggaggggaguacucagccacuaaucagugagcaauuaguuuucuauagugaguaaacuuggccaucacuguguguagguauguggucaauuguacuugacauagaaagagaagagugaguuuggugacuugguucuccuguaaaguagcaguugcuuuucuaguucugagguuuccucuaacaaccauaucacuacccuccuaccccaguauaaaauagaaagagauaaacuuccaagacugcuucuuccaaaacacugacauaugcaaaugaucccaauauugaaacacagaagaaacauguggagagacuucaguuaagaauggcgcaugccuuuaaucccagcacuccagaggcagaggcaggcggauuucugaguuccaggccagccuggucuacaaagugaguuccaggacagccaggacuacacagagaaucccugucucgaaaaaaccaaaaaaaaaaaaaaaaaaaaaaaaaaaaaaaaaaaaaaacccaaaaaaaaaaaaaaaagaagaagaagaacauauuauuuaauaguuuaaaacaaaccuacuuuucaugagcacagcuagcccuguuacauuaauacaggaauaccagaauuuggguccucugaauaucaccaacaggaucaaaaucaagugugggcagaagcacuuauaucaagacucaaccauacuauuucccauguuauauauauguacauauauauuuauauuucaucuagccagucauuuugaucacaguugugaucacaguaccuguaguacugccugguucgaauuagcaaucuagguacuuuugaacuuuguucauaaugacuuauugacuuugcccaugacuguguuuuagcuuaccucacagucugaauuauuagucucucuuccccacuagaccauuugccucuccuuucuucuccucuaaucuuucuuucuucuucgucccucucuccucacucuuccaugauuuucucagggcugggcuucaacaucgucggugggacagaucaacaguaugucuccaacgacaguggcaucuacgucagccguaucaaagaggauggggcugcggcccaggaugggcggcuccaggagggugauaagauccucucggugagaaauggcuucggcuuucuuugcuauacuuugcucccuagaccacaucugauuccaucuuggccugccuguuuggaaaugaaaauauuuagaguguaucauugaauaggaagaacauugaucagucuuccaacuuuaccgcugggaugggaggauaguauuauucuuguuugacagacaaggcaaauuuaacauaaaaugugaaguuacuugccccaguucaaaaaacacaaagcagguagaaagaaaggacugguuuggaggaaggagacuuaagauccacacuuuucaacuuucucuugauaacuuuaucacuucucuuuuguugacuaaaaaacugaauugugccuuuucuugggagacugucaguccuuaauaauggucuuaacuuuaaaaagcaagguaaggauuaaguuucuucuuuaaauuuagggcccuuccuuacccauuauuaagaugaaaaaaaaugaaguacaguuuggauaucugucaauugugcucccauuuuauccuguuaauguuucuuauuauauaguaaucaugaaucuuauuuuuauauacucaaagauaggaauuaaauuuuuuuuuuuugguuuccauaucucaguacaguacucaacauaggcuuaacaaaugaccaaaucagaaaauucauuuaaaauagaaagguugacuaacaaauacagucauaugggcucacugacccuuuaaauuuuuuauuauuuuaacuguguguguguguguguguguguguguguguguguauguguguagggugaaauguacacaugagugcuggugccauggaagccagaggcauggaauccuccuggaguaagaguuauaggagauuaugaacugcccuaugugauugcuggaaacugaacggagguccucaggaagaacgguguaugcuuuuaacaacugagccaucucuucagcuccagacccuuagucuuagaaucaauugaauauuccuaaaguaaauaaaaauucagguauaauaagacuuuuaaaacucuuauguguggcuguauuuuuuuauuucuguucuaccucacuggcuacagugucauuuauuauaccgucaauuuugagcauugggaaugcuuagaccaugcuauaaaaucuuaaaaauucauuuuuuuaauguugcuguagcucagcuuauuuguaugaaaauaacauacacauugguauaaagaaugggaaaguacugagacugugaauuauuaucuaggauuuaggccugcuucuaagggcugugcucaaauuaaaagaaauuugaagaaggaugggacuucucgcuacagaagugcuuccuguuuccacaugugccuuggauuguggcccaaggucuaagaaaaaacaauuauuuccuacuuugucuuaugaacugaauagagcaagagagccaaacugguaaaaggcugaaguaagugaaugaagcauagaccaagacaggauuugauuaaaaauuaaggauuaugucagauacuugauuuagaacuuccacaaacuaggacuauuaaagauuuuauuuaguguauggauguauguauaucauguaucuggacuugguaucugcaggaggccaaaugaguacuucuuaaccccuggaacugggguuacagaugguuguaagcugccauggugcugggaacugaacccagguccucuagaagagaagcagugcucuuggccaaacagucaugucaccagccccauaagcagguccuucaacaauuuugcagaagaagaaggagagcagccauguacauacauuguuuucuauguagagaacagugguuuuaguucagaaggaccaucaaaagauuauaaucaagagaagaaagugacugaguucuguaaaauauaguguguggguuauucuugauaaauaaaaauagauuuaaguggggauuaggaaacagcagugagagaacauucacagaugaggaagaagaugaaaaagaaagagugagcugcuuucaggauucucacaaaggaugaagcagaagaaccuacugaggugacucagguuaggauaaugaagaagguauguaacagauacuaugaauauuuguuagugaguuugcuuggugaauagaaggguuuuaaggauagcagcuaacuuggaucucuguacagaauguggccaugcuuuucuccagggauauucaacucaauaauggcaaggaaaguagggcaguguguuccuggacuaugugucagguacugggacaaaugauuacaauaauuuacaaagugcuuuuuugaaauuauagccaaaauccuagaugaguaaaaugcaaguaaaaugugaagaugauaaagacaaaaaucuaaugaaggacugaaggacugaaagugugaagggcagaaguugaggguagguuuuuuagaguuugcuauaugucuaguaugucuaaauguuaaugucugaguuuaaucuuaguugauaacuagagaaauuaugauuauugaaaauauccagccugucggugggugccagcacccacaaacucggcggacagucccauggucccuagaggacucucugcuccccaggugcucuagcacgcccaggauguuaggaucacuggugagcagaacacaucaucaguuccuacaccaccugagugacugggagcagcaggagccagagaugcaggagcccugcccgaucagugguucagguuccuuccagucgcuggucuaccuugguugcgaacucagcagacagucccauggcccccagaggagguaccacucccaggaacucuuaacaugcccaggauuuuaggaucccaagaucccagaaucccaggagcuuggucacucuuggaucucagggucucagaagaagcuugacucccaggaacucugacacacccagaaucucaggauuacaggaucauggaaucacaggauuacagagaaagcuggacucugaggaguucugacucaaccgggauugcaggaaggacaggguccaaucagauauagcgagggcagggagcacuugagauaaucagauggcgggaggcaaguguaagaacagaggcaacagaaaucaagguuacuuggcaucaucacaaccaaauucuuccaccauagcaaguccuggauacacacaccaucaugccagaaaagcaagacauggauuuaaagucacuccucaugaugaugauggaggacuuuaagaaggacauaaauauucccuuaaagaaauacaggagaacacauguaaacagguagaagcccuuaaaagagaaaagguaaaaaucccuuaaagaauuacaggaaaacacauccaaacaggugaaggaauugaacaaaaccauccaggaucuaaaaauggaaguagaaacaaauaaaucacaaagggagacaaccuuggagauagaaaaccuaggaaagaagucaggagccauagaugcaaauaccaccaacagaauacaagagauagaagagagaaucucaggugcagaagauaccauagaaaacauugacacaacaaucaaagaaaaugagaaaugcaaaaagauccuaacccaaaacauccaggaaaucuagacaaacugagaagaccaaaccuaaggauaauagguacagaagaccgugaagauuuucaaccuaaagggcuaguaaauguuuucaacaaaaugauaaaagaaaacauccccaaucuaaaguguaacaaggacacaggcuccacuauguucauagccuuauuuacaauagcgaggagcuggaaagaacccagaugucccucaacagaugaguggauacagaaaauguaguucauucacacaguggaguacuauuaaguuauuaaaaauaaugaauaugaaauucuuaagcauggaucuagaggauaucauccugagugagguaacccaaccacaaaagaacacacaugauaugcacucacugauaagugaauauuagccuagaagcucagaauauucaaaauacaauucacaaaccacaugaaacuuaagaagaaggaagaccaaaguguggauacuucgauucuucuuagaagggggaacaaaauauccauggaaggaguuacagagacaaaguaugaaguagagacuaaagaaaugaccauccacaaagugccccacuuggcgauccauuccauauacaauugccaaacccagacacuguuguggauaccaagugcuugcugacaggagcaugauacagcucucuccugguaggcucugccagugccugacaaauacagaaguggaugcucacagccauccauuggacugaguacaggguccccaaugaagcagcuagagaaaggaccuaaggagcugaaaggguuugcagcccccuaggaggaacaacaauaugaacuagccaguaaccccagaacucucaggcacuaaaccaccaaccaaagaguacacauugugggacucaugguuccaacugcauauguagcagaggauggccuagucagacagcauugggaggagaagcccuugguccugugaaggcuuuauucuccaaagugggggaaugccagggccaggaagcaggaguggguagguuggugagcaggagaauggggucagggagagauaaggguaguguguuuuucggaggggaaaccaggaacagggauaacauuugaaauguaaauaaaauauccgauucaaaaaauaaaauaaaauaaaaguauugguaguuccacuuaucaaagauacuagcaggacucaugaagagaaagaacaauaaaaauguguuagagaugggagaugguaggucuggauggggauggugguugaagacgacacaguggguuucuguaggguguuagcugcuucuucguguauuuucacugugacugucaagccugccucuuacaacacuuucuucuggugacuauucagucucacugagugggaaauuuuuguagcugcuguguuucuuaagcuccuugugaacuuuucuauucaauaacuuagguuugaucaggaccauguauguaagguguuucuaccacuggacuuuuccugggcucccaacaaaugagaacucuaugcaaaguugaucugucucaguauccucuugagccacccaguuugucuaaaacuuaaccuaagacugaugagagugggaagaacaauauaaauguaaauagcuucagcuucaguugagcaaaggagcaguuagcaagucagggugggaaaauagagacauucaaagaacagugaaauguuaagaguauucugagcuucauuccauuauuuaaaaucucuagcccuaguuucuauacuuaggaggcugugugauaguuacuucuuuaacaaaguuaguauaaaaaugcaaucuacuucauaggauaauugcaggaauuaaauuggaauuaaauauaaaucacaggccuauuaaauauaguaaauauuucaucuauuaaucccauaaauaguaacagugacauguauaaauccauaugucuugcacaaggugggauguguugaguuacugagugugauauaaauaacacugugacuccuaacagcagcaagaguacuagugcuucacauuugucaacucuguguaguaagaaugcccuacauucaagucauuuguaaagguuucuaucuucacaaaaaaaaaaaaagauuuuuaguaaacuugaggauaggaauuuacauggaaucaaugaaaauuguugacaauaaaauaaaccugcuagaauggucuaaagaauuguuuccagggcugaagcuagagaugcugaggacuaggaauauaaagaauaaggggauaaccugaagaugaugucauagaggguuaccugaugcuaccuaccuagagauagacagauacucacagaugaucuguaggucuaguaaccagagccaguacauucaaacaggauaagcacagaaguuaagaaagaggagaaccaagucuacuaaaaccugaauucacuucagaugguucauagauagguuguuggaaaaccuaacuuugaaaaugaagaaacuuccuucuacaugcucaguaacuuagcucauauuucuagaccuuggaguuugaccugaaagagucugauuuuauuuuuaagggauugguucacugcauaaaaguaaauuguucacuuaagagacuuagucuuuugccuuucugacuucucucucuugcuauugacagguaaauggccaagaucugaagaaccugcugcaccaagaugcuguagaccucuuccguaaugcgggaugugcugugucccugagaguacagcacaggguagguauuaccugcaccuggauaugggacaguaggcuuuuacacuguucuugugaauagguuuguaagcuucaaagucugcuuuacuuuaucuucuguuaugauugccuuugucagcauaggcaggaguccuuuaggauuucugccuaucaguaaaagaaguauguaacccaaguucuaccuucaguggauuaaaguuucauuaagugaaaauggaaagaaaguagaauuacuugguaagaggccaaaugaggauacagaggcugaagaagauugaaaggagcuaguguaaacaaacaaacaaacaaacaaacaaaaaaccaaaccccaaaacaaaaacaaaaacaaaacaaaauuggagaaagcagaagucaguuugaacuauguggugagacucugaaagaaaacucaaacuauuaaaaaaagaagaagaagaagaagaagaaggaggaggaggaggaggaggaggaggaggaggaggaggaggaggaggaggaggaggaggaggaggaggagaaggagaagaaggagaagaagaagaagaagaagaagaagaagaaagagaagaagaagaagaagaagaagaagaagaagaagaagaaagagaagaagaagaagaaaagaagaagaaaauaaaaaagaaaaaaaaaaaaccaaaaaaacaaauacccccaaaacauaaagugauauccaagaaagcaaccagagcugcaaacagaacauugguguguugaacacaaaagcaagugauaaaagacaguauaguauuggucagcaucugcuuuugcagugguucuucucugguucuaaagcauggagaauuuaugugggcacauguuucagauaugauaaggguuccuuuuggagaauauguguucacuuuagaaacagccacaaauaacuuagaaugcaacaagcaguauugguccaaaauuuuaucuaaccugaagacccaugucuuuuaggacuugucaucauuugauaaauggucgaacagcaguuucagaagacaguuugugcaguugcuucccuauaaaauggguuaggguuucaugggcuggauguaaugagguuaaucuaacuggaagaagaugguauuguuauuucaaguuaaccacugucuuagucaggguuucuauuccugcacaaacaucaugaccaagaagcaaguuggggaggaaaggauuuauuuagcuuacaccuccauacugcuguucaucgccaaggaagucaggacuggaacucaaacaggucaggaagcaggagcugaugcagaggccauggaggaauguuucuuacuugcuuucuucccuugucuugcucagcuugcuuucuuaaagaccccaagacuaucagcccagagaugguaccaccuauaagaggcccuucccccuugaucacuaauugaaaaaugccuuacagcuggaucucauggaggcauuucucaucugaaacuccuuucucugugauaacuccagccugugucaaguugacacaaaaccagccaguacaaccaccaaaaauugauuuaagaggggccacccuguaaaacagggcuggaaugaagaaagacaaugcagauauaaauuaaggaaauacuucaggcaugguggcacacaccuuuaaucccagcacuccggaggcagaggcagguggauuucugaguuugaggccagccuggucuacagagugaguuacaggacagccaggacuacacagagaaacccugucucgaaaaccaaaaaaaaaaaaaagacauugagaaugacuagaauguagguuguuuaucuccaagucuuuaaugucuacuccagauagauuucaccuuuaucuguaccuagcauuuugaaugugggcauggaggacaaggucccaucuuaggagcaagaggcugaguuagaaucuuuccaaguaaugacauuguaaguguguugacagaguuuggaucugcucuuauuguauuaaaaugacugauguuccuuguaaguaaauguuuuuagaaagguuuccuuucucaccccucuucugcucugcaauauccagacuuccugaaggaucauuaauuuucaucucaccccuucauuuuccuguuaggaagcauauauaacaagguagagacauuauagaaacagaaauuaucuacucuacucugugaggucccauuaagcuaguaaacaaaaguuaaaugauucccuaccaaaacaucugugagagugauacuucaacuaggacaauaguuuguuucuuuuguuaguauguguguggguuuuauagcuuugggugauagagacuacauuugcaggucauuaucaacuuggaucuuuuaguuguugcauacacaguagucagagaguuaauauuucuccuucccuuuuaguuaccagugcagaauggaccuauaguacaucgaggugaaggagagccaaguggaguuccuguagcuauggugcugcuaccaguguuugcccucaccaugguagcaguuugggccuucgugagauaccgaaagcagcuuugaaaugcuugcugucuuccaguguguccaaugaacucucucucucacucaccaucucugacauccucccauauucuuucuccuccacauagccaauacaagauuuaaagugacugcuuaucacccaaaacccugcuauucaaaaucuccuauucuaauggaagaguacagggguuauuugaagaaaagcugugguggugugugugugggggaagccuugcuuagaaugaaugagaaguuacauauuuuacuaggacugccaauaaaaacucagcuaucauccaaagaggaaaagcucagccuuccugucuccauggacgacaccuuucucuuagcuggcaugcugugauggcuagcugugcuaugugaaaggaggagcugauuuuguuuuuuuuuuuuuuuuuaaaugcuuuuucuugggaaguauuuguggccuuuaauuuguaacuauauaccuagaugccuauauuggacauaggcgaaugaaguuuuuucuuucuuucguuuuuauuuuuuuuaaauuaaaaaagaaaauauauguauacaguaauacacacacacacacacacacacaguagcauaaaauugaugccuuauggagaauuaaagagguaagaaagcuacugguucuuggguuucuaauggacaauuuugggggacuaggggaucauauucccucauauauaaucaagacucauauugaaaaaugaguucuggauuguaaagagaacuuacuuuuuccacuugccuguaagucuuuguccacaaguuaaaaacauacacagugcuaaggaaugaucauaacugaaacauuucaagaacuauuagcagagcauguauauugaggauggggaaguuagcuuuaaaagagaaugcucagucagugacauuaggaaaauaaugacugaagcaauuaguuaaaaauuguagagcaacugguguuacucaguagcuacagugcugugggaaauuguaguaaggcaucucuacucaagucaauuuguucaaaaggcuuugggauauacagaugagucccacagucucugaacugccuuaguugcuauuuuacaguacuguuaaaggauccauuggcaugggaugggaagcagcagggcccaaucaaccaucaagacaucugaaaaagaucaugucucaagguggcacuugagccuucaaaacugcuuaacaauucucaguuucuagugucagacaaaaagccuaagggaaggaacugcccuccugguaggauggaccugaaucagccugcuucugacugaguuaggaugagaaggcauugguauggguuuucuuuuugaaaaaaaaaaaaaaaaaaaguauuuuuugaaaaagguauuuucccccaaagcuauaaacacuaguuuugguuuuaauaagguuaauggaccauuuuucaaaaaggagaaggaauaaguuuuguuuguuuguagagggugcaaggaaauuuggugagcauuucugaggaaagccugaguacacaguguaaugaagagaugcuggagaugcagggauauuggugaggugggagcuguccuguuuauguaacaucuaaguugguuuuagaguacugaggauaguugaaccaagccuauuuuuuuuccacuuuaacaaaauaauuuccuucuuuucaguaaauuggccagacuauuauuuugacauaagauuaugaagaguuuucccgacagucuagcagucacuuaacagauguugauugcacauuaguuuugucaggacaccuuuauaaaaagagaaaugcacauauuucauccaaagggacauugugguuacaguuaggaaggaaacccuuaaaauggaguuaguuaucuaaguguaaguuguuuauauuacagacagcaaaagaaaauagcuccugaggucuggacacugaggauuucauagaagagggaaucguuaggugccaaucaucuaguaagagcaugcauaaauagaggaaaaguuaagaaucuuaucagggugaguaauaaacacaaccaguaagaaaaauauugccauccaaaacagagcacagugcagcaacauagaagauaagcagauaaccagcaaguauuguaaggaguucagaaaaggaaagccaucguguaguggcaucaggggagaauggaaaggaaagucuagaacaguccagugauacuuuaccucugggaaaacucuugauacagggagacauuugcuuuaaacaaucuucacauaacuaagccauucaguacuuuuugaaacugacuuaguaacaggagucauuguaagcuccauagaaggcaagacgcauuccacaucuugucuugaccagcagcacucuggaggcccagugucugcuacccuucuuguaucugauggcauggguaacagcucugccaugggccugcuuacuucuaguauucaccucagggcuuggaaauugguuuugaaaggcuuuuagacauagaaaguaaaacuaauggcaaggaggauaaaacacuguuguguguuguauuguugaucuaaauaaaaaauaucauugguagaaguuuuacuuugguugauaaggauucugauaacauuugggucuccuuaggaaagaaacacuuaacuaaaacauuuaaguuuuaggcaaauacuguaauauuucacucuuaguuauaugaaaacuaaaugagauguugagaaucuauauagauuauucaaauuuuauguuucuuauagacugacucaaauauuccuaccaccuuaaaauuauauaugaugcaccuaccacauaaauuauaauguuuaauguuuugaaaauggauuauagguauuuuuaaguuuucauaaaguauuucuuauauuugucauugugaauuauauguaauucuaauagacacuguuugcuucaguuguuuuuguuuccuuuuccuacaguuuucugugugggugauuucauuuaauuaauuggacagucuagccacaggcaacaaauagaaauaguauuuguaauuauagucuaugccagggacugucuuaaacugauuaguaacacuaugacuuacccugagaucuaaguauugcuauaaagagacugaagaggagagaauaaaguauuuuccuaggacuacauaguugguaaaagagaaucaugauuuaaacucuggacuauggauggcaguaucaguaauauucccucauagcuagcaguccucaugcaaggucucugaacaaaagcaacguaucaccugcaaaugcuuggguuucaucccauucuuauggagugagaugagugugugccagccagcaacucuguccuucuagguaacugguucaugcugaaccuugagauucaccacugucaggagcucucucucucugcuuagaaucauccagacagcgggcuggucagcccacauuaaauaagaacaugugggacuagaauucagucaacaaugacauguuucaucaggugguuaaaauguacagauucuguuggaaauguuccaugguauuucaauagccagaaugaagaacugggcuaaguccagagcucugcucucugagcaucugccccagauacagaggcagaguaugaaguggaacauuguuuuauuccuaggugcucaggacagacugaucaaccuccaguaacauaugugguuaguaagugcuucagcuuguguagccauuaauaaccaagucauaggauugugaaucuaaaauacuccuggguaaaauuuguauuagaauggaaaaaaaaaugagggucagaaaggugagcuaacuucaaguuagauacuccccucuauuuuggucucaaauuuguuuuaguguguccacaacaugaaaacauacaaaaacuauauuuuaaaaaucaguuuacuuucaucuuuucucuuuaggcuuucaauaaagaccagaaggacugauagacagcuagagaggaucguguaggcauccagauuagaauggaagaauccauugaacaaucugagaaaacuaaucagguguuguuuuaaucacauuaguuuuaaguuagauacaugcucuuuguaguauuuuggguuuuauugugcaaauaagcaauuaaaauauauuuagaagccaaguauaaugguacaugucuuugcucucagcauuaggaugcagaggcaagcagaucucugugaguaggaagcuaguguuagaucucccucacccucuccucccucucccucucccucucccucucccucucccucucccucucccucucccucucccucucccucucccucucccucucccucucccucucccucucccucuuccuuccucccuuccucuucuucuucccugccucccucucucccucuuccucugguguguguguguguauguguguguguguagucauaaggauuuuauuuuacccacuuugaguggaauguaucuuuguacagauaaugauguuuuucuucauuuagcagauaacuaucaacacuaguacagaaauacaaagauaaaauuuagucacuaagcuggaacaacuuaccuuuugagagugggugaucuuuuuuuguaucuuuuuaacaucacugaagaauacaggguuugacuuccuaagcucucuaccucucacaguaguuucaggguuggcuacuauccuagguuaagugugcacgcucgacuugcccagaaagcauaugccacaacaggauccuucugcacacguuuauugggagagcuugauugcagaggcgaaaagacccagagcccagaacuggugcugcuuauauaggccuaggagaggcgugucucacacccgauugguuaugcuuucaguaccucauuuacauaucuacauccgauugguuaugcucucaguaccucguuaacauaccccauuuacauaucuacacccgauuggucaugcauucaguaccucauuuacaugucccgggccaggcagugacuaggcaaaaaaacucuacugcacaugcgcauauugguuguuuacccaaacuuaugggugguggccagcgguaguaagcgccaccuuguaauggcauauauggcuucccacaguuaagccuucuuugcuguaccuuuuaacuucaaaauuuuauugagaccaguccucaccuacagugugcaguuaugauuuuuaaaaaagagacaguauuuuaaagaauucugaccagugggaaugagauucugaacugccauuaacucuuguguugauauguauauagagaguucaaagcaugugacuauuuacccgaugcacuuaauaauacaaaauuugacagaagaaagcacuguugaugaaaaauccagcucuauuaaacacuaaugccucuaacugcgaauuccccucauguuccauuacuauaggggagacagggaagaaaggaggacuaauaaagguuuucaaugcaauuuuguuauuugccagcagaaugauuuacaaaagaacuucguaauauauugacuaguaacaggaaacugggaugauucuuuucaguguugacagguuugcaaaugaagacacagaauugaauuucguuucaguuguaaugcuauguuucuaauucuguuugaauacgaguuuauuauuacuggauacuuguauaccuuccaggcuuuucacuucuuggaaaauuauuuucuuuaaguaccuuauguuauuuccuuucugcucugauucuuuuuuuuucuuucaguuuuuaaaaucuacuuagaauauuaaacaggauggaaguagaaaaaaacucauaugaaguccucuaugaaaggaaauugugacaaguuccugauuggacagaaaccauuccaucuccaagggagaauaugcaguguaacugugucuucauagaaugaguuagauaguguuccuucuguuucuauuuuguggaauaguuugaagaguauagguauuuugucuucuuuaaaggucugacagaaugggacucuuuagauaguauaucugauauuugguaucugucuagaaaauuguucaucuauauuuuccaguuuuguugaauauaggcuuuuguaguaggaucugaugcuuuuuuaauuuccucaguuucuguuguuauaucugccuuuucauuucugauuuuguuaauuuggacacugucuuugugcccucugguuagucuggcuaaggguuuaucugucuuguugauuuucucaaagaaccaccuccugguuugguugauucuuuguauaguucuuuuuguuucuacuugguugauuucagcccuguguuugauuauuuccugccaucuacuccucuuggggguacuucuuuuuguucuagagcuuuuaggucugcuguuaagcugguaggguuugcucucuccaguuuuuuuuuuuuuuguuuuguuuuuuuuuuuuuuuuuggaggcacucagagccaugaguuuuccucuuaggacugcuuucauugugucccauaaguuuggguauguuguacugucauuuucauuaaauucuaaaaagucuuuaauuucuuucuuuauuucuuccuugaccaaguuaucauugaguagaguguuguucagcuuccauguguaugugggcuuucuguuguuuuucuugcuauugaagacuagccuuaauccguagugaucugauaggcaugggauuauuucagucuuuuuguaucugcugaggucuguuuugugacugauuauauggucaauuuuggagaagguaccaugagaugcugagaagaagguauauucuuuugcuuuaggaugaaauguucuauagauaucuguugaauucauaacuucuguucuuuucacucugucucuguuuuguuuguguuucccugaucuguccgaugaugaaagagggguguugaagucccccacuauuauuguucgcgcugcauuaacguuuguuuuaugaaugugugugcccuuguauuuggagcauagauguucagaauugagaguucuucuugguagauuuuuuuccuuugauaaguaugaaguguccuuccuuaucuuuuuugaugacuuuugguugaaauuugauuuuauucaauauuagaauggcuacuccagcuuguuucuugggaccauuuguuuggaaaauuguuuuccaucccuuuacucuaagguaguguuugucuuugacacucagguguguuuccuguauauaguaaaauguugggucccguuuacgcaaccagucuguuagucuaugucuuuuuauuggggaauuggguccauugguguuaagagauauuagggaauagugauuguugcuuccuguuauuuuuauguguguguguaucuucuuuuggguuuguugaaugaagauuacuuucuugcuuuuuuuaggguguaguauuccuccuuguguugggaguuuuccaucuauuauuauucuuuauagggcuggauuuguggaaugauacuguuuaaauuugguuuugucauguaauaucuugguuucuccaucuaugguaauugagagguuuguuggguauaguagccugggcuggcauuuguguucucuuagggucugaaugacaucuguccagggucuuccagcuuucauagccucuugugagaagucagguauaauucugauaggucagccuuuauauguuacuugaccuuuucuccuuguugcuuuuaauauucuuuuucuuuguuuugugcauuugauguuuugacuauuaugugacgggaggaauuuuuuuucugguccagucuauuuggaggcuuguaagcuucuuguauguucaugggcaucucuuuguuuagguuaggaaaguuuucuucuauaauuuuguugaagauauuuacugacccuuuaaguugagaaucuucacucucuucuaaaccuauuauccuugauuuggucuuauuguguccuggauuuccuggauguuuuggguuaggaucuuuuugcauuucgcauuuucuuugacuguugugccaauguuuucuaugguaucuucugcaccugagauucucucuuuuaucucuuguauucuguuggugaugcuugcaucugugacuccugaucucucuccuggguuuucuaucuccaagauugucucccuuugugauuucuuuguuuuuucuauuucaauuuuuagauccugugugagcacuaaaagggguguaggggaaggagggggaagggcagauaaccugcgcccagccagaguuccucuuaugcuccaggcaggcggauacgggagggguacugggcacuguccacucggcccugggugggcaucuaagccacugaccccacucaaugguggggggagggcggacaaggggcagcccccaaccggggaccccagggcgacaccggguugcccugggguuauuggagagaggcgagaguaaacacagugggccuugaugaacagagacagucuaugguuuuagagcuuuauuguagaaaggcagggagaaagagaaaagguagaaagagaaagagacuggccauguccgagaggagagaaagggggaaaaggagagagagaagaaaggcuagaguaagagggagagagcaagagggaaagggugaggagagagcaaggagagaguaaggggaguaagagcaagagaguaaggaggggccaaacagccccucuuauggugugcuguuaucuuuacuguugcuagcuagccugaaagucagaagcuugggacauugccuaugugacuacuaaccaugcuucucuugugggagcugagggggcaguaacuuugacaggagccaggguuccaggagacaugagagaacuccuuccaucccauguaagugaauuaucaccacugggucccgggauucaacaucuagccucaacuggaaaccaggcugucuguacauagcccagagccccacaauccuggaugauuuuguucaauuccuucaccugauuuguuguguuuuucuguaauucuuuaagggauuuuuguguuaccucuuuaaggguuucuagcuguuaaccugugcuccccuguauuucuuuaagggaguuauuuauguccuucuuaaaguccucuaucaucaucaugacauaugauuuuaaaucagagucuugauuuucuggugugucgggcuauccaggguucgauagaacugaauucugaagguagaacuggauucugauaaugcuaaguagucuuguuuucuauuacuuauguucuugcucucaccucucgccaucuguuuaucucuggucuuagcucaucuugcugucucuaacugugacuugucucuccuauaaaccugugugucagcauuccugggagaccaguucucuccuagaggaauuugggucuggaaagcuguggcacagggucaauucugggugcagacggaaaccagaaggauccuuuccuuggcuguuccuuaguuccuguaucuugauggcuuugggcucgucccucuugguccaggaauuugaguagaaguggugguccuaccugugcucacugauuugucagcacuccugggagaccagcucucucccagcgguauuuugguauggagcgcugugacacaggaucagcuucugguacagauggaaacucgaagaauccugucccagguugcuccuaggcuccucuguccugauggcucugugugagucucuuucugcucuaauucuuauaucccuuggaucccuguauguaaacaucagcuguuucacagguugcaugccugagagcuacuugcaaagcaaguagacauaaaucacauuaacuaggacucaucaccaauucaucagugauccuguuucaagaucacuguuugauaccaguguguccagauuugccucuugaacuaugacacucaauaaagaccuguuuaacuuauugaacguuuacagucuuggauuuuuuuuucuuuagaagacuauuaaguauuuccuuauuuuucugucaucuucauaaaccaauaucucugaugggacaaugggaaggggaaagaaacauaauuuugagguuuacuuuacccaagaggccaacacuaggacucagcacuaucauagaauuucuaacaauuccugagugcugaccaggguccuaguuauuauccuaagcccuuaacauuucacuuuaggcucacaaaacucuuagagaagcuguuauguccguuuuacaaugagaugaacaaggcauagacagguuaagaaacuugcccaggucacacaguuacuuaaugucagcuuaaguuuaaagccaugcagucuggcuucagagucuucaucauaaucagaacacacuacugccucuacuuucuaggugcuagauacuguauucuacugcacuuucccaguauuaaacucucaaaacuacaaggcaguuugagucguuccaguuuuauaggugaaauaagucaaugguuaaagaugauaaacuuguuccagauguacagcuguuuuguuaccaaaccuggcaguuuacuucagacucagaaagucuaguaaaugacugggguggugagaugccucagcauauaaaggcaccuuuuaccaggcuugaggaccugagcgauuucuggaacccacaugguggaagacaucugacucccccaaguuuuucucuaaccaucacuccagcaccaggacaacaacuccuaccccuagacacacacacacacacacacacacacacacacacacacacacacacacacacacgagagagagagagagagagaaaggggggaaagggggaggggggaaagagaaauaauuuaaaaauguuuuaggcuugcaguucuuauauuuuugcauuuauagccugaaaagaacaaugaauauuaaaaagauaugguucuauuccaauaaaguuuuaugguuaugcguuacuagugauacaguguacugccaauccuaugacaucauaaacuauauguaggcaaaccuagaagguagagucuuuucucagauuuaaauucauguagcaugcuauuaaaccuucauauauguaaacauagaaaauauuuaguaaaaauacuagucuaugggaauuuucaguuacuaaauuuuucaagaacugucuuauaugcaguccauagguggcuaaaauacuguauguuccauuacuaguuaucaaaacaaacaacuccaaaccuguccauauuaggcucuuggucacauuacuaaaaauuguaaaccuaaccagguucaucugaaguaauaaaaauggaagaaauucuucaaauguugaucgguuugaguccuaaauggaaaaccaugacauauuuaaagaauggcucuaaaauaugcaaaauaugcauuagcauauucuguagucauggaaggcucaguagggaaugugcuugcugugcaagcaugaaggcguaaguuugguuacccauuaaccacauaaacuuugaccguaaugguacuauauaacagcagcaguacgaugaggagacaggauucaaauggaaagcuacagguucaaagauugcuacaaauuauaagguggagagagaggaagauacccaauguugacuacggccucuacacaagcacauaauauggaguagggacaaacauacacaacaaccuccaagaaauaggugccagaaaaaaauccuauaaaaauuucccuuguucuuuauuugaaagugaauugaacaaugacuauugcuagaauugaaugugagcaucugucuuggcuagaauuccauccuuaagauuuaacugucuaccugaaaauauuaaacuauguuaagcguuuacuuuauaaauuggcccuugacaacugaaaaguuggauagagcuuugcucaauuugauaacucuaguggcagagguaaaauuguaucagcaacuuuucuuguugguguggcaaaauuaaaaacaaaaacaaaaaaacaaaacaaacaaacaaaaagggauacauuugucucaguuugacugagcaauccuaccacagcaggcaagauaugcagcaggggugugaggagacagcugcuguauuguaucugccaccaggaagcagagugaugaauauuggcacucucccuucuauucuucacccaugguguugugauccccacacuuaggauggaucuucccgaccucauuuaaccuaauuuagaaacuuccuuacagaguugccaaaagauuucuuuuccaucaaugugaccauuaagauuagcuaccaucuguccucuugagaugcccaaaccauaaaccacagaggcauacacccacagccaaacaguggaugcagcuuggggacucuuaaggaagacuaggaggaaggauugcagccccuaaagggagagaaacuccacaggaagaucagcagaaucaacuaaccugggcuuguggggcucucaaagacugaaccaccaaucaaaagaacauacacgggcuggaacuaggcuuccugguacauauguaacagaugugcagcuuggucuuucccaaacaacuggagcaggggcuaucucaaaagcuguucccuguaugugcgauauauuauucuguuguucuagcugggcugccuuauuuggccucagugggagaggaagagacuugaugugccaggguggguggauacccaggggggggggggcuacccucucagaggagaacgggauggaugggggaaggauugugggaggggaugaccaggagaggggcaguuauguggccucauuuauccuauagcucacaccccauagaaaacaggaugguacuggaaauacccuagagagugcuugugaucacuuuuaucagagaaugugcauaaaggacuaagaguuuucuaguuuugugcuaacaaccuaauuguaacuuguuuuagcuaaauaaaacggaacuggaguaaaucuacucucaaccacuccaguuauacucagaaguuacaucaaaugguaaggagaaccaaaauaagauuuuuuuuuugacauguugucuuagugaucauagaaggagguuaugguuuccagguuuuagcaauguaccagaaauccccacacugaucaaguuugaaggaaaaacauuuuuagggaaagaagauagaucagggguucuucaguguugucccuagaaccucaguuucaguaugaccuggaagcuuguuaggaaauauauuuuagguuucauccaucaccugcgcaaucagaaacuggcgauagggccuagaauagauuuuuaguauucucuauaggauucagagacacacuaauguuugacagucacuaguacagaacagcaagaugacuugggguaaugguucuugccacuaagucugacaaccugaauggugaaggacacacacacacacacacacacacacacacacacacacacacacagcacugagacagagguauuaauguggaaaagaauuguuugucuuagcuacuuuuauauugccgugacaaaacaccaugaucuagauaacauauaaaacaaaguuuaauggcagcagacaagcauguauaacacuggagcaguagcagagagcuuaccuuugauccacagcagaagauauaucuugggaggggaggggaaaggagagaggucgggaggaggaagggcaagagugagacuggcauuggguuuugaaaccuuaaaacccauuccuagugacacaccuccucugacaaguccauaccuucuauuccuccucaaacaguucuaccaacugggaaccacauauucaaacauuugaaucuaugggguugcuucucauucaaggacuuaaggcucuaacauaauguuucccacaaggacuaaagacaagcuuaagguuuacaauuuaagaggauccaugaaauauccauagaagccacuaucaauuagauaauagucaauucuacaggaaggaauaucuguacuacuugacagaguauaaccuuggauaagcuuguuaccuuucacuaauguggauauauacuuauaugaaaaggauagcauauuacugauaauagcacuaucuagacuauauguguaugauuaaucccauuauaaaucacuagcugggugcagggcuuugauggaauaugacucagaacgacgauggucuucuauguagugaggaggucagaaaaugcccagaguuuuggagccaggccccuugauuuguaauaucuguugaagugagaacacacuuaaguaauauggacacuggaugaguuuugaaaugucauaggaaaugaauuuaaggugaaaguugaugcuguguaagugcuauacacuucacacuauuuuaauaaaucuuguagucccuuaugguuucaucuuuguacagagaagauuuuucaaaacaacagaaagaugucaauccaaggcuagguauaauggcauacaccuguaauccuagugcuccugaagcaggcagaucagcacagucaaccaagaacgauaaacaccagcuuugaaggagacacccuucauaauuuauagcaccccuguuauuagagaccuauccugucaauccuaaauucugauccaaaguaauuuuaguauaucuacaaaauuuucuucuaauacuucuaacuguguuguuuaaccucucaguuuaaaacugcucacccuuauacuacuugauucacacauuugcagaucucuaaucuacagucaagugaagacacaggggagggaagggauugacaaaaagucuugcuuuaagaaauguugucguggacacaucaacguuuccuuugauuuaaugcaaauuacgucuuucccccaauauuaauauucaaacucugaaauacuguagcuauccuccuguuuacuuguuuguaugcuacuaacaauagugacacuuuuauacacuaacacaauacacagugugccaaguuauaagucaaaggcuauggagcucugaagagggaauaauuuauguugccuauagaguacaguggacuucaaguacuaugggaguguguaaauuggagguguguaaauucauggcauauucaguaaggaauauuaguauggaaugaaaaguggcaaaaccaaccaacuaaacaaaaacaccaccacaacaaaacagcaccacacuguagucuucuaacaaauaauuuuaaacuugcucugaaaauuguagagacagagaggaucuuuuaauuauguauaaaccugucuuuccagugcugugugagauuaagaucauucagucuccccuuugccuuuaugcccucuuucccccugacauagauguuauccuaagcuuaaggagauacguagcuucuccugugguuacuugugaggcuacucccaaagcauuucaguggcaucagagagacagaggcagaggcaaagguuuucucugucucuuccuggaaaagacaaggcagguguuuuguucauccaaacuaucauacuuucuaguuugugucccuauuagaugaccuguuucuucuuuuuuguuucuguguuucuugacucauccagaggcacacaaacaaugaaaaacaaguguucauucauuaaguauaggacuucaugaaauucgcaggcaaaaaaaaaaaaaaaaaaaaaaaccuagacuauaucaucuugagugagguaauccagucacaaaagaacacacaugguauacacucacugauaaguggauauuaggaaaaaaagcuuggaauauucaugauacaacuuauacagaccauaugaagcucaagaagaaggaagaccaaagugugaugcuucaguccuacuuagaagagggaacaaaauaaucaugggagauagagggugggaagguugggaggaauaaaggaaggggagaagaaaaaaagggggggcagggucaggugggaagaaacaggggagauguacagagccaggaucagggaacugaacagaaagguguguugcaaugggagaugaacaggagguagccaacagaaggucccagacaccaggaaagcaagagguucccaggacccaauggggaugacauuagcugaaauacccaacaaaggggagggagaaccuguagagaccauauccagagguuagacaugacccccaguugagggauggggccacccacuuuucucaaaaauuuuaauccaaaauugcucuugucuaaagaaaauauagggacaaagaguggaguagagacugaaggaaaggccaucagagacugcccuaccuggggauccaucccauaugcagcuaccaaaccuauuguugaucaauacccauacagccaucacuauugccgaugccaagaagugcuuguugcaaggagcuugauauagcugucuccugagaggcugucagagccuuaccuauacagauguggaugcucacauccaaccaucggacugagaacagggaccccaauagaggaguuggggaaggacuugaaggaacugaagggauuugcaaccccauagguagaacaaccaaucagauuccccagagcucccagggacuaaaccaccaaccaaagaguaugcguggagggaccuauggcuccaggugcauuuguagcagaggauggcuuuaucugguauccauuggaggagaggcccuugguccucugaaggccugaugcuccaguguaggagaaugcuagggcagugaggugggagucggugggggagcacccucaaagaagcagagaguaaggaguaggauagaggguuugcggagcagaaaccgggacgggggauagcauuugaauuguaaauaaauaaaauaauaaaaaauuuuaaaaaguucaguuacaacugaugagccacgacuuaaaauguguucauuaaccuggugcuacuugugcauuagcuuaaaaaccaaccccgcccuuuaucugaguuucuugagucgcagaagucaagauccagaauaugcgaauuacagauuuuccaaaucgaaaaacccaauugcacccggcguauccugaggucacggaaccagagcucagaagccucgacuuccgggggagggaggaagcagaagugcguuaaggccaaucguuuccguuugccucggggaggcuuaucaggcguggaccuggcacccaaagccugcgcugagucuacaacuucgccugagacguguugcgggccgcgcugggcucgcucuggaagcggcugacuaagcaggccgcaccuucugccaugauugcgcccgcuguguugcgagcucugcguaagaacaagacucuacgcuauggaguucccauguuggugagcggcugugacgggagcaggggcugcgaguccggaaggggcgggcccucuuuggcugaguggcguauuggugcugucuuucggauacugcugacuagggggucugugggagccaccggagcuuugagguuuuuguuuuuguuuuuaaguucacgcucaaaaguguaccucgggucccgccaucccccaccccccguuuccuuucccuucgugaacgcgcguguuacuauccccguuuuacaguaccuuuccuggguuaaauguugagauuuugcaagaagacuaaucaaaugucuucuuuaauaauuacauucauuuguaguaauuauguucauaauuuguuguuugaucauuguuaaguuaauuugcuuuagcauauuacgauauaaaagaaaauaaacaaaaacuuuuaaaaauacaagacauuuuucuuggugugguucuuggcacgugugaagugccuuuuguauuuaagcacugcuaaaagaaagguugauuuuagaaacguaauauguuuuuuuaagucgucuuugaugugucuggaucuuguuuugauaauuagggaacucugcaaucugcuuuaagaguuuugggguaagcguucguuuuuauaaaaugacagcaauuuacaaggcauauauaaauuuuuuuauuucugcaaguuccucugccguucaaaaucacggauguugcuacugacuuaccauuuaucacuaugggagucaauuugauuuucuuucaaaauuauaaaagucaagauguuauggaaagaaaaaaaaaaucucagggcuaggcuuucuauguagacuuagcacccugcccuauuuucggggcuacccagcaggaaagaggcuccuuuacaaauggaaauuccuuucuuggucaguuuuuaaaugguccuaucagucuuaugaaggcacacucuggaacucugucuagaaaaaacucuuaagccuaauuuauuuuacagaugcccuuccagaaguuaagcaaagagcacuuucuaugcccaauuugagaaauccuccucugaguucuggguuucuccucuucuguuuuauaacgcgcgcgcgcgcacacacacacacacacacgcgcgcgcgcgcgcgcgcgugcacacacacacacagcuagcuagucguucauuucuguuugcuuuaugcacauacaugugugcaaaauagcauucuuuuuuauuuaaaauuacuauauagauuuaauagauaagcacuguguuuacacccuuuucaucccuaccucucccccgccaacuucuccugugauuccuuucucccuuucaguuuuaugacuuuuaaaaauuaaaauuguuacauguuaauuauauauauguguguauauauauaaaauuauauauuauauguauguauaaaagcagccauuuugauuuagucuuauguaucccaaauagcauuuuuuuuaaaaguagcuaagaauauuuuauauguauaauuguuaaauacaaauuuuuauuguggcugcuguuuaccuagaaaucauggugguuaaugaagggcccuaaaaccuaagaggugaaucucuagauugcaagagaggaaacaagaggagagaauguucuuagaagaaaagcauauggcccauuuuucugaugcagaaacccuuucagagagcagagcaguuccucuaauugagccacuaaucuagugaacagagacucuaaaucuaauguuguuuuuuugaugauuuuuuuguuuuguuuuacuuuucacccuucaaccuguguacaugugcaagcgugugcgcaugcagggacacgcagcacaggugcucuccccguuucuuaccuucugaguuuaucuaguuuuuuuuuuuuuuuuuucauuuucuuuuugucagaaguuuuaaaguuacaacaguggaguuuuguugcuuuuaugaaccucaaauuuuaaauuucuauuuuauguuuuuacacucuuucuauuuaauuauuuaaguagugauauggauaucaagcuuuuugcuccuaauuggcuuagcuuauucaucucugaugugaggauuauagccagcucacucuuggguaaaauagcaguagcaguuuggaagcucucugaaaggguuucuucauacagaaaaaugggucauaugcugcaagacuccuuuauaauuuguuaagaaaauaaaaggcaguguuuacaaauguccaauuuuguaaagucaugaaguugaaagaaauucuacacagacaaggccagaguuuuauucccagguguacccuauguaguuauaguauuagaaacucaagggaggagagaggugguucccugauuaagaguacuugcugcucuuucagaggacuagaguuucccagcagcuguaucuggcugcucgugacugcuuguaacucuagcuccaugguaccugauguccucuucugaucuccacagucacccgcauguacuggcacaucaauagacacauacgugcacauguacacguaagcgugcauguaugguugcaugcacaaauacuaaauaaaucuuaaaauuaaaacuucaagcaaaacagauuuuacugauucugugugaucaaagaagacucaugaaucaaacagcacucaaaacucaaagagguuucaagaguucuguccuguuacaucggcaggaaauauuuauagacaaaacaaaacaagacaaaaccaaccaaacaaacaaaacuaaaaaaauaacuuaauuggauagacauuuuuuuuuuuugacuugguuugaucaguuaguuaacaaauggcauuucuguugguuuaccuucuaagguuacauacaucucuaaagggauuuaaguagagacagguccacuccaaacuauauaacaguaggcaaucauuuaguuggguguguuuuuauuuccuuuugaguuuggaagcaggggaaucggaaguucaaggcacauaccaaguugagggucaucuugguuaaugagacccugugccuuaguugguuucuauugcugugaggagauaccaugaccauguauggcaacucuuacaaagacaaacauuuaguuggggcuggcugacaguuucagagguucaguccauugccuucauggcgaggagcacaguggcaugcaggcaaacaugcugcuggggaaauaauuggagaauucgacuucuagaccuucaggcagcaggaagagagagccuucuaggcucugacaccucaaagaucauccccagugugauacuucuccaucaaggccacaccuccuaauccuuucaaaccuugugaaucucugauaacuaagcauucaaauauaugagcccuugggggccauucuuauucaaaucaccgcacucugucucaaaaaaaaaaaaaaaguaaacaagaaaagucaaauacauauguaguauugauuuaugacaucaguuacaaucuuauaauuuuuccaggauaguauaguggccucccuuucugacauuucacuugcugcaucuugucuguuguuuaaaaaaaaaaaaaaaaaaaaaaagagaaaaaucucauggauuauuucagaugcaaguaauucaaauggcauuuauugcaauauauuaucauuguuguacuuuauuacuaguuauuguugcuaaucuuauugugccuauuuugaaaauuaaacuuugcuauauguauuuauguauagaaagaaaacaguguauuuaggguuuaauauuuguucagguuucaggugucacuagaaugcauuugaagguaacccccaccacauuuacuuuuaagaaaaugaguaauaauuuucuaggaaauauaaucuauagguuguuuauaugcugucuaaggcauuguuuaacugaauguagcuagucagaguugaccuucuaguucauguagcuauucccuuccuuuguuucaguugcugguuguuggagguucuuuuggucuucgugaauuuucacaaauccgguacgaugcugugacaauuaagguaagaacuauaauugguguuuggcuuguguaggagaauuucaugcucauuucacuuagcaauuuuaaucuguuuugucuugcaaacccaauagcuggucuuugcaccuuuucuuguuuagaguaucacuaaugugaguccgugcaagugaaucauaugaagcauucaggaaaaggucucuguauuuacuuguaacauuguuguuucucuccccaaauauucucagacguaguuguuuuuggauucuuauggaauuuaagaacacaguuuuccucucuaauuauaaaugagcuauucuauuguaacugccagugauguuauaaguauauugccauuucucauugguaauugauacuaaaauaaaauauuuuauuauaaaugaagacaccuaucuuuuuuuauagcaucuguauuauuguaggagugaguauacuaggaccuccauuuuacagguguggaaaaaaagguccagacagcuauacuauccugcguauaguaauguguguacaccggacagagcuaggauuuguacccucuguaauuacacuuucacucuuaaauuugugcugucuguuacauaagaugucugguuuauuaacugagaaaugucuuguaauuuggggagagggaacacauaccugauaguugaagacuuuucuaaauaauauauaauguaccauuauaugcuggaacaaguauuguucacugugguaguggacucuccauugcuguauccccaccagguacuacauacugcuaaguauguaguuuaaguacaugugaauaggacagucuuugauuugccuaucuaucuugugcuuuguaacaagagaguuuagcuuaauauuuaauguaaauauugugacccuauuuucaagaccagauaaugaaaauaagaauaaucauaauaauagugcugauaugauccagacaucacuagaaaagaaaacuaaguaauccuguuacuuuaaggacagaugaaaagggcacaugcaacuagaguagggaguuaaauaaccaaaacagcagacugcacaauaugcaaaaagaaguugcaguugguuauauuggauauggggaugaaaacacauaagaagacugaaucccacauguccaggaagaaacagucaaguacuuacaaaucaauccuaaauugguucaucuuaaaacaggguaguaaaugcugaguuagcuugugcauacaccccacuuacuuaucauauuauuuauuugacugaucuacaaaauuuauuaaaauuccauuuucuuuaugagguggaacuaaauauaguggugaccaacaggggaagaucugauacuagacauguuuuugucuagcaggaacacaguuggccuuguucagucuuaucaagggucuagcuuucuauuauuuuauacacagugauucccuggccugugaaucaaacugagugguagaguacuugccuaccauccagcaagccauggguuugaccuccagcacaaugagggaggggagaggaauugauauugagugauggaagcaggaaaugguuuccuuaacucuuagguacucuaauguggaaaaaaaaacccuggaguuucaaacugucauuuggauucuuugaggauuuuaagcaaaaccaugggauacauaaaacaaaagaucaauguuuuagaaaaaaguuuuuuguuuguuuuuaccucaguuuucuuucugcuuccuacaugggacuuuaagauuuauaaaguguacuauugaacuaugccuaaguucaugagcuauaggagcuguagaguguacuauuaaacuauguguaaguucauggccuauauguacugcagaaaauacucuuaaucugcacuuaacccuuuuuguguauauacucaucccuggauucucucugcuguuuuaccuucuaauuacuaaaucugucuuuuguuaugaugaguuucuuacuaacccuguucuuuuuuuuuuuuuuuuuuaaauugacaaugucuuuugccuuacagaagcuuugcaauuuuaugagguccuuaucgauucuuauuuaaaaauuuuuuuuguuagauauuuucuucauuuauauuucaaaugcuaucccaaaaguccccuauacccuccccccacccuguuucccuauccacccacucccacuucuuggcccuggcguuccccuguacugaggcauauaaaguuugcacgaccaaugggccucucuuuccacuaauggccaacuaggccaucuucugauacauaugcagcuagagacacgagcucuggggguacugguuaguucauauuguuguucagcuagagacacgagcucugggguacugguuaguucauauuguuguucagcuagagacacgagcucugggguacugguuaguucauauuguuguucuaccuguaggguuucagaccccuucagcuccuuggguacuuucucuagcuccuccauuggggucccuguguucuauccuauagcugacugugagcauccacuucuguguuugccagacaauggcauagccucacaagagauagcuauauaacuuugugauuuaguacauauuuuuuacuucuaaacuguucacuuaauucuuuuauuauguauuucaguacucuagagaaauuuuucauagugccauauuuuauccauuuuuuggggguaacaaacacuuugugaaucauaauuacuuaaaagucccaucucccauaaggguauaauuauccauuuucuucauuuuuuacuauaugauuuuaucuuugaauaugccuuauaauuauuuucaccuaaauauuaauuauuguuuguagguggcuguaaagguucuaggugauauuguuuuccuucagaaacaguucaucauuuuuuuucuuggcaggcagaguggggucuggugcccuuaacacuugggcaugagcuggguccuggcuuaguuggaauuacaguuagcuuuagugugucucagcuuauuccuuauucuuuagaccugacuuuauaugacuuuuaauuaguaugccaagaaauucagcuguacuuuucagagauuuucagcuuagcucuauauuuuuauuuuauggaguuuagaauuuaggaauuuaauaauuacuaauuuaguaauaauaauuuaguaauuccuuugggagagauaaacccugucacuugucauuugcuuucugcuuuugucuuugcagcccuaggugaugauuuuccuaauccccaguaucaacaucuuccugcuuuccaaacuuggcuccucuucuuuuuaaauuaacauauaaacuguacaaaguaacauucuucauuaugacauuuccauacauguauguaaugugcuuugauaauauucuuuucacuugucauaguuuggguuuuauucuugugaagagacaucuugacuaaggcaacucuuacaaaggacaacauucaauuggggcuggcuuauaguuucagagguuuaguccauuaucauuauggcuggaagcauaacagugaguagucagaaauggugcuggaggaucugagaguucuacaucuugauacaaaggcagccaggagaggacucucuuucacauuggauggagcuugagcauaggaccuuaaagcccauacccaaagugacacaauuccuccaacaaggccacaccuccuaauagugccacuuccugugggccaaccauauucaaaccaccacacuccuaguacccuuucuuaucucucacuucuuccuuucuucauucucaacacacauuucuuuuuuuuuuuuuuuuuuuuuuuuuuuccagacaggguuucucuguguagcccuggcuguccuggaacucacucuguagaccagguuggccucaaacuuagagauucgccugccucugccucccaagugcugggauuaaaggcaugcgccaccacgcucgaccccaaugcacauuucuaauaauccuuuuacuuucuuuccuuauuuauuuauuuauuuauuuuuauaaauuucauacaugagcacaaacaugauauagcuggcuguaacgcuaauaacacuuaguuaugauucuauacuuguuccaggcuuggcaagugcaguggagggaaaaugacuuucaacuccaauucucagcucuaaggaaacccuaaacugaagacuuaauugagcuauuuuauuuuauuuuauuuuauuuuauuuuauuuuauguauuuauuuauuuuguuuuaaaucucacuuugaauagaaaauagaagcgugagaagauagcuuagggaaguguuauucaauaggauaguauuugcugauaaggcagaaauggcacaugaccaauacugauauaauucuggaagcucagguacauaugugugggauuuuuuuuuuaaagauuuacuuuauuuauuauaugugaguacacuguagcuauauucagacacaccagaagagagugucagaucucauuacagaugguugugagccaccaugugguugcugagauuuuaacucaggaccuucagaagagcagucagugcucucaacugcugagccaucucuccagccccaugaguugggauuuuuagaucuacuuguuauaauuuauccuuuuuugauuuaucacauuugucucuaccauacaucauucuaguggaauucugggauuaaaccccuggcucaucacuuuguucauaggcucuguuaagucacucauacucagugagucuauguucugugucuuguuuauuucaccaacauuccuuuuuuuuauuuuuuuguaacacacauguaauagacaugaguuucagugugccacuauggaacucuaaauuucuuuguuggguuuuuuuuuuuuuuuuuuuuuuuugagacaggguuucucuguguagcccuggcuguccuggaacucauuuuguagaccaggcugaucucgaacucagaaaucugccugccucugccucccgagugcugggauuaaaggcgugugccaccacgcccggcuggaacucuaaauuucuaacucuuuauuuggucuauggaaaagguucuuuuauuuucaagugcauuauauagcaauauuuuaaauauuucuguacuacaaaaucuacauuagcaguaggugaauacugcugccucuggaggcagagggccaauguuuaauaccaacacaaguaucugucacaaguuauucaacuugguguauccugcuuucuauacacauaguagaugauggaauuuaugucuaucuaauagguuuugugagcauuaaacaguauauguacaugccaaaugccuaguaaacaauuccuaguguagaucagugucuggaguuauguauuaguuuucacuaugcauuaauuauuauaguugauauuagagauuuugacauaugcuuuaaauuggaugaauuuucuuaucuauuuuuuucuaugauuuuguuuguuuguuuguuuguuuggguagggacucauuguguccuuugcuggccuaggacucaugagagcaggcugaucucagauucauagagaucuucuauuucuaccuccuuugugcugggauuaaaggcaugagccaccaggcucagcucuccuaugacuuuuuuuuuuuuuuuuuggagauuauauaaucuuucucucuuuuuuauugguuauuuuauuuauuuacauuucaaauguuuucccccuuccuguucuccccucugcaaaucccccauccucuagaggugcucccccaccuacccacccacuccugccuuacugcucuagcaucccacuacacuggggcaucaagccuccacauuaccaagggccuccucuccaauuccagauaaggccauccuaugcuacaaaagcagcuggagccauggguccacucauguauacucuuugguugguggcuuagucccugggagcucuggugggguuguggggguggggguggggaguccaguuaguugguauuguuguucuuccuauggggcugcaaaucccuucaacuucuuaaguccuuccccuaacucuuccacugaggucccugggcucagucugaugguuacugugaguaucugcauuuauguucgucaggugcuagcagagccucucaggagacagcuauaccacgguccugucagcuagcacuucuuggcaucaacaaacaguuucaggguuugguguccccaguuggggcaucucucuggauggccuuuccuuuagucucugcucuccuaugacuuuuaaaaguaaaaaaugaaaaaaaaauaaagugaaaaaugaauauaaaagaauuaaaugauauauguucuuuuuucuuuucuacagauugauccugaauuggagaaaaaauugaaagugaauaaaauaacuuuagagucagaguaugagguauaguauguuaauauucuauguuuuguaacauucucauuagucaugacugguucuauuucucaagauauauuaauaguaaagaaaaaauaaguuuaaucugaguuuacaguauuugguaaauuaucuuaaauuuggaaccagaagugcuggggaguaaguucuauagcaccggguauuagacagugaggcuugagucuugcauaacauuauguacagccugacaugcagccaaacauaaauuuuguagauuuucuacaaggagucuuuccuguaaauggccccuaaacacaauauguucccaugacucuuucuugucaauuuugucucauauccuaagaauuauuuuaaauucuaauaagcauuuauacuucaacauaucuguauaauggugauuuugcuaggaaugguagcacauguuugcuaugccaguauuuagggaggccaagcuugauaguuuguauaugcucagccuagggaguggcacuauuaggauguguagccuccuaguaguuuuuggaguaggugugccuuauuggaguagguguaucccugugagugugggcuuuaagacccucauccuagcugcuuggaacucagucuucuccuagcagccuucagaugaagauauagaacuuuuagcucuuccuguaccaugcaugccaggacgcugccauccuccugccuugauaauaauggacugagccucugaaccuguaagacagcccugauuaaauguugaccuuauaagagcugccuuggucauggugucuguucacagcaguaaaacccuaacuaagacacuagacacuaggauugcugguaguucaaagccaacuuauacuacauagugaguucaaggcuaaccuuggcuauauaaacucugucucaaaaaacaaacaaagaaacaaacuaaaaggccauuuaguuccuuuagauaaguaauucucaaacuguggguuguggccccuuaaagaccacuggaaauaucagauauuuacauuacuauucauaacaguccccaaauuacaguuaggaaguagcaacaaaaauaauuuuaugauugagggaucacuacaacaugagagauuauaauaaaggguuguggcauuuggaauguuaagaacugcugcuuuagauaguuucauagccauucuugaaaauauuuaugcuaaauuaauagcacuuuguacauccauauauauuuaacauacacuccuaccugaaagagaaacacuuucauuuccugcuucccuguccuuuguugaagccuuggacuguuugcuuggggaagugagugagcacugagcaggcagucagggcugugaagggcuugucugggaauagauuuuucuguguaguucuuuuaggaaucauaaagguuaauagcuuuaugaauauagaguauuucaucuugccuuuuagcaaccacuuauaagagaggcaaugccaagguggccugugcuaauugguaaagauuguaugguucuucaauaaaaggguuaauacuuuguaucuaaacaucaaggaaaacauaugcuauuuucuccauuuuuggauauaaauuacccguugaucucauagcaauuuuuuucuucccucaguuauuucagaauagaagcagguauauaaaagugacuauugaagagguucaaggagcucuucuguccaucccuuuucuccagcuuccccccaugcuugagacauuuaagacuaagggaagcuaugguauaucagaguguaguugaaugguucugccuaggauaaauacuuuuacucagguuaccagaggagaaugacuucauucugaagcccaguaucauuucccagguugcaaaacaaggcgcuuugguuguuuucuuccuugugaagaugccagggucuacaccuuaggucuucuguuuucuacuguuacucauaccagccuuucagcuguugcuacacuaguacagcuucacauauacuccuguuuucccagucucuuuccuuucguugugcucuuaggaacagaguguaaacuccuuuugccacuaugggcuuauuaauguaacgucucucuguagcaagcaaguaaaguucuaaacccaggaagucccugagguuggcuuggagucuauuugcugaacuuguucuugagccuauuggguuuuccuugaccugaucaccacuuagugauaacaucacucaaagccacugggcuuuugaacuaauacgcuuaacuuuguggcucuguagaaaauaaaggacuccacuuuugaaaacuggaagaauauucgagguccgaggccuugggaagauccucaacuccuccaaggacgaaacccagaaacucuuaagccuaagacaaccugacugugcucaauuuuuuguuuuguuuuguuuuuuucaaugaaauguucucaucuugauauguaggaagaagauuccagaccuguggaaaccuggaugugaauaguaugauggcagaaauuuuugauuaaaaagucaaguauaagucuguaugcuuuucagucuacuugcaaaugaaaauaguaguguugaacacacacacacacacacacacacacacacacuccacuaccaaucuauaaaaaaaaugugacuacuacuuccauaacaugccaugaauucuacuuuccuauuacccacucauacucuuucuagucacuggaauauuuuugcuaucucaguuugguuucugaugaaaaucauaggcauagauccagauuuucccaauaaaauggugacuuuauguuaagcuuauaaauaagugaucauaaucuaguaauggucuuauauuuuauuccuaauacuuuauaacucagccucugaaaccuguucauauguagugcaugaugguaagaagaugugacauuuuuguugagguuaugaaaaggcuguguugugcaguagcauaaucugggaguugguucuaguuuguuuguuagaucuccuguagucugauccuuaaacaaaaugguaggaaagguaagaguuuuguuuuuaaaaccaguagcucauuuucuucuuuuacuucuguuuaggcagucucaauucucuaccuuguguaaucucaguacugaauucuaaauaccugaaguuuuagcugaaauauucccacuauaacuauuccaaaugauaaaaacaccccacuuuucucucaaucaauuuuaauuaauuucaacacauuaguuuuagugaucuuagaauauuacuuaauggauaauuacaaacugacuucaaaguuaguggcuuaguuauuuuucuguugcugugauaaaacacugaccaaaagcaacuuggaaaauaaaggguuuauuuugcuuacacucuuagucaggguaggaacucaaggcagggacugaugcauuggccauggaggaacauggcuuccuggcuugcuucccauuucuuccucaacuuccuuucuuauacggccgaggaucacuccggauagcaccaucuacaaugggcaguucuccuacaucaaucauuguucagaaaaauuaccuguagacuugccuacaaaaucauauagauguuuucuggauuaugauuccuucuucucagaugacccuagguuguaucuauuugauaugaaaaccaaccauaauaaucuacccauugucaauuugacacagcauuuccuaagccacaacccuucuuguuuguccauggugucaugcuaaugucauaugacagugugaaacauuccaauuuuuaaaagucccauaguuuuuaaauuuuucaacacuuuaaguguccaguuuucuuuuuauauaguaccuaaucucuuucaaaauacaaaggcucuuuaaguccccaaauuuaucugaaauacuaaaagucucucuaacugugggcuccuguaagacaaaacaagaacaaaacuaaagacaaagaaguuaaagacuuuuuuuuacccugggagggaagaacuagggcaugcauagucacaaucaaauaaagucaaaauccaaauccauauucaacaguguucaaaguuugaugcuugacaucugggacccuuuaaugauccuccaggcuccaaaagguugagacauuuaguuuuacuucuuuggacugccaacugcaagcacacaaacuuuaucucaggcugaggccuauuccacaguugcuguccuuggcuguucucuugguacugcuaucucuaaaaugcaauggucuccuauuguacuucugucaacuacuucugggcuaucuucaaguucccugacccugccacacagugucaagccuugauuuuuuuuccaugaccucuucaauccugggccuucuauacugcaacugaaucugcaccuucacuaacagacucuuccucucucccuugagggacucuagcucugcuaaacaaugccaagccucaucuauguucuaugaucccuucaaacuuuuaaaaccaguauuacuugggugauuguuacacuaccaaguucaguuuccagcaugagaugaagccucagcucuucuggaccauggcuuuuaugugcugacugagagggaacacuuuucagaagauuuugccccaauauaguugauuuucuauuuuuucccgauauaauauuuuuauugauuauuuggaaauuucacauaaugcacccuacaaagcauauacuuccuaauccucccaggucuguccccaacccuugugaccucccccccaagucccuccaaaggagaagaaaaagacuauagauccaauuuguuuguauacuuaccagaggaugguuaacaccccccccccgaccccgacccaauagcuagcuccuuaaagaaaacuaaguccuucccuaucuucacuccugccagaagcuaucacuuuuggagagcuacacuucagcauucuuaccuaaaguuuaaaagaguuuucuuugauggcuuucuuuuuaggcagcuacuuucuuugaaugguggugguggugaugggguuagggguugucacaaaagucuucuauagcucucucaacugagagucuacagucacuaauaccacugcaaaaguagcuuccuuguauuuuacaguuagcuggaacauggauuauggacuuccauuuggcuucuggcaacagcuugaaccauggauaucaacauggccucugguggcaguacagaccccagacaucagcaugggccucuguucuaguauggaccauugacacuuucauggcccuuggugguagcacaagccucagauaccaacguguccucugggccguaggccauaaaccauuauguccuugguagcaauccaguccauuaacaucaccaggguuucaaacaggagcacagaccaccagcauccacauggccuucagugguaagacaggugauaggcaucaacauguucuucugugugauauggacuucuauauggugaaaccuuggaccacagacauccacauggcuucuguuggcagcauggacaacagaccucaacaugcucuccaacagcagcuuagaccauagauauuaauauggcucuuggccaaagcaugggccacaggcaccuucauggaccucagaugcagcauaggucauggaucaauauggucaaccaacagcuuaaguuucccuaccuaucuauuccugagacugggaucucuccuuauuucccugggaucucuccauuuuucccuaguuugaagacucccccaaauaccaggaccaugaaccuaaaaguuucaaauuuauauccauauaacuuugauuuuugaacugaaucauaagguuucugaaucacucuacuuauuuuuuucugacuuauaaccugccuuuccugauuucuuuguaucaguauagaaugacaaauugcugccccuuuuacacuguagaggagaauuuaguucuuuucauaacguguaauugcuuguuuugggggguauuuguuguuaauuucucccuccaaaauuacuucaaguuuuuuuugccaauauucauuuucugcuuauaaugagacaauuaaagcauuaguaaagcccuuccgguaagcaccagcuccggguuuccuugggugcaaguugguagacacccccacgguccccaggggaucaguggaacacaacaucuguuccaaacuaauggugaugggccugugacagcaggagcaaggacacaggaacccugagugaccagaggcucggguuccuucugaucaguacugauuuaccuugguuuauaacagacuagacagcuccacaguccucagaggagacaccacuuccaaacacuguaauaagcccaggaucuuaggauaacaggaucccaggauaacaggagcuuggucacaccaguauuucagggucucaaagaaaacaugacugacaagaacucuugacacacccagaaucucagguucacaggagccugcaaucaaaggaucacagagaaagauggacucugaggaguccugaaucaacugggauuauaggaaggauaggcuccaaucagauauauugaggacagcaagcacuugagaugaucagauggcaggaggcaagcauaagaacaaaagcaaaagaaaccaagguuacuuggcaucaucagaaccaaacucucccaccguagcaaguccuggauucaccaucacaccagaaaagcaagacaugggucuaaaaucacuucucaugaugauggaggaaauuaagaaggaaauacagguaaacagcuagaagcccuuaaaaggaaacacaaaaaauccguuagagaguuauagggaaacacuaccagacagcugaaagaauugaacaaaaccauccaggauccaaaaauggaaguagaaacaauaaagaaaacacaaagggagacaacuacggagauagaacuccuaggaaagaaaucaggaaccauagaugcaagcaucagcaacagaauacaagaaauggaagagagaaucccugguacagaagauuccauagaaaacauggacacaacaguaaaagaaaaugcaaaaugcaaaaagauccuaacucaaaacauccaggaaauacagcacacaaugagaagaccaaaccuaagaauaauugguauagaugagaaugaauauuuccaacuuaaaguaccaguaaauaucuucaacaaaauuauagaagaaaacuucccuaaccuaaagaaagauaugaccaugaacauacaagaagccuacagaacuccaaauagacuggaccagaaaagaaauuccuccugucacccaacagucaaaacaucaagugcacuaaauaaagauagaauauuaaaagcagcaagggaaaaaggucaaguaacauauaaaggcagaccuauuagaauuacaccagacuucucaccagagacuaugaaagccaaaagauccuggacagauguuauauagacccuaagagaacacaaaugccaguccaggcuacuauacccagcaaaacucuuaauuaccauagauagagaaaccaaaguauuccacgacaaaaccaaauucauacacuaucuuaccacgaauccagcccuucaaaggauaauaaagggaaaacaccaacacaaggauggaaccuacacccuagaaaaagcaagaaaguaauccaacaaaccuaaaagaagacagacacaagaacagaaucccagcucuaacaaaaaaaaaaaaauaacaggaagcaacaauuacuuuuccuuaauaucucuuaauaucaauggacucaauuccccaauaaaaagacauagacuaacagacuggcuacacaaagaagacccaacucuuuucugcuuacaggaaacucaccucagggaaauagacagacacuaccucagagugaagggcuggaaaacaauuuuccaagcaaaugguccgaagaaacaaucuggaguagcuauucuaauauugaauaaaauugacuuccaacccaagguuauuaaaaaacacaaggagaggcacuucauacucaucaaagauaaaaucuaccaggaugaacucuuaguccugaauaugcuccaaaugcaagggcagccacauucauuaaagaaacuuuaguaaagcucaaagcacacauugcaccucauacaauaauagugggagaauucaacauccuacucucaucaauggagagauccuggaaacagaaacuaaacagagacauauggacacuaacagaaguuaugaaacaaauggauuuagcagacaaaaggauguaccuucuuagcaccuuaugguaccuucuccaaaauugaccauguaauuggucacaaaacaggccugaccagauaaaaauauugaaauuaucccaugcauccuaucagaucaccauggacuaaggcugaucuucaauaacaacagaaauaauacaaagccaacauucacguggaagcugaacaacacuccauucaaugauaacuuggguaaggaagaaauaaagaaagaaauuaaagacuuuuuagaguuuaaugaaaugaaaccacaacauacccaaacuugugggacacaaugaaaacauuccugagagaaaaacucauaucugagugccuccaaaaaagaaacuagagagagcauacacuagcagcuugacagcacaccuaaaagcucuagaacaaaaggaagcaaauucaccaaagaggaguagauggcaggaaagaaucaaacucagggcugaaaucaaccaaguggaaacaaaaccaacuauucaaagaaucacucaaaccaggagcugguucuuugagaaaacaagauagauaaacccuuagccagacuaauuagaaggcacagggacaguauccuaauuaacaaaaucagaaaugaaaaaggagacauagaacagaacaugaggaaauccaaagcaucaucagauccuacuacaaagggcuauacucaacaaacuagaaaauauggaugaaauggacaaauuccuaaacagauaccagguaccaaaauuaaaucaggaucagauuaauaauguaaacaguuccauagccccuaaagaaauagaagcagccaucaauagucucccaaccaaagaaagcccaggaccagauggguucaguacagaguucuaucagaccuucaaagaagaccuaauucccauucuucucaaacuguucuaaaaaauagaaacagaagguacucuacacaauucauucuaugaagccacaauuacucugauaccuaaaccacauaaagauccaacaaagagaacuucagaccaauuucccuuaugaauaucaaugcaaaaauacucaauaaaauccucgcaaacuggauccuagaacacaucaaaaugaucauccaucaugaucaaguaggcuucauuccagggaugcagggaugguuuaauauauguaaaucuaccaacguaauccacuauauaaacaaacucaaagacaaaaaccacaugaucaucucguuagaugcugagaaagcauuugaaaaguccaacacccauucaugauaaaagucuuggaaagaucaggaauucaaggcccauacuuaaacauaauaauagcaaucaauauacaacaaaccaguagccaacaucaaacuaaaugcagagaaacucaaagcaacaccacuagaaucagggacuagacaaggcugcccacuuucucccuacauacucaauuuaguacuugaaauccuagcuagagcaauucgaaaacaaaaggagaucaaggggauacaaauuggaaaggaagaagucaaaauaucacuauuugcagaugauaugauaguauauauaaaugaccugaaaaauuccaacagggaacuccuaaacuugauaaaaagcuucagugaaguagcuggauauaaaauuaacucaaacaaaucugugaccuuucucuacacaggauaaacaggccaagaaagaaauuagggaaacaacacccuucacaauagucacaauauaaaaugccuugguguaacucuaacucaggaaaugaaagaucuuuaugauaagaccuucaagucucugaagaaagaaauugaagaagaucucagaagauggaaagaucucccaugcucauggauuggcaggauuagcauagucaaaauggcuaucuuguugaaagaaaucuauagauucaaugcaauccucaucaaaauuccaaguuaauccuucauagaguuagaaagagcaauuugcaaauucaucuggaauaacaaaaaaaaccuaagauagcaaaaacuauucucaacaauaagagaaccucugggggaaucaccaugccugaccucaagguguacuacagagcaauugugauaaaaaaaaaaaaaaaaaaaaaaaaaaaaaacugcaugguacugguacagugacagucagguagaucaauggaauagaauuaaagacccaguaaugaacccacacaccuauggucacuugaucuuugacaaaggagcuaaaacuguccaguggaaagaagacagcaccuucaacaaauggugcugggucaauuggugguuagcauauagaagauugcgaauugauccauucuuaucuccuuguacaaagcucaagucuaaguggaucaaggaacuccccauaaaccagagacucugcaacuuauagaggagaaagugggaaaaagccucaaagauacgggcacaggggagauuuuuuugaacagaacagcaauugcuugugcuuuaagauugagaauugacaaaugagaccucauaaaauuucgaagcuucuguaaggcaaaagacaccgucaguaagacaagaaggccaccaacagauugggaaaggaucuuuaccaauuuuaaaucagauaggggacuaauauccaauauauauaaggaacccaagaagcuggacuuuagaaaaucaaguaacccuauuuaaaaaugggguacagagcuaaacaaagaauucucaccugaggaauaccgaauggcugagaagcaccugaaaaaaaauguucaacaucuucaaucaucagggaaaugcaaaucaaaacaacccugagauuccaccucacaccagucagaauggcuaagauaaaaaauucaggugacaucagaugcuggcgaagauguggagaaaaaagaacacucuuccauuucuggugggauugcaagguuguacagccacucuagaaaucugucuggcaguuccucagaaaauuggacauaguacuaccagaagauccagcaguaccucuccugggcagaagauguuccagcuuguaacaaggacacaugcuccaguauguucauagcagccuuauuuauaauaucuagaagcuggaaagaacccacauuuccuucaaaagaggaauggauacaauggaguacuacuccaauaaugaaaaacaaugaauuuaugaaaaucuuaggcaaauggauguaucuggaggauaucauccugagugagguaauccaaucacaaaagaacacacaugauaugcacucaaugauaaguggauaguagcccagaaacuuagacuacccaagauacaauuuaccaaacucaugaaacucaagaagaagaaagaccaaaauguauauacuuuguuccuucuuagaaugaggaacaaaguacccauggaaggaguuacagaaacaaaguucagagcugagacaguagaaaggaccauucagagacugccccaucuggggauccauccaauauacaaccaccaaauccagacagcauuucauaugucagcaagauuuuggugacaggacacuguuauagcucucucuugugaggcuaugccagugccuggcaaauacagaaguggauacucaaaucauccauuggauggaacacaggaccccuaaagaaggagcuagagaaaguuaccaaggaccuaaaggggucagcaacccuauaggaggaucaacuauaugaacuaaccaguacccccacagaacugugucucuguuugcauauguagcagaggauggucuagucugccuuuaaugggaggagaggcccuaggucuugagaagaucauaugucccaguacaggggaaugcuagggccaggaagcgggaguggguggguugggaaggaggguggggugagcguauaggggacuuuggggaaaacauuugaaauguaaaugaaguaaauaucuaguaaaaauguauucaaaaauaaagcauuaguaaaaaguguaggcuuauauuuuucaagaucaaauuaguguacuuaaauguuacaaccuuucuucuagcccaccauccaccuaauaggguaaaggaggguguggaacuauuucgaaauaguucuuuguagugaauccaaucuucauuaucagaguaucagccccucaguuaacacaaaucagcagcaguagcucgaccgauucauaaacaccauuuacgagucagcaaugggaguuugauccagaagaaaccaugaggcucugccaauuguccugaggucaugaaagcagcaagaagcugcuggaauaccaccaccaaaaguucuuuggugcauuucucucuaugaagucaugacaaacaaugaguggcaaggcaaaccaauaccauacagcaucgucaguaaagaucagugucagcaaaguccagcaaaguguggcaaggugaaccaauaccacacagugucauccacugucuguugguuauauuuauacccuuuccaaacaucacauguuuucucaagugucugcuuuagcaaaacauuacauggcuccuuuucaggcagcuuccagaaaaauauaauguguguguucucagcaaaacaucuuccuacaugucugcuucaccaaaaaacauuuucauaagaucguuuccccaccggccccccaaaaaaucacaugacacaacugaaucuccaaagaaaccaaagaauuuuacuucauaucccccuuucuguuuaaaaacuugccuuuuaaaaacaauauuaaucuagacacaauagaaacaauaagaaccauaaaacuagaacuuuacauaacaccuuaaacagcuuauguauagucuaacaaaacaaccuuaaauuucuaucaauauacaauaauuaagcaaaacaaccuuaaauuuuuauugauguacaguaauccaguaaagcaaccuuaaauuuuauagaacuauaugacuuacaaaaauuaaacugagauuagguaaauaauuuuaaaagacaagcaacgagauugauuagaaagagaggcccauuggucuugcaaacuuuagaugcuucaguacaggggaacgcuagggccaagaaguggaaguggguggguaggggaguggggguggaugguaugugggacuuuugggauagcauuggaaauguaaaugaagaaaauaccuaauaaaaaaauuaauuuuuuugucaauauacaacaauuaaacaaaauaaccuacccuccuagauaauaauaaccauaacacauuaaaugaccaaaaccauccaccccaauguaagggaucaggacaaugguucuuuucuauauaauuucuguuugcuaaauuggagugauuaguuuuugcuuggaaccagagggggugggaaugguuaguuuuuaaaaagcuagcuguagcauuuauugccuaguuucugcauuauuagucugucaaaucucugugauugaucauuugggcuagccauuuugaaguugauuugcauacauauuuuggagaaauuaguaauugagacagucugugagaggaauucaccugggcuguuugcuuugugaagacguucaugucucagcugauaagagguuuuaccuggucagaucuaaauuuuaaaaguuuuguugguaaccauauuuucucauucccucuagauacacaaacauaaccaugucccaucuuaaaacuugcagguuuccacucuaaugucagcacaucuuuauaguauauugucuggcuuaguuccucaguuuuguuguuguuguuuuguuuuguuuuugauaacccagucuuucucagcugcuguugcuccuuuuucaccaacauuaagaaaauuuaguuaacaaaguugucucucccuguggguuuuucucucccuuuuuguuuaauaagcaucucuuuuaagguaagauugguucuuucuauaacugcuuguccugugguauuaugugauaguccaguaaucugguuuauauuguaguaugcaaaaaauuacuucaucuuauuggauacguaugcaggagcauugccagguuuaauuuauacagguaucccuauaauugccauuauuuccuguugagagcugucccgcggcucacauggacugggguuacuccugggaggcaaacuagugcagaaaagacagaaacuaggcaguugaaagaaaaauggaacccaagacaagguuccugaucaaagcucaaauguuuaacaaaaaucuacgcuuauaaaggggguaaacccauccccugccacgccaaguuucuugauguugugaugccaaguugucagcacagccuuuuagcaguaagucgacaauuucacagguugcaguuaacucaggaaaaucuaggaggaccuagauuuucagcaggugguaggcagugucacaucaaaggaaaccaacugaagagcugcacuacagguggccccgccucagugccauaaggucugaaccagccugcuuuaggcuggaggauguuacaauuuccaguaaaccuguaauuacacagucagccuuuuucagaacuuagagcacuugcccauugaaaccugaaguauguaaaauggaaaacaaccaucuacccaaugcuauucuuuugguauccccuaggguuuuaucagcagguaauagaguuugauuauauagagaacauguaggaaauuuuuauuauuuuucggcuuguugucaagugauggaaauguuuuaaaccguuuuuuuaaagaaaaacuucuuaaaaauuaauguuuuucaugaaaauuguaggcuuauaacuuuuuuguaauuggucacuuuuuugagcuaauguacugggcaaaccuguaugagaccaaauauaaguaauguauaauagauaguuuuuacuucagauggcuuguuguaauuguauaaauaacaaaauuguuuuugaguuaucagguacaaauuuaguaaucucuauauugaaaaaauauaaaagcaaaauucuaggcuuuuaggcccaggcuugggaaugugaccucuguaacucaaugcuccaagguaugcuaaucauaaaacagauagcgacauuccuccacccaccugcuuccuggguucaaagaguguucauucaaagaaagucacccugccccacccagaccauugcuggaacccgcuaugcaaaugugcuauuguuaggggcucuuagaaacugucuugagagauaacccgaacaauuaccagguauucuuugugacucuugugacuuugcacuucuuugugacucuuaacugguaucuuugguauuuuccaacaagcccuccccacuuccuugaauugugguuucuuccuuuaaauacccccuuacccagcuacuuggggcgccaggguccucuaccccugcaugguguaggaccauaggcccgagaacgcucuugaauuaaaaguccucuugcaguuugcagcaagaccguuucucgugagugauuugggguguugccucuccugagucagaacgugggcgaguccucacauugugggucuuucaauaugaagaaugacucuuuuugcauauaaacgauuaguaauuauuuuaagagauucaagauaaauuaauaauacuuuaaggaaugcauauaauuuugauuuuucaacugauguuuauggacuuuugaucaccuugcuuauuuuaucugauuuacaaccugucauccccauuuuguuuguaucacuauaaaauguuggugccucuggaauugguguuuucuuuuuuuucuuuuuacaauauguagaagaauuuaauuuguuuuuaaaauacacuguauacauuugcuuuuugaauauuuguuaguaauuuuacccaaguaguugcuacaagcucuuugucaauuuuuauugaucacccauaaugacauaaucuuaucauuuguaagaggaacuaaaauuuugguuggauuuguugcugacaauuguucuaauuuuauuuuacuuuuauuuuuuaaaguuuauucuuuuaauuagguauuuucuucauuuacauuucaaaugcuaucccaaaagucccccagacaccucccccccccccacuccccugcccacccacucccacuucuuggcccuggcuuuccccuguacugaggcauauaaaguuugcuagaccaaagggccuuucuucccaaugauggcugacuaggccaacuucugauacauaugcagcuagagacacgagcucaggggguacugguuaguucauauuguuuuuccaccuauaggguugccgaccacuuuagcuccuuggguacuuucucuagcuccuccauugggggcucagcuccauuagcugacugugagcuuccacuucuguguuugccaggccccggcauaccucacaagagacagcuauaucagggucuuuucagcaaaauauuguugguguaugcaauggugucagcguuuggaggcugauuaugggauggauccccagauauggcagucucuagaugguccauccuuucgucuuagauccaaacugucucuguaacuccucccauggguguuuuguucccaauucuaagaagggagaaaguguccacacuuuggucuucguucuuauugaguuucauauguuuugcaaauuguaucuuguaucuuggguauucuaaguuucugggcuaauauccacuuaucaguggguacauauugugugaguucuuuugugauuggguuaccucacucaggaugauacccugcagguccauccauuuguguaggaauuucauaaauucauucuuuuuaauaacaggauaguacuccauuguguaaauauaccacaucuucuguauccauuccucuguugaggggcaucuggguucuuuccagcuucuggcuauuauaaauaagacugcuaugaacauaguggagcauguguccuucuuaccaguuggaacaucuucuggauauauacccaggaaaguuauugcaggauccucugguaguacuauguccaauuuucugagguacugccagacugacuuccagaguuguuguacaagcuugcaaucccaccaacaauggaggaguguuucucuuucuccacauccuugccagcaucugcugucaccugaauuuuuuaucuuagccauucugacuggugugagguggaaucucaggguuguuuugauuugcauuucucugaugauuaaggauguugaacauuuuuucagguguuucucagccauucgguauuccucaggugagaauucuuuguuuagcucugagccccauuuuuuaaugggguuauuuaauuuucuggaguccaccuucuugaguucuuuauauauauuggauauuaguccccuaucugauuuaggauugguuauuuuacuuuuagaauuaaucuuuuucauauaugucuuuaauuuuuuauuuuauuuaugaccuaagaaaauuuauuguacuaucuuuucuuuguauagugaacccaguaggagaaugaguugaagguaacauuaccagaacauaauuaaauuuaggauuaauuuuauccacauaugccucuugcaguuuuuguuuuauuaaaguuaaucuuuuuuuuuuuuuuuuuuuuuuuuuuuuuugcuuuagcuauuaaacaucuuggauuguuuuaauuugacucuccuuuuaauguuugaaacaaauuauuuaacucauguauauuuaaucuaauuguagacuucagccaguuaauaucucccacuaauuuuugaaaaucauuaagaguuugcaguuuaucccuaugacuguguacuuuuuguggucuauuuuuuuuugagcauuuuuucuguauuuuuuugaguaaucuauaacccccagcaugggagaauuuuuguguuuguuuuuuuuuuuucaguaaaaaguuaaucuuuuauuauuugcagauugcacaaccuucauauuaguauauaauuguaaacuuauaauuccaaaauccuauagucuuuucauuauuaauaaugauccaaagucuaguuaguucuguccauauguauaugacuaucagcuggggcaugagcaaucuacuaaugaacgaaauagaguaacucuccuucaauaccaucagcuucugaccacuuaucccagagaggaaggcccucaaggccaucccucuucaaugauggaauugucauuggcuuuaucuugugcagaucuuauacaagaaauuacagauccugugagguggauugugcagcaguuaugucauguccagaauucagaaucuuacaguuuuuuccucauccacaagcucuuuuauuuuuuucuguccccucuuacacaaaguuacuauuccauagauagauacaccugacccauuuauauucuuauacuauuauugagaaugauuauaguugugaauguuauuugauaaguuucaguguuacuuuuuaaauuuaauuauuuuacuuuuuacuuacucacuuuauaucccacuuacuucucccugccccccaacccgcucaccacuuuccacaauccuuccccccauaccuccucccauuuuccucugagugguuuggggccccuuggauauccucccacccuggcacugcaaguuucugggaggauagggcuuccucuuccacugaggccagacaaggcagcccagcuaaaagaaugcaucccacaacaggcaacagcuuuugggauagugccugcuccaguuguucagaacccagaugaagaccaagcugcauaucuacuacauaugugcuggcgggggcggggguguguguuaguuccagcccagcccguguaugcucauugguugaugguucagucucugagagcccuaaggguccaugucaguugacucuguuguuuuuucuguggaguuccuauuccuuugugggguggcuuucuccuauucuuccauaagaguccccuaacuguauccacuguuuggcugugggugucugucugcauuucucugaguuaacugguggauggagacccucagaagacagccaugcuagauuucugucugcaagcauaacagaguaucauuaauaaugucaagauugguacuugcccaugggauggaucucaaguugggccaguuuuugguuggccauucccuuggucucugcuccaucuccaugccuguguaucuugaauacaagauaaauuuuggguugaaaguuuuuugagugaguuaguguuucuauugcuucacugggguuucugccuggcuacagaagguggccucuucagguucuauauccccaaaauugugagucacagcugaggucauccucauugauuuuugugugucucucuuauuucaggccucuggcauguccacaagaugcucccccccuuccccaacacuaucucuguuauggaguugcagaucuccauugauucucauggccaccuggccaucucuucugccccuccacaccugauccuaaacccccucauuucccucucauuccuucucccucucaucccuucuccuuccaucugccucuuacgacuauuuuauuuauucccccucuaaguaagauucaagcaucuuuguuugugcuuuccuucuuguuuagcuucuuugggucuguggaguguaucauggguauccuguauuucauggcuaauacccacuuacaaguuaguacauaccaugcauguccuuuuggcacuggguuaccucacucagaugauauuuucaaguuccauccauuugcuugcaaaauucaugcucccaugugcaaauaauguuuccccaacgcucucagaccaaaccaguuagaaguaccuguugucagacccuuacccaccccaaaauuguguauaagaaucccaucaggaaggaugaaggggugugagaacuacucugucguccaagcauuuuguccuaagagcuguaacacuugggaagaggucugcucuucugaagcgccaccugaguuucugccacacucuucacugacuaguugaccucucauuggcccagccugacccaacucagugcagggugucacagauggaaggcaagguagagguggagguggagccaaccacugcagcagaagugaggaagcaacuuccccucccugcccgcacucacuucccuucacuggaacccuagccccaggccuagccagagaucuccguggaaagccacugggacucaggccaacaggcuauuaccaauaaaacugcuaugaacauaguugagcaagugucuuucugggauacuggagcaucuuuuggguauaugcccaggaauggaguagcugagucuugagguagaacuauccuguuuucugagaaacugccaaguugauuuccaaagagguugucuaaguuuguauucccaccagcaauggaggaguguucccuuuacuccacauccucaccaguaugugcuaucucuugaguuuuugaucauagcuauuccgauguguguaagguggaaucucugauuuguuuugauuuguauuucucuggugccuaaggaauuugaacauuucuuuaaguguuuuuuggccauucagguuucuucuguugagaauucuguuuagcuuugugugcccccccccccuuuuaaaacuuggguuauuugggaugcugguaucuaacuuuccgaguucuuuguaaauuuuggauauuagcccuuagucagauguagaguuggugaagauccuuuuccagucuguagguugccauuuuguucuauugacaguauccuuugcauuacaggaacuguaguuuuaugagguccccuuuuucaauuguugaucuuaaagccugagccauugguguucuauucaguaaauugucuucuguaccaguguguucaaggguauuucccacuuucucuuuuaugcgauuuaguguauccaguuucauguugaggacuugaguuuuaugcagggugauaaauaugaaucuauuuguauuccucuacauguaagaccagucaaaucagcauuuguugaagauacuuucuuucuuccauuguauggguuuuuuuuucuuuaauaaaaaaaucaaguguccauauguauguggauuuauuucugggucaucaauuccauugaucaacaugucaguguaccaauaccauacaguuugguuuuuuuguuuuguuuuguuuuguuuuguuuuguuuuguuuuguuuuuaaucacuccugcucuguagugcagcuugaggucagggauggugauuccuccagaaguucuuuuauuauuuaggaauguuuugguuauccugaguuuuguuuuuucuuuaagaaguugaguauuucucuuucaaggucuauagaaaauuguguuggaauuuggauggguauugcauugauuauguagauugcuuuugguaagauggccauuuucauuauguuaauccuagcuauccaugaccaugggaggucuuuucaucuuaugauaucuucuaaaauuuauuucuucagggacuugagguuuuugucauacagaccuuucacuugcuugguuaaaguuaaaccaagauauuuuauauuauucuuggcuauuguaaaggguguuguuucucuaauuuuuuuuuucuuggcccauucaucauuuguauaaaggaggguuuuuuaaaccauaguuguuggaguuugccaacaaagugucauccauauaaugauaaaugauagcuuaugaauuauuuuuaaugguuguugaauaaaauauugacauaaaguuggacuauuuaaaauuuucuguggaaguacauuuuaaugguauuuuuuuuauuggaccauuauuaucuggguagguauugagaaagcaauccuuuuucuaucuuguucaugcagggguauugugaaaaaaguaauuuuuaaaaucaauuauuauuauuggccaugaucuugcuaacacaggauaaaggaaaucuaggcuauaaaggacccauugguugaauuauuguauuaaacccucuuaacucuguuaucaucacacccccccacacuuuuuuuuuuuuuuuauuaaccaucauaggggaaauuugugggcuggaauauucuuauauguugagauuccagcuguucuuguaccaguuguuuaauugccuacaauuuuuuuuguuguuguuguuaugggcuguugcucuugcaauauaggucuguuugauaaccauuuuaggggcaaggcugaugguauguuagcaaugacuccuuuuauaaauauggaaacuccaucccugugauaucucauuguuuuuuuuuuguuguuguuguuguuuuuuuuuauagugagcacaguuugugacuguuuuuaguuacccauaucaauaccuuccccaggaguauuuaccauaucaucccuaauuuaaucauuugcuguuccuuuuaauugaaugaauacuaauuugaguacuuuguuguuguaaaagauccuuucuccauaaguuuaugggcaugucagccauauuaacucucaauguuucuguuugcccuucugguuccacacagguaaucaauccaaauuaugcuaucauuagauuguauuuguucuuguaagacagcauaaugcccuucaccaaucaacuggucuugaguaacuuuuaucuuccuugcuaaaugguuuguuuguuuguuuaugccuccaccaugacaaccauuuuaacaacugugcagcuuuuaguagagcugacaacagucuccuucuaaucuugggggauaacccuaugcugcauagcccaguuauuuaggauuucuuuaacaaauggagaaugcaagcuauacgauacaauaguauuguauacucuuuuaaaugcuuuaaagguaacauuucuauuggauacaagaucaguuaauuauaagcauggccaaaugugcuggcaaggugaaugugccuguguagccccaggcaaauacucuggugguacacuugagagaccccauugagucugcacuaccuccugcucuuccuaguucuugucucacacacagaggugcuuuggaugccuagcagugaaagugcauggagcagagugggaugucaccaguuuacuuuccagcuuggcuugcuucccacuuuuaucaugcaguaaauuucaugucucaagcaucaguccugaauccuguuguuuuccucccauuggcucuuuuuguuuuccaagcacuuccaccucuaucugcaaacucuguaagugcauagccaacucuucagucuucucuaacagaagagaauugucagcuuccuccuaaacuuuuucaaaauaauauacaugaaaacuaugaagcaaaauaaaaaacucugagaacaagauaggagacagccuagugguagcagcuucuauuuugccaaccuccuuuuacuggcugguuuugugucaauuugacacaggcuggggugaucacagagaaaggagcuucagauggggaaaugccuccaugcuauccagcugugggguauuuucucaauuagugauaagggggaaaggccccuugugggugggaccaucucugggcuggcagucuuggguuuuauaagagagcaggccgagcaagccaggagaagcaagccagcaaugaacaucccuccauggccucugcaucagcuccugcuuccuuaucugcuugaauuccaguccugacuuccugaugaacagcaguauggaaguguaagcugaauaaacccuuuccuccccaacuugcuucuuggucaugauguuugugcaggaauagaaacccugacuaagacacuccuuaaacaacauugcuaacccaucaaaaccugucauuuuucuaguauguuaguagcagaauuaccuauaauuccuaagccacguugggcaccaccccuaguuuuauauuuuccaaaaccuaauuuaauagauauauuuaaaugcucuaaccuuccuucuagcccaccacccaccagaaguaaugaaaagacuaauagagaaaaggaggauguggaccuguuuaaaaauaauucuuugaggugaauccaaucuguaucgucaggauaucaguaguucaguucacacaaguuagcagcaguagcucaauccacuugcaaacaccauucaugagucagcagugacacuuugauccagaagaaaccacuaggcucugcccaucagccugagucuguugaagcagcaagcagcuauuggaacaccaccaaauuucuuugaggcauuucucucuaugaagucaugacaaacaauggucagccaagaguggcaaagccauuuagcacgucaacaaaagaccagcaucaguaaagcccaacaaagaccagcaaagaguggcaaggugaaccaauaccacacagugucauccacugucuauuggguuauauuuauacccuuuucaaacaucacauauuuucucaagugucugcucuagcaaaacauuacaugguuucuuuucaggcaguuuccagaaaaauaccacguguguguucucagcaaagcaucuucccaugugucugcuucagcaaaaacauuaacucauaagauaguucuccuuucccugcccccuccaaaaaaacaaucacauggcacaacucagucuccaaagaaaccaacaaauuucacuucaaaauaguaucacaguuucuguugggucuauuccuguuaauugacaaagucucauuuuuuuucuuucagaaucaauucagaaacuuuucuacauaguuuugaaaucuuuuccucugugugcuagacauauccuuucuaagauauacugucucugcauaagaauucuugugagagaaugaguauaaaccaaaauaauuaaaacagaguccagcuuuagauccaaaugguccacauguggacccuguaauuucuuuccuaccagauucgauucucacucagccucagaugguaauuugguaggaauauuuuaguccuuaucacuuuguaagguuugaaauaaauuacuuagcucuugauuaguuaauucuaauugugaucuuuaaccaauuaaucucucccaacaauuuuugaaaaccaugaagaguucucaguugguaucuucugauuaguauuuucugugguugaauuuuuuuccagacuucucauauauccuagauugaaguggaaauuucugguuucuuuggagagugagugugucacaugauuuuuuuuguaaaaugucuuaugagacgaugguuuugcucaagcagacaugugguaggauguuuggcugagaacagacaugugguuuuuuuggaagcugucuagaagaagggcaugugauguuuugcuagacuggaugcuugagagaacaugugauguuuggaaaagauagaaguauaacccagugaacaaugaaugacacugugugauaauaguuucccuuaccacucuuugcuggucuucauugggcuuuacugaugcuggucuucauaaguuugacuugugucuuaggguuuuacugcuaugaacagacaccaugacaaggcaaguuuuauaaaggacaacauuuaacugggucuggcuuucaggaucagaggcuuaguccaguaucaucaaggugggaacauggcagcauccaggcaggcaugauacaggaggagaugagaguucuauaucuucaucugaagguugcuaguggaagacugaguuucagguagcuaggguaagggucuuaagcccacacccacagugacacaccuacuccaacaaggccagaccuucuaauagugccagucccuggccugagcauauacaaaccaucacaccuugcuuucuucuaucauuaucaugugguaugacuuauuagagagaaacacaccaaagaacuucugguguuccaguggcuucuuucugcuuccauggacucaggcugauuggcagacucuugugguuucuucuggauugaacuuccauugcaaauucaugagugauguuugugaguggaucaccacugcugauuuguaugaacugagcugcugauauccugauaaugaagauuggauucaccccaaagaaguauuucuaaacagguccacauucuccuuugcccuauuaaccuuuccuuucccuuaccucuggugggcugugggcuaaagagagguuaaagcauuuaaguacacuuauuaaaguagguuuugaaaaauauagcuggguguggugaugcacgccuuuaaucccagcacucaggaggcagaggcaggcggauuucugaguucgaggccagccuggucuacaaaguugaguuccaggauagccagagccauacagagaaacccugucucgaaaaacaaaaagaaaaacaaaaaagaaagaaagaaaaaagaaaaaauaagccuaccauauacagcaagccaauagccaacaucaaauuaaaugggaagaaguuuaacccaauuccaucaaugucaagaagaagguaaggcugucacucucuccauaucucuucaguauaguacuucaaguucuagcuaaagcaauaagacacuaaaugaaaucaaggggguuuaaaugggaacagaagaugucaagguaucacuauuugcaggugauaugauaguauacauaagugaccacaaaaccuuuaccaaagaacuccuacugcugauaaacaccuucagcaaagugguuggaugcaaaauuaacuacaaaagaucaguaacccuccuuuguacaaaugauaaacaggcugcgaaagauaucagggagacaacacccuuuauaauagccacaaauaauauaaaauauauggauguaacucuauccaaagaagugaaagaucuguaugacaagaacuucaagucucugaagaaauaaauguuagaagaugucagaagaugaaaagaucugccaugcucauguauugguagaauuagccuacugaaaauggccaucuuaccaaaagcaauauacaaauuaaauucaauucccaucaaaauuccaaaacaauuauuuacaaaccuucaaggacaauuuucaacuuuauaugggaaaaaaaaaaucccaggauagcuaaacaauccuguacaacaaaagacugucuguuuugguuuuuguuguuguuuuguuuuucuuuuucuucuuuuuuuuauuuuuuauuuuuuuuuuauuuugagacaggauuucucuguauagcccuggcuguccuggaacucacucuguagaccaggcuggccucuaacucagaaaacugccugccucugccuccugagugcugggauuaaaggcaugcgccaccacgcccagccccaaaagaacuucuggaguuaucaccuuacaaauaucuuagaaaaauguuuaaugaauagagagaaucuuaccuuguuggggauuacaaauugcuccggaaaagauacaaagagauacucuauuaauuucuacgauauaagguaauuuguaggaaauuagaccacagaagguacaaucaggagagaccgauuaagaacuguuaaugauuuugaaaaguuguugagagauauuaacuggcuaaaguugauaaguguaauaacuacucaagagcuaaguaauucauuucaaaccuuauauaaugauaaagaacuaaauaguucaagaaaauuaucagcugaggcugaagaggaauuggcucuauuaaaagagaaacuacaugaugcacauauagaugguaauguuccaaaaguggccuguaaauuaguuauauagccuucuagucauucuccugcaagaauucuuauguagugagaaaauagugucuucaaauagauauuuuuagcacaccgaguaaaaaaaaaaauuaaagaccuauauagaaaaggcuuuugaaagucuggagcaagacacaggacagccaagguuaggcaacgaaggaguuggaaaaaaggaagcuaaugauaguauaauagaacaagagggcugcguuccagcuccuauaagcagcagaauuuaacagcuucagccauaugucucuggcuuuauauucaagaggagaaggagacuacuggaacaauugaugcugguuagcuggagcuaagacauuaguggugaauaaaaagggaccaccaugacugaggugaaauaucaaagaagcuauuuuccagauauagccaagguuguacuucaugcugcauuuguauuugguaauauguaagagccacccuaugguacugguuguaaagucacgaagccaacaugaacaacagcggaggcucgguaguauaagaggccaugaaaggccauuggugaaggugcagccccaguugacaguugcaguugacagcuaaagacugaaggagugaacuguaaaaaaauaaaaguuauaaauuguaauaauaaaaaacuaugguaaaaaaagaaaaagaaaagacuucugaauucauugagacuucauuaaucauuucuucauuaagaaacagacccagcagagauugcgauuccuuuuacuaaugcugacgacugccuuauuaugggcagaaaaugaaaauuagcaaugggcuugaagugauuuuuuuggcagaguaacaacacaagcaagugauuucaauuuauaaaaaagaacuaauaggauuaucccuuauacaguaaguacagugaaagagauuccaauuucuggagccucuauauuuuauacuuuugcgaauaaaucaugaaaugcagguuauaagucagaaaaguuaaguaaaauaauucaaagucccuaugauucaguuuuauaaaaaaucagaguuuaugcaauucuuauggcauuauuagauuuuccaaaaucuuuuaauauagcacugacuguuuuugguuuuuguuuguuuguuuguuuguuuguuuuuuccuuugguuuuuucgaaacaggguuucacuguguagcucuggcuguccuggaaaucacauuguagaccaggcuggccucgaacucagaaacccucuugccucugucucccaagugcugggauuaaaggugugcacugccaccgcccgguugguuuuggcucuuaagaugcaguaggaguuguuuugcauagaaacugcugaacugauucuggaugauugggaauuaacuuuucuguuuauuaaacuauaacuaguaaucagaaauagaaauuauucauuguauauaacacauaguagaucccaugugggucuaccaggcccucuaguacaagguaauaaugaaauugaucaacuauuaauaagaaauguguuagaaacuucagaauuucacaagaagcaccauauuaacaggaaagcuuuaaaaggagauuuuucuuucacuuggcaacaagccaggaaauuauaagaaaauguucuauuuguucuuuauguaaucaaacaucauuaccugcagggaguaacccuaaaguuaccuaaagaaauaaaauuuugcaaauguauguguuucauuuugccaaguuuggaaaauuaaaagcauguagguacauauuuuagaucuauagcauaguauuucaaugggaacugcuuuaacuucugaaauuguugauuuaguauuuacacauuuaucagaaguuaugucaauuauuggagagaaagguauggcaugaaagcacggguuugucugaugugcacaacaaaggcaguggaggauuugaagcauggggcuggugugguaacgaccagccagugggaaccuagcgagcuggguggagagauuuugcaguucugagucaguguccaugaaauaaaaacagaucggccauugcccaccaggccaccagggcagagaguugccaucacaagugcaggaacuugcugcuuuugguuuuuugcuuuuuguguuuuuguuuguuuguuuuuucuuuugguuggcagacuuuuaaugacugcuucuauuccuuuagggguuuugguacuguuuagaugguuuaucugauccugauuuaacuuuggucuuugguaucuguuuagaaaacuguccauuucauccagauuuuccaguuuuguugaguauaggcuuuuguaguaggaucugaugauguuuugaauuuccucaguuucuguuauuucccuuucacuucugauuuuguuaauuuggauacugucucuguguccucuuguuagucagacuaaggguuuaucugucuuguugauuuucucaaagaaccagcuccuuguuugguugauucuuuguauaguuuguuuuguuuguuuguuuguuucuacuugguugauuucagcccuguguuugauuauuuccugccaucuacucuucuuggguguacuugcuucuuuuuguucuagagcuuucaggugugcuguuaagcugguaguguaagcucucuccaguuucuuuuuggaggcacucagagcuaugaguuuuccucuuaggacugcuuucauuguaucccauaaguuuggauauguuguaucuuuauuuucauuaaguucuaaaaagccuuuaauuucuuucuuuauuucuuccuugcccaaguuaucauugaagggaguguuguucagcuuccauguuuaugugggauuucuguuguuuuuguuauuauuaaagaccugccauaauccauauugauuugauaggauguaguuucccaucuuguguuguuauuuuccauuuauuauccuuuguagggcuggauuuguggaaagauauuguuuaaauuugccacaccaucuccaguaggaucucugugacaaguuccacagauagagggguugacuucaaaagggggaggccuccuggaacuggucguggaacuauuugccaaaggaaaaaaaaauauugagccgucguucucauggcaaucuaucuguuuuguuuucucuuauuccuuuucuuauuuacauguuccugguagccuaggccaagaucuuaaaugagaauaauggguaagaaaccauuccuugagaugggggucacuaauaugaccuuaucccuggggaaaccaaugcuuuacuuuugaaaucauuuacaagacuauuaugauagauaaaaacuuucccaacaauaaaauuccauaucaguggagguggguuuugguauaugguaaagaaagacuuaauuaaaaagaauaagaauagcuuaaauuuaaacauugaagauuuauuaaaaaaaucagguacuagauauuaaguaauaauugaccauggggcuggagaguuagcucagugauuaagaguacugacuauaaaaauuuauuaacuugcucuuggaaauaugucacuagccuuaaucgacugcccccagugaauacauccuuuuagaauuguuuuauuuuuaugauuuauaaugauguuaccuguucuguuugugauucacugaauacauaguuucagaguuguaauguuuggaucauuuuugugcuuuacugugccaaaugauuuuuuguugguauuugugauuguuuaacuggauauaguuucuaagugauguaauguuuguuuguuuguuuguuuguuuuuaauguauaaaacccccuucuugagagaugcaaaauacacucagauccaaacugccucuguguuuguuucuguuugucacugcagaauccuuacccacuuagcuuugaggacccuuauuccaggauuccccauacccaauugguguaaauuaguuuuuuguuuuuguuuuuuuuucauggaaugucuugguuucuacaucuaugguaguugugaguuuuucuggguauagucgucugggcuggaauuuguguucucuuaggugucuaugaaaucuucccaggaucuucuagcuuucauaguuucuguugaaaaaucugguguaauuuugauaggucgaccuuuauauguuauuugaccuuuucccuuuacugcuuuuaguauuuuuucuuuguuuugugcuuugauguuuugacuauuauaugacaggaggaauuucuuuucugguccagucuauuuuggaguccuguaggcuucuugcaucuuuaugugcaucucuuucuuuagguuagggaaguuuucuucuauuauuuuguugaagguauuuacuugcccuuuaaguugggaaucuucauucuuuuguauaccuauuauucuuagguuuggucuucuuauuguguccuggaaucccuggagguuuuuggcuaggagcuuuuugcauuucacauuuucuuugacuauuuugucaauguuuuguaugguuucuccugccccugagauucucucuucaaucucuugcauucuguugguugaugcuugcaucucugacuccugaucucucuccuagguucucuaucuccagaguugucucccuuugugauuucuuuguuguuucuauuuccauuuuuauauccuagaugguuuuguucaauuccuucaccuguuugguuggguuuuucuguauuucuuuaagggaguuuucuguuuccucuuuaagggcuuuaagcaauuuaccuguguucuguauuucuuuccuuuuuuuuuuuuuaaagauuauuuauuauuauauguaaguacacuguagcugucuuuagauacacuggaggagggcaucagaucucauugugaguguuugugagccaccaugugguugcugggauuugaacucaggaccuucggaagagcagucagugcucugacccacugaaccaucucuccagcuccucuccuguauuucuuuaagggaguuauuuauguccuuuuaaaagucuuguaucaucaucauaagaugugauuuuagaucaguguccauuuucuguuguguaucuagggcuugcuguggugggagaacuggguucugaugaugacaaguaacauuggcaucuguugcuuauauucauuccuuugccucuugccauuugguuaucucugguguuagcuggucuugcugucucuuacuguggcuuuucccuccuccaagccuguguaucaguaauucugggagaccaguucucuccuggaggaauuuggguauggagagcugugguacaggguuagcuccaggguguagacaguaaccagaaggauacuguccccugcugauccuugguuccuguauccugauggcucugagagggucccucuugggccaggaauuugaauagaagugguggucauaccugugcucauugggguguuggcauuccggggagacugguccucuccuagcaguauuugcauauguagugcuauggcacaagaucagcucugggcauagagggaaaccagaaggcuccuguuucaugcugcuccucaguugcuguguccugaggguuccuggugggucucucuuaguagcagugguagucuuaucugcagucacaggcuucucugcacucccaggaugcuagcucucucccagcaguauuuggguauugagugcuguggcacaggaucagcuacagaugcugugguacaagaucagcucugggcagagggaaacccuuauuauuuuugcaccaauauucuuaagagaaauuggucugaaguucucuuucuuuguugggucuuugugugguuuagguaucaauguaacugugacuuuauagaaggaauuagguaguguuccuuuuguuucuauuuuguggaauaguuugaagaguguugauauuaggucuucuuugaaggucugauagaauuuugcacuaaaaccauuugguccugggguuuuuuuuuuuuuggaagacuuuuaaugacugcuucuauuucuuuacgggugaugggacuggugaugguuuaucugauccugaguuagcuuuggaaccugguaucucucuaggaaaucauauauuucaucugcauuuucuaguuuuguugagcauagguuuuuguaguaggaccugauuuuuuuuuuuuuuuuuuaguuucuccaaauuuuguuguuaugucucucuuuucauuucugauuuuguuaauugggauaccgugucugugcccucugguuagucagacuaaggguuuaccuauccuguugauuuucucaaagaaccugcuucugguguuguugauucuuuguguuguucucuuuguuucuacuugguugauuucagccuaguguuugcuuguuuccugccauccacuccucuuggguuuauuugcuucuuuuuguucuagagcuuucaggugugcugucaagcggauaguguaugcucucuccaguucuuuauggagguacucagagcuauacauuuuccucuuagcacugcuuuugcugugucccauauauuuggguauguuuuaccuacauuuucauuaaguucuaaaaagucuuuaacuucuuucuuuauuucuucccugacuaaguuaucauugaguacaaaguuguucaguuuccaugaguaugugggauuucuguuguuuuuguuguuauugaagaucagcguaagugaauggugaucuaauuggauacaugggauuauuucaaucuuauuguauugguugaggcuuguuuuguauccuauuauaugaucaauuuuggagaagguaccaugagguccugagaagaagguauauucuuuuauuuuaggaugaaauguucuauagauaucuguuaaauccguuucauucauaacuucuguuaguuucacugugccucuguuuaguuucuguuuccaugaucuguccauuggugagagugggguguugaagucucccacuauuauuuugugagguuuaauucgugcuuugagcuuuaguaauguuuuuuuuuacaaauaugggugcccuugcguuuguggcauagauauucacauuugagaguuuaucuuaguagauuuuuccuuugaugaguaugaaguguccuuccucacuuuuuuuuuuuuuuuuugauaacuuuugguugaaagucaauuguuacucaauauuagaauggcuacuccagcuugcuucuucggaccauuugcuuggaaaaauuuuuuccagccuuuuacucugaggaaguguccuucacuaagauguauuuccuguaugcagcaaaaaguuggguccuguuuaaguauccagacuguuagucucuuuuuauuggagaauugagugcauugauauuaagagauauuaaggaaagugauuguuauuucuuguuauuuuuguuguuagaugugaaauuauguuugugugacuaucuucuuuuuugcuuguuacaagacuaauucuuuguguuuuaguggguauaguuucccuccuuguguuggaguauuauccuuuguagggccagauuuauggaaaaauauuguuuaaauuuguuuuuguaauugaauauuuugguuucuccaucuaugguaauuguuggguauagcagccugggcuggaauuuguguucucuuaggaucaguaugacaucuguucaagaucuucuugcuuuuggagucucuguugagaagucugguguaauucugauaggucugaccuuuuccccuuaccacuauuaauguuucuugcgggugcucgacuggccaggaagaacgacgcugcaacaggauccuucugcacacguuuauugggagagcuugauuguagaggcgaaaagacccugcgagcccagaacuguugcugcuuuuauaggccuaggagaggcgugucucacacccggauugguuaugcacuaagccucauuugcauguuucucaucugauuggcuacucucucauaguaccuuacagaaccucauuaucauaccucauuugcaugucucacaucugauugguuauacucucaguaccuuacagaaccucauuaucauaccucauuugcaugucucacaucugauugguuauucucucaguaccuuacagaaccucauuaucaugccgggccaggcagugucuuugcaaaaaacuuuacugcauauguacacauugauuguuuguccaaacuuaugcgugguggccagcaguagucagugccacucugcaauggcacauguggcuucccacaaauguucauuuucuuuguuucgugcauuugauguuuugacuauuaugugaugggaggaauuucuuuucugguccaaucuuuuuggaguucuacaggcuucuuguauguucaugugcaccucuuucuuuaggguagggaaguuuucuuuuauaauuuuguuguagauguuugcuugcccuuuaaguugagaaucuuucuucuaaaucuacuguucuuagauuuggucuuuucuuuguauccuaaauuuuuuggauguuuuggcuuaggagcuuuuugcauuuuggauuuucuuugacuguuaugugaauauuuucuaugguauuuucugcuccugagauucucucggucucuuguauuuuguuguagaugcuugcaucuguuauuccuguucucuuuccuagguuuucuaucuccaggguugucucccuuugugauuucuuuuuuguuccuauuuccauuuuuuagguccaagaugauuuuguucaauuccuucaccuguuuuguuguauuuuccuguauuuuuuuuuuuuuggauuuauguguuuacacuuuaaaggcuucuaccuguuuaccuguguauuccuguauuucuuuaagggaguuaguucuguccuucuuaaaguccucuuucaucaucaucaugagaugugauugaaagacucugagaggagccccucgcucaggccucgggacaauaguggacacccaagaacuuauaagagaccaagcuugacgcaguccacaugaggcuuuauucagggaaagccagagcucuggggacaacucauaucccaugcagggauagaggagucgaccccuaggggaaagaggucccaguuuuuuuaggcccucagggaggaaaggagaagggggaaguaugggauuuccagaucuaaacaaugucuauucucaagaaauggguaugggagggguacaaggaaagagucuggugcagguguagcaauccuggauuugccuggcuguaguugcuggggaguuuuuccgacucugucccaaaaaccaauaucacaaacaccuggcagugaggugcagcagugggcacacaccuggguugaaggaacggucagaacauuggcagacacacggguucaaggacuggccagagcauugugcaccucuauuuuucuaaaucagugaagcuaguucugcuaacaaugaaaucuauuuugccaauuucaggacuucugugaccuuuuacauucuguuaggaucuuucaugauuuuagauuagaaccuggauuuucugguguguugcaguguccaugguugcuguguugugagaucugaguucugaugaugucaaguagcauugguuucuguugcuuuuguucuuguacuugccucucaccaucaggucaucucugguguuaguuggccuugcagucucucugacuguagcuugcccuacugugagcccgugacauguuuucucugggcuguauuggggugcagaggucuguggccuagucucagcucccaggcguggauggaaacccuagggauccuauucccagcugcacugugguuccuggguccacuggguuucaggcaugacccaccugggucagguauuggggugguacuucuugucuuacaugugagccugagugugucagcaguacuggaggacaaagucuuccugggugggauugggguguuggggcuuguggcccagggucaacucucaggugcaaaugggaacaggaagcaguauauaguguuuugaggacugguuaucacuugcuugaauuugauaaaaaaaaaaaaaaaacaacuguuuuacaccuugauuuuuuuuuuucuuuuugugacaucucuguagucuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucucuguagucuuaacauuccaucaaucacguccaguugguuuacuucuuuuggauuuuuauugaacaaaauccauaugacauaucccuaucaugauuucccauuguccaauuccuuucaggucuuucagaagccuucuagaaaaggcugugacagcaaguacguuuucuagagaugguucacuauuuugcauggcugugauggguauguucugagaugcagggucuucagagaauucauugcuuuucauugcugauaugccuuuccugccaacuuaaugauuuucuggguauuuaccugucaggagccauaauggggaaagguaauaacuagcagaugaucuuccugaaauugucugcuucugguuauaauaugaccugugacagauucacucuaaucaggcaaggccuuaagagaauucauuuuaggaaagauuccugcuauuaauaugcuuucacuguuauuaaacauauauaacaauaagcagguauuagcccaccccuuuagagcagaucucugcugauccacaaagacugucuuguaguaagucuauauagauaaauagaugacuucucaagucuuaaugauaaucuuaucagaauuccuaaaauuauaucagugauuauuaaacucuuuuauaguggaacugcuauuagguccuuuucugauagucagaacugcaaugagaacucugccauucuaccaugagucaccaguuaauuuuucuuaguaaccagaugccacggacuaggcccaguuggccccccucaaucugugggaaucagggucuuggacagaugggcauagagucagcgagaauugacagacagacucagguaugagagaguguggaucugaauguaauuugucaauucgugcaucagacuuuuuauacagaagaaaauagggaguuuaggugacacacuggcaagguacaaugagguuaccagauccuuacauaaaacagaggaaagcaaacaugaaggacuggcaagaaccagcugggauaaaauucaauguuaacaacugggaucaaaacagcuccaccuaaggucagcuuaaucuuagaagccaggggaaagggcuuuguacccuugccauaguuccuauucuacucuauuguauaguccaccuucccccuaggccauuguaaauuccuguguauggguguaacucagcuaucuauauauuucuaaguaucuacucugguuccucccuagaccacaaccuuccuucuuccuagauaaugguaaauuccuguguagggcagugacuuagcuauccaugcccagggucggcucaaggacugacggccuaggacuggugaagaaucuaacuuaccuauaugucaaaaauucaauccuuagaagcacuuauaauaaagcaauauuaagggaaagcacacagaucuguuuaccuacuaaagcaaggacauuggagcauucguuauacaggaugccacaguuccaggagacuaaguuuccauuaacuuuuugccuugggacugcggccaggcuuuuuggccugucaggugguucacuacuggaguggauguugcaacuagacuuuccccuacucagagcacauucuaagagguuguaaaacaguuaaccaaaggucauaaaaauaggacuaacaauuuauuauaggagcuaggacaggagauaaaauauugaguggguuuaucuauacaaaacuucacuaauaacuuaguuaugguuuuaaacuuucagugaaccuguggaguugugacagaugauggauguucagccagauaauuacuccuaauggauaugcguguaaacauucgcuguuguaaacuucuauuucaauuuaugauuugauuuuuugugugugugaacuugugaugaacuuuuuagcauuugaucauguauuuugaaagauauauaaguacugaggacaaugauaacagagaagaguuuuuuucccuuaguagaauuuauugccuuuccucaauuaaagaagaaauauuucccuuuucccacuuagucgaauuuuucccuuucccacuuaggaucuuuccccuuuuguccucagauagcauucauaggaaacuuuuuacaaguuaguaauacaugcuguaaucacuuuucaaaaugucucuuuuucuucuugugacuucuuacuacuagcaguuugaaaguuagagcugagcaguuccugcugagauaguacaaaggcuauuuacuuaauccauugcuguuugagaaggaugugcuaagugccagaaacugcaguuucugaccucagaggaucacagaaggcaggucagcuacaguagcaagguaacuuagucuuagauaaguaaacuuuucauuauuauacuggaaacccuaaauaacucguaugacaguucuuacccuuaucccacacuuuaccagcuccacugcaucaagaagaaccaacaagaaagaagauccccaccaggacagacccccugcauuuaccuacucucuuuggaaaaccuccugcagagucuacaggaagauguaauuucauguaguaaugcuguuuagaugaauugaugauuucauaauuccuuuuauagaauucccuaaauggguagagguaaucucaagcccaguauagaauaaaagguacaaauagaguccuguaaaccaucauguaucaugggcuaauuacacuagagaggaaaaaggcuuggaauaaauuuacaaucuaggaauacauuccuuuuagguuaggaaugaggccacuaucugguaacuaaauguuauaagcugggaauggacaauuuauuguagguacaauaacagaaaauaaaugauggaguaguuuaucuguacaaaguuaaaaauaaaaagacacaaggcagcugauuugucucuugacaaaucuguuguaacuugugacauaaaaacuugucuuauacccagaagauguuccuacauguaauaaggacacaugcuccacuauguucauagaagccuuauuuauaauauccagaagcuggaaagaacccagaugucccucaacagaggaauggauacagaaaaugugguacauuuacacaauggaguauuacacagcuauuaaaaacaaugaauucaugaaauucuuagacaaauggauggaacuagaaaauaucauccugagugugauaacccaaccacaaaagaacauacaugguauauacucauugauaaauggauauuagcccagaggcucagaauauccaagauacaauuugcaaaacacaugaaacucaagaaggaggaagaccaaaguguggauacuucaauucuuuuuagaagggggaacaaaaaacccagggagggaguuacagagacaaaguucuauaccgagcuuuuguccccgccggcaagaacacacucaggacaaccggaaucuucugcggcaaagccuuuauugcuuacuuaucaggagggaagaccccgaaccggaaaaauggugcugcuuauauagccugcagggugauguuucagcaccugauguggcgugauagcuccugauuuguugcucgcccaucaccccauuacuacgcugugagaugugcagugacuaggcgugaguucacucuugcacuugcacauaaggcuuguuuacuaguuaggugcaguggaagccagcaccaucuuauaauggugauugcucacggcacgcacgcgauuguucgcagcacggcucuccacaaaguucagagcagagacugaaggaacgaccauccagagacuaccccaccuggagaucuaucccacaaacaaccaccaaacccagacacuauuguggaugccaacaagagcuagcucugccuagcaaguacagaaguggaugcucacagccauucauuggaugaagcacaggguccacaaugaaggagcuagagaaauuacccaaggagcugaagggguuugcaccccccuaggaggaacaacaauaaugaacuaacaaguaucccucagagaucccugggacuaaacuaccaaucaaagaaaacacauggugggacauauggcucuagcugcauauguagcagagaaugaccuagucagucaucaaugggagaagaggcccuugguccugugaagguucuaugucccagcacaggggaaugccaaguccaggaagugggaguggguugguuggugagcagggggaggugggaugggggaaggggauaggggauuuucagaggggaaaaugaaagaaccuaguggggaaagccccacucaacuacugauucaacuacugacccaauaaucacgaacagacgaccauccugauguaacaacaugagguaguuuaauggcggagcuccgagucgaaauguaucucaugcaggagacaguggauucaaccaagagguuuggaagcuagggguuuuuaaagaaaaggggugcagcugagggagcaauuggcacgguuucacaugauugguucauuuaaacaucagcagacuguauaugcagauaacauuuaacuuaggucagaagggcaggagguagggaggcacagggccagucuggcaugucauucucuuuaucucucuuuaucuuuauggccaagcagccucaggaaugucuuaacgauuggccugccagggcauguccuggccuguucugcuauguucucagccccagguuucaaagcucacaaacaacucuuugggcuauuugacauaaaugacaugaaucacaggucucaaguuuuuauuuucuuucauuccccucuucuucuacuaaguaauucuaaucuuagaauuucaaaauaccguaucucuuaauucuucuucuaucugaauuauaggcugguacugucuuuguaaaaccaugagcuugacugcaucuacucuacucugauuaaaagcaauucccuuauuuauuaugcaggggccaaaaauuaaaacuaagcauauuaaaagaaucgguccagcgaggacagaaaauagaguggucaucuacagagaccgagaauaucaagacacgaaccaucccuauugagcuucucgauuucgccuucucugauccaaccuuucucucaguuucugcauagaaucucugacuauuccuguguggucugcauaaaaacagcuuucuucuuuuaaggcugcacaaaguccuccuucuuuuaaaaacaguaaaucuagaccucuucuguuuuguaaaacuacugacagggagguuaaagauuuuucuaaggcauccauagauuuuucuaaaguccuuagguuuucauugacaacaucucuuaaagacugcauuucuugucuucccucaguuaaggcugcugccccuguuccuacuucugcuguaaguccuacccccauuaacauagcuaggguaagggagacuggcucucuuuuaaaucuccccuguguauauucauccucuaugcgggaagcaggaugauaauacacucaaggcaauaacugaaccaugacacaaaaaucacgagaggggucaaaaacacuaguugauaugcauggggugaguccuguacuacaagcccaccagccagcuggagauggcacaagguaauaauugguaucuguccuagacacggaacuaguuuggccacauaggugccggugggaaggagggggugucccuauacagagaccagggcuucuuacggacaccucagucaggguuaauuuuugcccuguuccccaugaacaggaagcacgguuacugguuuuguuaaaguuuccaucaaaagugauucccucauaguauggggggccuguggauaggcauaaccaguagucgguaguugcauugggaucuguuucauugagggcaaaguaagccccucggaccaaaucaaacagucucuguccugucaagggguaugugggggcaauggucgagggcucuuggggagucuuuuggguggggggaaaggguugguucggcucagggagcaccuuauuagggccuacugguagggcuggaggacuuucgauauuuagacagacauggagcaaugauccaggucugcuaccauaauuguagaacacgauuccccaggucaugccuccaauccacugggcaagggcaugauuuuuucccauuucugugaacugcaguuccacacgaucuaagucuguagccuugcauuccugaucuuuguauagccccauuucugcauguuugccuggccccuuauuuugaaaagcaaauuccaauccauccccagagggcucaacggcccauuuccaaucuccaucauuugagguaacaaaacuccauugacugcaauaguacuacuuaggccccuccacaccaggaacucuuaacaugcuugggucagcuauaaaacccauagcuucggaccucauuagggggaguacuccuggcugcgggaaugauuuggugaaggcaaaaauacaggguuggccaccaugccccccggagguucuaauuuugaggugguaaauaguauuucccccgauugggauaacacuugccaagugagauucauaggcugguguggguugucacuuuucuucaggauggcgccagugacguaagcgaaacuuaagaggauuagcaguguuuuccaggauccauucauuuuggucagucucagggggugccuucuugacgugagacgcgugaacccagguugggauuucuuucacuuuaacagcagugggugucguuagcagcaccaaguagguuccuuuccaccauggcuuaaggguucccugauugaugucuccucaccaggacagcgucuccuacuucaaacugaugcagcaccuguaugucaccagcaacauagguuucuuuuagcuguucccagaucuccuuucucacaauuucaagagccuugagucgggcuaaaaggugagaggaggggaugaaggauacauccgggcaaguucuacucucuucugucgcauagaugggcggaggcaccccauacauuaauucaaaggguguuaggccagagguuccggggguauucugggcccugaauaaagcauaagugagcagggcuguccaaucguucacgcuggucucuaaggucaauuuaucaaggucucuuuuuagaguucuauucauucuuucuaccuguccugaacucuggggucuguaugcacaauguaacuuccaauuuguccccaguugucuggucaaacccugacuuaccugagagacaaaugaagguccguugucugacccgauuaccuuggguaccccaaaacgagggacaauuucuucaaguaucuucuugguuacucugguggcugucuccuuggugggaaacgcuucaacccacccagagaagguaucuauaaagacuaacagauauuuauuuccgaaccgggcugguucuaccucaguaaagucaauuucccaguaggucccagaucugucuccccacagacaccuuccuccagggagccugcuggauccagcauuggugagcgcgcagguuuggcaguuucucaccaggucuucugccaccuuuuguagcccagaaaugugauaggaggaccuacugacuaauuuuaucgucuuuuuagauccuaaaugagugagacgguguaugucaccuagguacuuuauccccuuuucuucugugagaaccuuuauuucuguuucuucuucagcugguuggggcacaguuuuaacuaccagaguuauuggccccugggccgcuucuuuagccacuuggucugccauuugauuucccuuuucuacuaguccgguuccuuuuugaugccuugggcaguggaugauugcuaccuugagaggcagaugaacagccuccaacagaccaaggaucucuucuuuguucuuaacaucuuuuccagcggaggucaauaagccacacugccuauagaucgcuccaugaacgugagccguagugaaagcauaucggcugucaguguaaauauugauagccuuaccucugccagccucaaagccuggguuagagcgaugagcucugcuuuuugagcugagguucccucaggcagacuguuagaccauaugacagauuuuccaucuacuaccgcugcccuggcccuucacuuaccuucuaccacaaagcugcuucccucggugaaccauguugcugcuccuggccacagcuggucagagagguccggacaaguuccaguuucuucuaauaauaucuccccacaguugugcauggggguuucguuaguuuuggguaguaagguagcggaauugaggacagcagggggagugaaagccacucgcucagucagcagcaaacuuugauagugauucauucgggcguuggucauccagcaaucuggcggcugccugauaaugcucucaagagaguguggggccaccacaguaacauucuggcccauagucagcuuauuagcaucuuuuaccagcacugacguggcugcuauugcucguaggcauggaggccauccgcuagccacaggguccaguuucuuugauagauaagcuacugggcacuuccagggcccuaggguuuaagugaggacuccacgggcuaccccauuucucucaucgauauacaaagugaacggcuuauuuacaucuggaagugcuaggucagggacuuguagaaaggccuuuuucagagucucaaaagccgacugauguucuuggguccaaauaaauuccccucuuuccuuuguuagggaguacaguggggcugccaggguggcaaacccugggauccauagucuacagaauccugcuguccccaggaacucuccuaccuggugagggguggucggggucgggauucgcaucacugucuguuuucuggcguuggugagccaucguuguccauuccucaggauguaucccaaguaggucacaucuguucuucacgaguuccugcagcuaucagaaggucaucaacauacuguacaagggucaccuggggguuguuggcucgaaaagaggcaaagucucuugugcaaggccucaucaaacaaagugggugaauuuuugaaucccugggguagccucauccaugugagcucuccagucuuuucacuuucuggaucucaccauucaaaggcgaacagggguugacuauugggguguaaccucagacagaagaaggcaucuuuaagaucuagaaccguguaccagguuugcucaggugguagugugcugagcagguuauaaggauugggcauugugggauggauguccuggaugucuuuuguuuaccucucugagguccuguacaggaugguagucauucguccccaguuucuuuacugggaguagggggauauuccaaagagacuugcaggggacuaggaucccuuguuggagcagucuggugauguggggguguauacccuccugagcuucucuucccaugggguauugucggaccccaaugcguauagccucggacuugagcucaaucaccaccagggggaccugccuugccauucccauaccuccuguuucggcccaugcuugaggaaaccgaguaagccaauccuguagucccucaggggguuuuaauuugcccugauagaucccauauuccucuccuaauuguaaagacagugcuaaggucugaggugucucuacuccccaagauaccuuuggucugggagaggcgaagguuauuuguguuuucaauuugguuaauuagucuucccaauaggggcaugggacacuccggaaugaccaggaaugaaugaaucacuugguuccguccuagguucacucuccgggacaugguccacggguaugauuucuguccuguggccccaaugacuaauguuuuuucauuuuuucuuacuuggccuagugcugucuuaagcacugaaaauucugcaccugugucaaccaggaaauugacagggguccccuccacuucuaauguuacccuaggcucggggaggggggccgagccccaucuacccuagucuuugucuucuccaugggacaguacuuguguucccuguuucuucuuagggcauucacgagcccaauggccuguauccuugcaguacgcacauuggucuuuuacuaggugugguuuaucucuuccgggucccccugccauuuuucgucucucagguacccugacugucuagcccugcuucuuccuuugucugcuguggcggccagaauccgagucaaaacuuucuccugccuuuugucucuccuauccucaucuucucuccucucucucuucucccuuucuugcuuuucaucuucugucucucucuugugauacacuuucucagccucucuaacuacauccauuauaguguaauccugcaaccccucagucugcuguaacuuuuuccuaauaucaggagcugauugaccgaugaaggccauaaucacugaggcccgcugcccuucagauguagggacaaaugggguguaucuccuauaaacuuccaugagucuuucuaaaaagacugagggaggcucaguugccuccugcauaauuucccuugccuuagccaaauuggugggccugcgagcggugccccugagaccugccacuagagccugaugauaauuggacagccauucccuaccuugugcuguguuauaaucccacugggggcgggucagggggaauccuucaucuaucuggaccugggucuggaccggucguccggucucaucuuggauguucuuccgagccucgaggagaauccucucccucuccuugguaauaaacagugucugcaggagcugcuggcaaucgucccagguaggcuggugggaguacaucagagacucuaucagcccugugagcccugcaggauuuucugagaaaggggggugauugacuuuccaguuauagagaucagaggaggaaaagggccaauacugcagaaguuguagaccguucagagccccaacagcccugaggggaagugccacgguugaaucggcuggccccucagggguggcuccccgcuggcuccuuguuccugcugagggaccuccucccccggucccugaggcuggggccuggaguggggcuaagggagcuagcgguuggggaacucgaagguaggguggaggcugggaaucgggccacucaggagguuccucuaucucuggguagaucuuaggggugagugcugguggggugcggcacucgccaucuucuuuaggcugugacuucuacgucccguucacagcacucucucggacagccaggauccuagugcccaggcauaagggugggagaaacggccgaacccacggaggcagauaccccgccaaauccucccacaccgugauguaugguugcugguccgggugcgauccugguccuuccugaaagacaauggccuuuaugguccuaaugaugggaaggucaaacauccccuuggccggccagccuacuccaaaggaaggccauuccgaggaacagaaagucaaccaagguuucuuuuuaacuaucacugauauauuccauccucuuacccuaacaucaguccaaugguccuuagucaaagauaaagggguagacacagucugucccauaacgaaaaccacaaacaaaaacaagacagcaacagaaaaacaagacagcaacagagaauaaaagacaccaguaucuaagcacacucauuccucacucugucugccagacguaaaaccaaggcacgagguggaacuugaacccacaaucucagaaccguaaaaccaaggcucgagaugggacuugaacccacaaucucagaaccguaaaccaagacacgaggugggacucgaacccacaaucucacaacugaaaaaccaagacacaaauccacaaucucaaaacagaaaaaccaagacacaaauucacaaucucagaauugaaaaaccaagacacaaauucacaaucucagaacugaaaaaccaaggcacaaauucaucggugccacacuuagacaacagauaacauguaagacacacacaaacaaacguaccuccaaggggucuuucggggcuccugggugucaugaagaucucguugggcccuccaaaugaaagauccuaguggggaaaaccccacucaacuacugauucgacgggcacccaagaaucacgaacagaccaccauccugauguaaaaucacaagguaguuuaauggcagagcucccggucgaaauguaucucacgcaggagacaguggauucgaccacgaggcuuggaagcuaggaguuuuuaaagaaaagggguggggcugaaggaggaauuggcacgguuucacaugauugguucauuuaaacaucagcagacuguauaugcagauaacauuuaacuuaggucagaagggcaggagauagggaggcaccgggccaauccggcaugucauucucuuuaucucucuuuaucuuuauggccaagcagccucaggaaugucuuaacgauuggccugccagggcauguccuggccuguucugcuauguucucggccccagguuacaaagcucacaaacaacucuuugggcuauuugacauaauauacaugaaucacaggucucaaguuuuuauuuucuuucaaaacuaggaaaggggauaacauuugaaauguaaauaaaaaaauaucuaauuuaaaaaaccuauuguuuuaaacuuauaaugaacuuguggagccagaaaauagauaguggauguucaguuagguacuauucuuaaugggcagauauguaaauaguucuucuguagcucuuuaaaccuuaucgaucuaugacauggacuauaaguuuagaguuacuaugaacuuauggaauguaaacaugcuuagaaaacauugugaucuauuucuggagaagguauaaaaccuaagaaagacaagaaaaugguaguguagaccuuuucuguuucauccaguguacauaugucucuguguguauguacuugacuuuguuuucuauuuucucuggcucaugaauuaaugaacucugaguuucucaccgggcuagugaaaggcccuuuagucaaagagaaaagaaucuaagaaacuaaguuuucuuaauuucccugcugcuaucagcaggaguuaauuucuagaagccauccucuuuuggccccagaauggcaagagacaguuaaaucccuagaagucaucaucuucuggguucagacugauagaaccuaguggggaaacccccacucaauucccgauucggcuugcacccccaaaaucaugaaggaccaucuugauguaaauacaugaggacuuuaauuacggagcuccgggcugacaugcauccaacacaggagauaacagaugucggccaugaggcuugaaagcuaggguuuuuuaaugggguaaggggcuuagggguguggaauucagcauagcaacacacuauuggcuuauucaaacauuaacagaaaaauuacauguacgugcaggguucagaguucugugaguuguugacucaguucagauaguccuguuaugucuucacauuccccuuuaucuuauggucaagauguucccaggaauguuuuaacuacggggcauacccagguuuguuuuucccuuuucucagccccaggcagccucuaggcucacaaacaaccagcaauuucugaguacuuuauaugacuuacaggucuugaaauuucaucuuucuuucaagauuagcaggagagaauuaaauugccagaagucaaaagauuuuggcuccugcuaaugccagccuugcugccuuacuuaguaccugaaugccgagcuuaaccucagcacuguucauccauaccuucccaccuacccagcucugugccuuucauuucuugagaacaaacaaacaaacaggcaaacaaauaaaccagaauuuuaaaacacaaaugaaaauccacaaggaaacauguguacacauguaggauaaaccacaaauucagaaaaauguauuaacaaaaguccaguaaaauaauaauauuaaaaaaaaaugcccaaaguccgggcugaagucaaugcccucaaaagcugagggcauugacuguucuucuagagguucugaguucaauucccaguaaucacaugguggcucacaaccaucuguaaugggaucugauauccuccucuggugugucugaagacagcuacaguguacucacauacauaaaauaauucuucaaaaaaaaaauccuaguuacuucuauaaacuauaauucucacaagaucucugauagaggagcaucugucuuacuaauguuuguuuuuggauguaauuaaauggucaaugcuuuccuuauauaauauaagauuuacucuaugauauauauauauguauauauauacacacacacaauauauuauauguaaaauuuuuaugugauauguuauaagauauauauuauauauuauaguguaugauauauguaaucacacauacacauauuuuguucuaaaguucaaaauuucuuuuuuccacuuaaauuuucacagucagauaugagcuguauuaacucaaauauauacuuguuucuccaagugccucccacuuuuugcuuuucccucgggcuucugccauagguucuccagaucccugagcacacaaugcuuggaugagcauagcauuguuagguaauagccucccucccuuuacuuagcagagguuguaagccucuugccucugcucuccucaugcucugaugucuuaguuuugucugucacccaguggaccagauuugguuugguccauggcucccuuccucagaccaucuaccuggacuuuggcccuccugagaggugcucucuggcucucugugcucugggcacuguugucuccugccugcuguucccguagcccacccaaauggcgcuucucuaccucugaaauugucauccccaggaagguuccccagagaaugggcaaaagugauaugucugggcacaucaccuauagcaugcgcuuuaggggacaaagacaugugguccacaugaaacucaagaaaaacaugauuccucaaaauuuuccuguauauaccucuaaugaccaaggagcccaacagaaggauuacccauuuguuccucgggauuguuacuucuacagcuuccuggaaggagucccugggucccaagcuauacuagauaccuguacuggaggucugaaaggcaugauacagguggaugacuucacuuaugaaaucaaaccauuggcaucuucuuccaaauuugagcauguaauuucucugcuugugguggaugaaaggucacgugagucaaaaaaguguagaaaugaugagauuauggcaaaggcaggugaccucucugaagagaccaagcuggcuggaagucccagagcagccccuguauaucuguggcguuaccauuugaaaaguguaggaauacacuacacggugacucaugacuuauucaaacaaacugggagcaauuccuccaccucaguugaguuaauacugauuaugaauagcauuucagauagcauuuauaaaauaaguggauugauuguguaugcacgugguguauggauuuggaauacgaagaaccugcauacuguccccggugaaaauccccaccuugauccuuggaguguuauggcagguuuugguguauggaaaucuaaagaauugcacgauuuguaugccacuacagcuauucuccuugcaucaagaccaaaaaauacagauuauggaagcuuucagaauggauuauguaaccccaacuggggaguauuauuuacauauguaggaaaaaaccauuuauuucuggcuggaucuuuccuggcacaugcagugggucaccuuuuagauguaagccaugauacaccaggcuguguuuguuucagaaggagcaguugucucauggaugaauuuccuacucuucaugauaugauuaguaauuguucccauaaugaguuacauaggaggauccaugacugggacccuugcuugaguuuagagcuaaaaacagcuaaagaaguaaacauguaugaaguuccucguuguggaaauaagagaguggaggccagugagaaaugugacugugguucugugaaagacuguaccacugauaaguguugugaagucaauugugaguuuacucaggguagcucuugugcugcaggagguugcugucuaucuuguaaguuugcacccacuggaacaauaugcagagacaaaaaugguauuugugaucuuccagaguacuguaguggagccucagagcauugcccaggaaauuuuuacaucauggauggaacuccuuguucuccacuggcagucugcauagcaggaaacuguagugaccgucauuugcagugucaagcucuuuuuggauaccaaguaaaggaugguucaccagcaugcuauaaugaauuaaaugucaaaggugaccgauuuggaaacuguggcauuagaaucauacguggaggaagccaaccugucccaugucaaaaggaggauguuuuuuguggaaugauccacugugauggugucagucauauuccugguggaggugagcacacuaccuuuuaucaccuaaagguucaagauguuaaagaagaacagugcuuuggguaugaugcacaccaugggacagaacuuccagaaauggggcuuguaguggauggugcaaccuguggcccuggcaaauauuguaaagcucaaagauguguugcucauccaacuuugaauuuuaauugcaacauuaguucguguaacuucagaggggugugcaacaacaaaggcaacugucacuguguucgaggauggcagccaccacauuguuuacaaauaggaaaaggugguaguacaaauaguggcccuccaccuaccacucagaaaaaacaucaagcugaaauacaugugagugccaacaggcuaauagucauuuuaaguauucgcaugauucuuaucuuggcuucgauucuuuugggugcaguuuucaaagcaauauuuguuucagaaacuacagaagaggagcaacauucugcuguuaacagacaguugacuucauaccaaacuauuugaagccacacaauggacaaaauccaugucaauuaccacaagaaauugucgaugauguguaaccauugauaaauuggagaauuucaucuuaaaauaaaaucacugaggaauuagcauuguguuucuauguuuuuguuuguuuguuugguuugguuuucuuuuuuauuggauauuuuauuuauuuacauuucaaauguuauccccuuuccugauuucccccuagaaacucccuaucccaucccccauccuccugcuucuaugaggaugugcucucauccaaccacccacugccaccucucugcccucgaauucccauacacuggggcaucaaaccuuuacaggaccaagggccuauucucccauugacaaggccauccucugcuacauauauggcaggagccauggguuccuccauguguaguccuugguugauagguuagacccugggagcucuaguugguugauauuguucuuccuauaggguuuuaaaccccuucaccucuuucaguccuuucucuagcuccuccaucggggacccugugaucuguucaaugguuggcuucgagcauccaccucuguauaugucaggcucugguagaaccucucaagagacagcuuuaucaagcuccugucaacaugcacuucuuggcauccacaauaagugucuggguuuggugacuguauaugggauggauccccaggugggguuguuucuggaaggccuuuccuucagucucuguuccacacuuugucucuguauuugcucccauaaguauuuuguucccccuucuaagaaggaccacacuuuggucuuccuucuucuugaauuucauguggucugugaauuguaucuuggguauuccuagcauuugggcugcuauccacuuaucaaaauucaauacccuuucaugguaaaagucuuggaaagaucaggaauucaagguccaugcuuaaacauaguaaaagcaauauacaggaaaccagcagccaauaucaaacuaaauggagagaaacuugaagcaauccuacuaaaaucagggacuagauaaggcugcccacuuucucuguacauauucaauauaguacuagaaguccuagccagaguaauuagacaacaaaaggaggucaaagagauacaaauuggaaaggaagaagucaaaauaucacuauuugcagaugauauaauaauauacauaugugacccccaaaauucuacccaagaacucauauccccauccccgucuuccucucucucccucccucccugcuucauuauuacucuguguguaagugugaauauaguuucuuguggaggccagaguuggauccgagagagcuggaguuauugguaguuguggaucacccagcuugugugcugggcaccagacucagggucucugcaagagcagcaagcacucuuuuuuauauagauauauuuuuauuacauauuuuccucaauuacauuuccaauccuaucccaaaagucccccauacccuuccccccacuucccuacccacccauucccauuuuuuuuuuuuuuuuggcccugguguuccccuguacuggggcauauaaaguuugcauguccaauaggccucucuuuuuagugauggccaacuaggccaucuuuuucauacauaugcagcuagagucaagagcuccgggguacugguuaguucauaauguuguuccaccuauaggguugcagaucccuuuagcuccuuggguacuuucucuaucuucuccauugggagcccugugauccauccaauagcugacugugagcauccacuucuguguuugcuaggccccgucauggucucacaagagacagcuauaucuggguccuuucagcaaaaucuugcuaguguaugcaauggugucagcguuuggaagcugauuaugggauggaucccugaauauggcaaucucuagaugguccauccuuucgucacagcuccaaacuuugucucuguaacuccuuccauggguuuuuuguucccaauucuaagaaggggcucaguguccacacuuuggucuucauucuucuugaguuucaugcauuuagcaaauuguaucuuauaucuugguuauccuaaguuuugggcuaauaccacuuaucagugaguacauauugugugaguuccuuugugauuguguuaccucacucaggaugaugcccuccaggucuauccauuugccuaggaauuucauaaauucauucuuuuuaauagcugaguaguacuccauuguguaaauguaccacauuuucuguauccauuccucuguugaggaacaucuggguucuuuccagcuucugguuauuauaaauaaggcugcuaugaacauaguggagcauguguccuuuuuacugguugggacaucuucuggauauaugcccaggagagguauugcuggauccucagguaguacuauguccaauuuucuaaggaacggccagacugauuuccggagugguuguacaagcuugcaaucccaccaacaauggaggaguguuccucuuucuccacauccucgucagcaucugcugucaccugaauuuuuuaucuuagccauucugacuggugugagguggaaucucaggguuguuuugauuugcauuucccugaugauuaaggauguugaacauuuuuucaggugcuucucugccauucgguauuccucaggugagaauucuuuguuuaacucugagccccauuuuuuaaugggguuauuugauuuucuggaguccaccuucuugaguucuuuauauauauuggauauuaguccccuaucugauuuaggauugguaaagauccuuucccaaucuguugguggccuuuuugucuuauugacagugucuuuugccuugcagaagcuuugcaguuuuaugaggucccauuugucaauucucgaucuuacagcacaagccauugcuguucuauucaggaauuuuuccccugugcccauaucuucaaggcuuuuccccacuuucaccucuauaaguuucagugucucugguuuuaugugaaguuccuugauccacuuagauuugaccuuaguacaaggagauaggaauggaucgauucacauucuucuacaugauaacaaccaguugugccagcaccaauuguugaaaaugcugucuuuuuuccacuggaugguuuuagcucccuugucgaagaucaagugaccauagguguguggguucauuucugggucuucaauucuauuccauuggucuacuugucugucacuauaccaguaccaugcaguuuuuaucacaauugcucuguaguacaucuuuaggucgggcauggugauuccaccagagguucuuuuauccuugagaagaguuuuugcuauccuagguuuuuuguuauuccagaugaauuugcagauugcucuuucuaauucguugaagaauugaguuggaauuuugauggggauugcauuguggaggccagaguuugauccaagagagcuggaguuauuaguaguuguggaucacccaacuugugugcuggggaccagauucagggucucugcaagagcagcaagcacucuuaacugcugugucagcucucuagccucuuaaugccauauaauuuaccacuucuuaaguuuguuuugauugaaauuuuuuccacuuccuggauuauggugcuaagcagcacagccaagaacccagggucuuauccaagcccagugaauacccugcuuucuacucuacugagcccaaacguuuugucacauucuuuauacuucuucauguaaaaucugccuuucauauuuuuucaagaaaagaaaguacauauuugugagguucauuuuuauaguuuucuagaagcuucuauaucaacuuugggcugccuuagucuaugcuauucuuaccauugucuguucucaauuguauuagaucaucaucuauuuuauuguuaauguaaaauaagaaucaaaaaggcauuucuaaaauauaugggugugcgacgaaagcaguuuaaugccuuuuuuguguuuguuuuucucuuaaccucgcuaucucccaaauaauugagacuagacuacuauauuuauuuaacaagcuuuaaguauacaagaacugagcaguguuacucuaucuaaaucuucuaaacuaaucugccuaccucccagccaaagucccugagacccuugcauuugauggcuuucucugcuugagcuuuuuucucaugaugucuccuggacucuccccauggcuaauccucaguuccucugucuccuucccugacugcccuggcugggaagaagucuagcccuggucucucuccugcucagucacugacugauggguuucuuuuuugaccaaucagggaagaauagcggagcaauguuuacaaaacacugagacugagguaugagauucucagaauauggauugcaaccagauaugggggucacagaaaucagcauucaaauuacacaguacacaauagcauuaugcccgcugaaagaaaccuucauaccauagauagcuggaaugucaguaguugugcugaacuuugcuaugugacaauggggaaacucuuagguuuuuuuuuuuuuuuccaaaaauccagugguuacacccaucauucugagauggaauauacgccaccaaaaugaugccagaagcuaccacaaugcuggggugauuuaggugcugaauucacacacuagcuucuacaguugucuuuagguugugcaaugccaggaacuguacuugcagaggaguguguaacaacaacaagcauugcuauugcauaugugguugaaagccagcaacacaugaucagagaagagcagggaguagugaaggcgggagccguccacuuuauagaggacaauucugugagccaggguauuuguguuguaaaucaggcucuuauucugguacuuacucaccugguucuuuuuaugauuucaguguuugccugguguccuuucuaaagccaaagggcccacuuugggggcaaacggauuuaaaggggaauuugaaaguaauucuuguuacuuacccuaauaagccacauucugaaggaaaucauaguuaaguauaggaagcagagucauccaugauaccucugacaauuucauauuuuccagugagcuuggggguuuucaucuugcaaucaauucauggugcaauuaaaaaaugggcuucuguguuuuaaguucauaauuucuguagguuguucuguuuucuuucuguugucccaucuugugccacauuccaaugucuggacauacuuugcuuaugccuauaugugaggcagagguuccaaaaucacaagaggaaguacacacguucuaagaggccagccuccauuguuuccagacaugccugcguugaauuucaaaaauauuggcaugcaucaauguuaacauugucauggugcuaaaaacugaugguauuugauuuuucuacucguacuuuuuacugucagcaugaaacuguuaagcacuuuaaugcacauaugccagcgaucuagguaggagaauacaagguuuuguguuuuaggcaucuggaauuucacaguggcucugagccuugcuaugcaacuaugcaccaguguuugaggauuauauucaauaucccuagaugaaauauaccuuguccacauuuucaagguguauuucaaaauugaagacaaugaauccgaaaaugauggcacauucuagggacugaauagacuucuagauuuucuaucuucucauucucauuccuggauugugcuaaauauggucuauuuuauguucuauguuaagccagcagggguuggaacauucucccucauucaauuacauguuuaucagcuuucugguuuuaaugguuuccuucacugcuuaagcuugacugucuuagaacuuguucuguagaucaggcuggucuugaacuuagagaagcaucuauccaguaugucuaauuuuagucuuaacuuuguaguuguguguagucuaaggaggaagagaaauguagaaaacugaaauucuccugaagagaagaggaacagaagcgaguuuuggaaguauaccacagaguaagauaugagauauuuugggaccccgugauuuugaaagcugaaaagacaaagugggcaguucagacaagcuuuggugcauugccagagcucuggcaucagcagcuggugaggauggguuucuacaacuuccucucccccucccucucccuguccuccuccaugucucuccuuccccccaccccccguguguguguguguguaggggggggacauaugggugguggcaguacuggccaagaggacaggcucagagcauugcaaucauaguauuucuuuggaacuauggcagagguuuugaauguauaacagaagaacaaaaaguacaagggaguggcugagaaagaagcagaugggacagguggaggcacaugacaucucugagagggaaggcagggacagguggaaagugggacaucuuggagaggggcgguacauaucuucucccuucaguccauguccacuaaauuguaaagacugucuuuuuucuuuuuucguuaugaauggcuaguauaauggccauuccuaaguguuaggauggcaaggagggaaccaacgucuaaggguuaucuucuaauguccacuugugugccagaaaacaugugcacaugugcuguaaaaaguuauuaaaaaucccagccugcugcuucuuccccaucuuggaccgcuuauguucccagauaaaagacacacagccuuuauauuuuuaaauggccauaggcagcacaauaucuggucagcugccuacccuccaugcuguuagaaucuguuuuccuguugcuuacuauguuucaucagggaugcucuucgcuccaguggccagcccacauggccaagauuuaugacucagguaacccauggaggcuuuccuuuuuccaguccugcauguuucuuccuuuaguccaaggcagcuucuuccucuuucuucccuccucauggucccuucucuccaagccugggaaacuucaacccugccuauuucucuucuacccugcuauuggcuguuggcaucuucauuuaccaaucacaauuaacuggaggcagagucacaaggguugcaugcagacuccaggucuugagggcccacacguagcauuacacuauacaguaaaagacaaugccucaacacacaugcaugcuugcaaauacacacacacacacacaaauaaaaaaauguaauuuuaagaaugcuuugaaaacaaauguaaggaauuaagagcaaagaaaaaccauccuguaaauuuacuugguaaaauuguggggcuugcagaaaggauggcugaggaucagaugacagcuauguaggaauuucaggcuucccuaagaacauucuuauuguuaucacaaguggggagggagggaccaaggagggaaaguggacagaguggaggggggaguaggguggagagaggaaccugaucugguauugggugagggaaaaggacugaagccugaggaccagcagaaagaauggaaacaggcaaccucgggaaauaggagguuggagggacccuccagaaugcacccuagaccugggaggugagagacucucaggacucaaagggagggacaucacauguaaagucugacaguagggagaaagugagggaugggguugccaucccacagacacaucucugaccuauaauuguuacuguaugaaagaguuacagggauggaaauggagaggagccuggggaaaagaagguacagugacaguuccaaagugggauccagcucaaggggaggucccaagacuugacacuauuacugaggcuauggagagcuuacaaaaagggaucuaucaugauggcccucuaaaagacccaacaagcagcugaaagagucagaugcagauauuugcacccacccaauagacagaagcaguugaccucuguuguugaaucagggaaggcuggaagaagcugagguggagaagggugauccuguaggaagaccaggagucucaauuaaucuggaccccagagaucuuucaaacacuggaacaccaaagagacagcauacaccagcugauaugaggcccccaacacauguacaacagaggacuucugggucuguguucauucagagaugaugcaccuaacccucaagagacuagaagccuaagggaauucagaggucaggugggguggggguuggggucauccacuuggagauggggagggaugggaaggagguaugagauguggagcagucagaggcugggugggguggggcggggaauggaauauggaguguaaaauauaaauuaaaaaugaaauaaaagaaucugcaucuguggaaguaggagggaaauagaauuuuuaaauuaauuuuuaaaaaauuuauaugaguacacuguagcugucuucagacacaccagaagaguacauuggauuccauuacagaugguugugagccaccaugugguugcugggaauugaacucagaaccucuggaagagcagucagugcucuuaccugcugagccaucucuccagccccgggaaauagaauuuuuauuagcaauucucuaguuguauuugaaagucacugaaagugugacacuuagcagcuacuguagaaccaucuuugaaaguaauagaaguaaguucagugacuaaaagcagaaaaaugucauaggauuuucccauugggcacuuggaguguccugcucuuccuaaguaggaaaugcuaaguccagagaagaagagcucauagauucguuccugaacaaguugauuuauuuuuaucaccuuacaaacacagagauucauugaggaugacugaguuuugaauagauguuguuccauuaucaguuccuccauagaaucacccuucuccaaacuuuaucacaaccugcuucucuuccuugguuuuccucuauuacccggcuuccaucccuuucccuaauacuuauuuugaguaacaguuaccauuugcccaaggacacuugggugguggcaucuaacuuugguaacacuggggcuacaugcugaagaauuucugcuuacuaugggccaucucuagaaacuggauugcucucagccucacagucaccaugguucaagcccugugagcaaccuaauccacccaggaucaguuugauacuugaaagcaagaacucgaauggguguaaacaucuauacaacauucacuguacaaugagauccaaaggugcuaaauguccacagugcaguuuguccuucccagguggcguugaauuauucuaguaccuugagagaugacuacaagacuuccauuaucaacaggaauagaugagguaauuuaaagaaaucucuggaaaaaauagagaagcccaugccaaguucaucuuaaagacuuauauggaggcaugaagcugcaaugagauaaaggcauuaucuacuugggaacagaguaaaaucagacaucaggggaguuaagugcagaauguaguguacuuaucccuggaagaguucccagcuuugagagcugugugugaguugcugaauauggagaagccauaagagcaauguuauacaugaguagaaaaagauugaaagcccaggcuaucaaaaggauacccuuagcuuuuauuugguaguccagagacuagcucacuuauucaaguacacucacaugcuucauaaugaccuuucggccagagguaugcuacagguaugauugcugugcuguacaccuaaaaaauucuuugcacuugaugaaaucaugguugcuguaauauaccguaaugcacaacuuauaugcuugugguaugcugguaugagaaaaccugcucugccaaucauauaaaaguacagcuauauaauuacacauuauuguacauugcugugaccuuccuggcuggggucuggagcucugacuggguaguaagguaauggagaaaaagauaagcugggucagguggucugugcuauccugaggccacacaucccacugugaacaaccuggaaucucagcaugcaucaguaccuuuuuauuauguagagcauggauuugggguggagaugggggcagaaguuacuugucuugguaggaggucucuguaggcgagcagucucgggccuuaaauguucagcagaaagaagcugcaguugcuaguauuagcaccagucugaucaauucuuuguaagcacuagaacuugggucaguauaaaccagguuugggggcaugcauuugcuucggcacugcauggcugaggagguaugauaguaagaaguuugagagcagccugggcuaugugaugaguuuaggccuagucugggguacauagucuaagguccaagcaucugcucucccgaugacugccacucaggguuacucaucugugagucauuuuguacugaagcuguugaacgaggugaguuucuuaggcucuggaggagcagcacugcaauacuuuccaaauuaucuuccccuggauguguguacacuuaagagugguagaguuuacuggcuacuggcaugcucaaggguggauucacauuguuuguggcaaaguucuguugcuauuuaggcauuccuguuaaccccaagaaggugcgucucgcugccuuauuuuuuuguggauccagauuucuugcuuuguagcuuggcuacucaaaccauuacuugagucugaauguauuuuuuguuguuuuuucuuuccacuucuuuuuuguauuauuauuuuuauuauuauauuuaacacaauacauauuuucuaccagucauaaaaaugaugggcacguuauuaaaugaacauaaaaagauaaaguuuuuuuguuucuuuguuuguuuuguuuuuaguaaacauuaaaaucuuggcuuuuacugugguacaaccccaaaauaagaacaaguuuuagacauuggaguucauuguaauaaggcuguacuucaauguaccucacaccaacaaaggauuuuaccuccuuaguaacuaagauuugacugcuacugcaccaaggaaugaauuguaggcacaauuauucgaauacagauuuccugcuauggucaaagcuauuugacuugagugauugucaucauucucagcccacagggaacagguuacauucauauaagaaaugguguguguauuaagauggucuauccaugaagucauucaucaaguguuucaaugaacaaugguucugcuuggagggaggcacagacauuaggugaggguaagauucuaguucauuggcugugaugauuuugaaaaguagucaucucuggaaaagaguaacuuacaaggucaucuucuucaaaguugauagaauaauuuaaauaucaagcaaaacauucugucucacucuguuguucucuuacaaaccaccucccuaacuaauugucuauguuucuuuuggcuauauagauacuuuugaaauauguaagcuguucugaaaaccauauuauaauguaaaagcaucaaauaaacaaucccacuacuagagagggagagauaggggaagcaugauuucaagaccaucaugugauacacaguaagguacuaucauguacaaacaagcagaaaguguauauggacuguacaauauuggaccuauuucucaaauuaccaaauuaaagagaccacugggugacagccaacaaauuucuaauuccucauauuuuugaauuucaauccauuaggauauguugguaauauuaauuuucauauugagagauauuaaggaaaagugauuguuacuuucuguuauuuuuuguuguuauuauuguuuguuuguuguuauauuuguguggcuaucuucuuuuggguuuguugaaagaauacuuucuugcuuuuucuagggugucucugcuuguugguaauuuccaucuaauaucuuucauagggcuggauuuguggaaagauauuguguaaaguugauguuucauggaauaucuuguuuucucugucuaugguaauugagaguuuugcuggauauaguaggcugggcuggcauuuguguucucuuagggucugaaugacaucugcccaggaucuccuaguuuccuagucucuggugagaagucugguguaauucugauaggucugccuuuauauguuauuugaccuuuuccccuugcugcuuuuaauauucuuucuuuguuuagcgcacuugauguuuugacuguucggugacaggaggaauuucuuuucugguccagucuauuuggaguucuguaggcuucuuguuuguccaugggcaucucuuucuuuagguuagggaaguuuucuucuaugauuuuguugaaauuauagaauaagauauuuacuggcccuuuaaguugggaaucuucgcugucuucuauaacuauuauccuuagguuuguucuucuccauuguguccuggauuuccuggauguuuuggguuaggagcuuuuugcauuuugcauuuucuuugacuguugugucaauguuuucuaugguaucuucugccucuuugauucucucuucuaucucuuguauucuguuggugaugcuugcaucuaugacuccucaucucuuuccuagguuuucuaacacugggauugucucucuuuguaauuucuuuauuguuucuacuuccauuuuuagaucuuggaugguuuuguuuauuuccuucaccuauuugauugugauuccuguaguucuuuaagagauuuuucguuuccucuuuaaaggcuucuaccuguuuaccuguguucuccuguauuucuuuaaaggaguuaucuaugacguucuuaagguacucuaucaucaucaucaugagaagugauuuuagauuagaaucuugcuuuuccuguguggucguguauccaggacuugcuauggugggagaauuggguucugaugaggccaaguaaccuugauuuuuguugcuuuuguucuucugcuugccuccugccaucagguuaucucuagugcuaccuguccucgcuauaucugacuggagccugcccuucuuaugauccugguuguaucauaacucuucagagucaagcugucuuagugauccugugauucugagauccugugauacugauauccugggugugaccaaacuccuaggagucaagcuaccucugggaccuggagauccuggugugaccaagcuccuguguuccuguguuccuguguucccgugauccugugauccugugauccugggcauguuaaaaugccugggaguggggcuuccucugggugcuguggggcuggcugcagaguuugcacccaaggucugcucagggcauuggcccagauuggaagaaaccugugccacuggguugggcagagaucauguguuccuggguccugcuugucccacuuacuccugguguuggagagucugaauuuauucuaagucuagguacacauuacaacaaaguuacuucauaaggccuuugaguuugacaugaaaccaauaaugaagcuggcauugcuguauauaugcccaucauucagugcacuuaaaguuuuguuagcaaugucuccucuaauuugggacuauacucucuuugcuaacuacaucacucugggucucaucuccuugugggaugaggaagaaauuaacaaauauauguaaaacauuuagaaugagacuugaugucucagaucuaguccagguaagggauauguguuuguaacaguucauaucaaauguuugcacauauggauauguguguguaacaguucauaucaaauauuugcacauguggacauguguguguaacaguucauaucaaacguuugcacauauggauagucacuuuaguugaaagggguccauuugauccuucacaauugaaaauggaauuuaaaaugcuuugaaagucugccccauuuccgugugccccuccccauuuaguguuuuuuuccugggggcccagaguauaaaugcugcaaguaagauaggagcaggaaagcuggccgagaaugagaagucggccuaagauugagaccuguuugaaacagcuccauuucacguagggccuauucugcaaggauaucucucguguuuacuacagccacauaaacuggaccaaugcauuuaggaauucuuaaagaaggauauuuuucuagagauaaugacacaugucuaaaaucagugcuucagaguucaagacaggaggauugaaaguuucaagccagucugggcuacaaagugaaacacuagcuacaaaauauaaaaugaaagaugaaaaagaaaagaaggagaguagaaauaagacuaccaaaaaaagcgguugggggaaugugagugugugugugugugugugugugugugagagagagagagagagagagagagagagagagagagagagauugugugugugugugugugugagagagagagagagagauagauagauugugugugugugugugugugugugugugugugugugcaugcauguguguugauaccuauguuugcacaugguauguggguguuugggcccauacauacauauggaguccagaacucaacuaggaaugucucuuuuccuuuuuuuuuuauuagauauuuucuucauuuacauuucagaugcuauccccaaagcccccauacccuccccugccuugcuucccaacccacccacuccugcuuccuggcccuuguguuccccuguacugggacaaggaaugucuuuauuuguugaaauuuauuuuaguuucaauaaagauuuaguaagaagauuaaauguaugauggugagaguuaauagauucaaggugagauucauucauucauuuauugaaugagacagggucucucagugucccuacagcuuguuguuuugggcagauccguuggucacaagccauugggaugugccugucucugccuacuccaguucuggauuacuggcucacacugccacacucuacuuuuccaugaaugguggggaucugaacgaugguccacaggcuugcacaccaugcacuguauccauugagcuaucucucaucagccccugcauauucagugugugagugugcaugugugugugcacacucaagugcgugugagugcaugugugagugcacauguaugcauguguguaagaucaaagcacaaccuccuguggcauccuuagggauacuguucacccguuuugagccaagggcacacugugccuggagaugaccaauugggcaagccauggcagccaacaaaucuuggggauccuccugucucuaccuccccagcaccgggauuacaagcaaucacccagcaucucaggucucccugauggcauggcaaguucuuuuccacugaaccauccauucccagcccacuucugggcuuuuauuucauaucuugaagguaugauucuacugucuugacagucgcaugguuuaaagaauacaacuauaaaacucccccugucuucuggcuugccuauccuuucuccuggguucuuuuccugucuucuuucuuugcucuucuguaauguccuguacuguguccuuggguguaaaagcucuuuaauuaucuugcuuaggguuuggaaacuucaucuuaucuugucuuucaucuauuugagaaauucagccuucaucuuccaaaauacuauuccuguugauucuacccugaaguucggugcuucccuguguaacaaaggagagcuuacucagaacuuccaggaacucuuugguuauuuaguacuauuuacgcuuuguuuuuuaagcccuuuucucaguccauuaacuugucuuaguuguguacaaagugccauuauuccuuuggcuuuguguuucaaaacauauuacauuuucauauauuguauguacuccaacuuuuucaaauuauauuguuucucuuuaagaaaaaaaacaagccuaaagcuuguccagucauuugauaguauauuacaaguaucuuuaaaaacaugcuuucuaagcuagauuaaguacccaaggagcugaaggggucugcaacccgauagguagaacacccauaugaacuaaccaguacccccagagcucaugucucuagcugcauauguagcagaagauggccuaguuggccaucauugggaagagaggccucuugguauugcauacuuuauauaccccaguacaggggaaugccagggccaagaagcgggaguggguggguaggggagcagagcugggggaguguauaggggacuuucaggauggcauuugaaauguauauauaaagaaaauaucuaauaaagaacaugcuuucuuugagguucugaagaucaaaccccagcucuuucacaugccaugcaaguucucccccaccccuuuuuauaccuuuaaagaaacaguuuggggacugaagagagagcuggaugaguagaguacaugaaacugaguuuggauucucaacagccugauaagcaucugggcaugccuaggugugucugugacacucaugcugugggaggaaagacacagcuccagcuggguggugaccuuuguuccuagaagucaagagggaagguuaaagcagcacuucugaugucucagccugccuuccacaacgugcugcaaucugccagugugcuuuaagccuagucccagguagcugaaggacagcaauaccaacucuucuuugcgaacugggucauuuuuaccuuucccaaacauaguuccuuuccauuagacccucuguacuuccuggcuuuccacaaaaggccucuagagacauguucagccugaagaccaaugggacaugugaucagugugagccaugaaugcagaucaacacaaccuugugaacuuacuuaaaacauuuugaagugaggauuuuuuuccauucuuuucucuguuuuagauuuaaaaaauguguucaugccgggugguugugacacgugccuuuaaucccagcacucuggggacagaggcauauggaucucuugaguuugaaggcagccuggucuacaaagugggcuacuggacagacaaggcuacacagagaaauccugucuugaaaaaaacaaaacaaaauaaaacaaaucaaaucaaaacaaaacaaaacaccaagaacaguagcaaucaccaccucaacaacacacgugguucuugaggccagacuuuguaggugucagguccugcagaaagauuagguugucaugccugguagcacauguaugcaggcaggucuuagcacaguuucaaaugcuaccacaugguggcaguaggaagcaacagaagggaacugaagaggcugacuuucaaaccauaucccaaguuuggacacaacuucagcaauuuguccuuaagaguuagaucucaagucuucaugauggccagacuuuccuucaccacugaacaacaccuucaguucagcacauaauguuguaaucacugggugaauuuccugucagaguagaccauguuaccccacccuauucuaagucuaaucucauacuauaucuaaucaaaacaccgaauuuagaguguugagagguuuccagauuucaauaauucugauuuacuuagaguucaucuuuaucaaaacuaugauuauuucuuucaaaaaacuuacaguaggcagaaauucuagcuaaauaauucaagaaguaugcauuauuuuacaauauauaguauauacauuguuuuauuaucacauuuaccuuauauuuguauuuuauuguuuauucauauauuuauuaauauuuagauuuuuacuacauaauauuuuguuguauuaugguuuauguuaucuccacuuugcucauuucucuguuaggcucuaauggguugacucuuuuauucacauguguauccucuuuccaauuuugguuuuccaguagcggccuugauuuagaguguuuucugaauugucagucccuaguuuggauccuguuacuccuaggaugagaaagcauugaccauagaacucauauaauucuguuuuugaagagcaccuuucuuucuuuugguguauccuuuucuucugccuccucaugaccccuuggcucuuuccauuccccacuguauacaggguccugugaagagccuguggaaguaucagggucagagagauugggaauccuuugacacaggaagcugaauccaguacuucacuaccaugcaacaaagcaaccguugcuagcuucugggaaaugagucaggaacucucauauuggguggagaauuaacugcccuucuuugaaauagacuccauggcucgcaaccccuugcaagcaccacgucaggaggauuuggugugggcaccuccuuagacaacugcauuuauauccgcacauauccucccccaacauaauuaugauuaauauauaagugauaguaaugauaaacucuucuuuuucauuuuuauuauuuuaguucuuuguaauuuauuuuuuaaauucccauuucauccgaaccauagcggcccucccuccucucuucccagucccagccuuacaaauccccuccuacuacuaccuccuacccuucaacucagagaagaaguaucccuggagugccaccauacccugggacaucugaacaugggcuuuaauauccuuauccuagcuuccuggaagccagucucuuccuagcagccuucagaugaagaugaacucucagcucugccugcaccaugccugacuagaugcugccaugcuccugccuugauaauaaugaacuaaagcucugaauguguaagccagccccaauuaaagguugucuuuguaaggguugccuuggucguggugucuguucacagcaguaaaacccuaacuaagacaccuggucaucacccaucuucauccccucucccaccuuguuuccucucuccaucuaccucugaugacucuuuuguuuccccuucugagugagagucucauauccucacuuggggccuccuuauuaccccaugucuuugggucuauugauuguagugugguuguccugcacuuuauagcuaauguccaauuauaagugaguacauaucuuagcaaauaucuuucugagucugaauaaccucgaucaggaugauauucccaaguucuacuaauuugccugcaaauuucaugaagucuuuguuuuuaauagcuaaauuguauuccacuguguagauguagcacauuuucuuuauccauucuucaguugaaggauaucuagguuguuuccaguuucuggauauuaugaauaaggcugcuuugaauguggagcaggugucccucugguaaugagaggauccuuuuggguauauguccaggaaugguauagcuggaucaugagguagaacuauucccaauauucugagaaacuggcagauugauuuuuuuuucgucaguuuagguaucauccauuuauuauaaaagggaggcauggaaauuauuuacaugaugaaauaauucacgacaucuguggaaugggcaguuucacaugacaucauuucaucagcaauuucaguccgcauacuuuccaaaaaugucacuaucucuaaauaagaagaacuaauccuugucgucuagaacuacuucguugccuccauauucugggagaagaacuuuaucuccaacuuucacacugacaggcucaaucucuccacucuuuccuuuccugccugaccccacagccacgaccguuccuugcaauacuuuuccuugagacuuuucuggaagcauaaugccaccuuuggcuacaauuucggcggcauuccuuucaaccaauacucugucagcaaucagaagaaacuuccuaaaugcuuguccugucaugacuugcacugaaagugguuguguaaguucaccagcaauggaggacuguuucccuugccccacauccacuccagcacgugcugucacuuggguuuuugaucuuagccauucugauggguguaagguggaaucucagaguugucuggauuuaagugaaggacagguaaaauauuuugaauuaaaaacaucaaaaaagagggauaauauuauggguagggagguggggcagaucaggggggaguugggcaguuaugacuaaucaauaaacauaagaaaagaguuaauaaaaaucauuaaaauauuuggaauguuaaaaauaauuugaacuugucccaucaauucaauuccucaacacuuaaauucaguuguuauaacucacuaauuaauaaucuaaagaagaaaaaaccaugaaaccaaaugaaguaauuuauugaaauccaacauucauucaugacuuuaaaacauggccagcaauguuguucaauaguuaaguucuuugccuaguaugcacaagacccuagguucaaucauuguacacgcacacauacacacacacacacacacacacacacacucccucacucauacaaacacuacaaguaaaagaaaaauuucuaccagaagaaaaaaagucuauagcaaacaucauacucacuuuuucaaaaaugaagaacuuaccuugagaucgaguacaagauagagaguaaaaugacauuuucacugaucauuuuucuggacuugcaaacuaaccuaguaguugaagacacauaauaaacauguaaaguuuagguauaauauuucaaaacuaucauaaauuacaaauuacauaauauuuuuaaagaaaauauaaucuacuagccaagugacuggcauuguuaggcaaccuugucuuuacaaaagcagcacuagccauggacucucuggagucaggauuuuuaucugucuuccucaguucccuccucuccucuucucauacccugccagcauucuccaggacacuacacagacuuuagggagauaacacauugcaaggguuuaagaguccuauuggagucucagcucugcuauaggucccuuuaccucucuggacacuaagaucuucacuuuguguaauggaaugaauaagcucaagugccugaccacaguucuuugcauggucucuaguucuaagacucuuugguagacuuugugaaagucauuaauguuaauaccaauauauucaaacuacaaucgaagccacacuugucuuaauuagcuuuucaucacuguggcaagugucugagagaaauuguauacaauggaaaaaaaaaaguucauuugggcuuaugauuucagaaguuuugguaccagcuccauugcuaugaguccguggugagucaaaacaccauggaagugggcuccuguaacacaggaggacacucacaucaucaaggccuguaagcgaagggugagaccuagcgggacuuggaacaagauauagauagcaucuaagcacauguucccauugaccugcuucucccaccuagguccuaccucugcaaguuccuaccaccuuccaauaauguuaccaaaguaugaaucuaucaguggauuaauccauugguuagaucagagccucaggaucuaaauaccuuuuaaugguuaggucugcuagcuaugaucaaagccgucaguccacaugucuuuacagggagauugggaaacauuauauacaaaccguagcaauauuaaaagcaugacauagugcccuauucaggguguuuugggauauagauuuugguggguucauuuuugcccacuauuaaaucaaaauuugcacaucuucuagaaagauaaacaccuuccagauaaaagcacaaaaauuuccugcuggccucacuggucaacuauuuguuuuuaaauaauucaaaauuuauuaaagggaacuuacaaauaaaaaccaucacacagugaaauuagccagacccaaagucuauaaauuucagugaacuucuauccaguuggaacaaccauuuugaagauuuggagcuucacguuagauuuuacccuuucauuaucuaguacauguuuaggaauuuacccaccacaaaaacuuggagaaccccaaacagaguuaaaacgggaagaacucuuaguucuauaaucucuuucaugacucaaguguuuauuaccuguauucaguccuucaucacccagucuccuuuucucuuuucugcaugcuauauuuuacccaaaggcaauuucuaguguguacuagaugaaacacacacacacacacacacacacuuauacauacauguuaagcuagaguuuguguaugaggaagaacauguauuguuuucuuucugagauuaagugacugugugugauauuguauaugcucaguguauucauuuuccuucaaauaugauuuuauuuuucuuuagagcuaaauaauuguccauuuuauauacaugccagauuuucauuuuccauucaucaguugauagacaacaagguuuguuucauuuccuuguuauagugaauaagcaucaauagacaugagaggugcaaauaucccuguggcagauuaucaaauucucuggguaugugccuaggagugauauagcagggccaugcaguaguucuagcuauaguuuuugagaaaucaccccacuuauuuucauauugguuguauuaauuuguacuucaacuagugaacaaaagucugucccuuucucccucaaugccuccucucuucuuccccucccuucucugucucucugucucucucucucucucucucucucucucucucucucucucacuuccucucacucuggcucucucuugcuucucucucucucucucucucucucacuuccucucacucuggcucucucuugcuuucacucucccauucucucacauugucagucuuauucaugauagacauuuugacugggaggaggugguaucucaucaaaaauacuuuugauuuucauuucucuaauggccagggguauuaaauguuuccaaaaacagucauugguuguuugugguuuuccuuccuuuuuuuuuuaaacuguucauucaauuaguugaccaaauuguugauuaguaguuuccuugucuuaguguuugcaauuugcaauucuuuguaaauuacagauauuggccccuugucuaaaguacagcuggugaagacuuucuaauguucugucuuaucucuugauacuuuauuuuauuagugugcaaccccuuuucauucucaggagucucaucuugcugauaccuggggcuaguuccuauguuaaugcuguucuauauagaauuuucuugucugccaaaaaguccuaaggaguauucuucauguuaucaucuacaaguucuagugauuuggguucuaaauuauccucuuugauccauuaugaauaggguuuauacaaggugaaagcuaugaauguuaauuucauucuucuauagguaguuuuugagcacaaauuguuggcacaaugguagcacaaaccuuguggacauauccaacuaauaucugccuucauuuaaggcccauuccacaagguggaacaagaaccagacauucgauagucuaggacccaagguaaaaccaaauaauacuggucuaaaaaaauuaacaaacagacaacaccaaaucaaacugacccaaacugaacuuguaaugauaaaauggcuucuaauggcacuuugcuauacucauagaucaucauuacagaagcuuccuucuauggcagaugggaacaaauacugaggccucuagccagacaugcauaaaguaagagaccuugaaacauuuggcccuaaauuggagucuucaucaaauccuuccccucccaggacucagagaaccccacagaggaggaggaagagaggguguaugagccagaaggcguggaggaaauaaggccucuaagucaacaagaugaaaguccauaugaccucucagagacugaggcagcaugaacagggccugcacagcucugcaucaggccuuuuuauaucuauuauaacuucaaguuuaguguuuguguaggguuucugaauguauaugaaugagugugcuucugauucuuuaugccuuccuuuuggcucuuuuccuuguuugucuuguucaacuccaaugugauaguuuuuguuuugucuuaguauauuuuauuuuguuauauauuauuauuaucauuuagaagccuguucucuucuuuucuguucuuugcuuuucucucuucucuucuuuccuuccuucccuuccuucccuccuuccuuccucccucccucccuuucuuucuucuuucuuucuuucuuucuuucuuucuuucuuucuuucuuucuuucuuucuuucuuucuuucuauuuuugagacaggguuucucucuguagcccuggcuguccuggaacucacucuguagaccaggcuggccuugaucucagcaaucugccugccucuaucucccaagugcuaggacuaagggcaggugcaaccacugcccagccuuuucuuuucuucuuuauagaacaaaguuuuuuuuauugaaaauuaguacagggguuccgggacuccgccgaacuuaggaaauuagucugaacaggugagagggugcaccacagaaccggacagcuucugggacaggcggaggcacagagccgcugaggcagcacccuuugcgggccgcagacagccggccacuguccggaccagaggacaggugucugccuggcucggaaggccucagccucaggaguagcaggcgccaccuugguuccgggacuccaccgaacuuaggaauuuagucugcacaggugacagucugcaccacagaagcugacagcuucugggaccugccaaagcaacacagcuucugagaaagguccuguuaugggccuucuucuucggccaggaggagguccaaacacaagauaucugcgcaccuucccuguaagagagcuugccagcagagagugcucugagcacucaaacucagaggagagaaucugucucccagguaugcugauagaugguaacagaaucaccagaagaacaaucucuaaacagagucaacuauaacaacuaacuccagagauuaccagauggcgaaagguaaacguaggaaucuuacuaacaggaaccaagaccacucaccaucaucagaacccagcacucccacuucgcccaguccagggcaccccaacacacccgaaaaccuagacccagauuucaaagcauaucucaugaugaugguagaggacaucaagaaggacuuuaauaacucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagugaggcaacacuggagauagaaacccuaggaaagaaaucuggaaccauagaugcgagcaucagcaacagaauacaagagauggaagagagaaucucaggugcagaagauuucauagagaacaucggcacaacaaucaaagaaaauggaaaaaugcaaaaagauccuaacucaaaauauccaggaaauccaggacacaauaagaagaacggauaauagaaaguggauaauaaaaaccuacggauaauagaaguggaugagaaugaagauuuucaacucaaaggaccagcaaacaucuucaacaaaauuauugaagaaaacuucccaaaucuaaagaaagagaugccuaugaacauacaagaagccuacagaacuccaaauagacuggaccagaaaagaaauuccucccgacacauaauaaucagaacaacaaaugcacuaaguaaagauagaauacuaaaagcaguaagggaaaaaggucaaguaacauauaaaggcaagccuaucagaauuacaccagauauuucaccagagacuaugaaagccagaagagccuggacagauguuauacagacacuaagagaacacaaauuccagcccaggcuacuauacccagccaaacucucaauuaccauagauggagaaaccaaaguauuccacgacaaaaccaaauucaaacauuaucucuccaugaauccagcccuucaagggauaauaacagaaaaaaaccaauacaagaacgggaacaacgcccuagaaaaaaaaagaagguaaucccucaacaaaccuaaaagaagacagccacaagaacagaaugccaacuuuaacaacaaaaauaacaggaagcaacaauuauuuuuccuuaauaucucuuaacaucaauggucucaacuccccaauaaaaagacauagacuaacaaacuggcuacacaaacaagacccaacauuuugcugcuuauaggaaacucaucucagagaaaaagauagacacuaccucagaaugaaaggcuggaaaacaauuuuccaagcaaaugguaugaagaaacaagcuggaguagccauccuaauaucugauaagauugacuuccaacccaaagucaucaaaaaagacaaggaggggcacuucauucucaucaaggguaaaauccuccaagaggaacuaucaauucugaauaucuaugcuccaaauacaagggcagccacauucauuaaaaaaaaaaaaaacuuuaguaaaucucaaagcacacauugcaccucacacaauaauagugggagacuucaacacaccacuuucaccaauggacagaucauggaaacagaaacuaaacagggacacagugaaacuaacagaaguuaugaaacaaauggaucugccccuccucuacagaacauuuuauccuaaaacaaaaggauauaccuucuucucagcaccucaugguaccuucuccaaaacugaccacauaauaggucacaaaacaggccucaacagauucaaaaauauugaaacugccccaugcauccuaucagaucaccaugcacuaaggcugaucuucaauaacaaaauaaauaauagaaagccaacauucauguggaaacugaacaacacucuucucaaugauccuuggucaaggaaggaauaaagaaagaaauuaaggacuucuuagaguucaaugaaaaugaggccacuucauacccaaacuuaugggacacaaugaaagcauuucuaagaggaaaacucauagcucugagugucuccaaaaagaaauuagagagagcauacauuagcagcuugacaacacaccuaaaagcucuagaacaaaaggaagcaaauuuacccaagaggaguagacggcaggaaauaaucaaacucagggacgaaaucaaccaaguggaaacaaaaagaacuauucagagaaucaaccaaucgaggagcugguucuuugagaaaaaucaacaagauagaaaaacccuuagccagacucaguagagggcacagggaaagcauucuaauuaacaaaaucagaaaugaaaagggagacauaacaagagauccugaagaaauccaaaacaccaucagauccuucuacaaaaggcuaugcuuaacaaaacuggagaaccuagaugaaauggagaaguuucuagacagauaccagguaccaaaguugaaucaagaucagguuaaugaucuaaacagcccgauaucccccaaagaaauagaagcagucauuaauagucucccaaccaaaaaaagcccaggaccagauggguuuagugcagaguucuaucagaccuucaaagaagaucuaaucccaguucuucacaaacuauuccacaaaauagaaacagaagguacucuacccaacucauucuaugaagccacaauuacucugauaccuaaaccacaaaaagaccccacaaagauagagaacuucagaccaguaucccuuaugaauauugaugcaaaaauccucaauaaaguucuugcuaauggaauccaagaacacaucaaaacaaucauccauccugaccaaguagguuucaucccagggaugcagggaugguucaauauacagaaauccaucaacguaauccaguauauaaacaaacucaaagacaaaaaccacaugaucaucucguuagaugcugagaaagcauuugacaaaauccaacacccauucaugauaaaagucuuggaaagaucaggaauucaaggcccauaccuaaccaugauaaaagcaaucuacagcaaaccaguagccagcaucaaaguaaauggugagaagcuugaagcaaucccacuaaaaucagggacuagacaaggcuguccacucucucccuaccuauucaauauuguacuugaaguccuagccagagcaauuagacaacaaaaggagaucaaggggauacaaauuggaaaggaagaagucaaauuaucacuuuuugcugaugauaugauaugauaugauaugauaugauaguauauauacgugacccuaaaaauuccaccagagaacuccuaagccugauaaacagcuucagugaaguagcuggauauaaaauuaacucaaacaagucaauggccuuucucuacacaaaggacaaacaggcugagaaagaaauuagggaaacaacacccuucucaaaagccacaaauaauauaaaauaccuaggcgugacucuaacuaaggaagugaaagaucuguaugauaagaacuucaagucucugaagaaagaaauuaaagaagaucucagaagauggaaagaucucccaugcucauggaucggcaggaucaauauaguaaaaauggcuaucuugccaaaagcaaucuacagauucaaugcaauccccaucaaaauuccaacucaauucuucaacgaauuugaaagggcaaucggcagauucaucuggaauaacaaaaaaccgaugauagcaaaaacucuucucaaggauaaaagaaccucugguggaaucaccaugcccgaccuaaagauguacuacagagcaauugugauaaaaacugcaugguacugguauagcaacagacaaguagaccaauggaacagaauugaagacccagagaugaacccacacaccuauggucacuugaucuuugacaagggagcuaaaaccauccaguggaaaaaagauagcauuuucaacaaauggugcuggcacaacuggcuguuaucauguagaagauuucgauugauccauuccuaucuccuuguacuaaggucaaaucuaaguggauuaaggaucuccacauaaaaccagagacacugaaacuuauagaggagaaaguagggaaaagccucgaagauauggguacagggaaaaauuccugaauagaacagcaauggcuugugcuguaagaucgagaaucgauaaaugggaccucauaaaauugcaaagcuucugcaaggcaaaagacaccgucaauaagacaaaaagaccaccaacagauugggaaaggaucuuuaccuaucccaaaucagacaggggacuaauauccaguauauauaaagaagucaagaagguagacuccauaaaaucaaauaaccccauuaaaaaauggggcucagaacugaacaaagauuucucacccgaggaauaccgaauggcagagaagcaccugaaaaaauguucaacauccuuaaucaucagggaaaugcaaaucaaaacaacccugagauuccaccucacaccagucagaauggcuaagaugaaaaauucagguggcagcagaugcuggagaggauguggagaaagaggaacacuccuccauuguuggugggauugcaagcuuguacaaccacucuggaaaucagucuggcgguuccucagaaaauuggacauaguacuaccagaggauccaguaauaccucuucugggcguauauccagaagaugccccaaccgguaagaaggacacaugcuccacuauguucauagcagccuuauuuauaauagccagaagcuggaaagaacccagaugccccucaacagaggaguggauacagaaaaugugguacauuuacacaauggaguacuacucagcuauuaaaaagaaugaauuuaugaaauuccuaggcaaauggauggaccuggagggcaucauccugagugagguaacccaaucacaaaggaacucucacaauauguacucacugauaaguggauauuagcccagaaacuuagaauacccaagauauaagauauaauuugcuaaaaacauuaaacucaagagaacgaagaccaaaguguggacacuuugccccuucuuagaauaggaaacaaaacacccauggaaggagguacagagacaaaauuuggaagugugacgaaaggauggaccaucuagugauugccauauccagagauccaucccaugaucagcuuccaaacgcugacaccauugcauacacuagcaagauuuugcugaaaggacccagauagauauagcugucucuugugagacuaugccagggccuagcaaacacagaaguggaugcucacagucagcuauugaauggaccacagggcccccaauggaggaacuagagaaagcacccaaggaacuaaagggaucugcaacccuauagguggaacaacauuaugaacuaaccaguaccccggagcucuugucucuagcugcauauguaucaaaagauggccuagucggccaucacugcaaagagaggcccauuggacuugcaaacuuuauaugccccaguacaggggaacaccagggccaaaaagggggaguggguggguaggggagugggggugggugggcaugggggacuuuugguauagcauuggaaauguaaaugagcugaauaccuaauaaaaaauggaaaagaaaaaagaaaaagaaaacacagugaacacaggaacccaauacccagucacuucacauuucagagcgcacaagaaggagguguaauuacagugguuaauugguuccugguaaaaugucacugcagaugagagcucauuaauauggcauuucaaucacaagagaugccagguguuuuauuuagggucuaugaugugcuggccugacuuccuucuuggguuacuucucuccguggaaaagaaacuacaaacaucaauuuguaccuuaugaucaaaaaauaugcuuuucguaauauauguuuaagaaaaaaaagaacaaaaaauuaaaacaaaaaaaaucccaaaaaagccugcauaucauguucacagauaugcuucuacauaauauagaaaauguaucccacauuuuaaaaaauaaacuuugcaguuauuguauuuaaaaaaaaauugaucuagucaaguuugcuguccuagcaagauaauaggucaugaggcuaauugcuauuucugcuuuuguaaucaaacuucuuuuauucugcucaaugcuacaacaacugccagacauauauguuaaaauaggacccugccuacacagacagaauccauguaaucuuggguuuuggacuuuauaugucuuggacugauaugacuaggugcuacaucuuaggaguacucucaauugcaauccuagugccaugaggauugggggcuaagauauaauauagccuauuauuacaauuaauuguuaauuauauuauuauauuauuaguuaauauuauaauauuauuauaaucuauucauagucauggugaaucucugaguuauaccagacaggagcuugaugguguuugucuugcuuuguuuggggugaugcucauuuuguuuucuagauuugggucauuuuagugcugcauggauuugaguuguuuuuuuuuguuguuguuguuguuaaaaagaauuuaaaguuagaugaguugggaagaggagaggauccagaugaacuugggagagggaaaaauaugaucaaaauauauuuaaauauaaaaauuguuuuaaacuaaaaaaauaaaauauagagaggucuuuagugauaugcauggcuguucccucauuuauauacuauauacauaaauauaauuuuauauuauagacguucuacauuauauauuugugagucuaugagugaguauguguguuagccaggccucaccccuagacuacuuuacuggccauuucuagccccucaaaauacagguggccaaacuucacccuauacagaaaauucucgaacucgaagcaccaccaaucccagagcuugccccaagaucaggccucagaaugccaccaauuugaggccacccuugaaagcuccacuacccucuaaccaaaaaaaucccuguaugaagccuaccuuaggcuaaguucuuugcuauuuuuuccucuuucccaauaaaucuuguguguaagaaaaaaaaaaaaaaagaaaaaagaaaauuaguacagggagcugaaacccuucaagaauuggagauauggcaauugauguagucaugcauuaggacacaucaaaauguuuggcuuuuuaaugagcuuuauuuuaaacaguacaaagcuaaaaugccucuacaggaaaauaacuggaaaauuaacauuauguaguaauaauaccauggaauacuuagugauguacaugcaaagcagcucuauuuagcauuggucauguauuccugaaacacaaugccuggaauuuuguaaugagagacagaaaaggaguggaugguggauaggagggaacuuggggaggaacugagaggaguagaaggaaaggaaaccauaaucaggacacauuuugugaugauaaaaaaaaaaucuauuuucaauaaagggacuggaaacagaagcucccccacaguguguaauauuguuuuguuuuugaauuuucaucagaaauuagguaucuguaguugguggacuuaagucugaguucuuaauucaguucuauugaucaacauauuugguuuugagccaauaccaugcuuuuaaaaauuuuuugcuauaacucuguguaguacaacuugagauagaacauggcaaugccuccagcuguucuccuaucauucaggcuuguuuuagcuauguguguguguguguguguguguguguguguguguguguguguguguguguguguguuuguauuuacauaugaaggugaaaauuggucuuucaauuucugugaaggauugugucccaguuuugauguagauugcauaaaacuuuugauugcuuuugcuuugauggccauuuucacuauauaauccuaacaauccaugagcauagaaaaucuuuacaucauuugauaucuucuucuucuuucacuuucugggcuagagcuaucccaagauauucugcuucuuguuguucuugguuuugugguuauugugaaggguguuguuucuuugauauuuuucucucaaggccuuuguaacuuguguacacagggcuacugauuuuuagguguuaauucuguaccauucuucuuuccuaaaaacacuuaucaaguguaaaauuucccaguagaguauuuaggaucucuuguggauacaauccuaucaucugcaaauaaaaauacuuugaauuguuuuuuuccuauuugauccucuucucaugccuuacaacucuagcuaauacuucaaguacuguugugaauaguauggagaaaacgaacauuuuugcacucucuuguguguuuuucucuguuuagguugguauuggcuaugagcuugcuggaugcuaccuuuauuaugcugagguaugucacguguacgucuaaucuguccaggacucugauugaucaugaagggaugcuggaucuugucaaaggacuuuucugcaucuaaugagaucaucauguggcuuuugucucucaguuuguuuaugugguuuauuaugcuuaucaguuugcuugaugaccaauccagcucagucagacaacagggucucaagcgagggagugaggauugaaaagaaaaagacaauucaaaaacauuauagcaugacuauauugugcagauuuuugaaguaugcccauaugauucucugcacugccucacugucuguugugauguuucccuuuugucucuaauuuuauuaauauggaucuuuccuuuccauuuuuuuuuuguuuauuugacuaagggcuuauuaaucuuacugauuuuucucaaagaaccaacucuuuuuuuuaauugauucuuuguauuguugguuuuuugguuucuauuauauugauuucaguucucaguuuaauuuuuucauccuuugggguguuaguucuuuuaguuuuuuaguucuagaguuuucaggugugccaugaaguggcuaauaugagacuucuuuuuuuguuuuuuguuuuuuucuuaauguaggcacuucugacuaugaacuugccuuuuggaacugccuuuauuguuucccacaguuuagguaugccauauuuucauuuucuuuucuuuuuuuuuuaagauuuauuuauuuauuauauguaaguacacugaagacacuccagaagagggcgccagaucucguuacggaugguugugagccaccaugugguugcugggauuugaacuccagaccuucagaagagcagucgggugcucuuacacaccgagccaucucaccagcucccuauauuuucauuuucacuaaauaauaaaaguuuuaaaaugcauucuugauuucucucuugucccauuuuuuccaauaauuaacuuuuaaauucacuuuacauccagauuuuacuccauucccccucuucucccagucccacccuuacaagucccucuccccauugcccacuccccuucucugaagacaagaggagccacccuuggguaccacuccauccugggcugauaucuggucccagcaggacuaggcaccuccucucccacugaagcccaaccaggugguacagguaggaguuaaggaggcccaauggcagggaacagagacuaagacagcccaucucucuacuuuccauacccccacuuacccuguuagggaacucacaugaagaucaagcuacauuugcuacaaauguguaggggggucuaggucuagccucugcaugcucccugguuggcagcccaggcucuaugaguucccauggucccagguuacuugauucuauaagucuuguguuguucuugucuccucuggcuuggucacuucuaucucccagucuucucuagaagauucucuaagcucugccugauguguuuggcugugcgucucuguaacugccuccaucuacuguuggaugaaacuucacaggagacauuuaugcuaggcuccuaucugcaagcauagcagaguaucguggagagugucaggguuugacgcucucaaauggguugggucaguuuucaugaguuuauauacuuucuguuguuguggauauucaucuuucauccauugaggucagguaaaauguaaaugucauuucaauuuucuuuuaucuguugacacuaacuuuguguaugaguaugcggccaauuuuggagaaaguuacaggaggugcugagaagguauaaucuuuuguguuuggaugaaauggccugccaauauuguuuuguuuuguuuuguuuuguuuuccuacauccaucugauuuaugaugucauguaaguccaguauuuuucgguuuacuuuuggucugugugaccugucuguugaaaguggaguauuaaaguaacccacucacaguguauggagguuaauugguuuuaacucuagaaguauugcuuuuaugaacuugggugcccuauguuugcugcauacauguuuagaauuucaguaucuucuugguggauuuuuucuuugauuugguauccuucccuaucucuucugauuaguuuugcuuugaguucuauuuugucaaauguuaagauggccacguggcuuucuucuuugguaccuuugcuuggaauaucuuucccauucguuuauuuugaggugaugucuagcuuugauuagguaaaguguguuucuuggaugcaccagaaagauggauccucucuuuuaauccaaucuauuaaucuaugggguuuuuuguuaauugaggaauugagcccauuaguacaagaauuaucauugugcaacguuuauugauuccuguuauuuuguugugaugauguggguuuuccuccuccuuugauuuacugguaugacauuauuuauuccuuugccuaauauuauuguuguuguugagugugguugaccccuucagauugaaauuuuccuucaacuccuuucuguagagcuugcuuuuuaaauaaauacuuguuaaauuucguuuuaccauggaauacuuuacuuucucugucuauugugauugauagauuuucuggaaaugggggucugagcuagcaaauguguucuuuuagaguuuguaaaacaucugucaaggcccucugggcccaacacaaguagugcugaaaagggucuguucugauagcacccaaugauggaggagguugcugauggcagccagugacuagacugaucacuuagaagauuuuuuucugagggaauaaagcuugauaauuuugggaccagcacucccuggaaaauuaaaguauuuucuauuccaaguacaaauauguguaugcaaugucuuaaaacucacuuugcuccuuuucuaacccauccaguccuugcuauucuauaaggaaaggggcauacuucugcucuuaagucuaacuugauuauaucuuucuggcaaacauuuuaaaccaucuccuuaaacuuucuaucaacuacuauaacccccuaaaacuauuuaaaucaaaucaggaauuccauaaaaucauugauucaccuaaacuauauuguuugaugaaagcucaucuucauguugagcuacaggaaaauuucccaauagaguaggcuaugacacaggaaguaaucacaucaggcuauaggcagugagcgacuucccaugaccaaucauaccauaccagauacaugaggaauauagaaaugaaaaacauaagaaggcaucauuaucaagcaauccuggaauggagcacccaagcucaaugggugauacuaccccugggagauugguucuggguacuauaagaaagaaggcugagccaguagagugcaagccaguaagcaguacucuuccauggccucugccuaaguuccugccuccaguuuccuguucugcuuugaguuucugcuccaacuucccuccaucacagaguguaacuugagaguuguaagugaaaacaaaccaauuucucucuaacuugauuuccuuuaugauguuuauucacagcaauaggaaaccuaacuaagacugauaccaaccaaguagaguaaaagucaaaugaaggugauaagcuaagucagucaauuuccauagugaauugaaauuauauacauguaauacaguguuaaaacgguauuuuaauggguaggcaggggugcucucagauguuaaugauguaugaaugaugaaagagguauaaaacaagcuaaaccuagacacuuugcuagacauacuccuuugagguuuaccuagcauacaaucagauacaaacacuuaaaaugcagcagaugaguuuuacuuagacacaauaaaacuuaucuguuuuacuuggacaccaucaugugagaagacuugacucucauuuuccaucacuccagaaauguucuuccaugccucaucacuccauauaucaggcauuugcugauugucucaguaaucccauucaucagucugcaauguucuacagcucccuucaaugaaagcacguacagagaauaaccuuuggucuaguuccuucucuuagucacuaccucuuggguagucacucaugccacuuugaaugucagaaauucacugauguuaauguagaggaucauucaauuaaucaguuuaucugucucuaaacuuuagguguuaugacuuaggaguggcauuuuauuuuaaguauuuggaauaagcuuagaaauaauaaugcuaugaaccgucauagguaagaauauguuuauaggguuuugaggacugguuaucacucacuuauuuuaauaagaaacuauguuuuacaaccuguuguuuuucuuuucgugauaccuauguaguuuuaacauucugucaaugaccucuaguugguuuacuucuuuguauuuuuacugaaaaaaaauuccauacaaccuauuucuuucaugauuuauuauucuccauuuccuuuaacaucuuucagaagccaucuagaaagggcuaugacaagcaagugcauuuuguacagaucacccacuguuuuucaugguugugaugggugugcucugagaugccggguuuucagagaauucauugcuucucacugcagaaaagcuuuucugccccuauuacagagaugaaugcauuuuuuuuucuggguauuuaucuacucucuugggcauaucuacuguagauucaguaugaggauguaguuucauguaguacugcuauauagaugaauucaggcuuucauaauuccugaccaugauuuuauagaacuuccuaaauugauacaaguaaucuuauugcaccccccccaccccauagaauaaaagcuacaaguagaguucuguaagccuucaugugucaugggcuaauugcacuagggggaaaaaggcuuggaauaaauuuauaaucuaggaaaacauuucuucuagguuaauaaugaggccacuaucugguaaccaaaagucauaaacuuggaauggacaauuuauuguagguacaagaauagaaaguaaaugaugaacuaguucaucuauauaagacaaaaaauaagacacgaggcagcagauucaucuguugacaaaacugcucuaacuugugauauaaaaacuauugcuuuaagcgucuaaugaacuugugaagccagaaaauggauaguggaucuuuaguuagguauuagucuuaauggacagacauguaaacaauuuuucuguagcucuuuaaacuuuuaauagucuaugccaugaacuauuaguuuaaacuuacuauaaacuuauggaauguaagugcuuagaaaaccaugugaucuauuucuggaaaagguauaaaaccuaagaaagucaagaaagugguaguguagaccuucucugcuucauccaguaugcauaugucucuguguguaugaaccugacuuucuuuucuauccuuucuggcucaugaauuaaugaacucugaauuucucacugggcuagugagaggcccuugaaucaaaagauucuuuucuuagaaaagaaucuaagaaacuaaguuuucuuaauuucccugcuguuaucauuaggaguuaauuucuagaagccaucgucuuuuggccccagaauggcaagagacgguuaaaacgcuagaagucaucaucuucuggcuucagaauagcaggagagaauuaauuugccagaagucaaaagcaguuggcuccuucugaugcuggccuugcugucuuccucaguaccugaauaccaagcuggaccucagcacugauccuccauacuuccccacacaccuagcuccgugcccuuccuaacuugaaaaaaaagaaaaaaaaaaaaaaaggaaaacaaauaggcaaacaaauaaaccagaauuuaaaaucacagaggaaaauccacaaggaaacauguguacacaugcagaauaaaccacaaauucagaaaaauguauuagcaaaggccgguaagauaaaaaaaaugcccaaauauauuucuauaaacaauaauucucuccacaagaucccugauagaggagcaucuacugucuuacuaauguuuguuucuggacauaauuaaauggcuaauccuuuccuuuauaauauaugauuuauacugauauauauauauauguguguguauauauauauaucauauaacauauaugauauauauucuacauaugauauauagguuauaagauauacaucuuauauuauauauuaugguguaugauauauguaaacacacauauauugucuuaaaauucaaaaugaagauaaaaaaugcucaaauuauuucuauauauaauauuucuucccacaugaucucugauagaggaacauccaauguuuuacuaauauuuguuuuuggauauaguuaaauggucaauucuuuccucauaaaguauauacuguacuauauauagcauauauuauguacauguugucuauuauaugcuacauuaugucuuaugauauuguuuauauauguauguaucuaugaauauaaaauauaauuguccuaaaaccccaaauuucuuuuucccacuuauauuuucacagucagauaugagcucuauuaacucaaauauauacuuguuucuccaagugccucccacuuuuugcucuucccuggggcuucugccauagggucuccagaucgcugagcacacaaugcuuggaugagcagagcauuguuauguaacagccucucucccuuuacuuagcaggguuguaagccucuugccucacucugcucuccucaugcucugaugucuuagucuugucugucacccaguggaccagauuugguuugguccauggcucccuuccucagaccaccuaccuggacuuuggcccuccugagaggugcucucuggcucucugugcucugggcacuguugucuccugccugcuguucccguagcccacccaaauggcgcuucucuaccucugaaauugucauccccaggaagguuccccagagaaugggcaaaagugauaugucagggcacaucaccuauagcaugcgcuuuaggggacaaagacaugugguccacaugaaacucaagaaaaacaugauuccucaaaauuuuccuguauauaccucuaaugaccaaggagcccagcagaaggauuacccauuuguuccucgggauuguuacuucuacagcuaccuggaaggagucccugggucccaagcuacacuagauaccugcacuggaggucugaaaggcaugauacagguagaugacuucacuuaugaaaucaaaccauuggcaucuucuuccaaauuugagcauguaauuucucugcuugugguggacgaaaggucacgugagucaaaaaaguguagaaaugaugagauuauggcaaagguagguaaccucccugaagagacuaagcucgcuggaagucccagagcagccccuguauaucuguggcguuaccauucgaaaaaugugggaauacaauacacggugacucaugaauuauacacacaaauugggagcaauucaacugccucaauugaguuaauauugauuaugaccagcauuucacauagcauuuauaaaacaaguggaauguuuguguucgcgcgugcugcguguauuuggaaugacaaggaccacuacucaauuuccucauuuuauaacaauguuuggagacuuauggaauuauuuggcuauuggaaagcugguuacuuuuggcauauggagcaugccacuacagcucuucuccuuggaagaaaacuuggaaauacagauuaugcaggcuuucaggauggaauauguaaccccaacuggggaguauuauauacauauguaggaacaaaccauuuuuuucuggcuggaucuuuccuggcacaugcagugggucaccuucugaaugugaggcaugauacaccggguuguguuuguuucagaaggagcaguugucucauggaugaauuuccuacucuucaggauaugauuagcaauuguucccaugaugugcuacauaugaggauccaugguugggauccuugcaugagugaagugcgcagaacacauaauauacaaaacguuccucguuguggaaauaagauaguggagggcagugagagcugugacugugguucugugaaagacuguaccacugauaaguguugugaagucgauugugaguuuacucagggcagcucuuguaauaaaggagguugcugucuaucuuguaaguuugcacccacuggaacaauaugcagagacaaaaaugguauuugugaucuuccagaguacuguaguggagccucagagcauugcccaggaaauuuuuacaucauggacggaacuccuuguucuccacuggcagucugcauagcaggaaacuguacugaccgucauuugcagugucaagcucuuuuuggauaccaaguaaaggauaguucaccagcaugcuaucaugaauuaaaugucaaaggugaccgauuuggaaacuguggcguuagaaucaaacgaggaggaagccaaacugucccaugucaaaaggaggauguuuuuuguggaaugcuccacugugauggugucaagcguauuguugguggaggugagcacacuaccuuuuaucaccuaaagguucaagauguuaaagaaguacagugcuuuggguaugauauacaccauggauuagaccuuccagaaauagggcuuguaauggauggugcaacuuguggcccuggaaaauacuguaaaaaucaaagauguguuuuucaucaaacuuugaaauuuaauugcaacauuaguucauguaacuucagagggguguguaacaaccagggcaacugucacuguguucaagguuggcaaccaccaaaauguuuacaaagaggaaaaggugguaguguaaacaguggcccuauaacuaacccucugaagagauaucgagccaaaauacaugugaguaucaacaagcuauuaauuauuuuaggugcucgcauuuuucuuaucguggcuuugauuauuuuuggugcacuugcaaaagcaguauuacguccagaagugccccaacgacccccagcaaacaguuaacugacuucauccuaaacuaauuggagccacacaauggacaaaauccacgucauugaccacaagaaacucuccauugucucccaucagucauguuaccuuucacaaaucugagaauuucaucuugaaauaaaaucacugggaauuagcauuguguuucuauauuuaaauuucuuauaauuauuucauauugucuaucuuucucauuuccccucucuuauuauuucucuguguguaagugugaguucaguuucuuguggaggccagagucagauccgagagagcuggaguuauugguaguuguggaucacccagcuugugugcuggggaccagacucagggacucugcaagagcagcaagcacucuuaacugcugugucagcucucuagccucuuaaugccauauaauuaccacuuuuuaaguuuguuuugauugaaauuuuuuccucuuccugguuuauggugcuaagcagcacagccaagaacccagggucuuacccaagccgagugaaugcccugcauucuacucuacugugcccaaacguuuugucacauucuuuauacuucuacauguaaaaucugccuuucauauuuuuucaagaaaagaaaguacauauuugugagguucauuuuuauaguuuucuagaagcuucuauaucaacuuugggcuuccuuagucuaugcuauucuuaccauugucauugucuguucucaauuguauuaaaucaucaucuauuuuauuguuacuauaaaauaagaaucaaaaugacauuucuagccaggcagugguggcacacgccuuuaaucccaacacuugggaggcagaggcaggcggauuucugaguuugaggccagccuggucuacagagugaguuccaggacauccagggcuacacagagaaacccugucugucucuaaaaaccaagagagagagagagagagagagagagagagagagaggggggagagagagagagagagagagagagagagagagagagagagagagagauuucuaaaauauauggaugugcgaagaaagcaguuuaaugccuuuuuuguguuuguuuuucucuuaaccucgcuaucucccaaauaauugagacuagacuacuauauuuauuuaacaagcuuuaaguauacaagaacugagcaguguuacucuaucuaaaucuucuaaacuaaucugccuaccucccagccaaagucccugagacccuugcauuugauggcuuucucugcuugagcuguuuucucauggugucuccuggacucuccccauggcuaauccucaguuccucugucuccuucccugacugcccuggcugggaagaagucuagcccuggucucucuccugcucagucacugacugauggguuucuuuuuugaccaaucagggaagaauagcggagcaauguuuacaaaacacugagacugagguaugagauucucagaauauggauugcaaccagauaugggggucacagaaaucagcauuugaauuacacaguacacaauagcauuaugcccgcugaaagaaaccuucauaccauagauagcugaaaugucaguaguugugcugaacuuugcuaugugacaauggggaaacucuuagguuuuuuuuuuuccaaaaauccagugguuacacccaucauucugagauggaauauacgccaccaaaaugaugccagaagcuaccacaaugcuggggugauuuaggugcugaauucacacacuagcuucuacaguugucuuuagguugugcaaugccaggaacuguacuugcagaggaguguguaacaacaacaagcauugcuauugcauaugugguugaaagccagcaacacaugaucagagaagagcagggaguagugaaggcgggagccguccacuuuauagaggacaauucugugagccagggaauuugugcuauaaaucaggcucuuauucugguacuuacucaccugguucuuuuuaugauuucaguguuugccugguguccuuucuaaagcaaaaggggcuuugggguggggaaagaaauuuaaaggagaauuugaaagacauuuguuagaagacuguugcgguuuggucuguugguauugauaguaaugcuaaauuguauaacucaaagucuacaccauugacugacuucucauguuacaagcauuuguugugaaaaccuugcuccuuguuuuagaaguguugguuaaauaaaauuggcuacagcuaagugcuggaggcauuagagguagguugguuuggagugagcugguugcaggagagaaaugaugagaguuggaggaggaggaggagggggggugggaggaauacagaagaaacaaagccaccacgaggacagauggaccaugagcagaagggagggagaaacagcaaguaccagguacauacuggggaaguagccagaccagcaguuagaagaguguauuagggggucacacugcuguaacugucaaagucaaauaaaauaacuauagugugagucucauuuauuuguauaguaguuggugauaagcuuagguuguuugcaauacagaagacuucuuugacuuaaaaagggaauacaauccucaucacccaucacuugcauuuugugaaacuauuucuacaguuucuccucaucuauacagugucacuguuccuggaauguuaauuguaccaaaacuuugaugucuucauggaacuauucauuuguauguauguaaguaauuuuuaaagguuuaaauuauuuugcuuuuuguauuaaugaguauuagacuauuguauaucauagaugcuaguauccugccacugagccccaacauaccuuaccacuuucucaguauagacccacaacacauuccuugaucacacaacaaaggagacaagugauaauaucaaauauucuccagguaaacggcaugugugaaauucagguuaggcccaaggauuuuuuugguugucucuuugacauccuaagauagaauaaagcaagccacacacucuuauuauguagaguucuauaauuuuacuuacuauggauguucagucugcauuucauugaaguucaaggaaccauucgccacuacaguguucaggcuauggaauauuaauacaacuccugaaguacugaaaggauucgcaccauaucugaaccaguggaaaggaaguguacacauuggagagauaagaaagugcaaggaauuuacaacacacaaacagcuuugaaaaucuauucuguggcacuagggagaugacacagugguuaaaagcuuugauuauuuucccagaggaccuggguuugguucaauucccagcacugacaucguggcucacaacucuguaacuacaggcccaugggacaagaugccuucuucugcccucuguggcuguugugugcaugcaaugcacauacauauaugcaagcaaaacauucacuaccaacaauugugcauauucuugauuaaugauugauaugcgaugaaacagccaauagggugggaugcaccauacaugugcagucaauucuggguaauauaagcaagcuaagcaagccaaaaaggaccaauaaguaaggccacaccuucaguuuuugcccaacuucccucagugaugaagugugaccuggaaguuuuaaaauaaaccauuuccuucccaagaugcuuuugucgugguuuuuuaaaaucacaauagaaaccacaaguaagggagagauuguuaauaggucacugggcaucgcuacaacagaacuaaccauguguaugguuguucagaauugagugauugaggccuaagaguucagugagauagucugaaggagaauggaagauaagaaugaagagaccggcucucugcucgucccuguuccagagacagccgcaucuucuugagcagugccagccucuucccguagacaaaauggugaaggucggugugaacggauuuggccguauugggcgccuggucaccagggcugccaucugcucuccacauggcaaaguggagauuguugccaucaacgaccccuucauugaccucaacuacauggucuacauguuccaguaugacuccacccacggcaaauucaacagcacagucaaggccgagaaugggaagcuugucaucaacgggaagcccaucaccaucuuccaggagcgagaccccgcuaacaucaaauggggugaggccggugcugaguaugucguggagucuacuggugucuucaccaccauggagaaggccagggcccacuugaaggguggagccaaaagggucaucaucucugccccuucugccgaugcccccauguuugugauggguaugaaccacgagaaauaugacaacucacucaagauugucagcaaugcauccugcaccaccaacugcuuagccccccuggccaaggucauccaugacaacuuuggcauuguggaagggcucaugaccacgguccaugccaucacugccacucagaagacuguggauagccccucuggaaagcuguggcaugauggccguggggcugcccagaacaucaucccugcauccacuggugcugccaaggcugugggcaaggucauuccagagcugaacgggaagcucgcuggcaugagccuuccguguuccuacccccaauguguccgucguggaccuggugugccgccuggagaaaccugccaaguaugauggcaucaagaagguggugaagcaggcaucugagggcccacugaagggcaucuugggcuacacugaggaccagguugucuccugcgacuucaacagcaacucucacucuuucaccuuugaugccggggcuggcauugcucucaaugacaacuuugucaagcucauuuccuaguaugacaaugaauacggcuacagcaacagggugguggaccucauggccgacauggccuccaaggaguaagaaacccuggaccacccaccccagcaaggacacugagagcaagagagaggcccucgguugcugaggagucccuaucucaacucagcccccaacacugagcaucucccucacaauuuccagcccagacccccauaauaacaggaggggccuagggagcccucccuacucucuugaauaccaucaauaaaguucgcugcacccacaaaaaaaaaaaaagaaugaagagaccuggcuugggaauugucagaagagugcucgaaauuaccucaaaaacuauguucgugugauuuuuuaaaaaaguuuaucuuuauuuuuacuuuuuuaaauuggaauuuuauuuauuuacauuucaaaugcuauccccuuuccugguuuccccucugcaaacccuauccuaucaccccuuacccugcuucugugagggugcuucuucaccuacccacccacuccugccucaccucacuaucauuccucuacacuggggcaucaagcccuaacaggaccaauagccuccccuccacccccacugaugccagauaagaccccuucagcuccuucaguccuuccccuaacuccuccauugggauucccgugcucagucugaugguugucugcaagcaucuagaucuauauuggucaggcucuggcagaaccucucaggagacaacuguaucaggcuccugucagcaagcacuucuuggcaucugcaguagugucuggguuugguaucugcuuguaggauggaucuccagguggggcagucucugaauagccguuccuucagucucugcuccacucuuugucccuguauuuucuuuacacaggagcaauucuggguuaaaauuuuggagaugggugggugcccucauuccucauugagggagccaugccuaaccucuggauauggucuccacaggcucucccuccccuuugugagguauuucagcuaaugccauccccgugggguccugggaggcuuuccuggcaucugggacuuucugguugcuacccccaguuccccaucccccauugcuacacaccucuguucaguuucuugacccucuguacaucucccccaucuccucccauaccuguuucuuccucuuuuccccucccacucuucucuuccucccaagucccucccacccccuacuucccuugauuauuuuguuuccccuucuaaguaggacugaagaauccacucuauggucuuccuuccucuugagccucuugugguccgugaguuguaccauggguauuccaugcucuuugccuaauauccacuuuucugugaguacauagcauauguguucuuuugugacugaguuaccuuacucaggaagauauuuucuagaacuauucauuugccugugaauuucaugaagucauuguuuugaauagcugaguaguauuccauuguguaaauguaccacauuuucuguauccauuccucuguugagggacaucuggguuguuucuagcuucuggcuauuaugaauauggcugcuaugaacauaguagaacauguguccucuuuacauguuggagaauauucugggugaaugcucauuaguaguauaccuggguucucagauaguacuauguccaauuuucugaggaacugacagacugauuuccagaguagguuguaccagcuugcaaucccaccagcaauggaggaguauuccuuuuucuccacauccuugccagcaucugcuguuacuugaguuuuugauuuuagccauucugacuggugugagguugaaucucaagauuguuuugauuugcauuucucugaugacuaagaauauugaacauuucuuuagguguuucuuggccauaggaaauauuaaggcauagagauuguugcuuccuguuauuuuugugguuagagguggaauuauguuuguauggcuaucuucuuuugauuuuguugaaagaagauuaauuucuugcuuuuucuaggguauaguuucccuccuuguguuggaguuuuccauuuauuguaccuuguagggcugaauuuguggaaagauauuguguaaauuugauuuuucauggaauaucuugguuucuaucaucuaugguaauugagaguuuugcuggguauaguagccugcacuggcauuuguauucucuuagggucugaaugacaucugcccaggaucuucuagcuuuccuagucucuggugagaagucugguguaauucugauaggucugccuuuauauguuauuugaccuuuuccccuugcugcuuugaauauucuuucuuuguuuagugcacuugauguuuugacuguuaggugacaggaggaauuucuauucugguccagucuauuugggguucuguaggcuucuuguuuguccaugggcaucucuuuuuuuagguuagggaaguuuucuucuauaauuuuguugaagauauuuacuggcccuuuaaguugggaaucuucgcuguaucuauaacuauauccuuagguuuguucuucuccauuguguccuggauuuccuggauguuuuggguuaggagcuauuugcauuuugcauuuucuuugacuguugugucaauguuuucuaugguaucuucugccucugagauucucuuuucuaucucuuguauucuguuggugaugcuugcaucuauaacuccugaucucuuuccuagauuuuauaacaccaggguugucucucuuugugauuucuuuauuguuucuauuuccauuuuuagaaccucgguggguuuuuaaaauuccuucgccuguuuagauguguuuuccuguaauucuuuaagggacuuuuguguuuccucuuuaugggcuucgucuaccuguuuaccuguguucuccuguauuucuuuaagggaguuauuuauguccuucuuaaaguucucuauuaacaucaugagaugugguuuuaaaucggaguguugcuuuucuguugucuuggguuauccagggcucccuguggugggagaacuggguucuaaugaugcaaaguagccuugguuuguguugcuuauguucuugcucuugccucuugccaucugauuaucucugguguuagcugcucuugcugucucugacuguggcuuguuccuccuguaagccugugugucagcacuccuaggagaccaguucucucugggaggaguuuggcaauagagagcuguggcacagaguccacuccaggcacagauggaaaccggaagaauccuguucuaggcugcuccucaguuccuauguccugggggcucugacuggucccucuuaguccagguauuugagcagaagugauggucucaccugugcucucaggugugucagcacucuugggagaccugcucacuguuggagguaccuggguauggagagcuguggcauagggucagcuccaggugcagauggaaaccagaagugcgcauuugauucuauuagagacuuuguuaccacuguguuauuuccuugaaacucuagacaaaugcaguagacagaggaccccuuucccugccuuccauuaggaagaggacugaucaaacagugaggaggaaggauaugauaucauagguagaaaagauacaggaauguaggcuguaugccuuccccaguagucagagcugggugucaucucuccucucucuacaccucaucccuaacaguagcagcugccuuuuauuccugugacauggauacagccacugcucugccuacuaacccacauggguugauuucauucaagccaccacgcaaaugucuccucuuuagagaccuauaaaagacaggaagaagagcuucugacagaaaccaaauagacuagucaguuuaggaugaugugacaaaagugucagagacugugguggccuaaauggcaguuucaaagacugaaaaguccgaagaugagaguccugggguauguccuuucuguuaggugcuaccugguuuagagagcuguggccaccaccuugcugugucuuccuaggaggaggagagaaauagcuuguuccacuccuuuccuucuaacaacacuagugccaucacagaacccauauuucacauacuugaccaaaccuaauuaccuccuucuccaaauugcaucccuuaaggaucucugucuaaauugccuacaagauuauaucugucacuaugguugcucccugaagccucacuuggccuuaguucccuucacagcagcuaucuucaccuuaagaucguggacauaaaccucagcucacuuguuuacuguccuccacacugcaagggaaaagacuuuuuuguguuugcuaauauaucccagcacccacaaacccauagacuauucuauaauuaaugaguggauggauggauggauggauggauggauggauggauagauggauggauggauggauggacagauggauaaacaaauuacaaacccugaggccccuucacauaugagcuggauuuuaugguagccuucuuacucucaucaaagugagauguccaugugaaugggugugagaucaugcuaggugaugcuguguucacucccuccacuauuggggugcaucagcauaccaaacaccacuccucucuccuuuacuaauuuuuuuucugcugcuguugauucaucauuuuuauuaucaucgucaucaucaccaucaccaucaucaucacuaccaucaccaucaucaucuuuuguuuucaacugaaauagaauuaacuucacuuuuaccucuguuuccucuccccagcuuuucccaacuacccucccuugagcccuucccaugcccuccaauucuuaaagcaauagccccuuuuugauuguacauauguguguauguauguaugcacaaauguauguauauacguauguauguauguauguauguauguauguauguauguauguauucauguauucauguaugcauguaagcauauuugguuucaaagcugaccacucagcauuggacaaugcauaaagguguccaacccugggagagaguaauccaccuucucccagaaguucuuucuuugggggagggacccuugaacauuuucccuucaacauuaacacauccauugauauugccauuguccuagacuugccuuuguagccaugucuaggagagauuuuucugguauucugagagucacacauacacucacacacacacaagacaacacaacaacaacaacaacaaaccuccacuagacaaaguccaaagaucaacagaucauagggaacccaggcgaauagauacauccacaucacagcuccugugucugugguucaggucaucuauugccuccacacugcagagccuuugaguggaauccacaagcugugguguggggagaaguccacauacaauugcuccuuguuacuuaaacuucuuuagaucuuuauuuaucccuagcucaucacccaucaucaagacaacuuuuuuacuccugaaaauaugaaguagaccaucccacucugcaguaaaacuuucugccuaugggauguuuucucuuuauuuuuguauuuauuuauuuauuuauuuauucauucauucauuuauuuguuuacuuuauaucccaauauuugcacaccuucuccucccaguucucccccaacccagcuuuccccaucauuccccuaccccuucucagaaaauagggaugucccccagguaauaccccccaccccaccccacaucaagucccugaaggacuggagacauucucuccacugaggccagacagugcagcccagauagaggaauggggccuacaggcagacaacagauguagggacagccccugcugcaguuguuugggggaccugcaugaagaccagggugcauaucugcuacauauaugcauaagaggugccuagguccaacccaugaucacucuuuggauggugauucaguuucugggagcccacagggguucagguuaguugacuuuguuggucuuucuguguagucccuuauucuuuucuggucccucaguccucccccaacucuuccauaagacuccuugaguuccaucuauuauuuagcagugggcuucugcaucuguuucagucagcuggugggcggagccucucagugaacaguuaugcuaggcuccuaucugcaaacauaacccaauaucauuaguagugucauggcuugguuuuugcucaugggauaggucucaauuugggccaguuauugguuggccauuuccucccucucuggucugucuuuaccucugcacaucuuguagacaggacacauuuugggucaaagguuuugugcaugggcuaucuuuaucccuccucugggacuccugccuggcuacaugaaguggucacuugaggauccauuccacccacuacuagaagucucagcuaaaaucaccccuauagacacccuacaugcccccaucccaacauagaaaugccugcccccuaccgauuuccaaucuuucucccccugcucucucuacaccugaucccuccauuccuguuccccuccucauccugaccucucccaccgaggucccucccuccagcuaccuccaauaucuauuuuauuuccccuucuaauaaagauucaaccauccuccuuuggccccgccuugguuuugggcuucuuugggucuaugaauuguaguaugguuauccuccuguacuuuaugguuaauauccauuuaugaagugaguacauaccuucauguccuuuugggucuggguuacccccagaggaugauauuuucuagcuuaauucauuugccugcaaaauucaugaugugcuugcuuuuaauagcugaguagcauuucauuguguaagugaaccacauuuucuuuauccauucuuuaauuuauucaaucuaggugucuugagggacaccuaggucguuuccaguuucugacuauuaugaauaaaacugcuaugaacauaguggagcaugaguccuugugggauaguggcacaucuuuuggggucauuauuuuugguuugaauaucaacaaacaaagaguauuagagaccucaaaaugcuaccugaaaauauuauacugaagaagacagccuggagguagaaaucacagccauagucuuuugucucaacaccucccuaggcauaugacccuuaaguaaaucacauugucauuuagggaucugugcuuccuaagcuuucaaggggaagaauaucuaccuucagagaucaucauuauuaucuaaggagauaacaucaauggauauaauuucaaaauauaaacugcuacauaaaugucagauugcuaucuauaguaagaccaugcaagauuagaaaggagcuugcuuccaugugcuauauuccaaaggacagauacaucccuaggcaugauggcauguuaggaagaggcagaaagauaagcaguuucagaggcugucaaguggugccacugaagcuggagcaaacaaugcucuagaagagucucaguagguugaaaggaagccuuuuuccucuagcuauggcugaauggcuaaggcauaauuccuggaggcugcuaacuuucugacugguacucagagggcaccugugcugugggaucugcuauucuacucuucauuugccuaugucucuaccuaugaggucuauuagaaacugauagagaacaaggugacugccuacaaauaggguuaccaagaaccacaguaugaggucccugcugaaaacaggggccccucuauaacucuaggagauugucugguaaauagacaaagggauaggacaggacauuuuuagccaucaagaaaugcaagcuauucuaaagauuuuaccccaaaaggugaggggaaggaaauaaagagguggcuguuucuuagucaaggcaaucacaggaagaagguauugcuuaguaacagaggcuuccuccuuccccucccccuuuaauaagaaagacaagaaaaagagaagucgcugucuuaggugccaagucagaggggcaggggguaacuuuaaacuuuaaguacucugguggguuaaagagaauggcuguccuaggcucauagacuugaauauuucaucaccaaggaguagcauuauuggaaaggauuagaaggaguguccuuguuggaggaagugugucacuggggauggccuuugaguuucagaagcccacaccaagccuagaguuucuuuuuuuucugcugccuucagaucuggauauagaacucuaaaccaugcuccccaccaugaugacaauaaacuaaauaucugaaacuauaagccagccccaauuaaaugcuuucuuguaugaguugguguggucaugacuuuguucuaaagagguuauguaauaaguuguuuuaaagggcacugaugagccuuugugucuuuguagcauggacacuaacuucauuguaacauuugcuaaaaugcacuauuguugaauccauaaccauaucaggauuugggcucaaacuacaguaacagcaugacccaaauaaaucugaauccuauaucccuaugaucuugaagcgguaagucacugugagcaaaagaaacuaguaaaccucacuuucaccauaaccuugccuauaauaucccuucaucaugcccauugcuguaaaagaguuuauccuggguacaaauacugcgacgugauaauuaguagguuaaaaugaagggacucuuuuaaacccuuacacacuggcuugauacaaugggacccuaugaacucucagugaaaguaguuaaaauagucuaauaaguuauaauggaaccuuuagagacgaaaaccuauuauagaaagccuaaucaauaaaaggauaucauccacacuuucuuacaauuuaacagcccaguuugauguuacuaguucugggaaauagugugucaccauagaugacuaugggccuuacccuguauccacccaucaagagugcuauaccaaauaguauuaacaggccuugugaggcaagccuguaaucuugaccacuuuggaggcugaggugagggacucucaacuuugaagucagguugggcaacuuuagugacaugcuaucucaaauuaaaaaguaaacaagacaaaacaaaacaaaaagcaaaagcaaacaaacaaaacacaacaaaaaccccuaguuuggugacagcacuugccagggguguguaaaggccuguguuaaaaccuccauaccaaggggugagguggggagguacugauggggguacuagcgaggguaaugauucuaucaaacagcuggcccauguuuucuucucauagauuuggcuaacacacuguucaaaagccuaucucagcagcuucuccaguaugguuugccucugucucugaagggacacaguagacuacuugucaguaccuuaaaaauuaagacaauugaagacuuuuuaucugauaaagucuuugacaaccauuuccugugcuuucuggagucuuaauguugguucuuagcaaccuucuggauucugguacaagaaaauucacauccucuugcucguugccaucaaaaagaacaaguaguacaccacuuucuagauuucuuagaaauaaggacuggcaaauaucugaacuagugacccuccauacuugguuucccauugugcuuugguuguuggaaauaacauugagcugaacucaaauuucacugcuuguaaaaccauugccucaaagaauaccgacucagagccugauauagcugucuccugagaggcuaugccagugccuggcaaaugccgagguggaugcucucagccauccauuggauggagcacaagguccccaaugaaggagcuagagaaaguacccaaggagcugaagggguuuggcagccccauaggaggaacaacgauaugaacuaaccaguaucuccagagcucccugggauuaaaccaccaaccaaagaaaauacauggugggacucauggccuuaacugcauauguagcagaggauggccuaguuggucaucaauaggaggagaggcccuugguuuugugaagguucuaugccccaguauaggggaaugccagggucaggaagcgggaguggauggguuggugagcaggagguagggggcuuuuggaggggaaacuaauaaaggggauaauauuugaaauguaaauaaagaaaauaucuaauaaaauauuuuuagaaaaggauacugacucaaucugugaucucacuauuagagaugacuuugccuccaguguuggaagcaauuccaccacacacucuaaugucucuguccagugaugcccagggcuccuacaguaucccccaaauaguauuuaaccaaacauggcccuuuggaauauucuacccacgaagaaagaggaauuaccuugagaagugguaugauguagugggaauuaccuucuugugggccucuugacuauuugaagagcaccuugggaguugcugaguucacaaaaauagaaauucaugacuacaaggaggcacugcuaacuauaccaagcaagaaagcuuaaugagcuacugcuaauuuuuaacuuuuuagccagaaugucccuaauaaagaacaaagagaaaaaaauagcacaugugcuuacugucagucaccucaaugcuagaugucuuggucaucaaugcucucccuuuccuauuguuagagacuacuggccauuauuugacaagaacacucuuaaaggugaaaacacugggauguuccuaccuuguggcuggcuacccaaguuagaaaucaagaaugacucuacauguauaugagggccuaaguguaugaucuugcuagggccaugccuuauuccauucaaauauucuuaguaguaaccaagacaugcauuucacuucuuaaaauauacaauaccagaaccucgggaaagguaauuaauaaaaauuguauuucagaaagccccagauuauugguuuaauuaaaagauauaaaguucuccuuuagaauuccuuugcaaauuccaacauauaaguccuuaaauaaguuucuguuuugucucauaggccaggaaaugcucaucagauaauaggacguauuucaaaguaaaauuccaccagagaaagaaguaaagccuccuagacaccuaugagcuauugcucugaaggacguugauuugagcauuuuucuuaguuuacagaacauacaugguacucacuuaaaagaaauacccuagcaucacaaccaagacaacaaccccaacaaaugcauuaaucucaaagguucacucuaccucccucucacacacucuuaaucagauauuuugauuacuguugucuuuagacuccaucagccccagugagcaccugcuucuuacuuggauguaugaagccucuauuacuucagacgugcuucuuggcugccuccccugucacucuugaauggaacauccaaaucuaacucuccugcuuccaggacucuucuugagacuaguuaucuuuguaauuguccauucgcaaaaagacaggcccucaagauuuagaaaaaaaaauaucacauuucuauuaaaaucagaaacuuggagaaugcauuuauuuuucuauuauucaacauugcuuucuaaauuuuagucaauaaaguaaaacugagaacaccaguauaaauauagauaaacagaaauuuuuaaaauuucaguuaaaaaggcuaauuuccuaaaacaauuaagaaauuuugcuauggauccaaguuuccuuacccauagaucugacaugaugacaucgacuauacagaacugucaugagaauuaaauaugcagacaacauuuacuccauuguuuguuaguuguucaucaacacaaaaaccuaugguugaaggcaucauauugaagugauuggauacagaauaaaauauggaaauuuguaguuuuaguaaauagacauuuaaaugucaggaauauuaaacuuuuuuuuuguaaugaagaccaaaacugcaaaauaccuaacaaaacauuucacaagaaaggaaacagacaaauccagggaugguaguacaugccuacaaugccagcacuuggcagguugagacacgaguucaagaucaauuagucuauauaaugaaugccaagucagacagggcuacacacuccuccacccacuagcaaagaaagguaaaaggucuaagaagcaaaaacuauuaggucuuuugggaauaugggggaaauugauauuugcuaacuaaaguggcaugugcuuguaaccguagcacaugugaggguacgguggaaaagaucucuagauuugucucuagagagacaaauucccaauagaauguuacaguaucauuaacagaugcagagacccacaaucaaacaucaguuguugcucaaggacucucguggaagaguuggggauaaaauugagugagccagaggggucaaggaccuacagaaucaccuaaccugggcccaugggggaaucacagaaacugaaccaccaacuaaauaucaugcaguggcugaacuuagguuucauauacauuugcagcagauguguagcuuggucuucauguggguccccuaacaauuagagugggagcugucucugaauuuguugccugccauuggacuuccuucuccuaacuggacugcuuggucuggcuucagugggagagaaugcacuaaggccaacugcggcuacaugucccagggugggugguaccaaaguggggagaagaggaggguguaaugggcgagggauuuguaagggugggacuaggaggaguugagguugggggacaggggcuugaugaggauagaaaguaaguaaauaaauggauuuuaaaacaacaagauaaaaugucaaucuuuccuaaauuaaugaauuuauuuaaauaaaauugcaaccagaauucugauuugguguuuguauacuggcuaugaucaguuuaaguuucagcagaauaucuuuuuuuucccccacagaggcuguuauguuuauugugcagacaaugauaauccaccagagaaguauugccacaagcaagccguccaaguacaaucacagacagcgacucuacacaaggaacagagaaugaagucagagggcacacaaaggaacagggagaaagucagucucaguuaaucaucuugaucuugauaaguuucuccugcaagcacacuuagcuuucagaaaugguagagaaguuagauguccagucuuacuuagcggugaccaacaacaguaaaaaacagucuuauaaaauuugucucccacaaaaauaaacuauauauauaaaaauguuaugauguucucaguguuccauuggacacaagccuuuuuuuccugucucuuuuuucuuucuuucuuuuuuuuuuucaguaugaaaaaugagguauacugggacuuaagagguaguaguguguuuugauuguacaacauagaggaaauaaagaauaacuucaucagauauggaaau

SEQ ID NO: 6728 - RNA, 9895 nt, Mus musculus
cagaagaagagagucuagaguugggugcucucuaugauuuugacuuuuaaaauaauuuuauggguuuguuguuguuguuguuguugaacuguagauccaacccagagcauugggcuugcuaggcaaauacuuugccacugagcuaaaucucuagaguuggcuauuuauauagaagugaaagaucuuuguugcuaagcaacuaaaucuagaauuuagcugugaaguagacaaaggggguaagagaggggcuugauuucuucguucgguauagcuacaacuguaaacuucuguuuacugauaaggaucgugccaaccaucugacaaaaggggccagacaacaacuguuuucugcugauaugucacucauccaguuuaacucuccguguaaguucuucucuagcacagucuauuggguaaugugaaaauucauaauuuuugcauuucuuuccuuuuaaauaugugaguggcuuaagcacaggucccaggggguagagggcggaaugauugugguuugucuggaacuaagggcauggcuggaauggaggacucuagggguuaaaaccaggauaguucugagcaaaucuaagggaauugguugauuauccuaauugccaguuaaagagcaggcaacauagaagauaaagauacaguaggaguauugaaaauugauagaucaaguccccagguaggucagaaagcagcauggaacugcuacuuaccugaacugaggggagagggcuggugagauggcucagcgggcaaagucacuuggacacaagccugguagccacagauagaccccagaucacauggaaagguagaaggaguaacccucuccauaaaguugccuucugaccuccauauuccugcuguggcucacaaacucccauaauaauaaaguuaaaaauuaauuaggggagacucacuucucuucugacccugaaauggagagguagaagagaggugaguaccauguggauucaaauaagcuuauaaagugaacauacugaaagccauuucuccuugauuuuuuuaaacuuuuuuuuauuuuuuauuuauuuauuuauuauuagauauuuucuuuacauuucaaaugcuaucccgaaaguucccuauacccucccuccgcccugcuccccuacccacccacucccguuucuuggcucuggcauuccccuguacaggugcauauaaaguuugcaauaccaagggaccucucuucccagugauggccgacuaggccaucaucuguuacauaugaagcuagagauaugaguucuggggguauugguuaguucauauucuuguuccaccuauaaaguugcagaccuguuuuacggguuuacaauuauacgaucaauuuuggaggagguaccauguggugcugagaagaagguauauccuuuuguuuuaggauaaaauguucugaagauaucaauuaaauccauuuguuucauaacuucuguuaguguccaugugucucuguuuaguuucuguuuccagaaucuguccauuggugagagugggguguugaagucucccacuauuauugugaggugcaaugugugcuuugagcucuacuaaaguuucuuuaaugaauguggcugcccuuguauuuggagcauagauauucagaauugagaauuuaucuugguagauuuuaccuuugaugaguaugaagugccccuccuugucuuuuuugauaacuuuggguuggaagucaauuuuauucgauauuagaauggcuacuccagcucguuucuucggaccauuugcuuggaaaauuguuuuccagccuuucacucugagguagugucuguccuuuucccugagguggguuuccuuuaagcaaaaauauguuggguccuguuuguguagccagucuauuauucuaugucuuuuuauuggggaauugaguccauugauguuaagagaaauuaaagaaaaguaauuguugcuuccuguuauuuuuguuguuaaaguugggauucuguucuuguggcugucuucuuuuagguuuguugaaggauuacuuucuugcucuuucuaggguguaguuuccauccuuguguugguguuuucccuuuauuauccuuugaaggccuggauucguggaaagauauugugugaauuugguuuuaucauggaauauuugguuucuccaccuaugguaauugagaguuuugcuggguauauuauccuggguuggcauuuguguucucuuagggucugcauaacaucuguccaggaucuucuggcuuucauagucucuggugagaagucugguauaauucuaauaggccugccuuuauauguuacuugaccuuuuucccuuacuguuuuuaacauucuuuguuuagugcauuuguuguucugauuauuaugugucgggaggaauuucuuuucugguccaguccauuuggaguucuguaggcuucuuguauguucaugggcaucucuuucuuuagguuagggaaguuuucuucuauaauuuuguugaagauauuugcuggcccuuuaaguugaaaaucuucauucucaucuacuccuaucauccauagguuuggucuucucauuguguccuggauuuccuggauguuuugaguuaggaucuuuuugcauuuugcauuuucuuugauuauugugcccauguucucuauggaaucuucugcaccugagauucucucuuccaucucuuguauucuguugcugaugcuugcaucuaugguuccagauuucuuuccuaggguuucuaucuccaguguugucucacuuuggguuuucucuauuguuucuacuucccuuuuuaggucuuggaugguuuuguucaauuccaucaccuguuugguuguguuuuccugcauuucuuuaaggacuucuaccucuuaagcaguguucuccuguauuucuuuaagcgaguuauaaaguccuucuugauguccucuaccugcaucaugagaugugauuuuaaaucugauucuugcuuuucggguguguugggguauccaggacuggcugaggugggagugcuggguucugaugauggugaguggucuugguuucuguuaguaagaugcuuacguuugccuuucaccaucugguaaucucuggaguuagaaguuauaguugucucugguuggagcuuguuccuccugugauucuguuagccucugucagcagaccugguagucuagcucucuccugaguuucaguggucagaguacucucugcaggcaagcucuccucuugcagggaaggugcacagauaucugguguuuggaccugccuccuggcugaagaugaaggccugaaacagggccugucccagaagcuguguugcuucuacuugucccagaagcuguguagcuucuguaguccacacucucacuggcacagacuagucucugagggauccgggacccaagauggcucgauuuuuuuuuuuuuuuuaacucagcaucacacacucagcuugccuaguccuaaucaacacaggaugugugagaaucaauaggaacauuucagggaugcccucugguaguucuauuuucuuuuuuucuuuuuuaaauguacaucauggcccauuaaauaucaaacucucuaaauggaucagcucagguaugccaucaggcuugcauacaggugcccaucuaaaguuauauagagcaugguaugcuggggugcaauaagugaagggagaugcuucuauuuugggggggggggcguuggagacaggguuucucuguauagcccugguuguccuggaacucacuuuguagaccaggcuggccucgaacucagaaaucugccugccucugccucccaagugcugggauuaaaggcgugcaccaccacgcccccuggaagaugcuucuaacaauguugaaaaacauagacaauguggcugaacuuuaguagugcagugauaccauguugucuuuaguucagaggacuacauugcaggaagucuucugcaauggguuuugagcuuauuuucuugcugccugcucuaaagcuaagcucugggaggauaggugggagguagguucagguugcuccucagcuuucuccauggcacuuugccuuugguuugcucuuccaacuccacaugcucucauccucaacaacucccacucgauaaaaagggggaauuuggcagaagagauauagaaaaugaaucuagacgugaugaucggaugcuaauccagagagcuucugagcuuguagguuuuauaaaguuuucuucuuuuuuuuuuuuuuucuuuuuuuaaugucagagcuggugggcaugucuuugauuccagcacucaggaagcagagguagacagaucccugagugcgaggccagcauggucuacagugcaagggugagcacagccagagcuacacagagaaacccugucucaaaacaacaaaaauuuguaguugucuugugugcugcuugugucuugcugaguaaacaaacccuccaacuuuuccaagacccuagucaaauggauccagggucuuuuaggagcaucaauggcaagcauguuuucagacugagacaaaccaauaugugucaaaacuuagaacagacaaaaccuuaacuauuuuacacucagacaauguguacuugguuagugauuuaauuuuacugugauaucaaugagaugaaaauggauuaucuccacaugaacaagaagacuuagaacauuaaggaaguuugaauauuguaucuaggaaaaugaaacuaaggcaucagaggauuuggauauaugucggaaaaaugucuccauuccuuguucuugggaagccaggggcuuacaguucagacuguacauccccuuuuaaaauuuuugauaaucguguuauuugaggauuauuuuuauaacagcuccaauaaaacaauaaugaauucgacaggauuuauguagucuccccccuauaauauguauuuuaaauggguauauuaguuauauuuccugucacuauaacauaauaccuaaauaauaaaacuuacaaggagaaaggguuauuuuaggucaguguuuucucgguucuaguucaugaucaggugaauagcccagaugggaaugguaagaaaugaaaagcagaagcaauccauacucaucacaagcaggggaguggauucucagaggaagaagacaagccaggguuccaaugagccagagaacuucuccuuggcgcccccuucaggagguucacagugucccccaauggcaccuccauauaauuagggcuuuagacacaaacuucuggacauguucaacauagaaccuguagcggcaggauauuaaagacuuugauauguagcgguggaagugcuggaaaugguaccuuaggcucaaaugcaacaggggacaaaggcaagagacuaagagaaaccacccucaauggaaggggcaaguacucagguuuuuuucugagcuugagguguggguaucagaggaaggaagaguuggagggauuagaaauguaaauucuuuaggauauaagaaauguuuguguggaugaaagagagacacacagagagacagagacagacacagagaaagacagagacacacagaaagacagacagagggauuauaguuaugacgugaguaauuaaaaacuuuugauuuggggguguuuugcugagauuaacaauaaugaggguaaaauuuuuggugaggcauaauuuuaucugucuggagcucaugucuuugaacuuugugcaagagugaugagaaaugucaaaaucagugcagucagauggagaaugaauguucugguauugacuggacuggaagaugguauauaccauaccagaaccauaugguauaggaagcaucugaugauggaaucagagugcacaggaaagucuuuuuaaguucaaguugaauuaugcagguggagggguuuuuuaaagguugagaauggugugugcuucucuguuucucucuccuucuucccaaggccauacagucuuccuugccuccuuuucuccuucccuuuuuccuuuccuucuuuuucucugucaucaaaaguaaacauaaaaggauguauggaggugcaggaaaaguuaaaucaggaugccuacuuuaaggaagauggauuuggaauucuggaguugauuguuauuugguuagguauuuuuauuucgcacaucuuaggcaugguucaucgugucagcaugauuaaagcuacaauaaaaagcugggcacaucagugcgucccuguaaccccaucaccugggaggcugguagaggcugcuaguuuuccagaagucauuuucuuuuggcauugccauuuucuacagguaaccgaugagaacauguuccugccauagccuuagaaaaauuuucauaaauuuucccucuucugaaacuauuauuaaaguuuaauucauuuuaaguaacauucauuuauaauuuaaaguguuccaccauaucuguggugguucccccuacuuuuccaugguccauggaaauauacuagguauuauagaagacauuaagauaaaaguuauaaugccaggcagugauggcacacacuuuuaaucccagcacuugggaggcagaggcaagcggauuucugaguucaaggccagccuggucuacaaagugaguuccaggacagucagggcuacacagagaaacccugucaugaaaaacaaaaacaauaacaaaaacaaaacaaaaaacaaaacaaaacaaaacaaaaaaauaaaaguuauaaacccugucgguaaggaccguguaaugcuauauguguguguguguguguguuauauguguguauauacauauacacauacauauacauacauauauauguauacauccauuccuccaaggggaacucaucaaggagacagcaaauaaugaacaauccauauaaauccuaagacuuauacaaauauauauacaguccaggacagccaggacuacacagagaaacccugucucgaaaaccaauauauauauauuauguacacacacagauuguuugauuauuuuucaugucuccaauuuuaacugucacugggacacuaucaauaauuaugcagauacccaaauguagguuaauacuaugcuagaaaaaucgagauauagucaaacucuacuccuaauuuugcuuuaauuccuuuuauuauggauguccucauaccaccaauaaggauuaagcuacuuguguaaguacuuaucuucauacuuugaaaguucucaauauuaucuugucuacccucacuucagaacucuucaucccauucauugaaaccaaaucccaaaccauugccuugaugugccagucaguagguauuuucucacuugacuucuucaccuuaucugagcacucuuuuguuuuuccacuuucagcacugcaacucugaugcucaggcucugccaggacacaaucucgacauggcagcacuauucccuggccugcuccaggggaagagccaggacagaagugucucauacccugucuuuaucagcucuggauggagugcuucauaauguuaggugcagaugcuagaacacucaugagagucacucuuuugcugcucuggcuuaaggcacuuccaucccuuauugaccucucacagacuggguccacucaauaccucaguucuccagaaguaguuaucccucugaaggugaccagcagggccaggggugcaaagaauucagaguggcucuccuauagccuuguauuugguggccguagacauguuguccauaugcgagucaagaagcuguugguuucuacucacaucccuguacucaccuacacagaggaacacaccccccucagcgauuaccccuuugucccuagugacuguuacuaucaugguuauguagagggagcccuugagucuuuaguugcuuucagugccugcaaugggggguugcagggaguguuacaaaugaauggcuucucuuaugaaauugaaccuaucaagcacucuagcacauucgagcaccuagucuauacauuaaauaauaacaagacacaauuuccaccuaugcuauguaguuuaacggagaagagacuacuguaccaacccuuuggaguugaagaggcuaagaagucagcuaugaagcaaaauuauggaaaacuguggccccacaugugguuucuggagcuggcuguagugguagacuaugguuucuucacuaacgcucaacaaaacuugucaaagguacgaggagaugugguucuuguuguuaacaugguagauuccauguacaagccgcuggauacuuaugugacuuugguuggcaucgagauuuggaaucgaggaaauguucucccaauggaaaacauacaucaggucuuagaagauuuuucucauuggaaacaaaucagucuuucucagguacaucaugaugcagcccauaucuucauuagaagcucacuuauaaguguacuugguauagccuacauugcaggaauaugucguccuccucuugauuguggaguugaaaauuuccaaggggacgccuggucucuuuuugccaacacgguggcccaugaguuaggccauacuuuugguaugaagcaugaugaggaauccugcucuugugggaaaagugguugugucaugaguacuuucagagugccagcagagagauucaccaauugcagcuauagugauuuuaugaagaccacuuuaaaccaaggaacuugucuguacaaucauccaagaccaggggcagguuuccuggugaagcgcugugggaaugguaugguugaaagugaagaagagugugacuguggaucuguacaggaaugugagcaagaucccuguuguuuucuuaacuguacgcugagaccugcagcugcuuguaguuuugggcucuguugcaaagacugcaaauucaugcucuugggggaacucuguagaccaaagaucaaugaaugugaccuuccagaauggugcaauggaacaucucaccagugcccagaagauggauauguacaggaugggguccccuguggugccggugccuacugcuaucaaaagcaguguaauaaccaugaccaacagugcagggagauuuuuggcaaaggugcaagaagcgcaucucauaauugcuauaaagaaaucaacuuacaaggaaacagguuuggccauuguggcacagauggcacaguauuccuaaaaugcagaaugucagauguguuuugugggaaaguccacugugaaaauguagaagacauucaccauccccaggcuccuuauguuuugcagaacauuuaugccaaugguaucaccugcuggaguacuggccauuguuuggggaugggugugccugauguuggugaagugaaagauggcaccaccuguggaguaggaaagaucugccuacacaagaagugugucagucugucuguccuuucaaaugcuugccuuccugagacuuguaauaggaagggggucuguaauaacaagcaucacugucacugugacuaugggugguccccgccuuucugccugcacagagguuauggagguaguauugacagugguccaacaucucaaaaaagaagagucauuaucacuguccugucaauaacugugccuguuuuauccauccuaauuugucugcucauagcugggcuuuauagaauauauuguaaaauaccuucuggucccaaagagacuaaggccucuucaccagguuaggaagacauauagcuuaauagccgccuaugcacuaaguuuggcaacaacaauauuacuguauguaugaaucugggcauauuucugagaguuuacaggaagaugaaaguaucucccucuucaucuguaucagaaauauugucaccaggcacagguaauucuuaauguguucuuggcuguuauuuauucucuuaagcagcaaauaaaguguaauugaga

SEQ ID NO: 6729 - RNA, 21454 nt, Mus musculus
cgccuuuacugugcgccggaaggaggcucuuauagcgcuuuuggaauuauggcggcgguggauauccgagguaauuaauuuuaugcuccccuuaccagauugugguuuacugggguuucauagcuugcggaagucagcguuacccucuuuugugaggucucucaaguucuucugaguggcuccuggauacccuaaggcucuaaucuaacgaaaaggggucgcgcuuucccguuuucugacgagucucuuuaaaaggguagaugcggaaaaacuagaaacaauuuagggguuucucucacaaugcugggcguuaugucggggcgaagggauagcuuuucggaagagagaaguggaauaagauaagggcugaucccaccuuauggguccccggacagaaauccccgucuucuuauuaauaauuuuaaauuuuagccuauaauaccuuucacuuaucauucauucagugguugccuucggcaagcugagcaguagagguauauuuucauugaguaagaauaaauaaaugaauggagacucaaccucuuacuagcuucuuggucggguagcauuuuguuuagcaguuuguuuuugcuuguguauauuucauucuuccucuuggcaauuucauacauguacauaguggauugcuuauuacuuagauuuguuagcguaauuguaaugugucugguguuuagaggaauggcagagaagcuggcauagggaggagauguagaagagaagaucuggaaagauaaaugugagagaacagucaacagggacggcauauucugacuuugucuuuuuuuuuuuucauuuacgcauuucuuuacuagaucauuuuagcugcugacaguaguguaaaagucagggauagaauuagaaacaaaaaaaggaaaacaaaacgaaaccagggcuuuucugggauggacagaaauuagagguagcuuggaagagugaugacugcauuagugagaagguuaaaucugcuugguuuuugguauauucuguuuaugaagugaucacaacuuaccuuuuauuuucagacuugacuuuucauuucaguuuuuguagaugaauguccauggauacaugaggcuguuuaaauugauugagaucugugaauaauaaaguaagucauacuugccuugaccuucaggcauggauuggaagcauuuagugauuauuaugcucauuccugaugaauaaaaacucacaauuuagugggagcagauuaucugugauucugguuauggaauaagaauuaguaauaagggggcuagagagauggcuuagcggguuaagaguacugauugcucuucagagauccugaguucaaauuccaccaaccacaugguggcucacaaccaucuguaaugggaucugaugcccuuuucuggucugucugaagauagccacaguguacuugcaauuauaaaauaaauuaauuuaaaaaaagaauuaguaauaaaaguauauaaauuugccaugagaacagagaaaaugccaccauuacuacuguaacaguuauuggguuacagugugccaagcauuuaaugugcauaauauuguauguauaauuauagaucuuaccuaccuaccaaugguuaguuaauagauauggacaugaaaugguuaugccugguaauggcagaaagauaaaacuuuuuuaaggaaaaaguuaucguuuccuaaagcagcuaaaagaaauguacauuuuaugguaaauggaauuguuaguaggauuaggaaauuuaaaucauagucgugguuuucccuguguugcucuucauuagcaaagaugccuuuuuccaaaaacauuauuuccugguuuuauauauugugacuuuacccauauauauuuguguguauacacacacacauacacacacacacacauauauauaaaugguugguauuauuuuuguuaauauacuucauuuguuccuuuuauuuuauuuuauuuuauuugguuuuucaagacaggguuucucuguguagcccuggcuguccuggaacucacuuuguagaccagccuggccuugaacucagaaaucugccugccucugcugggauuaaaggcgugugccuaaacgcccaucauucccucuauuuuaaaacacacaaagcaugauuuuuuuuuuaaaauuguuuuaacauguaacaacuuuuucucauuugauuaauauuucacgggauugcuugucacuuugaccuagaucugacuucuucagaaaugguaaaaguagcuguauagaagagcugaaguuuuucauccaguauuauauguuaggguguugauuacuuaacuauaaugguguuuaguaggcacugauaugaaacaucaucauagccaaugcucaauuaaacucauuauaggaaaccaauuuaccguaucuuuuaagacaggaucacauguaguccaaguuggccucaaucuuuugauccaccuaucucagcaucccagagugcuaugacuuauaggucuucaucacuguuccuggaucuaccauaucuuuuuagaauuugagguuuaauucuacucugaaucugaaacaguauggcuguaauaguggauuuuaccaucuuccccuuaacuuuuacaacacuauccucucaucuguaauaaaaggcucccuaauauucccuguugaucaguggaaggaucuuuaaacuggugguuguggcuguuuuaauuguuuucuuuucuuuucuuuuuuuuuuuuuuuuuuuuuuuuuuuuuuuuuuuugguuuuucgagacaggguuucucuguguagcccuaguuguccuggaacucacuuuguagaccaggcuggccucgaacucagaaauccaccugcuuuugccucccaagugcugggauuaaagguguaugcccggcucguuuuaauuguuuugaaucaguuuucaacacuuaagaagucaggauuucuaggauuuuaauuuuuuggguuuuuuugagacaggguuucucuuuguugcccuaacuguccuugaacuugcuuuguagaccaggcuagccuagaacucagagaucugucuaccucuguuucccagugcugggacuaaagauaugcaccacuaccaccgaguucuuuuaauaccuuuguaaaugaguuuucuauacuaggaaauaguuuuuauuuauuuauuuaauuuauuuuuuuuacuuauucauuuuauauccaacucacugccccccaccccacuaccccuucccccaagccuuccccucuccccugccacuucuccucugagcaucucccuggagccccucuggguaucucccuggaaguaguuuauacuucuuuucuuuguggugagccuuucuucuuuaacacagugcaaaauccaccucuugccccaugaaaaauaauuuccauuuccccuuuaaaguguucugcuuccccuuuugugcuuuuguaauucauuuaucccuaacuuuacuacuuccuauguuucuuuuucauaucugacuucuauuagacugucacaguacauagggcagaauaaaucauucuuuaauucauagcacauaauagguauuuguuaaaguagguuauuucucuuuucuaacuguuuuuuuccccccauagauaaccugcuggggaucuccuggguugacagcucuuggauccccaucuugaacaguggcaguguccuggauuacuuuucagaaagaagcaauccuuucuaugacaggacguguaauaaugagguggucaaaaugcagaggcugacauuagagcacuugaaguaaguuguucuagagauuuugcagcaaauaguuauuuuggccugugcguggugguugguaacagacacaguagaaccuuuggaaggaaagcaaaguuuuagcuggggagauaacuugguggguaaaaguaccugugcaggugcuugguaauccgaugguggaggagagaaucagcucuugaaaguugugcucucaggcgcuugguggggauacauguggccucaacccuaacaaagaguuacaggccacugaguaaagcugggagugggagagagggccucccagccaagagcacaccaaucgguugucuagugccaagcagccagcccugaaaacaugcauacaaggcacaucauauggacuuaacagguuauaguuaggaauuacauauaauaucuauauuuucauuuauauauaauacacauaaguuuauaauauguauuauauauaaguauauaauauacauauauauguaaguauauaauauguauacuaugaguacauauauguaguaauaacuugaugaaaaaggggcugugaauuugaaggagaguggggagguauaggugggagacuuggaggaaggggaagggagaaauauuuuucauuaaauugcagucucaaaaauaaacaagggcuggagagaugcucagcaguuaagagcacugacuggucuucugaagguccugaguucaaaucccagcaaccacauacauaguggaucuauagugagaucugaugccuucuagugugucugaagauagcuacaguguacuuacauguaaugauaaaucuuugggccagagcgagcagagccggagcgagcagagguccugaauucaguucccagcagccacaugauggcucacaaccaucuguacagcuacagugcacucauauacauaaaagauuguccuuugaccuuacacacacauacacccacauuuguguguguauguauaaaauauaauacauguauguaaacauauauaaucuaaaauaauaaaacacacucuguuuggguuuguacaaauuugacauccauuuguaacuuaaacgucuuugaaaugucuguguaagguaggaccggagcuacugcucagugaguaaguuuaucauuggggccauucagucagauaacuauuauuauucucuuuucaaaucugauauuauuuaauguagucugguuuauugcaagaccuucuuugacaaaugaaaaaauuuuauccaaacaugaaacaggauucuucacacauaggaugcuaaauaagaguuuuguuccauuugcacaaguuucugaaauaacucauguaaauauuggggaugagguaaguuuuauaaaguuuaguucuucuguuucucuugggcccacggcgccgacaagaugaacaagugcuguggucuccguacuaccuggaagcuccauagucacugaugggaccagaaguggcaugauaagcaguacaagaaagcccacuugggcacugcccugaaggccaaucuguuuggggugccucucaugcaaagggaauugugcuggaaaaaguagggguugaggccaaacagccaaauucugccaucaggaagugugucagggugcagcuuguuaagaacagcaagaugacagccgugauggccccgugguggccgcgugauggccgccuggcggcguggaggagaaugaugaggcucuggugcugaguuggguugaaaaggucacgcuggagguguuauuccuggaguccgcuuuaaggccguuaaaguagccaaggugucucuuuuggcucuaugcaaaggcgagaaggaaagaccaagaucauaaaauuuggcaauggaaacaguaauaaauuuucauauucugaaaaaaaaguuucuauauuuuaaauaacuuuuacuaugagguaaauguagcuguuaaagguaacuuacuguaguuuuaaauauaaucuuacugaaacuaaauuuaaauuuaugagguuuuauauuguuuuaaagccacauuuuaaucuauauaccaccuguauaggaaaauagguaguuuuauucaauagccaaccuuaaccacugaucaucagcacuuuuagccccgcuuuuacaaugcuguuauacuuuaucugguaacuuaaguguccuauagaaaguuuggacucauucacgaucucugugugccccuuucagucagaugguuggaaucgaauacauccuuuuacaugcucaagagcccauucuuuucaucauucgaaagcaacagcggcaguccccugcucaagguaaaaaguacaaaacaccauaauuuauuugcuuucugaccuguguuuuuaaauaagggauuuacuuugguauaccauucugcaacugacuuguguguuauguauuuugguuucuuuugucuucauuugcauugaauucuguuucgguagguucuccaaacuacauacauaucuaauacuuguuagcaucagcauccauuguacucaugaucagaauucauuauggcugcccagaagguuacacagcuagacagucaagcaaaaagacauuguaggaaucuacaucuucugaggacccauaccaaguauuccuucuguucagcauagauaaaacuauaugugaguguacauacacacacacacacacacacacacacacacauauuuauuuauuuauuuauuuauuuauuuauuuauuuccagaaagucauuugaaacucugagccugaggguuuuuguuuuuuuuuuuuguuucuuugguuuuuguuuuugguuuuuguuuuuuuuugguuuuuguuuuguuuguuuguuuguuuguuuguuuuaaagaacuggucacauaggcauagcauuuucugccuacuagaaucacagacuccuaguagcaaaccaggcauccaccauauucaaauucuacauuuuggcugggcaggcagguauagcuacacuuaagaaguauaucccaaacucuuguagcacucgagcacaguuguugagucccuggaccuugagucucuugagaaccuuucauuuccccucagucucugagaugauaacuuuauaaaauacaugaccgccgggugugguggcgcacaccuuuaaucccagcacucgggaggcagaggcaggcggauuucugaguucgaggccagccuggucuacaaagugagcuccaggacagccagggcuauacagagaaacccugucucgaacccccuccccccccaaaaaauuaaaaaaauaaaauaaaauacaugaccuauauaguuuuauuaaauucauagagaauaaagugaguaucuucaaauggcacauucaaucaaaaaucauaccuggguuuauuaccaaaugauacucacuuaggaaacaacagugaggaguaaaugaacccaggucugguuugaaugagagagcuacggcauguaguuuagugaacacuggaacuugaaaaacaccuugagaucaagccaggaauuugcagucucacugaagagaugauccaaaguagaaagcuggguaguauugccaagagacaucucccaaguagaugcuccacaucaagauacuuggggacauccuuuagucucacuugccaaagagguugcaguucagaauccaaaucuuguuucagaaugaaagguuuagagucucuacagagaaaagggaaccuuagauaauaagcaaggucacuugggaauauucaggauauagaaauggcauuaggugacauuggacucaguccugggacucagaggcaaguauaucauucucccccuauccuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccuugcaacucucucgggcugcugaagcacacucacucuaucccgugcaaugagacuagccucaugggauauaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaagucucaauucccgaaggaucuguucaaauucagccauccaauucuguaacauauacugaaaaagacuuuuugacaaauuagcuguccuaguaaauuuaacauacugaauggaaauaacacacaauuccggaaacuuuuguucacaacccugcugaguuauuugucauaauacaucuaguuguaucuggacaagaucuaugaguugauuaaccagcaugagaccucucuguaucuugacauuagcugaggccuguucaucuaugacuguagucacugaggcugacaaaguguuaauggugucagucgucuggaccuguccagacagagccaaggcugucugaauuaaggccaaacccaguuccuaguuagugguaaaaaagcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguacccaaaauggguugucuucauccugugggaaaacacagacagcuccccuggaucuuaucaagauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccaaagacaccgacacucuuggugcucgggguacagucuccucaaaaguuccccucuucuguuuuauaagauaggcuuugagggugcgaugcgcacgcucaacaauacccuguccuugaggguuguauggaaguccagucagguggguuacguccaucugacggcagaacuguuggaauuuuugagacguauaagcugguccauuaucagucuuaaggagucuggguuucccccaagcacuccaugccucaagacaauguugaaucacaugugaggcuuuuucuccgguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuuaccacauaacaggaaucugacacaauauuaagggguucuaaaaagguuuuuaaaacuucuaagaccacuaaacauucuaccacuugcggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuagaccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaaggcugcgaauccucaauacguuguaauugugcauucuguaaggccuuuuccacuuuuuguaaggccugguuagcagcuagaguaagaguccuaggggaggagauaugaggaucuccuucuaaaauaccaaacaaaggccuuaacucagcggaaggaaucuuuaaaaaaggucuaagccaauuaauaucucccaacagcuuuugaaaaucauuuaagguauggaggugaucucuucuuaucuaaacauguaaauauugauuucucucaaaggaggaaauaugcgugacauccaucugucagaccuguaauggccugacgccacgaggguuuaccccuacgugaguagauaaaauuugacaacaaucuaaaggcauuauuaaguaaucagaaucacuuucaguagaaccaaucccucuggcagcucaaggaauaccagaagaagaaaaaacagccauguaggcuuggcaaaauuauuauuaguugagcuauucugucccuuugugauauagaaaagacaacuugaggacaagaacagagaaccugaaguuccccuuuacaauucugaucuacaacuccaggguagacaauaagaccuuguaggcugcaagagccugccucugucauuauuguccaguggcuucaccugcucgggagagcgccuuccaggcccuaauagccuuuucauuugauucagaacuacuaaaaacuggcuccuugagcucaucuagugaugaguauaggcuccuucucuuagaagccuccgcugauugaucuuuuuucuuuucccuuuuuccucuuuuucuucuaaucucucuccagguauuccuaccuaaccuuaacuuuuccucggguucaagacccuuggaaaggccuguauacuuauuuuguguaccauauuuccucuuugcuccuacucucucuccccgcuuuacuucugauagcuuguccugaauuucaucuagaauccgcccuaucuuaaccacuugauaacaugugaaaaggaacaaaagggcuucuaacacuagaaaaaauucaaggccaaacauuuuccacuuuacuucugauagacugucuugaauuuccuuagaaaguucaaggccaggcuuaccucguaaagcuauacuuacggguuaccgccguuccccagcugaaaaguucugaauucauacaguugaauccuucuuaacagucugcuuuacgggaaccuuuauuaccgcgacccgcaguucugguucuggaaugagggaucuuccuugcgccagucccgaguuuuuucucgucccggaauucggcaccaauuguuauuagacgcguucucacgaccggccaggaagaacaccacagaccagaaucuucugcggcaaagcuuuauuucuuacaucuucaggagccagggugcaggaagcaagagagcaagaagcaagagagcaagaagcaagagagagagaaaagcaagagagcgagaaaacgaaaccccgucccucuuaaggagcauucuccuucgccucggacgugucacucccugauuggcugcagcccaucggccgaguugacgucacggggaaggcagagcacaaguagucauaagauacccuuggcacaugcgcagauuauuuguuuaccacuuagaacacagcugucagcgccaucuuguaacggcgaaugugggcgcggcucccaacauaucaucagacgauaucaccagauaucgucacucgaguuggcugacagcaaugcacagcauacacagaacacuggugugugcuauguguaccuauaccuguaccuaacuugauugagaugugccugugguuaggaguugaugaacuccucuggcuauauagauggaaugauauagaaguacucaacucuagguaacaagaaaugaacaguguggcuguuuuccuguguugcuuacuuauaaagagagaaauugccagaccuucccuuaaaguucuauuuagggaaguguuuaaguuuagcuguccaauucuugaaaaaucaucuuuuuagcaguuuguuuucaagguguguucauaagcauuuuuccuugcugcuuuaguuauuccacuggcugauuacuauaucaucgcuggagucaucuaucaggcgccagacuugggaucaguuauaaacuccagagugguaugugucuucccucaccugccugccugccuucccucccucccuuccguccuugacguaguagcccuguacuguugaacacuggccuugaaccccugguucuccugcuuccaucuucuaaguacugagauugcacacuuagcuuuuuucacauucuuugaacauuaaagcagacaucuaacugagauaccgugcucugaagcaaguagaaggucuuucacuuugugccagcugguauaaaaugcugacuguuggaggguuuugaguucuguuucuguggaucaacuuagugcuaauauauugagucugccugaauaacuacagucuacauuaguaacaugcauaaaacaccuggaacaagaacuacaccuguuacaccuguacuauuuuguuguccauuuuauuguucccuaaacaauacauuguaauagcugucuauauaguauuuauauuauguuaugcuaugccuuauaaguaauuuagaaaugauuuaacaauauauaaaauuuauagguuacacugaaaugcucauuauuuuauauaaggcaugugaauauggaacuaaucccuugcagauacugaagggugacuacaacugucaaaugguaauucugaaaauaggaaauuacugucuuugaauagguaauauuuguauuuacuuaggacacauuaguugaccucuugagagauuuagaauguguugggguuuuuuuguuuuacaagcuuacugcagugcauggaauucagucagcuuuugaugaagcuaugucauacugucgauaccauccuuccaaaggauauugguggcacuuuaaagaucacgaagaacaagguaaguggagugcccaggcccucccaaaacaguuugguucucuggggaugaagcucgagggcuuguaacguuaccuagauagguuuuaauuuuucagaaggugauggcauugcggcccuuguguucaugucauaggugcaggaauaguaacaucacaacaguuauuuuguccgugggcucuuauguucacaagcguuguaaagacgauugaagguuuuaaaugguuuaaaaugcaaagaggagggacagugaugauggaugagcaaagguuauuuuuuauuucuugaguuaucuuggauuuuuggaacucuucaucccgcuagucuucaaagucagggagaugagauacuauucuugguggccuuucuucagauggccaggccauguccuucucccuccccacuuccuauuuucacccccuccuguuguguguugugauaagguuuaaacccaggacuuuacuagguaagaacuuuacucccaaguucuaucccuaguugaugggguuacuuacugguugucuauccucuccccugaccccucacccaagguguguguguguguuguuuguaccacagcacauuugugggugucagaggauaacuccauaguugguuguucucuccaccuuaaauguguguucuggagaguaaacgcagaucuucaggcuugcauagcuaguaucuuuguccacuguacuuuuucauuggcccuaggucccuuucugauucuuugauauuaccaccuguuaugaugcuggguccuuuaguuuccauggcugguaaucugugcuguucuuuuaccauguaucaccaaaaaccuaucuccggaaaugugucuauaucaguguauuuucuuuuuugagaauacugaaguguggaaaagauagccuuuauguaggauucagagccauucaguggcccuucagauaugguuauuuugauuguuaauauugggguacaggcaguaacguuuaauguaggaaagugggggcuggggagauggcucagcaguuaagagcacccgacugcucuuccagagguccugaguucaguuuccagcaaccacuugguagcucauaacccucuguaaugggaucugacgcccucuucuggugucugaagacagcuauaguguacucaaauaaaucaaaucuuaaaaaaaaaaaaaaaaaaaaaaggaaagugggccuuaguggagugauguuguccccaccuuaugcuaucuauuuagagcaaaucacauauguaacuucagauuuuuuuucaauauuccuuuuaaucuugccuucaugaucuuguuuuguaauuuucccccuggauacaguggcuagcuuuuuuuucucagagggaaugagaaugaauaaaucaaugugcuuuagaaaaguucuccaguggagcucaggcuggccuugaucccacaguucaccugccuucauccucccaagcgcuaggauaagcagagacaugcauuaccauucccugcuaaaugcaaacuuuugaaacagauuuugugugguccaggcagguuaaucugaucuugcuguaugaccaaggaugaccuucaacuccugauucucuugccugguuuaauugcugucuuuauaauugaguguagugacuaguuugcaaaaucugucuuuucuauguguccugaguagauucuguggaaaaggaccgcugaauuguacuuaaaauacucaaaaauaauauggauugauuuagguaauuaugaggaauguuaguuuaagaacuguuugucuccaggcggugguggcaugcgccguuaaucccagcacuugggaggcagaggcagguggaucucugaguuugaggccagccuggucuacagagugaguucaggacagccagggcuacacagagaaacucugucucgaaaaaccaaaaaaaaaaaaaaaaaaagaacgguuugucuaucagugcuacacagugauauugaacuauaucagcuuuugaaauguuugcaaaagagagcuaggaacuucuuuuauguauuuacuauguuuuauuugaagaguugucuuaauagagauaucauuaaaaauaaugguuugaguauguucaggauguugauuugaauuuuauauuuuaauagagaaagucaaaccuaaagccaaaaggaaagaagaaccaagcucuauuuuucaaagacagcguguggaugcuuuacucauagaccuuagacagaaauuuccacccagauuuguucagguaacaagaauguguugugaauuuucauuugauguuguucuaacacauuuuuaauuggaaagucucuuagguaugauuuaaaaauacugcuuuuucuuauuagcuaaagauuuaccucugaaugagaaaagagguucuuaguggaguuaaugaauauaagaaauggauucagcauuguucagugccccuuauugaaucugugaacauugaggcuguauuuagauaauauucuuaaccauaaggcugcugacggcauaauggguucaauaauccuagacuauaaagccacuagacauaagugacucuugagcaugggcgaacauagcucauuuagguugaguugucauguaaauucauacaaacucgaucuuaauauuugcaccagaggcuggagugaugcucaauugguaaagagucauuguugcucuuugagauuacccaaguuugauucccagcacucaaaucagguaucucauaacugccuacaacuccaguuccaggguucagauacuaucaucuggccucuauggguacccacaugugugaauuugaacauguacacauauacauaaauaaaaguaaaucuuaaaacaaaacaaaaccaaaaugucagggcuagagauauggcuuaacaguuaagagcacugcuugcucuaacagaggaacugggguugauuccuagcacccacgugauaguucacaaacauucaauaccuucuucuggccucugcaaguaccaugcaugcauguggugcacagacaugcaugcaaacaaaacauacacauaaaaagaaaaaaccuuauaccaaaaaaguaagauaauuuaaaaaauauuaauuauaagguuucuuuuuauagauauuccuggagguucuuuugaaaaugaauuauuaaaugcauaugguuuuaucugcuguuaaugucuuuuaugaugaaauucuuuugagugguuuugguuuuuaaucuggaaacugcugggguacuauaagaugggacaacagucagguuuaccuuguuugauucagguugccuaaaagcauuccuguucuguuugcauaucucacagcacauucugcuggucgacagcaguguccacugggaaagacuagucagugugugcuggugcuuaaggugucugcucaagugguaguucagagcuagcaguacaaaaaucucaaauuuuucauuccucucuauguuacucuauauguuuccucuucuauuaaauauuuacuccuccaaacuuagauauauuugucuugauauguucaugauauacagcugugugugggugucuguaaccaccuucauauuuggaaauuuguuauaaagauuguauguaguuuuacuugguagagauuuauuucugugagauauaguaagagcauauagcuaagggcuggagagacagcucagugguuaagaacacuggcuguuuucacagaggauccagguuggauuccugguacccgcauggcagcucauagcugucuguaacucuagguucagggacuccagugcccucuuuuggccucuguaggcaccaaguaugcauagaguguacagaaauacauacaggcacaacauuccuaugcauuuuguuuuaaagaguguauagucagauucuauggggagaacacaauagagucuggaggagccuguggugguuuguauacaguacagguuuccuuguccuuuucccuuuuucucucucucuuuuuuuuuuuuuuuugguguuuuugagacaggguuucucuguauaguccuggcuguccuggaacucacuuuguagaccaggcuggccucgaacucagaaauccgucugccucugccucccaagugcugggauuacagucgugcgccaccacacccggcuccuuuucccuuucuuauacaggcuauacaguaugcauuuuuaccucaaccauaaaaacacagcaauaugugaauauuucugccuugaaaauuuauuagaaacucagaacuacauuuuuuaguuuaucauauacugaugccucucuuacauguuuaacaaaggcccacagucucugaaggaaagcagaucuuugacauaaaccauauuauuugugcagcauagagacagugacccaguguuaucagguacagaauggugggaaccccuacaauucaaguuuguauauuccagccaagggccaaccuugaaaauaggccuuuuuuuuuuguuuuguuuuuaauuuuuuuucaauguuggggguuaaacucauggccuuggaggagcuaugucuucaacaacccccuuuuuucccaaauaaauagauagguagauagauagauagauagauagauagauagauagauagauagauagauagauagcauuaacuuauuguggcuuaaugguagggugguucucuggagaggggacauacggauguuaaaggguaacuuaugauuauagggcaacaaguugaauuucuccguguggguccuuggggucaaaagcgggucagguguggugguaggugcauuuuacuguacgcacugagccaguuuacuggcccuauucauuuauuuauugauugauugauugccagggucucacuaaguugccugagcuaaguugccuugaagcucacggagcacaaguaggcucugaccaugggcuccucccuccucagccuucugaggaucuaggaucacagcucuuuaucaccaagccacuguaagcagccuuucugaggagggccgugucaggccuaccaugguuaacuuucucugcacagugaauaagaagaccuauuuggucugguuaaguguaaauguucacaauucuugcaguuagagcaugcaaguucauaauugacaguaugaauguggagcaggugauuccagagaaauguguggucuucuauaaagcagauagcuaaggaggcuuaaggggagcaccuauguucagaaagacauugagaaaacacaugacaguggggagagagguggcuuggugcuuaagagccacggcugcucuuacagaggaccuggguucaaucgccagcacucacccugugcuucagaaccaucuguaacucuaguuccaggggaucugagacccucugcugguuuuguuggccaucaugccaacaauaggagucugccaagguaggucggaaaguauagugguugugguauuagugucccauuguucugucagugugucagugugauuuagcaugcagagugucacuguugagaguaaggaguugguuaugagccucaagggagaagaagguguuuuggaggauuuaauaugaguacuaggacagaaaaauaagaaagucuaucaaaaaaaaaaaaaaaaaccaaggaccguaaagcccugcugcauaguaggggacuugacacugcuucugacuucuaauguccccaacagucuuuuuugcaguuucauuaaaaaaugugugugugugugugugugugugugucugugugugugugucugugugugugugugugugagagagagagagagagagagacagagacagagacagagacagagagagagacagagagagagagagagagagagagagagagagagagagagaacacgaacuuauaguuccuggguuucugguaaucaaacuaagguagguggagguagguagguagccaggcuuuggugacaagugccuuuaucugcugaucuaucucccaggccccugaaguuuuauuuuuaauacuauaccgcuuacaaucauuuuuuaaauuguuuuuuaauuauuuguuuggugugucuguguauacguugugcaugugaaugcaguguucuccucacgggccaaaagagggcaccugaucccggagccgguguucuaggugguuguaugcugcccaguguggguguccggaaccaaauucaggucuucugcaagagcaguacauggccgggcagugguggugcacgccuuuaaucccagcacucgggaggcggaggcagguggaucucugaguucgaggccagucuggucuacagagcgaguuccaggacagccagggcuacacagagaaacccugucucgaaaaaacaaaaacaaacaagagcaguccaugaucuuaacccacuggaccagcugggcugaagagguggugcagcaaguaagagcacuugcugcuucauagagggucuggguuuuguuuccagcacccacuuaacagcucacagacaucuguaaucuaauuccaagggauuggauguuuucugguuuccauggccaccaggcauguacaugguacacaacuguacauacaggcaaaauacagauaaaaauaaaucuuuaggggaaaaggcauuuuuuucucaguuuccauuccugcuauacuuaaaggguuuauccauggaaauugcuguguagaccagguuggccucaaaagucacagagacccacuugccucugccucccaagugcuaugauuaaaccaaaucugggguccuuucuuauaguccauauccucuaagcagguaaguaucagaagguuuggacacuguuauuucuucucauuagauucuauguggcuacucuuuuauuguugccuguguguagagggugacagauuuuuagaugaacagugguuuuuuuuuuuuuuuuuguuguuguuguugguuuuuuuuuuuuuuugguauuuuucgagacaggguuucucuguauagaccaggcuguccuggaacucaacuuuguagaccaggcuggucuugaacucagaaauccaccugccucugccucccaagugcugggauuaaaggcgugcgccaccacgcccggcuggugagcaguguuuuuauguuugauuuauaucuuucugaaaugaaggguaacgaguaggaagugggaagcuuguuuuuauggugcuugaaugguaguugucguuuauaaugcaguuacauaaggugccguuuaagacuguaaagcccagaagaaacuuuauuaacuugacuuuucccucuuuuguuccccauuuccuauuuuucaaauccuagcaaaagucuggagaaaagccugucccagguaugguuuauuugcugcucuuauuaaacuuaaaguaagaucaggcagcuguguaauguucuaacagcagcggcaugggagaugagcugcagccaguuugucccuuaggcaucucaguauaguuugccauuccuaaccuuugacuuguugaaugcaagcagauaguggcucuguggaagugaccaaagcauuuggagguagagucuggguggaaagauugggaagagcaaggaggccaaagugacaugauaguagguuucaccauugugaacagguguugagcugucugugauguugccaguuuuuguggcuuguucacacauaaugucucauuuuaguacaaacauguuugccuagcauuauaaaauuuuuugauuuauuuuuuuuagguuuauaagagaauuuuaaaauauguuuaccugggggaaacaacuaaauauucaaccacauaagcaauuaaaaaugaauuugaaagaguaaaccuuuaauguuaaccaguguuuaaaauuaugucuuucuucuaccuucauuugucuugacaaaauuccugcuuuugcugucuaguggaucaggcaaaaaaagaggcagagccuuugccagaaacuguaaaaucugaggagaaggagagcacaaagaacauucagcagacugugagcacuaaaggucccccugagaaacgaaugagacuccagugaauguuggacgaggaagaagcuggccagcuccuugucagucgcuauaccucagcaccgugggaggcucuugagccuggaaacacuaucgcaguuuguacggaaugcacuuguucuuuacaaaaggacguucucccuaccauguuuucuaugugaauauuucuuaaauaucuuuuguaaucuuuccucuacuggacuugggcagugcaccuaacucacagauaugccaguauauaucuuuaaaacaauaaaguuauuuguauauauuacucaucau

SEQ ID NO: 6730 - RNA, 1844 nt, Mus musculus
ugaucucaagguguuuuucaaguuccaguguucacuaaacuacaugccguagcucucucauucaaaccagaccuggguucauuuacuccucacuguuguuuccuaagugaguaucauuugguaauaaacccagguaugauuuuugauugaaugugccauuugaagauacucacuuuauucucuaugaauuuaauaaaacuauauaggucauguauuuuauuuuauuuuuuuaauuuuuuggggggggaggggguucgagacaggguuucucuguauagcccuggcuguccuggagcucacuuuguagaccaggcuggccucgaacucagaaauccgccugccucugccucccgagugcugggauuaaaggugugcgccaccacacccggcggucauguauuuuauaaaguuaucaucucagagacugaggggaaaugaaagguucucaagagacucaagguccagggacucaacaacugugcucgagugcuacaagaguuugggauauacuucuuaaguguagcuauaccugccugcccagccaaaauguagaauuugaauaugguggaugccugguuugcuacuaggagucugugauucuaguaggcagaaaaugcuaugccuaugugaccaguucuuuaaaacaaacaaacaaacaaacaaacaaaacaaaaaccaaaaaaaaacaaaaaccaaaaacaaaaaccaaagaaacaaaaaaaaaaaacaaaaacccucaggcucagaguuucaaaugacuuucuggaaauaaauaaauaaauaaauaaauaaauaaauaaauauguguguguguguguguguguguguguguguauguacacucacauauaguuuuaucuaugcugaacagaaggaauacuugguauggguccucagaagauguagauuccuacaaugucuuuuugcuugacugucuagcuguguaaccuucugggcagccauaaugaauucugaucaugaguacaauggaugcugaugcuaacaaguauuagauauguauguaguuuggagaaccuaccgaaacagaauucaaugcaaaugaagacaaaagaaaccaaaauacauaacacacaagucaguugcagaaugguauaccaaaguaaaucccuuauuuaaaaacacaggucagaaagcaaauaaauuaugguguuuuguacuuuuuaccuugagcaggggacugccgcuguugcuuucgaaugaugaaaagaaugggcucuugagcauguaaaaggauguauucgauuccaaccaucugacugaaaggggcacacagagaucgugaaugaguccaaacuuucuauaggacacuuaaguuaccagauaaaguauaacagcauuguaaaagcggggcuaaaagugcugaugaucagugguuaagguuggcuauugaauaaaacuaccuauuuuccuauacaggugguauauagauuaaaauguggcuuuaaaacaauauaaaaccucauaaauuuaaauuuaguuucaguaagauuauauuuaaaacuacaguaaguuaccuuuaacagcuacauuuaccucauaguaaaaguuauuuaaaauauagaaacuuuuuuuucagaauaugaaaauuuauuacuguuuccauugccaaauuuuaugaucuuggucuuuccuucucgccuuugcauagagccaaaagagacaccuuggcuacuuuaacggccuuaaagcggacuccaggaauaacaccuccagcgugaccuuuucaacccaacucagcaccagagccucaucauucuccuccacgccgccaggcggccaucacgcggccaccacggggccaucacggcugucaucuugcuguu

SEQ ID NO: 6731 - RNA, 1339 nt, Mus musculus
cagacaggcuucaaacuugcuauauagcuaaggaugaccuuggaugauccuccacuucccagaugcuaagauuauaggcguauaguuuaguuuauuccuguuggaauaagauaaggguuuauccuggcccagauguggagcugaacgacagauuuuaagaaaaguuacuauaucuuccacauaagaagguucuguccagaaauuuaugugcauauauuuugugacuccuuauacacuacuccccagaguugguggguauuaccugcacccaagaauguguggucagacuuggggguguucguacugcgugccuagagucacagaccugguaagcaaguugcugaucucucugcucuagccugugagcacauucuuagaccacgguugaaaagccuuaaggugaaauucauccaucucggguccauguagguucugaaaucaccgcuuucccagggaguuguguccucuggcugaccugugaucuccccgagcccagcagacuucaucauugcagaggguagcguucuccuucaccuuucucaguucggcagggauuccaaccucacuggaugacggucugcccuguagcuccccuccucccagcaccgagaaggcccugggucucugccguccgacuuggagcuuccugauacagcuccuccacucuccuccauuccuaguccuuggagguuggaagccuguuucagcuccugucuucuagggagaucagaauguuguccuuuugucgccgugagccuuggcacccagcuagcaaagcaggaagguguugaacucacuaaugcucugcuuccccuggucccuccuguauuucaccuuaguccacagccaggccuccacagacagcggucugaggcucuguucaaggucucaaggagaggcacuggacaggcucuaguuuucugaaaaaguugucuuuggggcuuucuccuguuaggucccuugagucuagaagguacagugaaaguuguuuuauuguucaguauuuaacuacaagcguccuucccugcaccagugucuccucuguguccugagucccuccuugagccccuauuugcuuuggaauuuaaauuauuguguauugucggaaauauuuaaaggcuuuuggaaaaguccugaaggaagcguauuaccagguucuuuccuuuggccuuuucucuucgugucuuucaagguacuguacauuguugacgggaugccaagcgggcuggguucaguggcuaagccucccacuauuauagugucaugcugaucucagccugguccccacaccagagcucucagagacuugaauaaaacugucauacugguuacucccggu

SEQ ID NO: 6732 - RNA, 3557 nt, Mus musculus
gacaaugguugcaaagcuuagcacacagggaagcagaagaguccugagacccgggacggaugaaugagguccguuuacuucuagaauucgcagagaauuuaaaguugagaaucuccaggcuucucucuauaggaccacuuucuccuggaaugcuucugagagccuaaaaggcagccagagaacaugaaggcaggacacgucacccuagcuacagggccaaggauaggaauagggugcugcccugucgucucugaaugccagggcucccagggggugacaagcagcacuuagaacuugugguaugagguggugaugaggauaaaacacaaagcccuaugucaaacagcacagcuccaucuggagccccugcagacguuaggcagggccuaucccauaccaggcugggaaggcacuugcauuggauacaaaugucaaugggaggucaaaaaaaaaauuaguaaucaaaggcuaaaccauacuucaauauaacuuucuaaaaugccaaaauuaauaaaaacauccauggcaugguuggugcucagcccuaagguugucuguguagguaugguggugugaaagauggcaggagcgagggcaacacagaacuuuugaaauuuggucuugagcgaguacaaagcaugcuguaucacuucucaggggucuucacaugucaggguuucccuuacagccauucugaccugagggcuucuccccuccuguccugguaggaaaggcugcucucugaacacuaagucuguguucuuauuuccauccugggaugccaucuugcugcuaccuucacaccugacaacccaaaugccccggagagcaguuagcgggucagucagagcagggcagggcagggcagggcaggccuguuuccaaagucgcucccagcucaggucaguacucucaaucccaggaucuucucuuucccaucuugagacuuggagaggaugcagggacaaaggcagcaaagaaaucaaggaccugagugcagagcucaggagaaccccgaacucugcagucaguccagcgcuucuccagcagcuuagggaggcccaggugccuccaggguccgcaaccagaaacggacagagaaggcagugggugggaauaccuagaagcagcucaugaaaaaaaauaaaagaaacacacuuggccugcagaccuaaccaggaagccgggucuggguuuggcuaauuagauauggauugacuacccuuaaucaaacaagauuccagcuccugguuccugcccuccaacuaaguaccagagauggugagccuccagguauccaugccaggggagaguccaaggagaagggucuuucuccuucuauaugcggauuuuauugcaauuuuugaacuaggaaaauacuguuuugccaucuagaaauguguuuucaacaacugugucauaacaggaagucauucucaggucaagccaaggacaagugcuauaugacugagccauauggaauaggcaacuuuagccuuugaccucacuuuucaucuuucacauucucacuuuucuccaccaagggaagcaguguugcaaggugaagccaucuguguuggagcuggggcucuggcuccacacauuuaagagacaggaccuuguuauguugccccagacugacaucacaccccaggcuaaagcaauugcccugccucagccuccuguguagcugggcuucuaggaaugcaccccggaaccuagcuaagaugguagguuuuaaaguuagggccuuaagcagagaaguggacaucacccccagcucacgggaggccuucugagggucacacaucggcaaacuucggcuugaaaauggacaggugaagucgccagguucuugccaccacaacucccugagggccacucuuaccucuaccucaauuccagucuacacaaguccuuagaggaaguucaguacuucaccaacacuaggacaugccucuuucccaggccuucuagaggcagacaugugugcuucugaccugucggaucucgcaauuacacacccauccaaaggcacaugaucaaauaaacaugauuaaaagucgggggcucuacacccgugguggagcaccccuggacacuuacauccggagguguccacucacagccacagccuuuagggcccauuguucuuuacucuguucagagcuugauauugguaggcccuugcuuagcaagugggagaugcagcuauggggguuggggugggguagcagaggaaagaagagaaugcacagaagacaugaacuucaugaguuaagaaugguccuucucauggggcaacagcauggagccaggauugggucuagacacccugcaaagucuugugucccugagcaacagccugaggguaaagggauucuauuaggaguauuacccuuugucacaugauguuccaugccuagggacccuuuuccuaacaauuauuccagaacugaccugauuucgauuccuagcaaguuaugacccuagggaugauccucaaaaaccagaggccacccagcccccguuuccucaguaagacaccaaugguaaggacauccagcugaccagguuaagugggggagggaguuaggaaaugaucauguagucaccugggcuacaugaaguggugggagagcaugcgccuggccugggugcccauuaaucauguucaaccaauuccacaucacucaucuuccagaagccaaaggauaaaacuaaggcaagaugcccugaggcaaagauggugagccaugcugucagcuucagcacauucaucgugcaggggaaggagcuggcccucgagcuggcagggagccacaaugucucaaugcccuugcaagggaaguguaugauaaaggcuuuuagaaggaaaccugagagggaucaagacacaggacaagagucaugcaagaaaagaggaaccgaggaggcgggccgggcucagagcucuggccagacacaaccauccaaacagcaucugucugucugucugucuuccuguuuuugagacaaguguauugaaugugaggaaaauaaugucacuuuucuuuuaaggucagaagggaaaacaucccuguucugaguuguucaaauguaggugaucguuauuaugaugccuacaaggucacagggaugucaaagaacaccacgugaagagcauccacgacagcuucccggaaauagcuggaaguggcgauggaggcaucuccucaguucccagcaacagccugggucucuaaggauaagcacuggcaagugaaggcaugagaagacucacagaaaagagcaguauccaauccugcuagcagccugaagguagcggacacauguuccgagcagacagccaugucuuugaggaaagggaagugaaagggggaagcuacugucacuuaaguggguauauucacagcuaccaagccucguccuaaccaugaccacagauaugggaaccuaugucacacaaaugguaacuucuuaacacuugccccaucucuaggcucgcucgcacggaagaguggcaggcagugggccagcacugcacagguuugucg

SEQ ID NO: 6733 - RNA, 1677 nt, Mus musculus
uacucuuagggagccaggacuauucucaucugcuccuccagggagaagagguguguggaaauggccacgcgugaguaggggagaaaaaugacaauucaaaaagcugcaauccaucaauaauuguacgacuugaagacccaguuaacauccuccuuuccaguuuucaucuuuguaaaaccauucucugugcuugagugcuuugccugugugcgcgccaugugcauuccuagugcccauagagaccagucaaguaugucauuuccccugaaguuacaggaggugccauagugggggaugggaacggaaucuggguccucuggagaagucaaugcucucaaccaccaagccaucuaucucuacagccccuccaggguguguguguguguguuaucuacuuuguaagacuccuuucucacacacaugaaaauuuuauuaaauaaaauauuuguuuaaacacuauuuucccuuucccauccucuuguaggcagaguggcuucuaucaagagaaucuauccagacucacgcauguauuucccaguuuacugacccucccaggaauugaacauguuagacccuccuauaaacuugacugcguuaggggauuuacuuccggaucuccguccccaggacugucuggaugcuccuugaacaguaccaucucaucccuuucccaagaccuuaaaugugcacagugucucccuuuacaauguagucacagccccuugcaaaucacuggauguccaaaacuaaaacacaggaggcuuuucccuccacggucuucacuucaaggauaaacagauggcaccugcccaaggucauguagcugccucgcuauuuuuucaaauugcuccaguuugccuaauauuaaacuucaaauuaaaaugaaacaaaaauggucugguggggcacauuggcacacgccuguaaucccaagacuugggcaguugaggcagcgagauaaugagaggccaguauggccuacccaguaagaucuugcuucaaaaccacaaaugagcaaauaaacaaugaaguacugacucuuguuacacaaaucacaucaaugccugucuuggaaauacaguuugguaguuaccauggcugaaauauggaagccauugcuaugacaggcuuaaaaacauguaaaagagguuaagguccuugggggugguggcggcagguaacaaaaagacauagcauaggucagcccuugcccaagaauggcaggcagcacccgccuuuacuccuuuagucuuuggaaacuggguauccagucaccaggguccuagauauagccaguuucacaaggcaagcgcaaacuagcugguuccgcaugacuucccgagccugcggaagccccacuaggagaccuccccuuucggaauucuaauaacaauggccaggaacuucuucuuacaaagaugaacacagucuucauuaaggccagcagagcaaucgaaagaguucuuccaucgcuagccauaagguuccggggugugagugugugcguagcggcgacaguggacguaagcugguccccguggccaaauaggggaacagcagauccaucugaaccgggaauuggcgcagcccguaggaccaaacggcgcggacaaaagacagagggcuccgcagcccgcucggacuguccgaacgcacgcugggucucaccuucgggag

SEQ ID NO: 6734 - RNA, 2180 nt, Mus musculus
aauggcauacucggcaaacacaaacaccgugccuaaauuguacagaucugugauugaagauguuauuaaugacguacgagacauuuuucugaaugaugggguggaugaacagguccugacggaacuaaaagcuuugugggagaaaaaccuacugcagucuagggcaguagauggauuucguucagaagaacagcagcuuuuguugcaaguucagcagcagcagcagcaacagcauuaccaccaccagcaccagcaagcacaacuucagcaaacgguaccucagcaagcacagacccagcagguccuuauuccugcaucccagcaagcuacagcaccacaaguuauuguuccugauucuaagcugcuacaacauaugaaugcaucaaguauuccgagugcugcugcuacagcugcuaccuuggcgcucccugcaggagugacuccuguucagcuacuaacaaauucaagccagcugcuucagguggucagagcagccaauggugcccaguauaucuugcagccucagcagucgguuguucuacaacaaguuauaccacaaaugcagccugguggaguccaagugccuguuauccagcagguccuagccccacuuccuggaaggaugucaccacagaugggugucaucauccagccacagcaaaucuuauuuccaggaaauaagacucaggucauuccuacaacaguggcagcacccgccccggcacaagcgccgaugccugcagccggacagcagcagccacaggcccagccugcccaacagcaagcuccgcuggugcugcaaguugauggaacaggggauacaucuucugaggaagaugaagaugaagaugaagaagaagacuaugaugaugaggaggaagaagauaaagagaaagauggagcugaagaugggcagguggaagaagagccccucaacagugacgaugacuuaagugacgaggaagggcaggaacccuuugacacagaaaauguuguugucugccaguaugauaagauacacagaaguaaaaauaaauggaaauuucaucucaaggauggcguuaugaaucuuaacggaagagauuauauauuuuccaaagccuuggagaugcagaguggugaagaguugcuccuuuccucuuauaaaugagacaaagacuuaaaaaguuaaaauggacgguuugaaacuugggacaucuaucagccaaaacuucacuucugcaugucagaaaggcgcaguagaagcaaagcuccuggagcagagcuaggccuugaccacauagacacuacuucagaccggcaagccguggaacuguagcaccugggguugcugggcggggggagggguugguguaggaaaacuguaacugucgauuuuaaauacaggaaccugccauugguaauuagcauguaaagcuuugucuauauuuguuucuccaaguugggcucaaucagaagauauuuguuggaaugacccgaagaauuacccuuuugauagacugaacugaaauugcuuacuguaugugguuauauuugguaaaaauugcgugugagcuuuuuucagaagggcaagaauuaugguguugaauuuuaauucacuuguauaagaaaauuuaaaacucauaauaggucuuaaacacauuuuuacuugucacucuccucaguacucauaccucucgcgucccugcuggcugaacaucuacgcaagauuuaaagaaaaggaucgaugggcacagcuuggagacgagguugacccagggauggaugcuugguuuaauuagguuuuccugcuuguuaaacguaacuuaaagacuugggucuuaccuagguugacuagaauuaaagugacagcuuaauuucuguacagaaaaacugcucagucccacucuauaagaggaaaccccaaaugggcucucaggaaucuguuuucaucucacaaaggucccauggagcugcaguuguacagcacaugugagauguggagguuuuccuucugggcugcgugugugcuuacugugccugagucugugugagcccugggaugagagucugugcguuggucuaagcauaagggcaagggaugaggacuggauuuuuauuaaacaauuuaguaauuauaaaaguuucuuguguuuacuaguaaaggauuuuuaaaauuauuuuaauuuaacaaaauuuuu

SEQ ID NO: 6735 - RNA, 21531 nt, Mus musculus
ggacaggcagaagccuaauucaaugagaagaaagaaccggccgcuuuaguccuauggggugcgacaacacaacaugagggucuuuccggaucuuugcacgccccugggugcuccagcccagaagugucguagcugagaggaccaucugugcagguaaggcuguucccaugcguggcgugcaucugggcgccgacggagggugccgcuguacccacgcagaggacagagaaggcaaggcugaaggcaggaggagugagcgugccauacaaggccggagugggcgugggccaggaccuggcgaguccugcggcguccccaggauccccuugcagaguccagccugcaguagaccucugccucuguugaaauuugggcugugaagaaacacgaggccaggaggccaauaguacuuuaugguauaaauuuuggaaguuuauguuuuugguuuuuuuguuuuuugguuuuucgaggcaggguuucucuguguagccguggcuguccuggaacucacucuguagaccaggcugcuggccuugaacucagaaauccgccuucugccucccaagugcugggauuuugcuuuuuuuuuuuuuaaaggcuucuuuuauguauguggauauuuggcgugcauacaugaguguacuucgaacaagccugguguucagggaggccagaagagaucagugagaucuccuccagcuggaugaucgugagccgcccugcggggugcuaggauuugaaccuggguccucagcuuucuuaaccacuaagacaucuacacacacacaccuuuuaaaagagcuuuuauuuuuaauuguguaugugggugugugugcuuacaugugucuguggaagauccaagagacccaaaugugucaaacuccugaaacuguaauuugagacguugugagcuccugaacucugaagaacagcaagugcucuuaacugcugagcuaucucuccaacccuagcgguaucuuuauaagacacagaaagagagguuacgugguggcuugccugagguugugugcaggcugguauuuggaaaaguuaggaagcccagauguggaccagccuccauucccugccacaguaagauggguguuagugagaaacgaagccuuuccacaccaguucuagugacuuuggggagcgccacaacucccuccaccuuggaugaccagacacagccuuguguguggagcaaggcaguaagaagaaaaacauaaaacaaaacaacuaacaacuccaagucagcuacucggagaagacaaaaaucccacgaccuggaaauccaguugucgauaacaguggaaaguaaucgagguggugucuuuuggcugauggagccuacaagugcaggaugcuccuguaucucuaaugcgacuuuguuagucagguauuguuaguucuauaagccucgguuuccaugcuguguaguaggguuagcuuauuaugguuguguauuuguguguauguauaauguauguguguaagugaagguuagggggcaacuuuguggaguugggucuccuguggauuuuuauuuuuucaguuuuuuuuaaaaagauuuauuuauuuauuauauguaaguacacuguagcugucuucagacacaccagaagagggagucagaucucauuacggaugguugugagccaccaugugguugcugggauuugaacucaggaccuuuggaagagcagucggaugcucuuaccugcugagccaucucaccagccccugauuuuuguuuuuuuguuuuuguuuuuuugagacaggguuuuucuguauagcccuggcuguucuggaacucacuuuguagaccaggcuggccucgaacucagaaauucgccugucuccugccucccgagugcugaaauuaaaggcaugcgccaccacugcccggcucuccuguggauuuuagggagggaauuuauaaggauagguuugcgugcgugcgugugugugugugugugcgugugugugugugugcgugcgcguguguguaugcuacuuguguuugauugcucucaaaggccggaggaguguugggucacuuagaacugagugacaggagguugcgagccaccuugauagugggugcugggaucuaaguucaggucuucuacaagagcagcaauugcuuuuagcugcugagcccucuguccagccucuuauuuuauauuuuacaccugacagaacucuuggugagcuaucugcauuuucucauuuuccuccuguguucacucaugguccauaccauugaggguggaaaccuuauugaaggggccauuuuauccugaguuuuaccagcuagugguguuagcauuuugcaucuuauuaugucuuaggagucagggucuuacugaauuuuccuaugauugcauuaucucuuaucuaucuauuuaucuauuuguuauuuguuuguuguguggaaguuagaggacgaccugaccugaggugucauuugucaccuaccuuguuugagacagggucuuugguguucucucuuaguucauuaggcuggcuggccucagagcuuaugaggaauugucagccuccaacgucccauagaguggaaccgucuucugaagauuccagccuguauaaaugucaagggcuuugucuccacagccccacugaauaucauagcaugcugcuuuauaguacauuugcaaggucacuauguaaucccgaguuacguuacuguguaauuacguuacuauguaauuccgagugcuuuuauaauuaaccccacaccccaggccccaaucuagcccugcacuggggugaagugguaaaacagucccaggccuccaaccaagauguccuccagugcuuggagucuauccuuggguagcaacgagcccagcagcacugaugcaccaacccaaacaugcuguugcucuuauaaugcacccacuccagggccguggaugggaucugcugcuuagccaauguuuacugccacacagagagccccaguaaaccaaagccuuugccagaccugcaucauggggaauauugaggccaagccuggaaagguuaugggggagggggaggcuggaugggcuuuuggguccucuaaaugcuccccccccccccccgguuuuucgagacaggguuucucuguauagcccuggcuguccuggaacucacuuuguagaccaugcuaaccucaaacucagaaauccaccugccucugccucgugacagugcugggauuaaaggcgugcgccaccacgcccggcucuaaacgcucuugguaucuggggaaacugccugacaccagggaaaaccuccagccucccacagaguaaaagaaaccgguaggccuuugccccagauguaaagaggggcuugggaaacugcuaacagacugggugcuggacuucuggaccacccacgagaaaagguggcgagaugggagccaaaggagcugaaccuuugaaagcaccguaaaagugaaaugaggugaccuccuugugacaggagcaguucccagauuauaacgagcacuggcuccccuccugauagugauccuguaccccagccacucugaaguuccaagggaaguucagggccaggcuggccuugaccucacuuuguagcuaauggugaccuucagccugauccuucagccuccuacugcuaaguauucugauuacauccugggccugccuggcuuugagugugugugugucuggaacagggcaggcacccaccugacagccagggaucaacagaugacaaagacuggauguauagggaaaaauaacaguguuaaacagacuucuccccguuuucgcuuuuaucucaacauggcuuagaaucuagauuccuaaauugcacaguauccuaauagcuugguauaucaacgaaaugcuacugaagguagacucaacuaaggaaacucuguugaacggaaauagggauuauaaaauacuauacucccagcauuguaaugccuaugcagucaguucccagccaccacaugguggcucauaaccaucuguaauggcauccgaugccacccucuggugugucugaagacagcuacagaguuguuuuguuuagcucagcaguaaucugcaccuagccaacugggucagugggugcuaagaauagaagaaacaaccguggaucucuugccuuagcauagcaugagcaaggcccugaggucagacuccagcccuguagcgaaacaaaauaggaacuuaccuccagugagaugggaguggauaagccaagguuaaaccaaacaaacaaaugcagauauaaaccauaguaugcauccugaaagcaagcuuguauuuuagaaaaccauacuuagacauggacuggguuuuguuugguuuuguuuuuaaggggugggggggggugcuuuuuguuuuugagggucuuggguagcucagguugcucucaaucucccugugugacccaaagaauaaccuugaccuugcguuucuccugccuguaaucucaugugcuggggauuacaagaguaccaccgggccaucuucgcuuucauuuauuuuuacucuguguacgggugcuuuuccugcacuugugucugcucgcugugcggucggucaguacugggagagggccucagugugcauguggaagucauaggacaaugggguccuggguucaaacucagguuuggcaagaagcacccuuaccuuucacucagcaacuuuuuaaaaaucgugugaaugugaggguagggucugcacauaugagugcagucggugccuuacagagccagaagaaacuguuggauccccuggaguuugaguuaacaaguagguaugagccaccugauguggggggcugggaacugaacucaggucaucugcuagagcagugugugcucucucuuuaaacugccauaucucuacuccuuguuggguucuuuugaaagucuaggcagccuaggcuggucuugcaauagugaccucacuuccugacccuuccaaaacuggggaccauuaguugcuaccucagugagagcguuuuagaaugcuggggucaggggaugugaagacauggaguggguauguagaucgcucugcuggaauguuccugcgccuugggauuccagggggagccccugugacuccccuggcgggcuuucagagagcagagaugagaggaagccuuuaaacauaaacuagacaucugugauguccccaaggaugagguggacaucugggggggaggggggugucuuggaaagacauggggacagguguuuauuucucugagacaagagcaagaauuugugccgggugugguagcgcacaccuuuaaucccagcacuugggaggcagaggcuggcggauuucugaguucaaggccagcuggucuacaaaguaaguuccaggacagccagggcuauacagagaaacccugucucgaaaaaccagaaaaaaaaaccacaugaguauuuguggaaaagaugcagaacaaguuauuccugccuggucacgucucuucucuaggacagaggauuacacugucaguggugggaggggacguugggaaagugcuaggagcagauaaaggcguggguggcagccuuagcagugaccauugagcaugguggagcugccaggcaagaaggagagcgcacagccaggaugucuggcguucuguguuccucucuccuaggaacggacauggauaggaacaucuggaagaguaggagaagacgcgggcgaagccgacaccagagcccugcccuggggcagugugauuccagugagagguaugugugcaaguuuugaagggcagcuacgcucagcacuguucuggccuugucugauaccaugcuuagacguguacuccucagaacaagccggcacuggggccagcaggcucgaaagcuugacguguugccugccaucagcacuguuccaggaagugaucucacagucgcacucuuuguuucacagggacggcuucugaccagagugucagccauaggcuacugguagaauugucuuuuauuuguuguuuuguuuuucaagacaagguuucucuguacaguccugacuguccuggaacucacucuguagaccagcuggccucgaaacucagaaauccaccuaccugccucugccuccggagugcugggauuaaaggugucugccaccacuccugacuaauaauacaaauuuuuaugugaacuccaaguugguuuuuggguuuuuuuuugguguguagaggggcucucucucuccauagcucugacuguccuggagcucacuauauagaucagacuggacucaaauucguagcgugacacuaccaucuggcauagggagccuuaacauacacaaaaguacacaaguaauaggacagugagcacugcgugccccccccuucuuagaugauauuuuacaguccccaggauacauuuuuuuuuuuuuuuuuuuuuugguuuuuugagacaggguuucucuguguaguccuggauguccuggaacucacucuguagaccaggcuggccucgaacucagaaaucugccugccucugccucccaagugcugggauuaaaggcaugcgccaccaugcccggccguuaggauacauuuauuaucccgcuauaauaugcuuuuaucuaacauauaacauauuaugaaguauaaacagucuugucucagaacaagagcaccccccuaccccuugccccauucuccaccuggccucaccgaggacuccuaacaggagggcaggaggaagucugcacauagcccucagguucacaaguugcucccuuucuucaacacauaugcgguuuccacaugucuguccugugugugucuguguacauguguguguacaagcguguguguacgcguguguaguguauguguguguacacacgcacucgugcacgcaugugugugugugcauaugugugucuguaugaguacauguauguguguacacguguguguguguguguacgugcgcaugcaugugaaggugaagggacaccuuguaggacuggguucuuuucuuuacugugugagucccggggaucaaccucaggucaucaggcuugaccccaaacaucuguaccuacuuagcugccuugccagcccagcccuccccuuaaaauagauaaauuuagggguggcaagaugacucagugggugugaagucaugcugccaccguggaaggaaagaacagacacuccucaaguugaccuccaacccauacgugcuugcccacacccauacacacuuaaaauauuuuuuaaaauuucaaauaucaugguauuucuccacauuaaauuaacacaaacaguacaaaucccuucagggucgaagggagaaaaaauagcuguaacccuuggaggucuguuuucccgacgugcucugucccaucuuacucuguccugugaagacccuuagugagggucucagcccuuggagccuggagcauacagcaagucucacugccuguaaaucuccagcuugacccauacaauaggaaggucagcaccccgcccagcacugguauguuuuguuaggagagucacggguauuuucugggccucaggccuuuccacaagccauaaugggagcaagacgugaucugugcaagagucaagcacaguuuuggcagaguggcuuggaaaccuguugggcacagccaccuuuugggcuccacauggaaagaauggagcggcagcccuuagagagaaaggccagcauuugucaugacucuuaauccaucuuccugcugaucacagaccaguggccucagaaaguucugggccaaaaagggagaaaaaagacuuuuccuacaucuaugcauggcaucgguauuggugggaugcgggcucuucuuugccucccucagccuagcugugcagacuuccuuuuauugugugugaggagagaggagagacauucucacccugcgucccagucuaauugccacagagaccgcugguggcuuuacaaauccagagugucagccauggcuccacccuaauauuacugaggaaauuaccuccgcucaccaaggcgucuccaucuguaaaguugucuggccagauaaaauuuaagccuucugcugcuguagccaaugaagcucaccuggcuuuguaaaugcacgcgggcacauggacagagagcccagcugguaacauacuuacuggcaaagagcucugguuuucuugucauccugggacauuccaaaagacagcaaggaacucaagugcagaacugagaagauaagggcuucuugugacaggcguccucuuaggaagggagggaaggagaggaggaggaaggggaagaaaaagagucugacccuuguuuuggugauucacagaagcggucagugcucugugaaggucagauaaaggcuacagaugugcuaaguuggaccuucagugagaaugaaugagagcuggcaccggggagguggcuggguuuauagguagacugguuugauuccccggaaccuguguuuaaaagucagguguggggccaugugcuuguaaccccagugcugggaagacaaacagagcccugggguucaccugcccaccuagucugcuucgugaguuccagaccagugagagauccugccucaaaaagauugacacacaguauugucauuuggcccccgugagcacauacacacuccuauugccacaacugugugucaacagguacgccacaggggcaucucagagcucacaagauucuggccaccaugaugcugaguccccgucaaccucguccagcagaacuggagagucuucagugccagguaggcaguaaacugggcagggccccuggccagccugggggaaagaucaaaagccuucuccagccucaaaccagguagugacccugccuggcuaccauuccucagccagggcucugucuccccacuugguggggggaaucaaaaacccagucuucuuuuuuuuuuuuaagauuuauuuauuuauuuauuauauguaaguacacuguagcugucuucaaacacuccagaagagggcaucagaucucauuauggaugguugugagccaccauguaguugcugggauuugaacucaggacccucggaagagcagucagugcucuuaaccacugagccaucucuccagcccucaagaaccaauucuugacuugagggaauucuagagagaagguaauccacugacagaaggagccaagugucagucaggagugauucuggggcagauggucuucccgguacggaccucaguggcugaccaggaaugucacuuagccagcagaaaugauacagagacucuuuauuaucauuaaucgggucuguuuuuuuguuuuguuuugguuugguuugguuuuuuugguuuuucgagacaggguuccucuguauagcccuggcuguccuacgccaccccaccuggcuuuuuuuuggggggggggggucuguuuuuuuuuuuuuuuuuuuuaauugggucaguugaauucuuuuuucuaaagaacuuccagguuuuuacuuugacccugaaaagaaccgauacuuccguuugcucccgggucacaacaacugcaacccccucacaaaggagggcauccagcaaaaggagauggagagcaggaggcugcagcugcugcagcaagaggacaugcagaaaaaggugggcuacccuuggcuacccagugccugcuacucccaacagcacccaucugccgcugagagcagcugccagucaggugcccugggacacucacguaugacagacugugcuaucagaguuucccugacauggaaaugauggauuaaagaccaggcaagaggccccauuucccacuucccuuucugucugcugacauagacccuggcaucuggucucacucuguauacaccagccuauugccuaugagcaagcaagagggguggcacagacuggcaagcccccagacugccucguacuggguuucucuuacugccaaugaggggagacuuucagaggacaccaucaaauuucauugauuggauuucuguucauuaauaccugugucccgcauuauguccuguggaguuaaauauuucuguuacccaaacuacaacacaacaacuagacaaugauuuuuuguugucuuugcuuuuuggacaaggucucucauaacccaagcuggucuggaaagcacuguguccaaggauggcuuugaacugguguccaguauccaccucuccagugcuagaauuccagguuuaugcccacauggcugccuucacugaaucaaucaaucuuucuuucuuucuuucuuucuuucuuucuuucuuucuuucuuccuuucuuucuuuuuuaauuuauaaacuuagaaaauuaccagagugggauuuaaugcaucuuccauccuacgaaaaaaccagcuggguuuucucaacuucuccaguuauugccgguaagacaucuuauucugucuuuggauguuccuucuguaguucacacauccagucaggagagaccgugugcuauagaugaucagucuucguagcuggggguauuguggggcuucuggggguccugcuugagguuuaauaaagacacggagacaucuauauaaguuuaagagagucggccuuuugcugggaaugucucucagcuagccucuaucugaaccaggcuucuccaccuuugccugcaugugguccauacugccuacuccccagacccaucucucccuugugcaucugccuguaucuaccugcaggcucagcuggucuuuaagccccagcucuaagccaucagcccuucauuaugcaaaaagccacacuccuuacuugaccaauuguccuuccccagggcagcuugccucucuuuuuuuuugagcuucaaaaugcuugcaauugaagcccagcagcucaguguagaguuguacuugcuuuauaugccugauucaauccuguguguguguguguguauguguguguguguguauguaaucucuuuugugauguccacugguuaggucuaguuaguaagauaagaugaagggagaacacaaagcugggaaaugggcagugagaagagacccacgugcagagaggccguggagagguucuguuaaguuuaaggcuggcugagagacagccccuccuguucucuaaagaggaaauugaaguucagagcagagugacugacuccagguaaaaacagaaacaggaucugucuggccccagcccccgagcccauccccuuacccucugcuuccucuacaugcacaugagauagacuagugccuaccucaggaaaggccagccaugcagggguagcauacggccuccugcaucuccuucccaagagggcagaagucugucugcuugaccuggagaggaagcugucccguggaagaggaaagaggcggugaggugagcggcggaacaucuggccucuucuaauccacuguaugcccuucggcaagcugaucaucucucgggcccauuuucuucaucccaagagaaugucuguacagggugacuggggaaauugcuguagucuagcucugugauuugaggaagggcuacccagucugucaguuguccauagcauuguguaugagcccugcuguggaagugggugugggaaaggcagaaucccagccuuuuuuuuaugguugaaacaugaccuccuugcuuuuguggcccagacuggccuugaacuucggaacuucacacagaacugguucuacacgaauacaccugcgucagacuuggguguguggcugugggauccaggcauuccccaugcccucccguuucuguuucucucuccaguuuaucccaugagcugcgggugagcugcauggagaggaaaaagguagagauucagagcucagacccuucugcucuggcaagugaccgguuuaacuucaucauggugagugagaugugucugucggugcccagguauggcuggcugcuauugcuggccuggcuaauaagaagcugauuacuguggaaaaaaacaaacaaaccaggugccuuccuuuugguuuguugggguuuuguuguuguuuuuaagguguguguguguguguguguguguguauguguguguguguguaucguucacccuuuaaucccaucccgugaaauaaaccugggucuggccauguaccacggacaaaguaucuugucccuggcugugcacagugugggccugauccuugggccaucagcugaagcaugguggggguccugcauaccuccauuauauaauuuguaggaaguggaaagucuuugaaucuacugagaccuggacuggaagugaagaccaacugcuagggucuaggauccaguguacauuguuaaggagccagagugugcccugcacaugaaggacccuccaccuccacgggccuccugagugcaugccauccuuucuggaggccaaggggaagccuuggaggcugagacuaggccaugaaagcagugaucugcugucaagaugagaggcuaaagccacagagugacucuugaggcugguguugaggccuccuggcccaggagccccugacaacagaacauauccaugaaagaaguacuggggccaggccccagucucugcugcagcagcccuccugagggcccagugaauggacaguagcuacuuugcugcaguggguccccuugagcccguucccuggcagugugccugugguagagcaaccucccugugacccagcaucacaugugacuagcuggcuaguacagccagaggacuggggaggcagguugccacacucgauucccauuaucgguagguaccuccaagcacaucucuucaaaacugugaaguaggaggaauuucacaaguguguguguguguguguguguguguguguauacacuugugcauaggaacacaauuacauaguaaaaaagauaaguauagagauuuuuaguuuuaaacaacaguguuaaauuuuuguuuaaaggaaguguacuaggggcuuuuuaagacaaggagacucuguacuccaggcugaccucaaacucaguucuccugcgaaguuagcuuccugggcauugggauuacaggcccuauguuguauauuuaaauuagagcucuuccuggcuuuaugguggucacaugguagaguccucugugccaacacugagacccuuccagacuuguuucugagguggucacuaaggacaccagaguuucugucaggcccucuuuuugccaucuucaucagugccucagaaaugguagggcagacgcugugagaucacuuuguuggcguguacucacggagcgggaguaagucgggucccugccuuauucccugauggagaggagcuuaggcagcccacauggcuuggccugagaggucacuugcagccuguuucccuccaggcagacacuaccagugaccgccucuucacagugaaugacgucaaaaucggaggcuccaaguacggcaucaucaaccugcagggucucaaggcccccacguucgaggugcagaugcaugaaaaccuguacuuuaccaacaggaagguacggccuguccccacccuuguagccucuugccuuugggccuaggccacugcuguaguuggcugaauucagagagggaaaggacuuugugaagaauccaggagcaguugacucacuuuuccaagggacagaugguuugcugguuccugagagcccacaggaagagcaaggcccagagagucuuaacaccagaagagaaauguaguuuaggugcuuggggugagcucaaggcaggguacuucacuggcugucaggaauauucuuuucugaaggaucagaacugaucuggaggggugugguuccuggaauagggcugcagccaucacaggcuagauggaguucuuugcugugacucacaaaaugucaggugcuccauccgagaauagccuuuauugcugcaucuaagacagugacuucccguuggauaagacauaagccaugagcuagauacugguaaaaauggcuuggggaacccagugugguagcuguaaucucacucagcacacagaaggcugugccccuacaaguccgucuuuuuucugucccucccucccucccucccucccucccucccucccucccucccucccuucuuuccuuccucccuuccuuccuuucuuuaauuuuaaggggcguguaugugugugugcauacuuguucacaugugucuguguguguccaaaagagggaguucucauggugcuaggacccaaacucaaguccucuguaagagcagcaagugcugagccaucucucuagucccuuaccagccauuuucuaggcaagcaucuuacaguuguucuccacgagcagcagucagccaagucuuucucucccacacucccacaggugaacucugugugcugggccucacucaaucacuuggacucccacauacuguauccuucggcaggcgaauggguuuaguacgcagccaggugcuugcugguacgggccuaagcagcuguggagauggcagaggggugucucaccuuuugggaaaagucuacacuuggguccacaacagggagucuccauaagcagcugagguacagaggugacuguuuccggaaugacgaucaaguuccuguguuccagacaucugggacuugaugugugguugcuagagcuagcauuggcccuagaagucugacuccaggauccaccugcucuaccacugacaagaagguuuagguuugugggucaccagacagacccagcaucucuaucagggaggcugcuuuggcaagggaauaaaguagaaaggauagcacaucccuaagaagguuacccagcacgagguggagggaggaagcagcagauaggggaacagaacaccaugaagggaguucuuuugacaccgagcacaagacuaggucuuaggcccuguggcuguagaacaaucuggucucuguccacucagagcccgugggcuuuucucuaggaauacaggagcccacugugaggccaccugugcucuguugugugaaacuuguuucacacguuuucaugaguucagucucaucacuggugaguuccuaagcuuucaugcugucaucggacccgagacuuaguucaucgugugcacaggcaugugugggcauguuauaccgcagccuuaccagacucacuucaccuugaaaaaccccaguucuuuaguagaagaugggaaacagauugcaggagacuacgagcuuuuaacggugucugugacauuauguuccugaagagacggaaacugaaugcggaagguguaaaaaguguuacaucuggacaguguucucugcccuacuuggcguuuuauaacuucccaaaggauacugauggcguccuucucccagaggaccauccugucugucccugacuguccuuaacagauuuuuuuccaggcugugccucaugggccuugcagagacgccaggcugugccaccuugcuccccgcuucacuguuugucaguaaccaccaagguacggacggaguccuuuccuuagcuuugaggauguacauccucugucucccuggggcucacugagaugcggguaccagaggcuggcucggcccccauucaacccuuggggagggauugggcaacccugagggggagcugccccacgauugcugcauccuagaguuugcagcucuuuguaagcccuuugaggucaugucagccaacuagagcaaaaguacacauaacuagccagugcaagacauuaaaauguuggcuugagcugccucuagcgcucauucagaggcauugauuaagcucccacgugugguauguaugcuggcuggcugccagcaauucgcuccccucugcaugcugucuucagacuuuucagagggucggcaucugccgcaugcagucaacuccaagagugcagacuccaggcagagacggcccaaaguacagcuacugcauucccauguccaagcacauugcuugaccucuagaagauggcggcaaugcccuguagcgggaaauauuaaaaagaauggcaaguucccacccuacaccaagcuucucucugccccagaucuuugucucaccaccucugccccuuagcuggucccugauggcaguccuagcuccgguucaccugccucagagcugccuguuuccucucagccaucuacccacuguggucagcggucccagaccccaguaacccgguaaaaucaaaacucaagaagcuuauaauaaucagucaaauguauauaauaacaaauucucaauucacaagaugcccacccaauaauuucagagccaauugauaaugauagaagcuggccgggcgugguggcgcacgccuuuaaucccagcacucaggaggcagaggcagguggauuucugaguucgaggccagccuggucuacaaagugagguccaggacagccagggcuacacagagaaacccugucucggaaaaccaaaaaaaaaaaaaaaaagagagagaaagaaaaagaaaaaaaagauaaugauagaagcugcccaccuagauuagacaaguuaucccaaguauucuuuccuuuuauaauauucauaacuaccuguggcuauuuaaagccacgcggaauuuggaucaucuuccucucccuccaucuuccuuucuucuguguugcucccugccucugcaccucuuagcccugccuuccuuuucccuguacaaucacaggcuucuucuuguauuaauauuuaaauuaaucggaaaauucugcuacagugcccaccccagcagguuccuauggaaguaaaugaagccaggagcauuuagcccuguuggcaucucacugcccaacgacuuauggggcaugcaucuuaccacugaacagaaaaggagacugaagucuuggucugagaguucugagcaacagaauuccagcaggcugaggcaaccucuggggagggcagcccacuacugcugacaucuuucuguuguaaauccaccauugccaugugagagcuccaucugcaugaccucaucaaauccuagucacuucccaaaggcccugucucugaaauacgucaacauaugguuugggggugauuguugcaaauaugaacucuagaaaacaccuaacuccaagcuggggucugagcccuguuuccaguaccgucccagaucugugguugcuagccugguaucauggagagaugucccugggccuggaaggcagcccuguuuuccuucguuucucuuagcagguacagaccagccuggcaugcucuguaguuuccggaucccuggggccugguccugugccugguccuugaacguccaggcaaauaacugcuucaguacaggugagccauggccaucucccuggguguugaguacagaacuccacagaccugaagaccccauccagcagcuccucuuccccagacugccagcaucccuggucccagggauccguuucuugucuccaucagguuugucucggaggguccucuugaccaauguggugacaggacaccggcagucauacaggaucaacagugaugucuuggcccagcaguuugcagucaagguggguuggccugggaaggguuuacuagaaugcucuguacaguggaacauuugagugaaacucgguuucccugcuguaacucugggcuggugccucuuacaaggaaaacaaagcaugggaaggaucagggagcuaccuuguuuguuuguuuguuuguuuguuguuauugguugaugguuuugguuuguuuugguuuucuugaaaccacucacuauguagccauggccggccuggaacucauuauguaggccaggccauccuugaauugagagguccuucuuucugccucaucgucuggcauccugagauuaaaggugugggccgccaggccuagcaggauucacaggcuacacggagagggucugagcggugcaaacacuggcugauguggaacugccucccaaacuccuuagccaguuguuagcaggucuugaauauuggauucgucaggacagaucauuuucaaaccuucugaguugggacuguggaugcagcucgugaguagccugacauuccauccuuggagcacacaacaaaaccgugcagcucuaacacuaauucauagccuuaguuaguuucauauagaacuuguaaguuauagauuuaaaauuaaauugucuucauuacuguauuucaaggacuuagcuauagaaaaugcucucuuucuuuaaaagagugggaggagggagacaacugacuuguguugggcaggagcagagcuggccacuuagcccuucacccaucugugacagaaccacacacuuauuaacccagcuguuugcucucgccaccaguccaucaccccagaucccaccagagccauagcggauacagggagacaucacuuaggccuuagaaaagcagccuaaggggaccguggaucuaccuccaggcaccuacaggcucaccacaagugacacuggaggagacagagucuacaucuucuauccucuuacuagaacucagcuuccuaccuggugugguagcauauaccuuuaaucccaacacucaggagguagaggcaggcagaugcagaacucaggcucugaguucugaggccagccugauuacaaagcaaguucaggccagccagggcucuguuacauagaagaacccugucucaaaacaaaacaaaacaaaacaagcaaacaaacaaaucagccacccuucuaacuccacuaagaccaaaacuucuaccagccccaaugccaggacauauccuuucugccaggugguaaaaacugggcacgguugcucucuccacagacuccuuugcuguuuaauggcugucguucuggggagaucuuugccauugaccugcguucuccaagucaagccaagggcuggaaggcuacccaaauuuuccaugacucagccgugaccucugugcaggucuucaaggaggagcaacaccugauggcgucagacaugucuggaaagguagggaaugcucaccucgggccuuuaagauagcagggugcaggucacacagauguaccaagauaccaggguaggggcaauccugggaacuccuuugcugcuccauaagcuuagcuuugucuugauagaagugcggagggccucuguucuaugauucugauggacacaaggcucacaagucagaggcauccgucuuccuaguaugagaaggcuacugagaucaugucaccccuccggcugcauaccugguagucaaugugugcccgcuagaccccucccaaguaacugucuguguuucuaccuacagaucaagcugugggaccugagggccacuaaaugugugagacaguaugaaggucaugugaaugaguacgccuaccugccacugcauaugcacgaggaggaagggauccugguggcagguguguggggacugggagaccccauccuucaggugcuaccuguaaggccucucacaucuuaaccagcagagggagaaagugguaaauaaagggaccacggagauagcaacagucagcccucuaucauuagaucaguggcaggcagcacccucgagacagacagguagggacugaguuggacauugggccucuuugaagcacaggauuucaucaggcaccaucuugccuagaaagcucacuuaacaugagcagccauucugcucacguucccuuaagaggaugcugagaaauuaaggguacccaaugaacuuggauccuggccuucuaacauacugaugaucuaccaaaggagcagcagcuaucuagccacuacacccugaaggagcuagacugacugcagguuguacucucuccaggcuacaaccccaaauccgugcuuccaccuaaggaacagggaggaggcccugacucauuugcagugguccagaagccuugugagcuaaugucccuacagaaaguucucacccguuccauuaaaauucucgggggcuaagcagcauuagugggacuuuucuuaaauguacguaccaucuucaucagcaccagcacuggacuuuuuccuuuccugugcugggugguggacacaugaugagccuuucugagaagcaggcagugucugcccagcuguaacagcuagccacaucccccaaggacauccucugccauggcagcagagucccagagucacugaguggucauuugggaaucugacugcuaaagcccccacagaucuagcauccaucugggccaccguaacccauggagucccaugcuacaucguccuagguuggaguccugugaacuaacuugaacacuuuaaccaucuguucuguugggguguaacuaaguuggaaggucuugcuggguaguauuuuucauccaaagggacccagcugccuggcauuuggauaaggugggcuggacucccacuuaaggaccaccucuacccauaagccaccgcugugccacagccagccaggacauccuuagcauuuugaacacgugcagcuaacgaggcuucuggagcaacagaccaacgugugucuuaauuuuaagaaauguauuagcagaaacaccuucccccagagcagugguucuuccuaccacugcgaccuuugaauaagguugcucauguuucagugacccccaaccauacaauuguuuccauuguuauuuuguaacugauuuugcuacuacuaggaauuguaauucugauggucugaggggaccccagcgugacccaaagagggucacaacacacaggucaagaacuucuguaccaggggauuuguuuaggcuuagucacauuuagcccugagaggucaugagaagcaauguccacaugccauacauacuuuguuucauucucuaacucucuguguuauuuuuccucuuucuuagugggccaagacugcuacacacggaucuggagccuccacgaugcccgccugcucagaaccauacccuccccaugcccaaccuccaaggccaacauucccaguguggccuucucuccucggcuugggggcucccggggcgccccagggcugcucauggccguccagcaggaccuguacuguuucgccuacagcucgucuuguccagacagucaggaggagggcaggugggagcucccuucuguuuccaaugaggacauuuuauaaauggugcuugcuguaugcaaguggaguccuucagccucggagggcagaaugcaaagcgacugaccuggggccuggagagauggcucagugguuaagcacuggcugcucuuccagaggacccagguucaauucccaucgaccaauaggcaccucacaaccaucucagacuccaguuccagagaauccagcccccucuucuggccuccuugacggcaggcaugcgugggauauggauagaacacgcaggcaaaacacccguacacauaaaauaaaaaauacauuuucuucaauuuucuaauuuugccaaaguauauuauguggaguaaugucaauaaaggcucagaguaugaaaggccucaucauaaaag

SEQ ID NO: 6736 - RNA, 52919 nt, Mus musculus
ggaaaaagcauuuuaauuguaaaaccuucauguguuuuuaucacuugaaugagcagaucaacccaauauaaaaccuaacaggaaagaaugcacagaucuauuaaaacugagaauuauauacaagauuucagugacaaaaucuacuugaaaguauacagaacuauuaauuuuuccaucuuuucugcaacacaaaugacgaugccagcucugcugagauggugaguguaugacuugagaggggggugcuuuacaggaucagguauacucguaaaagauaacaucauuucuaguuuuugcagguaugagacuaguaagagaaaguaaauccgacugaauaaaacuguauguuaguauuagcuaacggaaaaaaacuugcaugggucaguggcugguggcacaugauacgaaucccagcacuuggaaguggaggcagguagcucucgauaaauccgaggccagccuggucuacagacggaguuccaggacaaccagggcucuguuacacacagaaaccuuaucaaaaaaccaaaucaaagcgaaccaaaaacaaacaaaugaacaacaaaacccuugcacagggucaaagcaaaaguuugaugugugccaggcaugguggcgcacaccuuugaucccagcacuugggaggcagaugcaggcugauuucugaguucaaggccagccuggucuacagagugaguuccaggacagccagggcuaaacagagaaacccugucucgaaaaaccaaaaaaaaaaaaaaaaaaaaaaaaguucgaugugucugaaagacagaaaaacaaacuguuuaaacaagguugugguguggugguugaaugaaucuggaaaaauaauuaauaaauuuauaauuaaggaucauuuuucuggaaugauugcuaaaucauaauuuaaaauauaaucaacucuacguagagagauauuuguauagcagccucaccuaaaauaagauagucacuuugaucuucugauaccaucuuuucagguuguuuucuaguauaugcacuacacaauuauaacauaaugucauuuauuuacaagacucaaagaaagcaucuccaagaucaaauauauacauuuuuaauaacugaaauauuuacauaaugaaaccaugucaagguugaacauuaaaaacaguguuuuggacguccucucaaauguuuaaaaaaaaaaaaaagacaaaacaaaaaccaaaaacccuaguaacucaagcucacaguuucauuauucuaacaacucagucuuuaucuuuuuaguaagcaaacauggcagcagccacaccuaauuucuugacagagcuguuuagaacuugguacuuuucaaauaaauuuugccccuagugaucuucugaauuacuaauaaaguccaaggauuucuugucaucaauauaguuaaagcuugaugaccaguaauaaaauuuugugagcagaaaauugucuugaaugugucuuggaugauguaucuuuggaagaaagauguaaacauuuuuaacuaccauggugaauuaacuacuauuguguuuugucaaaucucuuuuguaaacuuaccuuauucacuucuuuauugguacggggaauagaacccaggcccucguucaugcuaagcaagcauagcucucucacugaggucauccccgucauaagaaagugagcuccuccccccaccuuacacuucuggaauuguuuuauuaaaaugaauaugccaaaauuaaaugaagacaaguugaaaauauauugagcaaaaugcuccagaauucuagacucugcuucaauucugagccaucagguggagggagggauaagauuaugauguaucauccuauacacagaagaacacaaaacuggucagcaguguguugcucacagcagaauaccagucucuggaaaauacaccguaauuauccuagguauuuggguuggcacaauuaucacuuuuccuuuaugugugcauugaugauuacgaaauguuuaagggagcccaccaaaaaaauuaaaaaaaagacuuuuauacauacauucacauaaacacauuaauacagagauacauuaggaaggaccugucugcuagguuuugcacucuaauuuuaaacuccaugccuuuacaagggcuugccauuucugaucaggaaagugggaacgaggcuguaaggguaugacuaguauucaacuuauucauguuggcgccuauacaauacaguuuuaauaguaaguagaauucugcaaaagaauuggggagccauuuuaauauuuacaaggaacaaaucagcagaacaagaugcuaucagauaggcuguguacaguagcugcagcuuauaaaacacaccaguagucugugccuggugagcauaaagaggaccaaggacacagauggcuuuacacccgagugaguacacagagcaucaacaaauuagaggacaaaagaauucacauuuucuacauuaaaaaauuacagaucucacaaaugucuuugaagacaccgaaaauucaaaguccuuugaagggugugaaagaagaaaucugaaauguaacucugaauguaaaaaguuuuacuucacaaggccaauuuucuuggcuucuguuucauauaucaauaaucuccacauuuugacuauaaaaacuucugcuucuucaucuaguaccuagaaaauaaaagacaggaacacauguaaagauacuuauugguauauuaaaacaacaguaacauaccaaaacauccaccaaauacaaucaacauaaugacuuaaaagaacaacuguccaguaugaaaauauuuuaaacacaacauuuacgguacaaagaaagauaaugauucagccaaacucaaugacuuacuaaauacuaauaauuucaauauacuucuguuuuuuuacugaugugauuuugagacacacggcccaggcaugacguacacuuaaaugaaagugagaugaccaaaaguuccugcucccaccuuauaggcaagacugugccacaaauccugacuccacauuauuugaauacaacuuuuuauuuugauguuaguuuuauagacauuauguuuauacauauuuagccaaaccacuuuauagguaaagcaaaagcuuacuauacugaauuuagaggacacagaaagugguggcucaggcuggugagauggcucagcaguuaagagcacugacuacacuuccaaagguccugaguucaaaucacagcaaccacagggcucacagccauccguaacaagaucugacgccuucuucuggggugucugaagacagcuacaguguacuaacauauaauaaaucagaagaagaagaagaaagaagaaagaagaaggaagaagaaagaagaagaaagaaggaagaaggaagaaggaagaagaaagaagaaagaagaaagaagaaagaagaaagagaaaaaaaagauguuuacaagaaagugguggcucaugccuguauacccagacgcaguacuugggaggcagagccaggcagaucuuuuugaggucagccuggucuaugguauguuucaggacagccagagaaacucucaaaaaacuaaaacaaacaaaccagaagauauuuaugaagaaauuaaauauacaacuaccuuuuuaaaagauuuauguuaugcauauaaguacacuguagcuguccucagacacaucagaagagagcaucagauuccauuacagaugguugugagccaccaugugauugaaugcuggaaauuuaacucaggaccuuuggaagagcagucagagcucuuaacgucucagccaucucuccagcccaaaaacuaugugcuuuagacacuuuauuuaguccaaaccagacuuagcuaucaucuuaccuuacagucaacaaaugcugaucaugugauagugaauuaagcauuacaugagaauugacuacaguguuuagaggcaguaaacaguacugagugaacaccacugucacaaguacaaagacacugaacaaauuuaucuuucucuccugucgaaugaauaaacuagauuauuuuccuaucaugauugagcauuaaguacucuuaaucacugaucuaucagcuuuuggaaugcugauguauguguaccuacuguguauuugugugugugugcauguguguguucauggaggacagaagucaacaugaguugucauccaacgugcugucuaccuugcuuuuccagacaaggucucuuucuaggacagagauggagauggggacacguaccgauuagaaaaggguaggcagcaagcucgccuuucuccaucucccuaaugcugggacuggaagagcauaccaccacacucaucauuuucaguagguuuggggcauagaacucaugcuuaagcaguaagcacuuagagaacgcuauuauaugaacaaggacuuuaacuuuuauagguuuccucuggggcucccgggucuauacaaaggguacauacaccucugcucaaggacacgucuacuauguugguuacaaagcgucauauuugaccaaagaaguuaaugacacauacgccuauaaaagcuuuuuauaaaaagcaauuuuuaaaaauuacauguuuauuuguuugggguaagaacacauaugcuggggcuagagagaugccucagcaguuaagagcacugacugcucuuccagagguccugaguucaauuccuagcaaccacaugguggcucacaacccucuauaaugggaucuaaugcccucuucuaaugugucugaagacaguuuaccauguacucaucuacauaaaaugaguaauuaaaagaaaaaagaaaacauauaugucacaguauugacaccuagccccaguauuuuucuccacuccuugucucaaugaucuucagaauuuccaaggcuaugauauauacuggcuaucauuugggcuaacaaacuaauuuuguguuaugguuuuuuuuuuucccccugagacagggucucgcuaaguagaacucugccucugauuccuaaauucugggacaaaggugugcaauuccaugcucauuucuacuguuuuucuguuaauaaccuuuuuccaguugcuuaacucgaacuaaucccaaacaacuucauuggcuuaccaguccuuaauucacuccaaugacuaauucuacucaaauuucuuuucuucauaauuauccuuguguuucauguaacaauuuucuuauuuaaaaugcaaacuccuucucucccucugcuuaugaaaucacaauguuaaauaaaaguaaucacauagggcuggcgagauggcucagugguuaagagcgccgacugcucuuccgaagguccauaguucaaaucccagcaaccacaugguggcucacaaugauccaaagugaaaucugaugcccucuucuggaguaucuaaggacagcuacaguguacuuacauauaaugaauaaauuuuuaaaaaaaguaaucacacagacaauaauauaaaaaucaaaugcaauuaggaauuugauuuuuuagcacgguugccccccaaauacuuuugcaaugugaaugucucagaggaaucccuaucauguauuuccuucaaugacuaacaaccaguagaugucacacuccuccgcagugacagcacacuccuuaauagcaagcacaguacgguuucaguaucuguguauccacuucccaguuuuguauaggcccacugcauuuaucaguacuuaguguuaccaagcauauaauagaaauauaugcuuuaaucuuuauaaauaaaggggggagggagaucaaaaugguuaagagaaagaaaucaagauaaacuuuuaaauguuucacgucuccagaaacaauuggggcauaugcuugcaaucccaggaggcucagaucuguuuugagcucuaagcuagccuggacuaagacugagaccuaucuuaaaacaucuuaucaauugauacuugguaauuauaaaucuuuuuuucuuuaaagauuuauuuauuuauguaaguacacuguagcugucuucagacaccccagaagagggcaucagaucucauuacagaugguugugagccaccaugugguugcuaggauuugaacucaggaccucuggaagagcagucagugcucuuaaccacugagccaucucuccagcccccgguaauuauaaaucuuacugcugauaucuuugccaucauauucaaauuuuaauucagaucaauaauaccaggaaaugcauuaaauuuauaaaguaauuguucacauaaauauuaaaguaauaauguucuucuaacuuaccauggcaacaucaucuaaaaugcucuguggugaacuaugugccauaaccuaaaaagaaacagauaagcuguuauaaagaaauaaaacacagauacaaaaccucuaaaugguagggauauauuucuugaaccuaggggagucugcucuacuuucagacaagacuuuacuguguagcuguggcaggcuuggaacuugagaaauuugucugccucacuaauguaaggcaaguagcaccaagccugguucuauuagcuuuuuauccccagaccuugaucacuaaaggcaaaucaaucauuacuuccauguugaauuuuaaauuuucuuuuaaaauugauuuuucuggggcuggagagauagcucagcacuaacugcucuuccaaagguccugaguucaauuccuaacaaccacaugguggcucacaaccaucuguaauaagauccaacacgcccuucugguacaucugaggagaccaacaguguacccaucauacaugaaauaaaugaauaaaucuauuuuuuuuaaauugauuacucuguguggguuuuacugcauagcucuggcuguucuguaacucauucuauucuguagaccagacuggucuugauccacuggccuuugccugagugcugggauagaggugugugagacaccaugccugguuauaaaagcugcuucucacccaaccuccucaugcuauguaaccuagggugaccucaaacaucugauccuuugccucagacucccaagugcuaagauuacugaaucuguggaacuuggguucgacccuguagcacuggcuguccugaaacucuuucuauagaccacaguagccgugaacucauugagaucuuccugucucagccuccccaggacuaaauguuaaagggcuacaaauaaagcccagcauggcuaccuaugucuuaaugcgauaaucauuauaaaugaagaagucaguaaguauuucuucuccaaaaugaaagaauggcaauagggauauggugaucuaacuauaguaaccauuuuuuuauauuaauaaaaagaaaaucuguuuugaaaacacacuacaguauacacauuuuguuaaaugaugguuugauguacuggugcaugucauuaaauguuucagcacuaaggaaauggaugcaaguucaaggucagcuugggccauaggaaacugucuccaaaaaacaaaaacaaaacaaacagccuguaggauuuaaaauguccuuacacacuguacaauaauggccaagacacaaccuuuucauaagguuuaauuuuucauguauaaauggaguaaggauaauauuaguaacuuguauacccuaagacugcuacaagguuaaaauuagaaaaacugccauaaaacacaaacauugugucugccaagaacucuaaucaguacaugcuaaacacuuuuaauaacaggacuaccagagauaggugacuaccaaugaaacugacuaauuuccaucucugcaaaauucaaaucuuagacaggaaguggcauuugcaauagaaaaggagaaaacauaagugaugacaccguuucuguccucccuaugaaucaaagcuauuuuaugauaggucuaagauugagaaaggaagcugacuucaaauaucaggucacuuaauuaaaauugaauuauuaaguacuuggacuuuuuacuuuagaagugucugaauaaauuuuguguagaugcaggcagaaaaagaccaaccuuagagcaaacaaaaucaacuaauguagcuucuucuucaccuauguauucgaugauuuucuuauugauccauggccggauucuucguuccaucaguaucugcaaaacaaagccuaguugaagaacuaauaaauuaaacuuuucuauuauacucacacaaaauucauucaagagucaagugugggggcacagacuuucaauccagcacucaagaaagacagagaccagcagaucucugugagcuccaguccaguuacauuucgagaaacagaauuaccaagacacagaauucuaugccuaugauauacccagaaaacuauacucuaccaaacagccauuugaauuuccaugguuuugcuacucuauuuacuacauaaagaaagaugaaccaaccaagauauccaucaacagaugaauggauaauaaaaauaagauacauauuuaaaaacuguauaaagaaaaauaaaaucaugaaacuugcaggaaaaugaaugaacaaagcaauaaaacauuaagcauggucacacaaauucagaaaaaaaaaaaaucacauuuucuuuuccauaugucacuuagcuuauuguguguguaaagacuauuaaguuguacggugcagggaacauuuaagaagaaagauuuuaaaaggcaguauuagauaaugaaggacagaaugcaggaaaaaagaauauguacauugugaaagauaucuaaagccaauaauuuuucaaaucucaacugcauaguguuuuuuauuauucugugucugaugaauaagcacaucuuauuugcuauugcuaaaaaucaaacaaggcuguaugucacacugaaaacccagacauuugacaggcaguaugcuacucacagaauccacaauagaccaauccaaaggauaagcaaagagcucagguuuggcugugggaauuuucucaaugagacucuuaauguguuugcgcuuuucuucaguguuuacagugccuuugguggcauuuuuaucaucuucgccauaauccaggggaacgaguuuccuuuuucggggcacaucaucacuguccucauccucgaauuuguuaaagacacuaucuacagguaguuucuuucucuucacugaauuagguuggccaggacuauuggaagcaccuauaguuaaaaacacuaucuuaguaugaaaacaucauuuucaaaugcuaaaucugacaacccaccaucccucaaaaggugcaaacauauuuccacaauucucugagaaagaucccaacuguuaaaaaaaaaaaaguaguaacucucuacucacaagugcuagaaaauuuaacuuuucacuucuucucagaacuggaggcagcuggagauauaggagcacuaguagaacuaugaaaacaaucgugagcuacaaaggcauuguugaauacuuugcuaucuaucuaccauggaacuauguguguauaaguauucuuuuguccuuacaauggaacuuauugggacaugggaggaaaagaaaagaaagggcaaugcugacauacccaauuuaaggcuuaguccuauuuuuggccuaugcuccucaggcugcuguugaucuggugaguuuucaugaggaauaauaauaccacaaggagacucauccccaggaguguuggggguugcguugccacuggcagaggacacagauggggcagagcugaugggucucaaagucggcuugagacaaggcuuuugcucugguucuuccuccucuuccacaggcuccucucguuuuucuucuuuuucuugcuuuucuucuucuucuuccucggauucugguucuugcuuuauuugagguugccugcgccucucagccucuuguuccaucugcaaccaaaaaacacuacuugguuaaauuuagaaaagacuacuacuauaauucuucccuuugcuuuauauauuuuggguuuuuuguuuguuuuguuuuguuuguuucuuuuugagacaggguuucucuguguagcccucgguguccuggaacucacucugaagaccaggcuggcucugaacucagggauucaccuacucucugccuccugaaugcugggauuaaaggcaugccacaucacugcugggcuggcuacuuauguacuuauguugucuaaauugaccagugggaucaauccuaccuccucaacucuaaauaaaauuaagaacuaagcacuaggaauaagggaggugguucagagguuauaagcauugguuguuccgccaaaggacuugaauccacacagcuacagcugacuguaacucagaucccaagggauucaacacccagucagcaauaacaaaaaggaacaugaaaagacacggcuuauuuuuguugaggcauguaucauauaaaaacaugaaaauuucauagaagacagaaguacugaaaugacaguuauuaagugcaaaaauaagagcacuguacaaucuauucuguuauacaugacaagcuacaugacaagcuauuggguggauggacagcucagugauaaagagcaucugcaacucuugaagagaacccagguucaguucccagaccaucugucuccccaguuucagaagaucugaccuuugagggccaagcacaacugugguacauauauuuacauguaagcaaacucauaaccauaaaaaaauaauaaaaagauauaacaauuuuuuaaaaaugacguuagaaaaugaaaacaucuuuuaauaaggaaauauuucaaacgacaguuacuacaaaucagauaucauuguaaauacagcuuucuguuuaaauuauauuaaaugauggucaccaauaaugacagacuuauuugaugaugggagguauggauucaaggugcggggaaauaccucaguugguuaaaugacagcuaugcaaaccugaggacauacauuugauuuccaaugccuacuaaacucaacacagcaaauguucaaguaugacaacuggagcaauguggugacaggcaaaucccuagccagauucugucucaaguaaaccacagugaacugcuucuauggacuacaccaagaccugagacuuacuuccggcuugcacauaugcaccaccacuaaaguguucccuaaacaaacauauacaaaguucugaguucauuuaagacugaugauuucuguacuaaaauuaacaaauacuaauaaucuuccaaauaacagcauuaucaagucuaaaagcgcauaugguguaauuccuuuaucuacaaacuaaaauauaucauaggugacugauagaugauaaaguaaauuaaaacuaaacaauuucagauguuauaauaacucacccucuggagcucugcaucuggaucuggaugcccuucugccaguaagcgcugccugauuuccucaagcucuuccuucucucucuuccugucucguucaucagcuuccauuucuuuuucccuaucacgcaaccguuucugaagagcacuaccccuggaaaguuaauagcauuuaaugaucagaucauugcuuaguacacaaaauguccacaauacagaauuuccucaacacuagaaaucaaguaagugaaugcuaagacucagguaaacauccaggacugggugcuguugacauuaauguguuacaaguaagcacaaagguguuauuuuauucugaaaaaucacacuaugugucuaaaagcccaaagauaacuuucaaggggaagacaguugcuuugugccuauuccaaacugaagacucaacacuuaauuuguauuuuuucagauaugaaguaugaagacuauacacaaauugcuaauuggcuuuaggggauaaaggcauaacucagacaauacagaauggaugcuuaacauuguuugaggcugacuguccuaccaaaacaacuggcugugaugugcaugacuuuaaucccugcagucaaaagacaacagcaagccugaaccauacauacauacauacauacauccaguacaauaaagauaaagugacucaauuccuaaguuuacaucaauauggggaugguaggugcagaucagauggaacacucaugaaaacacugaagacaaauuccugagcaaucuaaauaguuaaaaggugugacuuccuauaaaaugacacucauggacuccccucuaaauuagacacuugaaauuacugauucuaacagcuaaacacaccagauauucucacggucacaaacagcccauccgcucaugcuuacuuaccuguaguacuucgggucaucucuaucaucaucauaaucuucuaggaauucuuuuagucguuuagccuccuuagccuuugcagaaaugaaggacaacauauauaaaccucaggcaagagucagauuacuuccuuucccuuucuuaagaaaauacuuuucuccauauucauagaacauacaauacuucucauuacuuaauauaugaaacgggcaucauauaaaacuuuuaaacagccgggugugguggcgcacgccuuuaaucccagcacuggagaggcagaggcaggcggauuucugaguucgaggccagccuggacuacgaagugaguuccaggacagccagggcuauagagaaaaacccuaucuugaaaaaacaaaacaaaaaaccccacaaaacuuuuaaacaagucagcuuuaggacaugacugagacaugaaaaacacauacaguaugcugaacaaaaacuccugaaaauaauucccaaaauacauucuuuuccaauaaaaaugacauacauuaggaaacagaacaauguuaccuuauuaaauaguagacaaaagcgauuaauuuucauuugagauuguguuaaauuuaaguaacauacaggauuuuagauuuaaaucauguuuauauauuguaaagguaaagcugccauuugugaaaaacaucuucuuuauccagaacucuaucuacuuuacauuaauaguaaaccuggaagauauacagaaucuuauuuuuggaauuguagaucaaccugguauauuuaaaaacuuugucuaauuuuuuauggccuauaucuaaacacuuuaaauccuaucuauauguaaagcagauaauaguuucugacuuacaaccuuuuaacaccuuucagcucccucaauauaaagacuuguaacagacauccaaaggaaccaucuauauauuccucaguaauugcucacaaaagcacaacaaauauucuuaugcaauacuuccaaaacauugugaauguaacuuuaacauaucauauauucaccuauuucuuuacacuaacugccuuauuagcaaaauuaugaucaaucacuuuucuauggcccauccuaaggcacuaagcccggauaugauaaggacucaaaugaaagguuuguugaguauucuaaguaucaauguuaguaucaaaguauagguauccaggucaggcuauguacacacuaaccccaaugcauuuauuacucugggaaacuuuaacuuguaaugaacauaucaguuaaacaugagaaaaugcuuauguaacuggaauuuccaaaagaucacaauuauuuuuguaacuacuucuuacuaguacuucggaagcaaagauauguauaucucagauuucaaggcuagccuggucuacagaaugaguucuaagaaagccagagcaccacagagaaacccugccuccauauauagaaaggcuucagauuagcucacaggaagcacaacauugucuaacuuuaaaauuaauuuucuaguauucucuuccaauuuucucaugaaggaaaaaauuaaacuacaaaauagaugcuuucauccuacauuaauuuauucaaauaaaaccauuuuaaacaauucuauugagaaggagcuaugauucagagaacacauacuuucuuguuguuauauguacuagauaauguacccucuacuuauuucuaaacauuccuaauguuucacuugguucucaucuugaaaaaguguucugaauggauaaucuacaaacuaaagauaaaauaaaauuuacauucucacgaaggcacaacacacuuuauuuguuuucuugagacagggucucauuaugucaggcuggccuggaacucagagcuguaccugcuuuuucugcugggacugcugagauuaaaggcaugagucacacacagcacucuacagaagacaaggaacauacuauuuuuuuuguuuguuuguuuugcgagacaggguugcucuguauaacucuggcuguccuggaacucacuuuguagaccaggcuggccucgaacucagaaauucaccugccuaugccucugagugcugggauuaaagaggugugugccaccacgcccagcuuggaacauacuauugaagcaauuuuuaucacuaggcuuaaaaacugugccaacggguucaugcuuacaguuauccguauauaaaugaaacacaaaucuaauuuugugacuauaugaagagaauacgguaggauaaaaaaaaaaaaaaaacugcaugauaagugcuaaauauacuacugcuuacaacaacacugccaagaacuggggaaaagaaaaugucuuccagaggacccagguucacuuccuagcuccuauauggcaguucacaacugucucuaauuccaguuccagaggaucugccucccucacacacauauaaaugcagucaaagcugggcgugguggcgcacgccuuuaaucccagcacucaggagguagaggcacacggauuucugaguucaaggccagccuggucuacaaagugaguuccaggacagccagggcuacacagagaaacccugacuggaaaaacaaaacaaacaaacaaacaaaaaccaacaacaaaaaaacaaaaacaaaauaaaugcagucaauacaccaagcauauaaaguaaaaauguauaaaucuuaaaaccaaaaacaaaccaaggcguuaugguggguggaugccuugaaucucacuggaucauagagacaagaagauccuuaugggcucaagcuaugccuagucuaccgaguuccaggagcuacacacaaaaaaaaaacccugucucaaaaacccaaagacugaaaaauaaaaauacaauugcuccccacaaaagaacgacuuucaacaaaccacacaacuacacugccuuauucaacaaauuuccauagcuauuuuaaagaacaacuuuauggcauuuuauuuacuuguguuacaaauaucacaaguuaagauacaaguugagggugucaauuuucucucucagauugguuggcucaacucauaacauaguuguagcugcaggaaacucacccggcucaaaaaguuuucagaaucuuaaccaaaugaugucauguucauucuaaguuaacuuacuaggguagauuugugccacacguacauucauuagugggcagcaaguauuugaaaaguaggaagagauauaaacugagucuuaucuccaaauuauauggaauaagcaacccaggccauuacuaggaguucaagacuagccugauauacacugauaugugauuccaaaacagucugagcuaaguagagagaccaccucaaaacacacacacacacacacacacacacacacacacgcacgcacgcacgcacucacucaaccaaaaacaauuaccugagaaacugacaaauuucauuuguaaggauuucuguuugacaguaagucugaauguuucugaauuaacaauacacuuuuuuaaaccuaaaaucucaccauuucucuucuucuuucuucuucucuuucugccuccuucucauauucccuaguuuucuuucguucucugauuucccaauucuuaaggcgcuaaaaaaaaguuucagaaauuuaaacuuuaacaaaggauucuguaaaacaugccucaccauccuaaggaaauaacuaugcuuuucagaaagagcauuuccucaguuuaccucuugauaagcagccucuuucucucgcaguuuucguucgaguuuucuucguucauaugcaucuucuucauccucuucucugucucuuuucuugucuuucucucuuucccguucccguucucucucccguucucucucucgcucucguucucguucccguucucguucucucucucuuucccgcucccguucccuuucacgaucucugcuuuuuucucuauggaaauagaacauuaaauauaucauauauuuuauagcauucuauccuuuuucuuuaggaaccacggggaacuauaacauguaugauaaaucaauaagcaaaaagucaaaauuuaguguuaauuucucuauacucaaggggacauagacuagguagucaaaaguaaaauucaaauaaggcauuuuuucuaaaaugaacagggcccugcauuuuaaucccaauguaggaauuaaacaaaaagccacagacuuuaauucuaacuaaaaguucuaaauugcauucugaagucaaugcuagcaauuauacacauuacaaaaaauaaaacauaaaacccaauguaagauuacauaaaagacugaaaaauuacuaacugugccuaaucauagacugaaauacacaauuuuuugaaaaaaaaauauugccaggcauggugguaaacaauucuaaucccaaauguuugggaaggaauggcaagcugaccucugugucuuugagaucauccuggucuucuacagucucuagagagguccugccuuaaaaaaaaaaaggaugagagcauacugcucuuuaccaaaugaaacauaaaagacuaauagaacauguuaaaaagacauucuaagagcagggcagcacucgggaggcagaggcacacggauuucugaguucaagaccagccuggucuacagaguuccaggacagccagggaaaaacagagaaacccugucucgaaaaacaaaaagacuugagaaaauagcuuaucaacacugacugcucuuccagaggacccagguucaaguccccgcaccuacauggcagcccacagcugucuauuaacuccaauuccauaggauauagaacccuuacccuuauauaugcaggaagaaaaaagaaaucaaugcacauaaaaauaaauaaaucuuuagagagagaaaggacaaucuagaaccaggcaugagaggagugguacaugucugucauuucaguauuugagagggaaaauuucaaggcgaucuaucuauacacacaggcacacgcacacaaagagacagacagacacugacaaagagagaacaaccagcaacagcaaccaacauaagauugccacagaaauuucuguuguuguuugaaaaagguuacuuuaccuuuuucaaaaaaaaaaaggauuuuuuuagcuuuauauaugaaggaaagauuguagaaaaagagauauuuggcaugcuaugugcgucaacagcacucaaaauuucugauaccagcaauuuguucuugacuuguuaugaucuuagaaacuuugcacuucuaggaaacacacacuagauaauccuuauaaauaagaaauuuaaaaacaaauuagagguagcucaacaccuauagcaagagcuacuccugaggcugagggaguucaaggcccaccuagacuacguaaaacccagacaccccucuuccccaaacacacauaaacaagcuuaauauuuaauuuagaguaaaacaacacuacaaguacuagagauuguucuguaguuaaggauacuuacuacuugcagaggaccagaguuugguaacugauacaucagaccaccuaccacugccuauaauuucagauccagggaauccaccccuucuagucuuuaaggguacucuauuugcaugcauauagacaaacaaauacacaauuaaaaauaaauauuuaaggaaaaaaugcacggggcuggagagaugguuuggugguuaagagcaccaacuucucuucuagaggucccgaguucaauuccuagcaaccacaugguggcucacaacugucuguauuggugucugauaccaucuucuggugugucugaagagagcaauggugguguacuuaaaugcauuaaauaaauaaaugaaugaaugaaugaaugaaugaaugaaaaaagaaagcccacaaguacacacaaugauaaauaaaucaauguagguauauggagacaacaugcuaggauauacauuuguauuuguacauguguuuuugagacaggguaucauuuaugcagucucaacuugcuaucuagacaccaggguucaaacucagagguguuucggcccccaaggugcugggacuaaagguguauaccaucaggcauggcuuugaaggauaauuuuuaaaaaggaauuguuugauuucauagaaugccaaauucucaccaaggaauguaucagaaagugagaaagaggggagauaauauauaguaaguauguaauuccaucaacauggugcagguuuaaugauggaugcuuuuuugucaacaugacacaaaucuagacauaucuaggaauauugagaaaaugccuccaucagauugccaaaucuguauauagggauagucaugacuaaagacuaaugugagagccgggcggugguggcgcacgccuuuaaucccagcacgcaggaggcagaggcaggcagauuucugaguucgaggccagccuggucuacagagugaguuccaggacagccagagauacacagagaaacccugucucgaaaaaaacaaaaccaacaaaaccaacaaacaaaauagauuauaugagaggacccaucucacugugggauggagagcaccaucccuauauaagacauuuagccaauuucugccuuagcagacuacuacugcuuuggcuuccuuguauacaaaacuguuauacaaaacacuacacugaacuaaauguauucaucccccagauaguuguguuuuaucucaucaagcuacauugcaagaaguccuguauuuugacaguuuuuauugaauuuuccaucuuuucaaucacuguuucuuauuuuugcuuauuauuacaaauaaauuaccacaaaauuuacaauaauaccuucuauaaagguaaaauuacuacaagucaagucaaacagaugggcucagggacacagacaaacauauccuuugaaaaauacugguagaaagucucaaugcaaauagaaaaauagccuaccaauuuaaggaaauaaugaaaacugccugccuuaaaacugaaggagcaacugguucuaggcacacaaaaacuagccucugauagaaaguaacuacagaaaaggaaucacauuguuuuucucaccaccugaaucaccccaucuccuucuacccucaggacuaaaaauuaaagacagacaucuuuuuuguguguuuuguuuuucaagacaauguuuccacuaggcugucuugcaacucaagauuccccugcuagaucuuguguauugggauuaaaggugugugccaccauacccagcacguuauuuuauguacaugacugauuugccugcauguuuguacgugcuccauguauuagaucucuuggaacuacaguagugagucauuauauugguccuggauaucgauccuacaagauuucaugcaagugcucuuaacugcuaaugucucuccaguccuaguauugcuuuacagaugagcucauuguauaucuggguauccuggaacuuacucacuaaccacugguugugaaauuaucccuuugcucagcuccauuugugguggcggugguggcaaaagccuuuauucccagcacuuagaggcagagaaaggcauuaucucugugugaaggaagccagccuggucuacagaggucugggacaaccaaggcuacauaggaagaucuugucucaaaaaacaaaaacaaauauaaaaauuguuacuuucaucaauaaugucauuuuauguacaauguaaacuacagaaaacuaucauuccaaugcaaauaguuccagaggaaaccuuuuaauuuaauuacacuaucagaaacaacuguuuguauggaguuuuaccuugaucgacuccgauccuuauuucgaucugagcuccguucucgaucucggucccgaucucucucucgaucucggucucucucuuuugugcggucacgaucccuaucccguucucguucccgcucccguucuuuuuccuuuucucguucacguucucuuucccuuucucguucccguucucgccuuucucguucccuuucacguucccucucucuuucucuccguucuuucucaauuuccugucuuucuuuuucuuuuuugccuuucucuucuuccaguuucuagaaaccaacaaaaguacuuuuagaguuaauucuguaccuccaguauacagacuuuccccggcgcaaugcccaauaaugcuuagaaaagcaucaaaccaccaggauuuguggcuuucuuuuuuuuuuuuaaacaaauuaaagagaaacaaucgcaaagcuagacuucgugcaaaaccaaauacucuacacaaaccaggaaucuucaaccuuagguggggaaaucuguuacgaguggcaagcuacugacuaauauccaaaaauaaccaugaacaauguacugauuccuaagaauuucuagaaagacauucaauuaaacuaaagcuuaauucugcccauuauaaguguguguaagucagugggaacagugacaguauuuaugauccuagacuucucacuauugaagguaacuagacgagggcuuuaaaguagagguggaagacaagucaagauaacaacacucuucugcccuccagguugcccacccuccaaaagaaacagaagcugaauuuagccaaguuuuaaacuauggaaauacuuauuccuaccauuauaagauggauacuccaccaaauacagaaacuuugaaaaccacucacuucaaacaacacauacauaauuaguuauuuuaauuuacaauaguuaaaguaaaagcagaaguuaugcccaccauuaagccuguaaaacaauaaaagauauaauuacagugauaaauccacccuugcaaggaucuuguauuaacuuacagauguugugcuaggacauggaucgccaacacuggauuaaccuugccuacaagcuauguuucugggaggaagagcaaguacacgguucacaaguaaacaguuaggccaguguguauccugaaagauuaccaguguaccacaagguuucuauacaaacuaacauggggaaaaagaaagcacaacaaaaacccaaacaaguaaaacaaaaacaaaacacauucaucccugugaaguucuguguuuaauuucacugaaauuuaaacugcaacaauaaaaugugcauuuuucuuuuucucaguaacguaaagcauuuaaaacuuuaaaaagcagucuuaccuguuagauacuuuuuuucuugcucauggaccaaagaacugagagaggauuaugaaagaaaagcuaguguguaaggcaucaauauauucagcugcugaccuaagguagcauacaggcaaagccaauacugaauacauugaaauuagaaaggaaagauaggagacauggagagccagaaacugaaagcuauuacaggggggaaaaucuaauuucugagacauugcuaauggaauucaaaguuuauauuuuaaaaugaaucuacacuacauaaaacuuaccucaaugucauacacuuaagaaauguauuacggagauaauauauacuuacagauuuuuaauuucuuuuguacaaguccucaacuuuuuacuccuguuguuuacuaugcugccuuuucucugauguaaugcaauugcuuucagaacucauuuuaaguuuacuuuacacaaaagcugagaaaaucuaguccauacuaaaugcuaaggaguuauauauauaugcaauaugugugugcauauaagcagauguagcauauaugcauauauuuuaagaaagauuaaagaaaugaaaugauuccuuaaacaauuaacaaaguuaugaagaaaaaggaaagaauuuuuuuuaaaaaaaucaaaaaucuuaccuuauucucucuucagacucauccgugcuguaaauggacgcccccugccacgcugauacccugacagucugugguuauuuaauaaucucauaccaaaacaugcaaagguucacugagcucauuuuuuuauugcuaagaauucaaaauauccccuuaaccacaccacccaaagagaacugguuuuuuuguuuugauuucuuuuauuucuaaaucacauuuuggaaauucagaacauugccaucaguaaaauaaaaggcagugaaaugccugacaaaccccuaaaaugcugaaguaguagcuugugaauuaaaaauuuuuaccaaccugauuuccucauaauucaccaauaacaugacagggauuaaaacaaauaaauaaaaacagaaggcggguaaaccacacacacaacuguauacccuuugaaagcuuacucagccuuuaauuggaauagugaacauacauuaagauuauucuacuaugacuugccacagaccaccauuguaacucucaaaacugugggaguuacauuugugcuuuuagacacaucuacuuccugaaaaagcacucuaugugaccuaugauuggguaucuggacauuaaguguucaacagcacugauaaucagcauuaauuguaacuugggauuuugaaagcaguaagaaaaaauaugauucaaauacagagaaagugaacacuuaacaccacugaguuauguuaugcacuucucagucuagucagaaccaaugauaucuuauuaccucuaacaucaaaauacaucaugcacuuugcauuucaccauccgaaagcaucaccuucaauaccagcgaacauucacagaugcacugucauugagagaagcuuuaaauaggcaaaacucaugagugggauuuacuauauacaaacacccauuuccaagccaguuaccccuuugcauauuuuucugagggggcauccauaaauauaauaaaaaacagaagcucauacuuacauccuauuccuuguuacuuuccaagcugagaguuucaucuugcauuagucaccauaugaucucuaucauaauggugggggucaaugaauagauuagcuuuaugggaauuuacaguucuuccaugcaucuauaauuugguaagucugguaaucacuggccuacguuuuaaaaucucccccacucaaacuuaauccacacaaauauaaaucuuaaauuuuaaucucagcucuuuaaaaaaguuuuuccuaggauuaaagaccugcccacaagauaaacugaacuauauguauguuauccugcugcccccugaauaguuuaaucugaccuugauguucauguugaaaucuaaauuaacuuuuguuauauuaaagugagaugcuugcagcagucagugacugagaacaauuagcaauggccacuauuaaauaugguauuagucuucuguucuuuuguuucuaccuuaguaucaauuaagccuauuaaaggcaauaauaaauuauacucuaaugcaaaguugauuuucuugucuuuuugcuuuggauucuguaaaaagucuagauugguaucaagugaaaaaucaagaauacuaccuuguguguaucucugaauuugcugaucucucgggauaucaaaucucuuuugucuucuuccauuucaauagcauuuauauccuccuaaaauuaagugaacagaaaggaauagauuuacauacauuaauagaaaaauaacaaaauuuaguauuuaaugcaaguauuacaaauacaucuaaguaaaacccaccaacuuggaaguaaaaucuaauguuguaaaguuaugauaauaauaguaauaguaauaauaaugauaaaaaucacauaucuggcaguuagugcacacauaaaaaucaaagccuacaguucaaacgaaccuuggugaugaguggguaagggaucaauggggccacuggaaaucuacggaaaaucugcagagaaacccacaaagauuuuuuaaaaaacagcucacauugugcuauaauuagacugacuacauacuuauccaggaaauaauaacuacgugugauauuuucuugaucucaaauuacaguaaaaaugauuuaucuuuaaaucccucuaucacccaucacaugcuuuuuuuucaauagccaaaauacucuuaagaguaccaggacuguuuccuaagauaaggaauucuaacauguaagaaauuaucauuugagauguauuugcaugcacaaaauuuaucuaccuuauaaaaagauuugccuauaauucuagccaaaaaauaauacuuccguaacuuacccucuucauuacuaucaguuauuuuuauccuuccauaucaauggaggaagaaaaauuucaacuuuaccuaauuaucugacuaacucuuuacauuaguauucccaauaauaccaaguagaugcaccuuuuggaccaaauaaugaauaauuacaguaauacaauuguaucuggccaaugauaaaacuaaaaugcccaaagacacugaaacucaaaacagaacuuacacuaucccuaaauaaacaauauauauguguauuuuauagcauuuuucaugacacagacaacuccugaguuucuaaagaaacauuguacuuuccagaagaauaaauuauauaaauuacuauugucagaacacauacguccuccuucuuuuccuuuuucuucuuucuggggugagagucagacuccugugagggggcauuuaguucacuggaauauucucggauuaaaacuucaauggccccuuuaaucaucuggucucuucgcuuuguuucuucaucuaaggcuucuucaucaucauuagugacaguuucuggucuggcguucuuaaaaaccaacacaaauuugaggagaauagacaaaaauuauuccaaagaaaaaaauaucaaugggcuaaccaaggaaaauacuagauagcuauacuacaaaaccuaaucaccagaaagguuauaggcugcaaaugaaggauucuuuccccacauaugcuucuacauguuuuuuaaucuuuuaaaaaacuauuuccauguuuguauaucugugugugcuacggcauacauauggaagucaagaagacaacuugaggacuccuuccaccacaggaaucucaggaaucaaacuuggguagucaguccuagcaucaaaguuccuuaccauuuaaccagcccagcuuccaauaugucuaugugcagcaaaagcagcuuaugauaaccauacaccuggccaggaauggagguauacucuuugaauccaguaccaaggaugcagaggccaguggaucucugugauuucaaagccagaugugugugcauuuguccagaacaaucugagagcuacagaguaaaaccaugucucugcuauauaccauacuccuuucugucugacuugcacaugcaguaggucaaaaccuagccaagaauggugauguacaccuuuaaucccagcacacaggagacagagagggccaaagguaucucuugacuuuguggccagccugaucuacaagagaaaccuugucucaaaaaaaaacaaacacaagaaucagucaaauacauagacgcacaacuuguuuauacuuuaucaaaaagaaguguuagacuuuaguaauaauuuauuuaagaguaacuuucugauugggcaauggugguuaaugucugaauucccagcacuaggaggcaaagauaggauuuggaauaugugugcagcugggauuacaugagacuuuaccuuuccuuucaacuaaacacaauaaccucaaagaauaguuagcaugaaucuauggaucuacaaauaccacaaaugaaagguaaagaguuuacccuucaguaaaagccagcaggagugacaaaugaaaacagcucucaggcaggauaguaauuauuaggcaaacuucccuucccuaaggggauccuaucucaaaagaaaaucugucucucagaaaaacacaaucuucaaacauacuguuguugguucuaaucaugcuuuagagcccccaaauauagaauucauauaguuaaaacuaaaaauuuauucuaagaccugaaaacuuuugauuuccccuuacuuucaacucaacacuuacucaaaacauagggaaaaauaaagaaugacacagaaggaaaaagcauggauaauugugcauacaaagcaauuuuucuaaacaaaaauuauacauguuuaugucucaaaauagcaauuuacuugguaauauauacugacuacauuggcagguaacaaaaaucaugcuuguagaaccaggaauauaaacgggccuugcuuaggagguaucauucuggauucaacacaauauagcaagagaaaaagaacuauaaucuuccauauaaaugccagguucuuggucacaacacauucaauucuacucaaguugauuuugcgcuaugugauuacuuaguaacaaguauaacuuaccagguguuucauaacaaccaucauuaauuuguuucuaucauuagaaacuauuucauauacauauucaauaagccuuacauuaacauuuaauuuaaauaaauucuuauucagagcacacuuuaugauacuuauagaaaacuuagcacaauuuuuucuucuuuuuugauugcuuauuuuauuuauuuacauuucaaauguuaucccccuuuccgguuuccccucugaaaacucccuaucccauccuccuaccuccugcucccccacccaccaauuccgccucacaacccuagcauuccccuaugcuggagcaaugaaccuucacaagaccaagggcuccccucccauugaugcuagauaaggccauccaucauucggcuggaaccaugggucccuccauguguauucuggauggugguuuagucccugggagcucugaggggucugguugguuaauauuguuguucuuccuaugggguugcaaaccccuucagguccuucaguccuuacccuaacuccuccgaugggguccccaaaagcacaaauuuuuaaaacuuuuuuggaccauaaauguuuauuaacauauaguaagaaauagaaguauaucaaagauaaacacccaguuucuuacuuucucaaaccugccucuucauccaaucuucuggcugccaauuuucuacuuggcaucuuagauaaggacaagaugcuuuuacacaggacuguaauuaaacuauuaaaauuauuuauuaaacaguauuaauaaacuauaauuggcgugacuguauuuuaaauugguaauuaagguccuuaaauuuauacaccugucacuaaaauccacaaugauaugauuuuggcuuucugaaaguuuucuaugaaagagaaugcucuaguaacacggcuauugauaauucaaauuuagcgcuuagaguguguuacuguuuuugcucacacaaacgccaacauucagcccaagccgaccucuuaaaccugcuauaccacucacuaacuauguagcaccaaacccagguccuucauaucuaaauucuacucuaucaaaguauucacugcuggacuuuggugcugaaggccuuuaaucccgccauuugcgagacagaggcagguggaucuggccugugaguucaaggccaagcagggcagcacagucuuaaaaaaugaaauccagaagaaaaauauaugaucugugugacauuuccuacauuccugauuucuuuucccuuggaagacucuccauagguuucuaaccauaggaauaggaauggaguuguaaauucaaaggccugcuaauauagaacuguccuuguaacguuucaccagcaaaaaacacuccagauccuucuacggcaaagcuuuauugcuucucaggaagaccccgaacccggaaaauggagcugcuuaaauaccccucugugugacgugucagcuccugauuaguugcucgcucaucaccccacuccuacaccccgggaugggcagugacuuggcaugaauuuacuccagcaccugcgcacauugcuuauuuacuaguuaggcacugaggaagccagccccaucuuguaauggugauugugcacggcuucccacauagaauuaaccuguagacccuaaauuaucaucuccuacaaacugaaauugaaagauccauacagcuauuuuccacaauuacaaccaugaaggauuuaagaaaaaaagaauucaagucuaccuuucaaauggcuaacugccccucaaucuacauuuucagaaagaaagcuuaugagccuaaucagucucuuaacugauugcuaauuaucaguaguacaaaaauaucacaaaaagaucacaggacagaagauuauuuggaauuauuuaaaaaggucaagccgggcgugguggcgaacgccuuuaauccuagcacucaggaggcagaggcagguggauuucugaguucgaggcuagccuggucuacaaaguaaguuccaggacagccagagcuauacagagaaaccuugucucgaaaaaccaaaaaaaaaaaaaaaaaaaaaaaaaaaaaaaaagucaauagauaagcugccaaauauuauccaaagcucacacaauuuccaaacaauuacccauuucugaauuucagcuucuaccuccaaauccaaagugagaggaaacagagcuucuggagacguucuccagacuaacucucaucaucugaaacacaagcaguuuugagggaaacccaaagcaaauacaguucuuucagaaaacacgacucacuaaaugaacuuggaagcaauuaugugaacauuuucuccugaagcaccuuuuaucuacuagacuguaaugcacauacauggcuuuccagagauuaucuguacuccaacagcugccaauuaauucucuuuguuuugcuuugcauucuaagacacaugcugguagauccuggcuagccugauugagguagauggggcugaccucagaucaaccugccuuucccucucaaauggugagauuaaaggcaugcaccaaccucagcucaccaauucauuuuucuuuuauucguauagguguuuugccggccuauaugcauaccacuugcaugccuguugcccauggaggcaaggccagaagaggguguuggaucccauggaacuggaguaacaggcaguuguaagcugccaugugugugcugggaaucaaacuuagguccauuccaagagcggccagugaaccagcuuuccagcccacugguuuauucuuguacacauggugaacaaacacagcuugaaacaaucauuaauuaucucuagacuuauugcuggguagggagacaaaaagcagcaagcagaacacagacuagauagaucaaacuggauauagcugcaaugauauacaauuuuacuaaauacaagcuuuaaaaaauggaaaaggaaaaaaaaaaccuaaucuauauauagacugaaauauuuuuaaucaaacuauuuaguugauaagaaaucuuuucuuucaauucaaaaaucaggaaaaaauagaucacuccuuucauacaaauuauuguuucucuuacuugugaucuuucuuugaccucagagucagaggaaacuaaaagucaacaacagagcuaguacuguuauucaguaaacauucauaucauuauuaauuuagaagauauuuuccuaggugguaaugagguagcuacugaaaaucauggaugugggagguaagcagaauccaacaggaugaugggcuauaaaagagacaauaauaagagcauauugugguaaaggggggggggagggacauauucagaacaguauuuauaaugauacagguuauugugugaaauuuuuuccaaacugaaacauuccauccuguaguucucugaacaggaagguugacaacuaaaaauaacuuuaauaagucccugaaacugaccagauuccccugacaaaaugaacaauaaaagcugagagaacaauaaaggcuggagagauggcucagcaguuaagagcacugcuguucuuccagagguccugaguucaauucccagcaaccacaugguagugcucaaccaucugaugagauccaaugcccuccucugaugugucugagaacaacuacucacauaaauaaaucuuuuuaaaaaaaaaaaaaggagacaaaagcugagcugcaaauaagucucucaaagaaaagcugggaaaaaaaaaaagacuaagaacagauauaagaaaccagcugagcuaacaagagguuuagaccaguuacuggaaaggacaaccucuaagcuacugaacugcauauugaacugcacauaggcuguacgauguguuucaguuuccgaguuuugugagcuaucaccucugcuugauugggccuuguugauguggcugucugggucauaucugcuccugggaauaacuccucauccauauuccuguacggaucaccaagcugaccuuuuguggcauuuacacucugcucugucaugagugccuuauuuaggggagguuuuaucacagguauaggaaucagaucauguuaauuagauaaacaaaauuuuaaugagcuuagaugggcaauaaaacaaagagaucaaauaauaauuuaaaaagucuguggaauggugccaauagauggcucaacauguaaaggggcccugccacaaacuuuacaaccucaguuugaucccugggacccaaaugguagaagagaacuuccaugaguugucuucuaauuuccacauauacauucacaaccuacacauacaaauaaauaaaacaaauuucuuuaaagauccaauaaaugagauaacaucuaaucccagcacuugaagugaguggggguggggaagaguucaaggucauauuacaaagaguaguaagaagcuacaugagauccuaucucaaaaaaaaaaaaaaaaaagucaaaacagagacugaacagagcugagcaguuaagaaucuugcugcucuugacaacauggguucaguuccucaacaaacauggggguucauagcugcuucuaacucuaggaaauuaauaacauuuuugguuuccacaggaaauacacguauauggugcacauaaacacacaugcucacuuucacauaaauaaaaaucucucaaaaaaaaauuccaauaaguuaaaacaaauccaagggauauguaauacaacaaaaccuuaauacuaugcccaacacaggcuuuacuucauauggaaauccaaacuacuaaaacuaaaucugacaaauaagcaacaguuauuuuuguuuuuuuguuugguuuugguuuuucgagacaggguuucgcuguuuagcccuggcuguccgggaacucacucuguagaccaggcuggccucgaacucagaaauccaccugccucugccucccaagugcugggacuaaaggugugcgacaccacgcccagcaagcaacaguuauuuuacccuguaaauauauauauguaguauaugucagugaaauuaucuaaguaacagaaacaagaauuaugcaauaauacauuuugguuuuuaagucucaugucacccagacuagccucaaauucccuguacaacuaaugagcuugaacuccugucccaacugcuuuuacucccaagugcugggacugugccauugcagcuggcuuuaaucuuguuuuuaugaaauaaaaauauuccaauuaaagcuauacucaugggguagggaugugacucaguggcagcauacuucucuguaacacaggcucuacccucagcacuggaagaaagaggguacacagaagaaaaugccuuccagagcaugagaauagaacgucuauaguaaaguacuuaaggugucaugaaacuuaacuucuuuuuuauaauaugguuaaauaugaguuuuagaaacauucuuuuaaggggcuggagauggcuaagcaaugaagaacacugacugcucuucaagaguccugaguucaaugcccagcaaccacauggugacucacaaccaucuggaaugggaacuguugagaggauacccucuucuggugugucugaagacagcuacaguauacucacaauuuuuuuaaaaagguuaaaauuuucuuuuuuaaaaaaaguaauacacaaagguuuuagaaaggguaagagaaggcuauaucucucuucaaaaguaaugaaagcuagaugaaaguacagaccuuugggguuuuuuuugggguuuuuuuuuguuuguuuuuuuguuuuugguagggggaaggaaaacaaaagaaaaaacaaacacauacacauauauauguauauguacauauauauguauauacacacauauguacauauauacauuuaagacacuauauacucaaguuuaagauuguuuugugaaggaugcaauauauauuaucacacaagacaaaaagaccuccuuuauccucaugcaaaguaaaagaauuaaaaugaaaaauaaaaauccugaauaaggucacucauacaugaaguaguuaagacuuauuuucacucauuucagaauccaaucugugugcacuaaaagagagaggauuacuaauaaacauuguguagguugaaauauauauuuuauacuuacuuacaaagcugccuuaaugaauuagcucugauuggaauagucuguacaaguguuuucucuggcaaguuaaccuuguccagccucccuuacuacuuucaucccaaccuggaacaagcaaaccaacagucauccacccacuguggguagauaaaacacuuaucuacaaacuauaaaauacacuccugcauaagccacaagcacauauuacaaugacaauaaucuugugagacuccaugcuaaauuuacuuacaauaugaaguauuuacacagaacuggcacagguaggcuagaaaagauauuacauaccccauuagcuuucuucuuugcuuuccauucauccaacugugccuuugucuuggcaucaacuuuaacaaguagcuucuucucuccaaucugaaggucaugcaauaaucugagagcacggaggguagauucaggcucuuuauacucacaaaauccaaaagcuaacaauaaauaagaagaauuugugaaauauuaagguauuaaaaacaugaaaaaauacagcaaggcaaaaugauuaaagguaauacuuaugaggucacugaagucaucaccacaacacugcucuuuaacccucuaauaaccauuucacuuuaacauugaugaacccagaggggagggagaguuaaaaaaaaaaaaaaaaaaaaagaccaggggaaagaagaaaauccagcaaaucauuauuuacuaagagcuaaaaaauaaugaaauuuuaaaaauuaaaaaaauaacaaaggauaggauauagcauuaaccaggggcauuuuguauuuugcuggggcaggacaguuacaaucccagaacucaaaagccagaagcgaaugagaacuggaauggcuuuaaacucagaauaaauccccuaugaauuucacuauagaaagcucauauguauccucaaugaaauguuuucaauuugacuuuuauagaaaaauuaacuggacagcauggcuauuuuuuuuuauuagaaaaaaaacaggcaguauuuuuagguacuaugauuauauuuugggcaaauuuuccuacaguugcgcccccgccaaaauaaaauguucauguuucagaguauauacuacaauacagagacaaaaaucccagugcuugggguguacuuaaaaauaacaugaacagccaggcacagacggugacacacaccuuuaucacaaaauucaggaagcagaggcagaaagaggaacucugaguuagaggccaggcuacagaaugaggacaggacagccagggcuauacagagaaaagggaaaaguggggaagaaggaaagagaaagaaggggggggggguaaugaaugggugaauaaaggaacacaaaagaaaagcuguaggguagggguaauaagauuacugaccauaaacugauaauuauuaaagcugugaguuguaaccauggaguugucacaucaucacauuuuguauauguguccauuuuuccacaauaaagguuuugauuuguuuuuuuuuuuccaagacaggguuucucuguguagcccuggcuauccuggaauucacuuuguagaccaggguggccucaaacucagaaauucaccugccucugccucccaagugcugggauuaaaggcgugugccaccacgccuggcgguauuuuuaaaucaagacuugguauagcuuaguaauaaugguggccacauauaugaaacacuccccuaaauugacagcaccaagaggagaaaaaggagacagagagcagagaauuuagcagucuagaaugaaaggcaguuuacuuucaaaauaggccauagauagcugggaagcacuugccauagaaguguguggaccugaagaucccacguacccacaggacccacauaaaaguagaaguaauauggcaagcccuaguaaucccaucccuccagaagcaaacauggaagaaacucccuagccaagauggcuagcuauucuacuaucuacaagcucuaaggacaagagacucuuaaauaaaaugaggaacauuuuuagaagacacaagaaaccaaccauacauacauacauacauacauacauacauauauauaugcacacacacacacacacacaaccaaagagcuaaagauggcuucacacuaaaaaagcacuuguuuuuaccagggacccaggauccauucccaccacccacaagucagggaaagcaacuccuccaucuggccucugcagaacugaacacacgaggugcauaagcacacaaguaggcaggaaggcacacacucauauacacaaagugaaaauaaauaggccuaaaaaaaaaaaaaaaguccagagccaggcagugguggcacaugccuuuaaucccaguacucgggaggcagaugcaggugaauuucugaguucaaggccagccuggucuacagaggacagccaggacagagaaacccugucucgaaaggaaaaaaaaacaaaagcaguccaauuaauuacccuucccuccuccugagcucuaauuauugcauuugggucaggcagccuuacuuucaggcaaaagaaccucaaaaaucuaaaaaaacuagugggagagcuagaaaaauagcacagcaguuaagaauacaugcuacucuuacagaaaaccaggacuccuguaaggcagguagaaaccaacucuaccuccaguuccaagggagccacacccucuuccagcuuagauaugcacuguauucacauacagaaaccucuacacaaauuacaggccaacagggcuagagagauggcucaguauucuuccugagguccugaguucaauucccaacaaccacaugguggcucacaacuguaucuaaugagaaccaaugccuucuuuuaaaaagcaugaagacagcauacucauauacaaaaaauauauguguagauguagagauagauagauagauagauagauagauagauagauaggaaggaaggaaggaaggaaggaagggagagagagagagagagagagagagagagagagagaaagaaaauaaauccuuaaaaaacuuauaggccaguaguaaguuuuuuuaaaagaaaccacuggauuuguccagucuagcauauucaaagagggaaggaagaaaacacuauugaguaaugcucauuuuuuucucuucuaccuccuuuucugcuucaacuuuugaaucuucuaaucccaaauuucagccaaacauauucaauggccuuuuaauacauucuuaagaaaauuaaaauaagggcuggcgagauggcucaguggguaagagcacugacugcucuucugaagguccugaguucaaaucccagcaaccacccauaaugagaucugaugcccucuucuggugugucugaggucagcuacaguguacucacauauaauaauaaauaaaucuuuuaaaaaaaaggaaaaagaaaauuaaaauaaaacaugcuaaguuuauauaaacuuauacaaauggguuaaaaugguggcaaaaacgaguaaggaaauuauguauaccuugaaguuucccagaagcaccuugcacucucuuccagcucaacaccaaaccacauuucuuaaaaagaaauuuaagaauuaccacuuaacaaacaaaaguuucaagacaaguaagaucacaauuauagguuauaguguaugguagcucacaccaguaauagaagagacugagauaguacuacaaguuugagggcagccugggacgauaauaccaucaauacaggagggaaaccagagaacaaaaugcucagcacgaucaugcuggcaacuaagcuuguuaaaauuacuccaaaucucccaaacacuugaaauaucuaacaggcugcuuaaacaaauacauaaagccuuagcaggaagugguggugcagaucuacgaucucaguacuaggaggcaacugcagguagccucuugagucugaggcuacccuggucuacugagggaucccagggcagccaagacuacacagagaaacucuaucucaacaaacaaacaaacaaacaaacaaacaaaacccaaaaaaccaaaaacaauauuuuuaaaaucuguugacucauaaaaucuguugacucauaaaaucacaacauauuagcccaaaaauuacuaguaagguaaaugcacucuuaguaugauuaaguuuuaaucacuuuaauuaaguaacucaauauccccaaaaacggggaauaagaauaaaaugaaacagccuggcggugguggcacauagcuuuaaucccagcacuuaggaagcaggggcaggcagauuucugaguucaaggucagccuggucugagugaguuucaggacagcuagagcuauucagagaaacccugucuugaaaaacaaaacaaaacaaagaaugcaaugaaacacuuguguuaaaaaacuguacacuugggcuggugagauggcucaguggguaagagcacccgacugcucuuccgaagguccggaguucaaaucccagcaaccacaugguggcucacaaccauccguaacgagaucugaugcccuccucuggagugucugaagacagcuacaguguacuuacaaauaauaaauaaauaaaucuuaaaaaaaaaaaaaaaaaaaaaaaacuguacacuuagauuggagagauggcaauguaguuaagaguuccaacagagguucugaguucaauucccagcaaccacaugauuguucauaaccaucucucaugggaucugaugcccucuucuggugugucuaaagagagaaaugguguacucaaauacauaaaauaaauaaaucaaaaaagaauuugaaaaaaaaaaacacaacaaaaaugguauacuuugaaucuaacaaauaaacaaaucaaguucuaagaaauauuuuaugaaagcucuaacuuguaucaggaaaacaagcuaaauaaauaaaaagaaauaaaaccagaaaacuuguucuguauuaugguuccaaaaugaagcacauauuuauaucauaagcagaaaacaaaaagcaguuaauacacacaucacugggaagguugaguacaaacuauguaguggugaauacagcagcauuuggaucguguguaaggacaauaucuaucugcucucagaaacauccauuugacacucaagugaguauuauaucgcaacucauccauaaauuaugaaacauggauauuuaagagacaaaauugguaaguuuacugaugaaucugagucacagaguucuagugugauuacuagacugcucuuuuucuacagauuugauaguuuuucauauuaaaaugcugagggaaaaaaauagagaacuuaggcaugagcacacaggccuuagucccaacaaucugggagauagaagauucccagcuuugaggccaaccuggacuaccugagauccugucacaaaaaaacaagcuacucaguaaguuugaaauuuauuaacaguuuuaaaaggugaaaaauaaacauuuuaacuuacagcuaagagcugucguauaagcaugucugaagccuucucagaaauguucccaacaaaaacuguaguaguagggccacaauuuucaucauuuucuuuuaauuuuaagccuggaugauccuuucuggcucccaaaugcuuuccaaccauggacacgguagguacuaggaccuaugguaaagaaaagcaaaaaauuugaucuggcaauuaugacauuauacuaaaaacaccaacuauaaagaauaaauacauagcauaugauuaaauucccuacauaucuaaucuaaaacuuuuaaagcauguaguauauuucacuaaugcaaauuuacucuuaacaauuaaauuucuauuuuuaauuacuuuuaaaagaaaacaaaaaugucaaacuuuuaugaguuuuuaaauguucaaaacaaaaaccauuugagauuacuuaaaagaaaaaagcuaguaauuuuaucacaauuauacucaguaccaagaugaaagcaaaaucauuauuccugauaaucuuguagcacaauauugaaacacuacaaaaacugucaacacuuuugcuuuuuauaagguccuuguguuuauuaguuaauuuucacuucaaacuugcaaucucccacauacaggagcagaauucuauguacucgacaaugaauucauuacaaacuaaguaagcccagguaaacuacgaacugguggagcugcuccaaagcccaacuucccauucccuuauucuguaauauaaaggggagugucaucuggaauguucuagaacugaacuuaggugcauaccuuuaaccuaacacuaaggagacaagaggcauguggacuucuacugcauuuaaggugaaccugguuuacauaaugagcuccagaccagccaggacuauaaagugagacacuaucucccaaaacaaaagcaauuaaacaaaaaauaaauagcccaacuauuugggagguuuaggaaguauggccuuguaguaaguuugucacuggaggcgggcuuuuagaguuuaaaauucccaccacuuuaaauucacucucuccuuccuguuuauaguuucagauuugagcccucaguucuuccugccuucauuucuaucuggugacauggucccuugcauuauggacccuuaucaaucuagaagaguaaguccaagucaacucuucuauuaaugaccuucuucauccugguguguaauccauugaucguucagaggacccagauucaggucagaaguacaucagaugcucacagucaccugcaacaugggcaguuccagggaaaccaaccuucuagccuugaaaagcacugcaugcaaaugcugcacauacugccaauuaggacaguauauacacauacuguuucuuuacauuaucuaagcuuaccaaaguuuuauauuucaagaaaugcuaggcauuuccuaaaucuuaaucuucccuuuauauuaccccuuuuuauuaucccacgggguugagguagaauacucaacuugauagaauacuuccccaaggucugagguuuaaucccccagcacaaaaaccaggcaugguuaguauauacccauaauuccagcauuuaaaagguagacaauaggaucaaaguucaaggucauccucagcuacucugguuaucucugguuccaagcuagcuaaggagacucuuguccuaaaaaacagugaagcggggcaaggcacaguggcgcacgccuuuaaucccagcacuugggagacagaggcaggcugauuucugaguucgaggccaggcuagucuauacagagugaguucuaggacagccagggaaaccugagaaacccugucucgaaaaacccaaaaaagugaaaagacaaauuauacuuacaguuggagcaggagccauaauacucauugguacaggaaucaucggugucccuaagaggaagaaaacauaucauauuucaagaucauaauuaaaauaauuccagggauggagagaugucccacauacccaggugugugcuucacaagcacaggauagugaugagcauccacaugaaaguaaggcauaggacggggcguaucguuccuacaaggggaagauagguggauucccagggaucacuggcaagcuauuguggcccaaacaggauugaguuccaguaaaagaucuugcaucacuuaaacagaggaggcuagcgagacaguucaguauauccaaggaccuacugccaagacugacugacaaccugaguucauucccugguacccacaugauagagagagccaacuauuagcuacgcuuugaccuccauaccuauaccagggcguauccuugcauuuuacacaugaacacaaauuaauaauaaugaaaaauauuagaaggcucaauguuugauggccaagacuacaaagaaaagaacuuacaagaaaauacuuagaacuaggaaugcuggcaacacacacacacacacguacucccaaacuugugacguauggaaagauuauuagccaugcuugguuacacagcaagguccagaccauccuaggccaggugaaagccugccuugacuccuguccccauuaaaaggaggcagggaguuauacauaaaacuaagaaguaaaauuugggugugguaacaaucaccuauaaucuuaucaccuguuaggcugaggcaagagaauaacccugaguucaagauuagucugggagagauggcucagcagcccuuuaacaugcauuuuuaaguaucugcaaagauaaaccaacuaccacuuuguuucccuuuagcaauaguaacaacacuaauuguuauacuaauuuagguagcuuugagggaaauuagcacuaacacuuugaggggaauuucacugcuaacuuuauuuuucaaauuuuuaaaccuuaugaauauggauauagcaccuuuauauacuuaucauuuuuaaagaauuuccaagcugauucagaaacucaaccacaaauacaaaucugucaagccaagugugaugacucacaacuguaauccuagcauucaggagccucacggacaacugaaaggugguagggaaccugggauaacacauucugucuccaaacaaauaacuuaaaugcuacagaaaaaucagacagugguggcagugguggcucacaccuuugaucccagcucucaagagauacagacaggccuaucucuguggguucaaagccauccuagucuacaaagugaguuccaggacagcuguacuauacagaacucugucaaaaacugcccucuccccacuacuacccccauaaaaagaaagcaaacaaccauguucacaauaaaacugucacguauuuacuaguaaauacacacauauaccaugcugcaaagauacagucuuuuuuaaaagaaaaaggggccaggcaugguggcacaagccuuugauccaagcacuuagaaggcagaggcaggugaaucucuguaguucaaggacccacagcuaggucuuuacagagaaacaaugucucaaaagggggugggggcagggggcaagaaagaaaugaaugaaugaugauaagaaaaaaaugugcucaaacuuaccuggagguacugguggaggaaagccaggaaacugugggggugggaucccuggagggagagcugggauucccaugggagggcgauucaaaugaggggggaaagacauucugacugcaccagucuaaagaaagaaaugacaaaucauuuuauuugacaccuuuccaaucugauaugccuacauuguugaccuucauuuuuagaguaucugcaaaauucuaaaguuuucuuacccaaaggaguuggcaaagacccucuuuucucugucuguccauugagaauuuuuuaaaacuuagaucuuuucuaaaauaaguucccaaaauguacacgaacuaaguucaggauagacuccuacaaucaugugggaauacauauaaaggaagaaaaaaauuuugagguucaguuaauaucaaaaauuaaaugccaaacaucaaugaaucuuuuaaaacaaacucagaauccaggaggguagcuaauuuuaaguguucugauacauucauuuuuaacccaauagaucuuugaaaacuaaacuagcaagguuaacaguauuuaaugacucaguguuagcuaguucuucaaagacaaacgugcuauuaaauuacaaacugagggggaagagagcauggcuucuaucaggucacagaauaacuguucuaacauaaagagcccacaaauuugcaauaagguaacaguuugguuuggguuuuuuuuguugguguuuuuuggagauaaggaucucaaguaaucaaagcuggcccuaaauacuauacagcuaaugacaauuguuaacacuugaccauccugacucuauuuaauugcaaguacugagauuacugacugguguauacuaccauacccaguuuaagacauuuuauuaaagcuaacuucuagccaggccuaguggcacaagccuguaauaccgaucuuaaaaguagaagcagagccgggcaaugguggcgcacgccuuuaaucccagcacuuggaagagaggcaggcagauuucugaguuugaggacagccuggucuacagagugaguuccaggacagccagggauucacagagaaacccugucucgaaaaaaaaaaaaacccaaaaaauaaaaaauaaauaacaauaaaaauaaaaaguagaaacagaugauuuuuggguaugcuagaacuugucucaaaaauccaaggugugggguggacaaggaggcaagacagcauugucuauauagucaagcuagcccuugguauaguccggucuccaaaaaaaaaaaaaaaaaaaaaaaaaaaaaaaaaaaaaaagcugaaauaaguugguaaagauuccaguagaauuaguuugguggguauuuuguuuuguuuuuuguuuuuuaacuaagcaggaaaccacugucaaaucacuaguaaaaauucuuccaccuaaaacagaaaaucccauacucuggaacugagaaagccuagaauuguugaacauauuuuucaaacagggcauggcggcacaugacuguaaucucugaaacugagagauggaagcagaaggacaaguuaaaagccagauugcuaugaagcaauacaauguuggguuugaggcuagccuggcuauaugagacccuaccucaaaaauauguuguuuuacuuuuuuaguggcugaguguauguauuuacuugguuuucaguuuaaaacacuguacaugacugaggcuggccucaaacccaauauccuuagccuuugaguaccaggguuauaagacuguaccaccaugccuagcuccuuuauuuuuuacucauccuuuaguagccaaagcuuaaaaggugugaugucgucuacuuucucucauccaucaacucccaccaguuuaccauguuauguuuucuuuuuacaaauauuuaguauuuugugcuuuauuauaauauacucauacauacuacaguuaccugcauugcuccuucaauaugccugacaucucuucuccuccauucuuaucuuuguaacucaguaaacgauaauauagaaacaccaguugccgagacuuuaucaguugccgaggcuuuucaacccuuucgaauaauaccgaacauucuuggauauuuaauuucaucuuugcaaaguauuuaggauuuucuuuaauuauaauuauugauuuaugugaguuuauauaugcuugugcauguaugucauauauggaagucaagaaaagucacaggaguccacucucuccaucacugggucuugaaauugagcuugggcugucaggcacagcagcaagcucaccguuaccuacugaaccauuuugugagccuauaaauauaucuguaauacagauuaucacuguuugcauucaaacucuaguacuaaaucauuucccccaaauuaauguguaauuuguauuaccaguguaucaaauauauccuuuccuuaaguacuagaacaaaucaauuaacuuuuuuuuuuuuuuuuuaauuuuuuuaagacaugguuucucuguguagcccuggcuguccuggaacucacucuguaaaccaggcuggccucgaacucagaaauccgccugccucugccuccgaguacugggauuaaagucgugcaccaccacgcccggcuaaauugacuucuaagaaucugaaguucaaacaaaaaaacucuauuucggguuuagcuccccaauuccuaaaguuccuaucuuuuuaccuguugguaagcauuucuuugaaauaaaaaagcauguacugcaugcucacaacuguccuguuuuauacuguaacucugacuuuuuaaauagucucuaagagcugaugaaaugguucagcagguaaagguacucgcuugccacucaagcuuguaagucuaaauuccauaccuagaacccacaaaguggaagaagagaauugacucccacaaguuguccucugucuuccacacaugcgccacugaacacaugucccaagaauaaguacauagaaauauaacuuuaaaaauauuuuuuaaaauacuaugccaggcaguagugcuacaccccuugaaucccaguacucaggaggcagaggcagguggaucucuaacuuuaaaggcagccuggucuacaggguaaguucuaagucagccaaggcuacccagagaaacccugucuuaaaaaauaguaauaacaauaacuuuaaaaaauauacucuauaaaacuuaaucuuugguuuuauaagccaguucuuauucacaaguaaaauaauugucagaaugauuuccacauuagcaaaaaggugccagaaaagccuuuaaaaacuuuaaaaacuuagguaagcuucagcauaucuaucaaaauaaagacacaaguuuguaagacauuauacauccaauuuuuguguguugcuuugucuuuucuuuuuguaauuuuuaccuuuaaaauuaccacacuaaguaguggguuucaauuaugacaucuucauacauguguuauuagacuauguucucauuuguuccccuuccccguugaguuuuuuaauaaucuaaauuacaaguguucuacauggaaaggagcaggaaggcaugucuguuaaacagaaggccacuguccuacuuacagaagcucuuguauuauauaauacucuaucucagcacuuucuuaggaagcaguugguauaguaccuguugaauaaauaaauuaauuaaugaacaauaaacaaugccugaggacucaucaauagaguuauuaaacagcuacuacuuagcaacagcccagugccuaguuucacaaugguauaaacuggggccauggauucauuuuuagagccacuuuuuucccaccagcauuagauauaaacaauacuuuuaaaguaaaucuuaaggauuaaguuauauuuuauagcuuuuaauauuaaguuaauuaaccagauacauuuuaguuucaccaauauaauuauugcauacauuacuauuuuuccuaugaaauaccuccauuuuauuuaaaguugcucaaaacuuaauauggguuagacuugaaggugaaaaaguauuauagucaaugccaacauuugaacaguucccauuuccuuuaagauaauagccuccuccuagggagguucgaaaaacagacacuccuaaugacauuaacaaaauaaauguuuaaacauugaguauuaacagcuuuaugcuuuguuaugugaaaugaaaauacaaccacagcaaaguguacuaggucuuauuuuuaaaauaaauuuaaauuuaauaauaaauuauacuuucuucuaaguuuuagagacuuugaaauuugguagauuuuacagaaaaauaaucaaggaaaagagcugcggagugguuuacuuucaguuccaaugaucaggccucaucaaguaaagauuugaacacagagcugaaagaggcugaggcaggaaggccuauuuauaucagagguaaaaaccuuacuuccaagcaaaggaaauaaauauaaaaagacuaagguagacaugccuuugaggaagaccagaaaggucaacuguaagccuagagaagaaaaaaaugcugagaguuagauaaaacugagcauuaacugggaagaguaaguguucaaagaggccagggcuuuguaauacacuguaaagguuugggcaacuacuaaaaauggauuagaaacauuuugaaagauuucugauuuaacaaucauugucacccuuuuaacccuggaagggaacaaaauggaagcaagaaacuacuucaguaauacaaacugugccuugaaggaggcagggguggucaaagucguaguuagcaaguugcuggcuagauucuggauagccaaaaggauuuccugagggugauguuagauaugauaacaguuauuacuacugauuuuacuucaauacuguuuauaaaaauaacuuuuauuaauguuuuuguucuucauucugcggaauuugggggcuguuuuuguuuuucaaaacggggucucuucuaugaaguucugacuguccuggaacucccuauguauucuggccucaaugauucuccugucucugccucccacauacugggauuaaaggcauaugcuaccaugccuggccuaagauguuuuaaauuuaaaagguucaaaauacauacauauacauguguuuauguguguguauauacauuuuguuuuuuguuuuucaagacaggguuucucuguguagccuuggcuguccuggaacucacaccauagaccacggugcccucaaacucagaaaucugccugccucugccucccaggggcuaggauuaaaggugugugcuaccaucaccuggcugguucaaaguauuuguaaaguauguagcuuucugugccagcauaacugucuaugagguaaguguuuccaaucucuaucuaauuuggugguguucacacaauucuauuugucaagacucacuccgggcgugguggugcacgccuuuaaucccagcacucgggaggcagaggcagaggcaggccgauuucugaguucgaggccagccuggucuacaaagugaguuccaggacagccagggcuauacagagaaacccugucucggggagagaaaaaaaaaagugacucacuggaauucaaaauggauuuuauuauauauaauuaacguguauuuaaucuaaaaaagaaaacagaccuaaaauacauuuacacucuccaacucuacucucuccccuuuucuuuuaugcccauuuuuuuuauucuugugaauaccacauguauacaaaauauaaccaauacuacuuaaaugagcacuacuccacugcauacuuauccagacagaagugaaugucaccagggaaagagugacacuaagcucucuagggacacuagaugguaccaauuauuuugcaaguucuccccuagaaaccauuuguauuaguuauaaaagggugagauuuuaaguuacuauauaaaccuugucaacuaguccagugacuccacaaugaauauaagugacuauuaauuuaacacugucucccaaccugcuuaagccagcacaacagaagagacuaauaacugcacuaccuuaagcaaguauagcuuuagaaaaaucacuucacuaacugaauucacagacaacuggauucuccaggaaccauucuaaagguucuguugccaaauaaugaaaauguuaaaaagaaacuuauuuuaagcagaacuuuucaacagguuggggacauggcucaggcauagagcucuugucuuccagcacagucauggccugucacugacacugcacagcagcacuggaugacaagaggcaaggauuggaaugcugaaguguuuugaaucuccaaaacauaagaucuuuuccugagaaacucucacuuucaaugagaaaaaagcagcaccuauccagacacauuggugaucgcuacaaccuaaggcagaauauacauagugcuucacaaauaggcuagagggguacuucuggguaaguuacacaacucuauauuuacuuuaaaaaauucacugagcuuucuaaagcuacuauuuuaaaaauacuucaauucaggacaacuaccaaaaucuaaggccugaggaaaauuaagcaguacuguaccaaugcuaauuuccugacugugaucacuguacuauuuuuaaaugauaaaaaaggaauuucccagagcuuucaggaaauacaccacaguauuuguggguauaguggcaacacaucugaaauuuaguagcaaaacaugucaaaagaaaacuacugaaaggagaaaagaacaaaaguaaacuggcaaaaacacugucuaaggaaccugaguuagaaugguugagaauucacuguacuuuggguaacuuuuaaauuaugucaaaguaaagauaaaacuguagaauaacaugggucugucaggacuacauaauguguucaaggccugggcuagaauaaggacugcuguuucaaagaguuaagaaaagaguaaagaagggcuggagagauagcucagaagugaagagcacucacuggcuguucuuccagagguccugaguccaauucccagcaaccccaugguggcucacaaccaucuguaaugagaucugaugcccucuucuggugugucugaagacagcuauuguguacucauauaaauaauaauuuuuuuuaaagaaagaaaagauuaaaggaaaaacagcaauauuaauaauucuuauuaguauuuucuccaaauacuuaaaaaaaauguuuuaaguacaaaagaagcuaagcuugguacaugccuauuacccagcacuggagaggccaggaccagagaagccugaguuugauaccagcaugggcuacuuacugaaacucaaaaaaccagaacaaagguauccaagaaggcuuuaagaaggaaucaaaaucuccuugaggaaugugggauagcuguaaaacaagagagaaaagaacugaagcucucuaacucaaggaaacaaagcuugccuaacaaguccacugcccuggauuuguuccccagcaucacaguaacucuauauuaacccucaaaacauucaaagacuagguaugguaguacacaccuuuaauccuagcacuugugaggcagaggcaguagaucucuaugaguugggaggacagcuuugucuacauagugaguuccugucucaaaaagcuuuuuguuaacauuaaaaaauaugggcuggugagauggcucaguggguaagaguacccgacugcucuuccaaagguccggaguucaagucccaggaaccacaugguggcucacaaccauccauaacaagaucugacgcccucuucuggugugucugaagacagcuacaguguacuuacauauaauaaauaaguaaaucuaaaaaaaaaauuaaaaaaaaaaaaaaaaacauuaaaaaauauaaagaacaguuuuccaagauggugauuacuuuuaacagugcuaauuuaauauuaacuuuucucaaagcuaugaaacaacaaauuuuccucacauaaauaaggaaaauaaacugaaaacuuuucuguggcuaaaaaaguaaugugaagccgggugugguggcgcacgccuuuaaucccagcacuugggaggcagaggcaggcagauuucugaguucaaggccagccuggucuacagagugaguuccaggagagccagagauacacagagaaacccugucucgaaaaaaaaaaaaaaaaaguaaugugaaaagcccuugaccugaagucaauaacucaacacaacauuguuaacacgcacaaguguguguaucuucauucagacacagcauugcaauaaaaagauaaucacagaauagaucuauuagccaaaauuauuaauacacaauggcuaaaugcaaaacacuauuuuuuucccuagaaguuuuuugguauccuaccaaaagaaaggaagaagauagcgcagcaguuacaaaaacuuacugcucuuccggaggaccuagguuucauucccagaacccauaugguguuucacugccauuuuaaaauuccaguucuuggagauccuuuccuggccucuggccucaccaggcacaaauacaguauacaaacauauauggaagcaaaacacccaaucaacccauccacacaaaauauauuuaaaauucuuagcagaaaauacuuuugugacaccuuccucacacacaaaaaagagauaaucccagaaugacuugaugccaacauguuuuuuccuuguaaaaguccucaauauccuuuuucucuccuagauuccuugguguacaaggguuaccgucuguauccaagaagcuaauuuguucagggaaacacaguaaguggguguagacuccaaaguuccccacugagaaauuaccaauucaaaaguuucaugaaaccacaaggucucaauucccuaccaguggagaaaguaaggagcuuaaauauguuaaagucuacucuaaguacacaggaagaaauguaaaaagucucugaaacgucugacucuuaauucuuaaguaacaccauuuauuaguauaagccaacaucauguuauacaaaauuuuagugagcauuuuacauacauuuuuuccagucccaaaguccaaccugugaaguggaucgaaauguaacucucauuuuacugaugaagaaaaucaagacuuaaaaaaguuuaauaagcacauugucugcuugaaucacaacugagcaauugaaugucuuaugagaacacugaacucuuugaaauaucuuuuauaaaaaaauuaaaguucucacaaaauuacauucguggugugaauacuccccguuaaacuaucaaccuuucuuaaaucuauauacaggcuuacaagaaucaauaucauacagcgacccucuuacuuguggggaaaaaaaacaagagauuuuuaaacugaagagaaacugaaauugagggugcucacagacaacacacaaaaaaacuguuuauacaauacugccucuaccugauucaccuuauuucacuaaagcacuaugauacaagagaagcccaaucuuuucccuccuuuuggucggcuuuacucugaccuguaucaaaauggcauuuccacgucaauauaaauccauuauuacauaacuucaagauaaccuucauacucuuauuucgaaaacuguauuuaaaaaucaauacugaaaacaaaaggagggcagcauauuuuaauaugaagaaggcuggugccgccuagaaugaauggagagauccuuuacagcaucccucccaaucggaaaggggaucagacggugaaacucaucacuagcuccaacaagcaggaaaggugcuuuaaaaccaaaaaaguggccacucgauaaacucaaggagggguggggcccguucuuuuggcggcuggcacuagacuaccagacagaaaagaaauccguugguggcccgcaccucgcuccaagagugggcgcaggcuacuuucaaggcgcagccuggaggcacuugaguccucggccccggaaaccuacugagagguggcucuggaggccccgaggagacaagggccuccgggccgaccgauccuagcccuggcuaagacaggagccccgucagggcccgaggcgauucgcucccaaacugaaacggaagccaauagacaaagugggcgacaaaaaauaaaauaaaauucccggaggaccgcuccggccgugggcccggccuccccgggcuccugguucacugguuuuuccgaggccuuggaggggaagagaagcccgagccgcgugcccguccccucccccaccccgccccgucuccccacccccccccaccccccaccccgcugggccuccacagcggcccuggcuucuccgccgccgccuccuccucccgcagcugagguagcaggucgagcgguuuccucacgcguucggaagcguggacucacccgccgcuaagaaaacgguacugucuucgcggccucugggcgucaggugauggaguggggcuccaccgguucgaggugucugcgcgccgcccgacucuagagacugguuccgaagcgccuacucgccuaggccgcaaaacacagccgcgcugcgcggggagcuccuggagggcuuccucuugcccggcgugcacugcgccaggaggcguggaaagggauaaccauagagaaggugaugccuagauagucuccgccgucgccucugacucauuaaguacagagggaugaccauagagugggauugucuagugggaccuagagaggcucgagcuguaaauuaccacccacccugccauuuuugauuggagccgauugaaucuuaugacugugcgacgccaucuugaggucaagguuccggcugguuacucgcgcggggcuuguuacagguuuucucacauuuuuugguaguucguuuuccaggaauuagaaccuuggucuccugauucuuggagguucgaugaccugauaccugggcgggaccgagaaccucaauagaaagcccagaugucauuuguucuucgcaaaguacugcucacaccaagaaauaacuggcaacggcuauauuggguuuuuuggacuuuuugugcguacacacacuauaucuuaggcgagguaacagggucaaagagguaacuagaugcuugguaucuucagaaaccuguaagaauauuuaaugcaacuuuccgcagugugcgaaugacuaaaaauacuaaaacagugaaaaugaauacucacaaauuacuggguuauccaaauuauggaauuuauaagcaguaucugcugcuuuuguuuccuguuacucagaaggauuuuauaauucguuuacaaggagcuugucucucugaagguggagagugagauuuauuccuguccugggagagcuggaguccugggauaacaaauagcaaaccuugguugguuaguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagagcua

SEQ ID NO: 6737 - RNA, 47050 nt, Mus musculus
aaguugcgacaccggugagaccucuagggcggggccuaggacgaccugcuccgugggccgcgaguauucgucggaaacaaaacagcggcagcugaggcggaaaccuaggcugcgagccggccgcccgggcgcggagagagaaggugcgugcccagggugugcggggcggagggugucucugccggucguguucaccgucgccugccugccggggguccgggcgggccugugucuccgagggccgcgcugcgggcgucucuagggaugaggggcgggguccaggcgggcggagaucgaggaaccccgcgugggaaacggggugaagccgguuucucggaacccagccggggccagacugagagcagccuucuccgagcuuugguaccccggaagugcuggcuuccccgggcggccgggagcagauggcuggcaucagggguggccucucgaucagaguggagcuagagauagaggaagcgcccuaggcugggucgccuugagcaacuggugaaacucugcgucuggugccccgagugugucauaguccagaagugagugaguggcacucggggcuaacuucucagugugucuguuggcaggcgaagagucguauggcgcuuguucuuucuucagaacugucacgaugcaugugucugacgcuuguaggcgccuuuaguguuugcuaguucuucccuuucacguuuucaaauguggcacugccgcgaacagaggcucaggcacauccgccugguaguggaggacggagugcaugagacaauugagguaacuuuuuacauaacuaggagaaaugagaguuccaguaacagaaacguagaagaaacgugagcaggacaggcgaucuguucaacuaacgcauaagauugacuggguucaaguuuggagaaugagagagaaauaaggaaguuaggcagugguuuggaaauaguacuuuugaagugacagcgggugaagauggccugaggucagagcuguaaacuguaaacaugggucacuuaaguagauuugcuguuugauguuggagcagagaacuggguggacacuuagggaacacaacaaagagccagguagaaggaggacaacgaggcugcugaggaggacgaaugcagaaaccacaauagugcagugucacagaagcugagaaacacggaagcuucagggagcauugucagcgauaggaaugaaaggccugguguuguuuuagaaggaucucuguaccauuguacccuugaaagaugagcgugaaccacaaauacuaguuuuaaauguucccacagacacuuuuuuaaaaaauuuuuuagagguuuauuuauuuauuauaugugaguacauuguagcugucuucagacaccccagaauagggcaucagauuucauuacggauguuugugagccacaaugugguugcuggaauuugaauucaggaccuucagaagagcagucagugcucuuaacagcugagccaucucuccagccccacagacacauuuuuaaagguaacaagaagcaguugaaauuagucuuaaugauuuguuaauccaguguagcuaacaguuucauuuuuaacaggaaauccgugucaaauuaacuuguccucucuagauaguuaggaggcucuucagugaccagaagcaaccccugacuacaguauccccagcaccuggcacaguguuuccuugucuaaaagaaaccugauuccuauuugcugcuccaagaaucccuauuugguuuucagaugucuuuuccaguuccuuguuugagugaaagcagaaagaauuuaugcaaguuaauuagauguaaauauucguuuuuaauuuaaaaauacuuguauuccauccauuuccacagaagguagagacauugacucacaauaaaaauaacuucauuacagaauuauuaaaauaacuuuggguugagucuuuauaauuuccagguauaggcggugcuuuaggagucccagcuacuuggaaggcugagcuggaaaaucacggccagccuggauaacagagauggugaaugacucgagaguagagcgaauucauccaccugaucuaaccuaggauggccuguagucuguuugacaguacagauagagaccauguugagucuuauucugugggugugauauguaugugugugcaccucuacuuuauaugcaaagcugaagucuuugccuauaugcucacaaauucagaggccagaggaggacagggggagcguuucuccacuguuuauugccuuacuuaaaaaacaaaaauguuauuuuugugugcaggguugggggggcuuccauaguaauauucggaagucugaaguuagcucucucuucccaccuuuauauuaguacuggguacugagcauaggucuccggguaugugggacaaguaccuuuacugucugagccaucucgagaagucuccccccacccccacccccacccccgcccccugggccuuuuuauuuaauuuuuguuguuguuuugcuugguuuugugagacagggacucucuguguagcccuggcuuuccuggaacucacuauguagaccaggcuggccugaaguucacagagaucugccaccacacccagcuuaauuuuuaaaaacuuaauugugugugugggagcacgugcgccauggcacacagauguuauaacacacaugaucacuuuauggaauccuucuugucuacgauaugugggcgcuggggauuaaauucugcuugucagacgcgggcugcaccaugagcaccaauuuuauuuuauaaggcacagucucuuuauugagccgaagcuguuucagcuaggugggcugucugucagucuccugggagccucuugucuccaccucccaguguuaggacuguaggcgcaggaacuaugccuggcuuggaugugaugcugggaauuugagcucugcuccuuuugacagcaagugcuuuuacccacugagcuaacucccuagauccuacugucuugauauacuuugagacuguugguguguuucaccauagaccuaaauggauauuaauuacucuugugauucuaaggcucucggauguacuauugagcauauacugccuuuacagaauccaaaagaaaauccauauucuaaauacaguuaauccugaagguuugaaauaaauuaugagcugauuuuagcucauguucauugugucuugugagcccgccaguuuuaccauugcuuugaaauaaguugcagcaauaagucuccauagcagagcuccaaaccucacagcuuagagcacuuaaguuaacucagggcucugcuucaggguggaauguguggcucagcugggaccauuuugauuugagcaucuucuccuggggcccagguugaggggacaaagacuaucaaaccacucugcugacuucucaaggcaaggacagcugcacaagcauggcucacauauaucugccaguguccaucagcuaagauugcauugauaaaggcacaguauaggagcucacauaaagacuuagaauaggugauggcuguuacccagaaagagaccaaagagcaaucucagggaauugguucuaggacuacuaguuuccaaaaucugaggaugucccaguccuuacauuuaacaguaguauuugcggguaagaguguagucauguucagagaccuugcuugauuccuaacacugaagaaaaaauaugaaccaaaaauaaauauauuauuuauaaauccuccgguguacuuuaaaucaucucucaacuauaauacccacuaauguaaaugcugcguaaauaauccuuacauuguguugauuaugaagaacaaugaaaucuacgugccaaauguuuucagucuacaguugaucgacuccaaggauccugaauuagaagauaugaaggguaaccguucuucccuuggggagacugguggaaggagaggauauuuacugaauaauaauugucucuaccacagaugguucgcagagguggagugggauggaaagagggaaaaagccacccucaaccggcugcaucacugcccuugcuccuuuuaguucuguuacuuucagaacaugucuuguagggcugggggaaugcuucgcucgcucucucugccuuauggaucaugggucugucuuggguauuccuaagucaaguucuggaauacaguugaggguuugcuuacauucacugugguuuuuagaagcccagguagaacaggguuugaugguacgcacuuguaauccuggcacucaggaguuggaagcaggaggaccucaagcacaagcaucgugagcaagaccugucuccauaaaugcagaaacaccagggcgcaccuuuaacaacagugcacaggaggaagaaguaggaggaccucugaguuugaagccagcgugaucuucauagcaaauugcugcccagccaggguuacauucugagacccugucccaaacagacagacagccaaggagagagauggcacuuaguggcaggacacuuuccaagcaucuuugcuucccaccaaccaaaauaaguaaaucaaaauucaaacucuaaucagaguuugaguucccuaucagggagauaaguaggaaaaacugcguggggcgcgggaggguguggaggguccuggaagagaggaacagccuguuugugcagucugccugucagcugugauaccuggccccagcuuucaugauaaagcuuuaguuuguuugacaggcaaccuugagaucauggggcuuucggcagacucaaagggcggagagaugagggaguaaaacaagaaaagcugggucuugagaacucuuguccucugagagucagaacgccacuuggugggaugaagugccauguuaccaugaauaugucacccaccucccaaacuuccaucaugacgucuuuaagucugcagcucagaacagagcccacuauucugccccucugccuuuucuuguaggccccucagcucucucuuuggaguaugugccuugcuaauaaacuucugccuagacuacaugucugugucuagucugagucuucuucuuccccacuucaagacaggaaauggaguccucacuucaggccauggcggcagcagccugauugguaggaaaauaaaucaagagcuugaaaacguuauuuauuuauuuauuuauuuccugccucacaccuugaaagcuuuuuagcacuauagccauuuauguagagcaaaaaaauaauuuugguaguuuuuaaagugguagaagcuggguaaguggcuuagggacauuccgccacaggcucuuuguggugauaaagccaugcuuaugucucacugaagauguuuuguaguguaccaguuuuauuuacauuugucucaagaguuagaaaaugaguucaguguacagugagaugggagaaaguaccuguuggcuuuuuuggggggugagagaguucgagacaggguuucucuguguagcccuggcuguccuggaacucacucuguagaccaggcuggccucaaacucaggaauccgccugccucugccuuccaagugcugggauuaaagaugugcgccaccacugcccggcuagaaaguaccuuuuuguguuuguuuuuuuuuucuuuccuuuaaaauugauuaaauuucaauuagggucucuuguagcucaggcuagcuucagauuuacuuuguaggcaaagaugauuuugaaguucugacucuccugccuacauucuucuaaguguuggaauuacaaguguucaaacccauacugguuuguguuuaaggagauugaagcuagggcuuggugugugcuaaacaaguacucuaugaaccaagcuacaucuccaaugcugugggugcuuuagugaaugggaauuucuuuuaggaaccuauucugaaacuuuaaacauugcuccugagauguuuuagaaguuuugguguugagaggagguuuucuagcuggauggauuuucuuuuuuccuccgcuacguggguguguguacaugggugugugcuggaggcuguagagucuuucugguucacucuccacuucuuucacugagcuauggguuuagucaaacccagaacucacuaauauagcuugucuggccagccagcuugcuuuggggaauucccaguuucugccucuguguucuggaauuagagacaagccaccagagccacccaguauuuagguacguucugaggaaucguauauccaguccucacauugcauaaccacugagccaucucuccagacccugcaucggcuucucuguggagcacaucuaaagcugugagauuacucauaggcuguggcuuuuccuucccuuguaucucugcuuuugguuuccccaaugcuaaggauggaucccagggucugcacaugcugugcaagcacucugucacagggcugcaucccagcuccuagucuuugucugauagaaauugccauugcucaucaaaacaaugacuucuuuuuccuuugcccgacugcccaaauuguugugcuuggagcaagcacaaagcagaggguaaagaagcauuuaucagaucagaacugauaggaaaguucuaguaaagaaaauacauugugggcagaaacagguggcguccuuaaaagggaauggcgucuguuuauagcagucaagagacacauugccuggccuuaccuuuugagcuauuuguaugagguccaauuugauuaaguaagagguagucugcucauugucuuggguaaauguauagauuggcccugucagguaagguccuccggacauugggaguuagucuuauuguguauaugagguuagcagcacagcugcauagcuaggaucugauuguuagugagcauuuugguuuuuuacuguugucccuuuuggccuccucaucuccacacaagugucugagagagaggagcuagauaucaggaagguguugcgguguguccgucuucaguggcuguccagaaagaaaagcaccaaaaucuauaucccuuucccuccucccucugccauccaggucucuagucagcuacuggcuucugguguucauagcucucagcugagaauguuaucaacuuugcaagugucuucugccaugcugccugggcagugggguauugaccuuuuccagugaugguuuuggcuguuguuagauccgaaucaacuccguuuggucuacccccuuugucccaggagugugugcuuguuccaugaccuggccauggccugcuucugcuucggggcuuauuccuucugaucauauuccaucaggcucuuccugggagucgugugauuucucugggugagcagaggagccccggcugaguguccucaccaccuggaaucuggauuggggguguuacucauuugccccuuaacccugcacaggcacauugccucaccuugauguuuaugacauucgaacgcagagucuucuagagaaaaaaauuuugggggggggggggagggguuugaaagguaaggagaaaacucccuggaaccggggauaggggauucaaaagagaguugucccuuuuauuuauuuucagacauuuuuguagauuuauguguauaaguguuuugccugugugcauaaauguacacaucugugugccuggugccuguggaggucagaagaagacaccagaugcccugaaacaggaguuaugaaugauuaugagccaccaugugggugcuggguagcaaaccuggguccucugcaagagcagcaagugcucuguaaccacugagccaacugcagcccccucccccaccccacccccacccccagggaacuguauuaggguuucuacugcugcggacaaaaacacaaugaccgaaaagcaaguuggggaaaaaggguuuauuugauuauacugccagaucauacuccaucguuggaggaagucaggacaggaagucaagcagggcuggaaucuggaggcaggagcugaugcagaggccauggagggaugcugcuuacuggcuugcucccagaacccaggaccaccagcucagggaugguaccacccaccuugggcugggcucuccccuguugauaauaaauugagaaaaugucuuacaacucaaucucauggaggaauuucuucaacugaggcuccuuccucucugaugacucuagcuuuuguugacacacacaccacaaaaccagccaguacaggaauaaaauuuugggggugugugugguuuguuuggguuuuguuguuguuguuguuguuguuuuuagacaggauuucucuguguaguccuggcuguccuaaacucggucuguagcccagacugauccuaaaacucagagaucuguccugccuaugcuacugagugcugggauuaagggggugugucacuauugcccagcucccaugggaacuuuuuuaaagagucaaacagaauaaugauuaugaaaagaacuuugaaaauagcauugggagcaugcuaaagugauggguguguuauuggugggucuuagaggauuugucccagaacgccccagugugguuccuuauaauggcuaaacaggcuaugugagccugaaagaaacgacuuaaaggacacagucccacccauuguaacuuaccuguuaaaauaaauacuuggacugucugugcagaaucucaaguuuccuuauauagugggagcauugauguuaaagaucucguuacuuuguaagcaguaguuuugcuaguaauaaaacgaguguaauauaaccuagucggcauuccuguaagcuccuagaggcagggacguuguuuugcacagaguccuguauguggguuaggaucuuuugaugccagacaggguaagaugguugacuuccuuguauuuugagacagggucucauugugaggcggcuagcugcugugcgugcuuggauuaaaggcauguggcaccacgcucagccacugauuuucuuguaaaauggauggguaaagugagcauaauacguuacuuaagguguucccacuuucuguuucaauuuugcauggaaggaaggagaaagaugaauaugaaagacaguuuacaguggucucagcccugugcucaccuuuguccugcccuucuccagggccgggugugguggcauaugccuuuaaucccagcacucgggaggcagaggcaggcggauuucugaguucgaggccagccuggucuacaaagugaauuccaggauagccagggcuacacagagaaacccugucucgacacccuuccccccccccaccccccccacccccaguuggcaggaugcuggaacagacagguauggugguugaucacuuggagcacucacuguaaaaugaguuccuuaaguucaaccucucagagaccugagaaggacaaauuuuaccugaguaagcaggaauuguaaucuaaguagccuaaguaacaauuaaaaugacagacuuacccauugcccagacagccacuccaccugaaaacagagguagucuuugcgugccccucuggcccucuguggagaaggaacaugagauagaccaaccuaaucuugucuuaggcaccaugggacaauuagcucuggugucuuuguccacauuuacagcaguguccugacaggggucaagguacugggacaaauaugguugguguagccacaauccagguggaguccuucauuguugugcccauaucuuggagaccuuggagcagggcacugcuauauuuuggaaaucucugucgugauauauuuaagcaucuuaaaugccauauucagcaggucucugaagugccugaggaccgucugucuaucagaaguauaucugaacagacaagcuuugcuuguuucuccuuauccaucuuaggcuuagccuugaaaauauagacagauggguagauaaaguuugagguuaucugcucuacacuguaccugugauguuagaauaaaguaccuuuuaaagagugaagacauagagcauaaguuucagaauacaaaacccguuuuaacaaguguuaacauguaaugucuccaaaauuaauaccaaguguguuauuauauguuucaagguuugguugucagggccacccagcaagguauguuguguuuguuugguugguuugauuugguuuaguuugguugguuuuguuuuauuuuguuuucuugaacccauaacaggguuaucugccagccauguucuuguccuuaaucaagaugguggugaagccaugguuccacccucuuuaucccaugguaaagauggcaaccacuucguaaucuuucuggcagcgggugauuuaaguagcagucugcucccuaccaucacuguugccagugaggcagcacauggaccugggggcuguggguugggggcggggcuagguggcaccuggagcuguguguggggagguggucggcugcugaaacuguuguggucaagcgggcaggugagaaggcgguucacaagaauuggacuuauggaguuccgaccaauuuggauaaagcuuucaauuuuagaugcgguggcacccauucuucuaggcuuugccggggaccaaaggcucaaauguacaucgucugcacauaagccugggguuauacaguugggguugggggauuagccucaggucaaaugucuuugaacccaaggcucccccagaggcuggcuucugacacucugucuuccaaggcugcugggaggugguuacaccuggaguccaaagucugucgcaucaggggcagagaaagaugggggaaaggagugguccccuauucucacguggcaggggccucaacuccuccagagucaggacaccagaugauaaguuuuucuccacuggugaagugagccaauucaagccagaguaaagucaauuaaggcagguuuauuaggaagaaguucucaggugggcucacugguccuaaaguggggaaggagacaggggaggagggagagaaagagaaagaacaugugcacacagggagagagaaaauggagagggggcagaaagagaccaaaauguuuggauuauguaggagagccucuuggggaccggaagcccguguagggacugaggaaugcugggagaaccuggaggucaguuccugucuugguagauaaaauaugcauaugaaauaugcaccucagcuguuugucccgggucugaaucccaacagguacaaguggauuugacuaauuacgaguggcuugauaaaauucugcuuuauacuuaauccaggaaccaacacaagacagcagcccuucgaggucuuuaggcagcuuggaggagaacacaugagagaaagguuuguucuuccagaaugaaauucgugagaguuuaaaaacaaaugagccguagccaccucaaagcauaaagucuuguuuucccuuuucagaaucccaagagguuuuguuuucuuugagaagguauuucuguccagcugcuccaaugacagagauaccugcaccuuuguccuacuuccagaaugcccagaugucugaggacagccacuccagcagcgccauccggagccagguacagugucagugccggcugcugcugaggccggggcagcuuugcucuacuuugccgaaugucuuuucuuguuaaacauuaagcugaggggaaaugucacagccuuggugcuaggggaccccaaacugcacuuguuuuacucuguucugcggggggacuuaaccucaugucaccccaacugaaacuuugcccaucugcaugauauguaaggaccgcaugcuccacguuaucugucuugaauguacucuucucuaggaagaagugagugcauuguuuuauguuuucuagugcuggccaguuucugacagugcucgguaaguauuuagugacggugauuauacaaugcaagguaaacugcugggagcucaggagaggggugggauacaggguauauacacaaacucuucacagaccacacacacuaaaucugucuguuguaacccugucagcuaagcacuacugacuggaggcagacuccacagcaggccuaggagcugucuagggaaucgguagaauuuucugagguacaaccaagauggagggaaaccuugacaaggccagucucaggucugcaagccugccuuguguaguuuguacuugcuagugaaagcugucauuaaaggcaagucacaagugaggauuaggggagccuggagagauggcucagggggucaaagcaauuccugcucuuccagaggacccaagauagauccauaugagguggcucauaacugccuguuaacuccagcuccagaggaccucuucuagucucugaggggugugugugugugugugugugugugugugcgcacgugcgugcgcgcgcguguaugcaucaagauugagccuuaagacuuucuuuauacucugaagauuuagaguuccucacuuucccaucaguaaauuuuagauaauuuacugaauaaucucaguacgcuccuaccuuaaauguuuugggaggaccaggagugggaggagccuguagcuagaauguaagacuuugcauuuuaaaacuguuauaauccugaacaaguagggucaagauuaaagugguuacuccuaccacaaguauaauaaauagaaaucauuuuggaaaagacuaaccaaaucguucuuaguuggcagucucauguaaguuuaaucaccauuauuuguugguaggugacauaaugaggagaccauguaaacccucuuuuguuccacagaucucuugccuuuaccauauccuuguaaccucuuaaacagaggcaaccacaggcuucaggaguccagaaaauagugucuuaucuugggcugcuauguauuaaucuuacuaaugguaaagggacuugauguuugauaggugauguuuuuuaaaacccaaagauuucuaaaacuguuauuguacaauguucuaagcaucuaaagcagcgguucucaacguugcuaacgcugcaacccuuuaauacagcucuucaugucaugguggccccaaucauaacauuauuuucauuucuacuuccuaacuguaauucuguugcuguuaugaaucauaacauaaauaucggauaugcaggaucucugaugugugacccuugugaaaagguuguccaacccccaaaggggucgcgacccccagcuugagaaccaccgaucuagaguguagcaagcaaauacccaacuuuauucaaguuggagacuguguuauuuggcauauaaggcaauuuuuuuucaccccgccccggcccuauaaggcaauuuuuauuaagauuuuucugugucggugacuuuuuaaaaaagauuuauuauguaugugaguacacuguuguuaucuuccgacauaccggaagagggcacaggaugucauuacagaugauugugagccaccaugugguugguugcugggauuugaacucaggaccucuggaagagcagucagugcccuuaaccgcugagccaucucuccagccccaauguuucuguguuuuaaaagauuuucuaaucaggaauggaagugaugaugcaugacuuuaaucuucauacucaggcaacagaggcagguggauucugugagucugaggccagguuacauguuugucuguacgagcaucucaucaccuagauuggagugagaucugaugugggugcugggaccugaacccuggugagaguucuuaaccccugagccucucugcagccacaaggggcgugcagucugccuguggguaauuacugagaacgagugcggugcacugaggacuucaguguacgucgcugcugucgggacuucuuaaugaaaagcucacugcuugcucuuuuuuaauuuuuuucaguguucugguaaccauggcuguccuggagccuuucauguagcccacguuggccuuuaucuuaccaucauccucuuaccucagucucccauguguucagauaaaggcagagcuaccaugccugugaaaaacuucugccuuuaauuucucuuaaaauaacacuaugucuaaaccauuuuaguaguuaauaagauuuuuaauuuuggaaaccauguauuuuuaguaucaacucauuuuaacaguuuuuaaacacuuuuguuuucucuuugguuuuucgagacaggguuucucuauguagcccuggcuguccuggaacucacucuguaguccaggcuggccaugaacucagaaauccaccugccucugccucccaagugcugggauuaaaggcgugcgccaacacuacccgacaacacuuuuuucuuuuuuguuuucuaagaucgguucucuuuauguagcccuggcuauacuagaacucaaagcauauuuuacaacuccuuuaaaaagauacuuaaacuuuauuuuguuuauuuuuaaaagagaguccauccuacuguguagacuggacucuggcccaccggccuuagcuucccaaugcuggcgugaugaucgacugccacuaggcccaguuuguuuugauggggccuuguugaauugcccagacuggccucaauuucaagaucuuccugccucaaccagaaaguauuagcauguacuacuguaccucgcugacagucuuuaagaauggcuccauuguggaauaauugccauaugguuaacuauacauagaggauucaaugugaugacuuuuuuuuuuuuuuuaauuuucaagauaagguuucucuguauaacaguccuaucuguccuggaauucacucuguagacuaggcuggccucgaacucacagagacccaccugccucccaagcacugggauuaaaaggugugcaccaccacuucuggcucaaugcgaugacuuauagcaugcauaaauacucguaaaaauccauaaaauucuuuguagugaagaaaagagcaggccucauuacccccaaguugcccauguucccuuugugcuguccccaugccuuuccccaccccuagcaaccacccucaggucuuuuugucaccucccucugggguuacucuuccagaaguuauauaaauagagccaugcugggcuggagagauggcucagccaucaaaggcgaggcucacucaaaauuaaauagaaucuuacagacuuuuuuugucuggcuucuuuaauuagcauaauuauuuugaaauugauggguguuaugucaguagucuuguuuuauuucugaguuguagccgguuauaugcuuaugccauaguucuuuggccaguuccuuguuucaauauuugggggagguuucaauuugacauauuacaaauauucaguuacaaaacuucaaauggucaugugcucauuuauuucggguaaaugccuaagaguagaaaauaacccaguguugcaggcuguggugagcuucuugagauaauaccacuuuuccaaauugguugaauaacugcauucuuggauucuugauaugccucgcagccaccccacccucgucagcccucaagggucagucccaagcuuucaaaccuuuuagaauguaugugcuagcauuucuuagucuuuaauuugcauaucucuaaugagcaaugguguugaauguuuuuguuuaucacgcugaugaaccuucuccagugagaugucuggugcagugugcugcccauuuucaaauugugaggacucuuuauguucuggauauguaaguuauaauacauauaccuugcaaaucauugaauaucagugaaguccuuuuugucauuuuuuuucucuuggaaaugugggguuucuuuuuuugugaaguuaucuaugaaaucuuauccuguuuuuuaaguuucuuuccaaaucuuuuuuuuuuuuuuugguaguuauaugcuuuauaauuuaucuguuauuggguaucaugacacacacuuguuaucucaacuucuuauuugggaagcuggggcaaacccagcucacagcccaggcucaaagacaacuuucauuuagaucuguggucuguuuuaaguugauuuuguguauguaacacaauaugggucagaguuuguuucucuguggauguccuugaucagcauugcgcuugaagaagacuguuguuugcagugaagugucuuugugcccuggcacacacugguucacagaucuggccucgauucugucccacugaucaguuagugcuuguaccagugacacauuccugcuauuacuguaauuguauauuaggucuugguaucacuguuuaacaagguggugguuauuuugguuuugguucuuaauaaaauaguugggccuggucguacacaucuuuagucccaacagcaggaggcaggaagcagaucucugaguucaaggucagcuggucuauuuacuuuguauauuuaaguccuaagugguuuugccaaucacuuugcaaaccuuucuuuuaaaaggccaacuggcaguuugugauugcauugauucccuuccuauguuguguagaggauuuuuggaacugauauuuucuuuuuuuuuuuuuuuugguuuuucgagacaggguuucucuguauaguccuggcuguccuggaacucacuuuguagaccaggcuggccuugaacucagaaaucugcgugccucugccucccgagugcugggauuaaaggcaugcgccaccacacccggcggaacugauauuuucauaaugcuggucuuauuccaugaauaguauaauucuauauuuauuuagaucuuuuaacuaaaauucuugauugugguaaauaacacaaaguuuaaaguuuaaaguuuaaaguuaccaucucauccauuuuguuucuguuuuuguuguuguuguuggauuuuguuuguuuuuguuuuuucaagacagcauuucucuguagucuuggcugcccuggaacccauucuauagaccaggcuggccucaaacuuacagagauccucugccuucccauugccaggauuaaaggcacaugccaucacugccugacucaucauaaccaguuuuuaacucauaguuuaauauuaaccacauucacagugugcucuagaaccauugaacugcccugccaucugcacgaugaguuaucuuuucugguucuuagugugacacucuagaucuugccuucuccugguuugcuuacuucgcucagugccgugcacucaagagucacccaugucauagugugacaggauuucuugucacauuuuuauuuauuuauuuauuuuugguuuuucgagacaggguuucucuguauaguccuggcuguccgggaacucacuuuguagaccagccuggccucagaacucagaaaucugccugccucugccucccgagugcugggauuaaaggcgugcgccaccacacccggcucuugucacauuguuuuccuuccuacucccuccugucuucuuuccaacauagccaggacuacaggugugcacaccgugucugccuaggaguucuuuaaggcugaggaauucucuauugcauauuuauaaugcuuuuuuuuuuuugguauccauugucaauggauguuugaguuguuggacuucugccaccuggcuauaaaggauagugugcuucugugaguauggcuaugcacacuucucuuugaaauccucuuugcaauuaaguaauuuaguaaauacacucaaagugggaucacuagaucauaugcucuuuuuaauuauuuugagcagggucuugguuugccccaaacuuaauguccuucugccucaauguccugagugcugggaaugcaggguugugccaccauggcuaaccccaccuaccucaggaauguugcucuccuuagugguuguaucauuuuauguaccagaaaacaaaguaugagggccacaguuucuuuacaucaccacuugucauuuccucuuuauuuuccuagagcugcgucucuaacuuggcaagcccuguagacugagcuacauccagccagucuuugguaggggugguuuugaugguggcuauccuagcgugagauaagcuuugauaugucccagagagaaucugccaagaguuucuugcauuuguagauucccuguucuuugcugcuuguuccuuugaugcacuuugugggugguguaguuguuuguuuugcuuuuguuccuuaauuucucuuagcaccguuuuuguaauuucgugaggacaagacauuugggacaggagucccuagacuauucuugguucuguaauucagugggaggccucauagaccacaggaaaaugauaguguucacuauuacaguugauugcagugaaagcauacagauuauugccaggcgugguggcacauuccuuuaaucccagcacuugggaggcagaggcagguggauuucugaguucgaggccagucuggucuacagaaugaguuccaggacagccaaguauacacaaagaaacccuaucuugagaaaccaaaaaaaaaaaaaaaaaaauacagauuaucauugguaauagaagaaggcacuucaggcaggccagagggcaccugcuugagauuccaguggauuuaugcagacagugcuuaauucuccuggcuacagcaugugacaacacccuugcaguauuuucaaccaggggaacaaacucaagccucaauggccaagguuuuuacuguuagcggucuauacaaacaugguuggccuuuguuuucuacccccuuuaggggccaagcuaacucugaccuccuccgagaucacagucuagguugcuggugugucccaaggcaucuguaaacagcccaauaggcuacuccaagggcuugcagaccccuccuggggucugagcagcgcagaagcuucuuggcaggggccgggucuaggagacccuaagacacagaguucguagcucuacugcucagugggaccguaaaucuuucuaaccacccggcuuggcuuucugaugucuuugcgguaaugcccaaaaggaaucacaucccagguguuccuuuaccaccuguuuauucucugcagaguggucccagacuguaguaauugugcuuauuugugucccuugccccagaguagcucaggaguccaggaccuugucugucucacuucacugcucaguuccuggcucccagugcccuguguucaagugacugagauucagcuccgcccccccccaacuccccaccucccaccaacacacacuguagcaaaugcaguaaucaguacuuagaaacugaaacaaguuuauguaaccagggaauggcaaaagacacgaauauaguuuaauuuuuaaguuuuuuuuauauguaugagaacaggcaguucugagcuaccaugaaaguucuaggaacuaagccuguguccuaugcaagagcccuaaguguucaguaaaaauuaaaauuacacugagaccuuguaucucaccuaccagauugguaagaaauccaggcauuagcucccaugauugugaaguuaacaguuuucuacacuggcaaaacucuaaacuggcgcaaucucucagaaaugaaggcagguuggcaaauguaauagaauuucaaauauaccuugauucagcaguuauuccucagagaacuugcucuacaacugcauuggguaaguauauacgugucgcuaagugacuaaggaggccugcccugcaguguuguuuguaaggcaaaagguuggaagcaaauuagauuuccacuguuagggaucaggcaaauaagcacagugaauuucuacaguggcugugugacugccuagaaagcuaagaaauagaaacaugaagagacaggcacagggacacaggaccuauagucccagcuccuucagaggcugagacaggauugggcauaaguucaggacuaacuuggaggacagaguagcaagccugucucaaguugaaaaaagaaaaagaagaugucuuuguuuugguguguaagaaccucugagugcaggagcaaagcacagccuuguguagcgggggcgcuggguuccagcucggcucaguagcacucagaaguugggucuuacgagacagcagcucaggagcagggagaccuuaaaccuucagaagaaaaugaggaacuguuguacacuuuuucauacuuucuuucuuuaaaaucauuuaaccuuuaaaauaaguuguaccuucuaaaaguugaaaacacaaagacuaaguaagggcuaagagaaagagcuagugagugugagaccugugugagagaaaaccacucgcugcuaaggaggccacccgcuccuagaccauuuucugcuuaggacagggcaggguggggucaugcucuguacaaaccagaauauccaguguaggagcgaucuauucuggccuaauuaacuguucauacagacagaugccagggcuguggcaccaagaaagucacacccauauuuaguucaugguaaacauuaauucaucauuuaguuagaauuguauugcuaaacgcagacaucacaguuuuagcuguugacaugaucucuuccuucucugggaaaauagaagccuaguuuauuucugguguguguguguguguguguguguguguguguguguguguguaugggugugcuuuagucuuuaugacuuuauauugcucacaggauaaagucucaaguccuugauagggcaaauaaaguuuuuuauaccugucccuaaaaggaccuuuuuaaaagagcagaguuucuagagccaggacccuuucugugggacugcaguuggaggcaaugcuuuaccucugagcuacauacccuuuuuaacauuuuauucugagaccagggacuagcacauugucuucaaacuuguacuuuuccugccucagcuccugaauucugagaacuguaggugugcccgccacacccagcucagaguccagagcuuacugaugucacuauugcuacugcagagugucugggauacaguagaagucuccugacuacuugugggaccgugccuuagguacuuuucuguugcugugauaaaacaccaugaccaaggcaaauuauaggagggcuuuauuuggguucauucuuacaggggcagcauagacgaucaccaucacccaucaugucagggaaguauggcagcagacaggcagaguggcugaagcaggaaguaauagagacagacagacagacaugcagacacacacacacacacacacacagcauugggaauggagaggcuuuugaaaucacaaagccugcgaccacaccucuuaaaccucccaaauagcaucaucaguugaggacuggauaugcaaacauuuaagccuauggggagcauuuucacccccaaagaugggucugcugcaagugaaauuaaagagacccuuagcccccuccgagucucccaagcucccauacuguuuuggaaaugauagauuaaggagaacauuuuucuggaagcaggcuguccuggguucagacccucugacauucacuagcuaugucuauuucuucaccuguuaagggauggcaauagagugaaaaaucaaaggauaugcacaugucauagucccuguuuuauagaaauaauuuuaugcuguuacugaauguggaguguauuaguauugugugcgugugugcgcacgcgcucaugugucuggagguccgaggacagcguuguggagucuuucuccucccaccuuuauauggguuucagagaugaagcugggguugucagacuuggaccgauggguggcaggcaccguuauuugcugagccaugugcccauggagugugcugcuaaugaguggcgguaagacuccacaguaauagucacacucuguaguugaaagcugggcagugguggcacacgccuuuaaucccaacacuugggaggcaaaggcaggugaauuucugaguuugaggccagccuggucuacagagugaguucuaggacagccagggcuauacagagaaacccugucucgaaaaacaaaacaaaaacaaaaaaaauaagagagagagagauugauuugaaggcagguuguguuuucaaucaccuuccugaaagaacuuagcuuaaucagguacuguuuaccaacaguaacuauuaacacuggaaguuggcuuuccuuccaucaugugguuucagggaauugauuguuagguuugccaacaagucccuuugcccucugagccgucucaccagcucuguuacuguucuuuuuauucauuuuaccauuggaaaaauuuguuuuaacaaaugaauuuaaaaauaccaaaauaaauuuaaaaaaugagaaaaagccaggggccaaugagauggaucauuggauaaggucacaugccuucacauaucaucauauguacccaaguaucuguacacacacacacacacacacacacaccaccaccaccaccaccaccaccaccaccaccaccaccacccacacauacacuuaaaaacacaguaaagccgggaauugagaccuaguuugguaauggaaaagcucuugcugagcauguauggagcucuggggucaguuuuuagcacggggacaggaagcuaagcacagcaaaaaugagcauaacagcuccugugugagcugcugaaacacgugacggggucagcccugcaaagccaaagcugcaggacuucaugacacagggcgacaacaggauguuuaagaggacucccagugagcguccaguguugauaguguagcagaagccagaggccucgagccagaccaaagacucgugcaaugaacauuugcaagugaagcuguuggggcaaagggguauauauacugugggacacuccacagcgucccugggagagucuuuguuuuauuuucuuuugcaggggaguuugcgagauuggagggcaaauacggaaagacagacaugagugggacuggggugcauaaucugaaacucauaaagagucaauaaaaaggguuuuuuuguuuuuuaaaagaaugacuauaacaggaugagaccuggguuuauccaaggaaagugggauuuuaaaaaagauuauaaauucauucaguccauccaucuagcauuuacguucuuucucaggcuuagugagggcgggaagaugaggaccgggaacgugggaguuauugaaggccugcgugcuguugaggagagugcuuguuugguuugguuuggaguuagggucccucuggguaguucuggcuggccuggaacucacuacaaacaggcugacauuaaacucccaaaugucaggauuaaagauguggcuaccaugccuggcugggagauuuuuuuuuuuuuuaacuaagcaauuuuaaaaagugauuguagucuuaaaacaauuuauuuauuuuaugcauaugaauaccauguagcugucuucagacacaucagaagagggcaucagaucccauuacagaugguugugagcaaccaugugguugcugggaacugagcucaggagagcagucagugcucuuaaccacugagccaucucuccagccccauaauuguagucuuacaugguguugugagaaagaauauggagagauaucuugaacaccacuauaugcuuuuuaaaguacuauuaauaaugagucccagcacucgggaggcagaggcagguagaucuuggaguucgaggccagccuggucuacagaaugagacuauagccaggacagcuuggaauacaugagaaaccuugucugggaaaauuaaaauaacaacaacaauacuaaaaucagguagggaguacuucaugaauuugaaaagaugagauuacuaaguuuguagcugcaugaagaacauuuggaggcggaaaguuggcucuguggugguuaagagcacuugcucuuccagaggacccaaguucaauucccaauuccuacauggcagcuuacaaccaucuuuaacuccaguuccaggggaucaucugaugcccucuucuggccucuguagacauagguguauguguggugcauagaaauguauggaggaaaaacaccuauacacaaaauaaagaaaucauaaagaagaaguguugguacaaguauauaguauuuaagccaagccuccaaaggggggaaugguugccugaggaggagaauagaaggaggggugaagugagccaggacccagguaagcgggagggagggccuggcuuccucggggacagcaguaaauaauaauccagacauuagcacugucuguaaggaguccugguggagccguuaccacacaucccagguguaugucuuccaggaugccuugugcugagaguccggcuuacugaaugcauuucucguucuuuagaaugacagccaagaacggcagcagcagcaugacaggcagagacuugacaacccugagccaauaucuaaugggcggccccagaguaacucaagacaggugguggaacaagaugaggaggaagacgaagagcugacauugaaauauggagccaagcaugucaucaugcucuuuguccccgugacccucugcauggucgucgucguggccaccaucaaaucagucagcuucuauacccggaaggacggucagcuguauguauaagugcuucguucucugggcugguguggcuuuuccucguagcuuguuguuauccucucaaagaucuguggaccaucuuccaucuuuccugauggccagaggcaguggggaugauggcagugaugaugugaugucuugguuuuguuguuguuguuguuuuaguucuaaccuuuugaauucuuacuugugagccagcagacaugguagcagggccugaaauccuagcacuuagcaaauggcucauggaaguuuagagguuuaggaaccauggcuuugggggaccaccauguggugauugagacacaagcaugauggcauaugccuaaucacuuggcagugagacgggucagucaggaacucaaguccaucuugugcugaugcagauuccaggccaggcugagcgacacagcaaagcaaccacauuccuauggucccuaucuuggcuuguguguuaagucuuuaaagacaacugccuucaucuacugggaguagauccuaguauuucucauaacagccuguuuucacuguuucucaggcuagucuggaauccacuguguagucuuggcuagucucaacuuucugauccugccucagccuccugagugugaggauuacaggugugugccaccauacccuguuuuacgagacuguuauagaaacucaaaugacauuccucuuucucccacagagcagugcagggguaggcaguccagauugguauccgggucuuuuauucacaaagcaugugugcuccucucuucagcuuagguccuagauuuccuuaggguccagacuagagccucaguuuucauuugacagcaggagggaguugagaaggggacauaggcaucauguagccgagagcacucccugcaggaacuaccucuauagcuuguucagaguuccuuggucacuaugcagucucauggccacaccugcuguaagggcagaaguaaggucauugugcuggaagccuuggcacuuggaauuaaggcauuuuuauguggggcugucgagauggcucagcaguuaagagcacugacugcuccucuagagguccugaguucaauucccagcaaccacaugguggcucacauccuucuguaaugggaucugaugcacucuucuggugugucugaagacagcuacaguguacucauauaaauaaaauaaauauuuuuaaaaaagguauuuuuauguaaaugaaauacgagaagacaacuccaauaauggucacccuagagauaaaaaaccauugcuuaaacccugugaccucucucuaauaacuguuguccagccuuaguaguuacuguggcagcaucugguuauuuaacagagucuauuaagcuauggagaaaaccuugggugagaucauuauuucagaacaaagcauccacuagauggagccagugccuaccugugaguucaucucuucauagucuauuuccucuuacucagaagacguuauuuuagaggauagcuauuuuucuuaagcuaaaaacuauuggguacaggguuggagaaaugguuuagcaguuaagagggugcaccacucuuguggauguacugagggguccauaacacccacgucagagagcucauaaccagcuucagggauugggugccucugcccuucaugaacaucugcccacauucacgcaaugcacacacacacaauuuaaaauaaaaauauaugccuacauuuaaaaauauuauuugagugcugcuucaccccuccucccucucuuuagcccucaccuuucuuacucucuagcccuccuucucucucucccuuccccucucucuccacauggccauggccggccucucucucucuuucuaccuucucucuuuccccugcauuucuacaacaaagcucuaaaaccauuuaaaaaaaaauauuaccuagagcuagggugguacagaccacaaucuccacacuuggaauucaaaggcaggaagaucacguguucaaguacagccugggcuacauggugaguuccaagcuagcuugggguuucuuauuagauucugugucaaaaacuaaccaaccaaauaaaaauauccuugguugacugaugaccugcaaaaggcaccuucuaaaagacucauuaaaccgcagaccucacagugaauuacaguuuuaagagugugcuguuugacauaugcauuaacacucugguguuuuguuucccucuguagaaucuacaccccauucacagaagacacugagacuguaggccaaagagcccugcacucgauccugaaugcggccaucaugaucagugucauugucauuaugaccauccuccuggugguccuguauaaauacaggugcuacaaggugagcacgaggcagucugcuguccgccuugaccugccuauggguuguccuugugugugugggaggggaagggugggagaguugggggcgggggagauguguaugcaggccugugcaugucagagugugcgugugcaguugguaggaccacuuuguggaaugcaucuuuuccuuccaucuuugcuuggguuuuggauaucaaaucuccaagcuuguaagcgucacguucugagccccuucacagccuccuugucuugacuuggucuagcaaagaggaagugucuuauauuuuggaucuaaguuauuuuuccuuuuauucugaagcauguugaaaguaccagaagacauacauggaaaacagguguuuucauguaaggucacauguuuucaguauuuugauuuauagugugccuauggcauuccaaagacuuuuguauauauuguccuuaacaaauagugcuauagaauuuaagugccccauaagccaccuucagaugcugcuacugaacgcaguagugacuggccccucacuugagaaccagcaucauuugcuuagucucucagagcagcccugcuucuuaccuuggucaaugggcacagggagaaguugcagcagagaugcaggcccagccucccagccugucccccucucucccucuccuccccucucuucucccucucuucuccccccuccuucccccuccuccuccccucccucccucccucccucccucccucaguaagcaacugcguccuggaccucagccacccagcacaugcuucauacucaaaccucagaaaaucaacaaaucaauacuggucauggaaucuucaggucguccucaguaguaggaacaguaaauguuaacucuccguauugaaguuuacucucugucuacauuauuuucuccuagauuuuucuuugggguuuguuuuguuuuguuuuguuuuguuuuuugagacaggguuucucuguguagcccuggcuggccucaaacucacucuguagaccaggcuggucucaaacucaaaagauucaccugccucugccuccccagcguugagauuaaagaucugcgccgccaccaccugacaaauagcguguugugcagcgguuuucuccgcacgucucacugcaccugugucugucugcuugccagucuuuaccuccuggucccuuucuuggccuuaguggacacauccuggaccucagcugauuagggaccaggcuuguucuuuugccuccuuuuacgauuuuauuggggguagaauucugccuucuuccacguuuauucucccccacuuccagauuuccugccuuucauuuuucaaaguugccuguguacuacauacagagguguggacucagcauugaauuuccugagaguuuuuuuuccuaguaaucuugggaaguuacuuaguuucuguguacuuuuacauuccauauggagaaagaggccaccaucuguaaacuaccucuccuugccucuguuuucaguuuuuccugcacugaucuguugaugacaauaagccaacuguauggacuaugugcguacuccguguuucauuuggcaucucacgagcagugcaugcgcacaccuccuacuuucccagcuguccagaugaggcgugggggcagggucacaguugcugugggucagagacuaaugaaucaguuugggaauucgcguucagaauuuggccuugauugacugacaggcauuauguaaaauuccucucaaaccuaguccuucuuuccuaaaggccaugguccuuggcgcccccauggaaucuguuuaucugcuuggcaauacuucccuaguucuauccgcugccuuugcaaacuugguuuuucuggauccucucgccauuggcuuguuagugugcguucugaccuugguuccuuuccuccucugcaguuccccucaggcucacaacccagucccagacucuggaggcuuuccccuccuuuguuucucagagagcccugauuagggcuggagaaaugguuuauccguaggagcacuggcugcucuugcagaggacaugaaaccgaugaauuuaguuuccuacucccacgucuuggcucauauucguuccucacucuguuuccaggggauccaacaacaaccucuuuuggcuccugggguggcaggcacaaauggcacuuacugcauacauauacacacaugcacagggaaaccaugcauacacauaaggaaaaaaaaaaaccuuugaaacaaaaucacuuacucucuggauuaauuuuguacccucagaucuaaccuuaaauuuuuuuaaaauuaaguuuauauaguguaugucauguggacauguauguuccaugcuucauauguagaagucagaggugaguuugcaggagucauuucucuccuuccauguugugugacagacuuuuccugcagcacacaucugcucgccagaaaagaugagcguagcacucaguagcaaaguaaaaacaacugagccggggucugacgagcgagccagugaggcaaaggacagacuuuuuucuuuucuuuuuuucuuuuuugagacaggguuucucuguguagcccuggcuguccucgaacucacucuguagaccaggcuggccucgaacucagaaaucugccugccucugccuccugagugcugagauuaaaggcgugcgcuaacacugucuggcaaggauauacuuacacugagagguugcuuacaaggagcagggaugauucaaaagcagcucugucccugagagggccacuccaaaaaaaaaaaaaaaaagcugccacccuggagcucccugcauggcugugggcagcucccagcuaccuuucugcauuugggcugcuagaaucuccaccccaagcggucguuugcuccuuuguauguuguugccgacugggccgcaggaaucuugugagguucuguucccucagcuauguggccuuugauuucguuugaggcuucuaaagggaaugucucagaucagaggaaaauaaaugucauccaagaggaccugccucaguugucacgccugccagcaagugccuucaccaacaaagcuaucuugcuguccugaagacaacuuugauucagugcuuucagccuagaagucauugcuuauuggacccaugguuuguugguugauuuauuaauucuacuuugauaucuacaaacacauauccuccauccccuuaucuucaauaggucugcuuugcuaacuuuuuuuuaaacuuuauuuacuuauuuauuuaauucauuuuacagucuaauugcugcccuccccucacacaguccccuucccccuucuccucugagaggguggaggcccccauugggucuccccccacccuaucacaucacgucuuugaggucuaggugcaaccucucccacugaggccagacagugcagcccagugaagggaacauauuucacagauaggcaacagcuuuggggacaucuccugcuccaguuuuugggguacccacaugaagaccaagcugcacaucugcugccugggugcaggggccugcuuugcuggcuuugauguugcuccuguucauccauugucuucuuucuuacuggucacuuccuuucccaaguuccucuaggccagucauccccaggcuagccuuucuacuucuuuagcuugauuucacgugccacaaaaacaaagguaccccagugucuuggggcuuuuuuaauuguuguuuguuuugagauagaaccucauugcauauucuggcuguccuagagcucaauguguagaccaagcuagccucagacucauggauuaaaggcaauacucagccaugccucguccuuuuaaugaaagugcuaaugcucccucccaucacccucuuuccguacuuaagguauauuuucaacuuccuugcaucuucuacgguuuguuaauacuguuacuugaaaucuaguaguuauaguuuucauuucuagaauuuauauuugucuguuuuaaagauguuagaucauuuuggguauaaucuuuuuguccagauuuaauuuuuuuccuauuaguuuccugucuuuaugauaucuuaaguuuuggggaaggauaauucuauugacuuuuacucauggugauuuauaccgugaaugagugauuucuggucauuuugaguuuauaucuuugaagaguuuauuagagucauuuugcaugcacgugagcaguugaagauuggcacaugccaaaaacugccuuugacccucaugccaccugaccugauuucuauuuuccuuuaaaauuuuuuuuuuuuuuuagggaaaagagggcuucuaagaauuuuuccuuuucuuugucacuucuaacuguauuugagauuguauucaacuauuaagauuagugucuucuagaaaggaacagggcggccaguucaaaauaaaacaguccuaugaggggggagugaggaugaucauaggaaagauaaaaaaaauauaugcaagggacagguaugggagggcugcaggucaauaccacaccagcaucaaguguauuucucauagccuucuuauacuacaguaccgagggaagcaaagccauaggcuaacagaaacaauugcugaaaaauacacaggugacaucuauucucauccaaaagccucccuguuccuuccaccaaggucaauagaaucuucagccccuugccuugagccucaagugcaccuccucuuauuguuccaugccucagcaggccaggaaaucugccaucagacccucaccugccuugauucugccuggcaggcagacucacaaacacacacacacacucacucucucucucucucucucucucucucucucucucucuccccccucucccucucuccucugcuuccaacauagaaaauuuuagagaaucuguccacuguauuuuuauaaauacagagagauggguucauuuuaguucagcguuuucaggguuagcaaaaauaaugucuauuguugugggcuacaggguauuucucagugguacuugcaugcauucuuagcugcccucaccuaacaggcacacacacacagcccuauccuggccagaguggggucucagcgccucccaucuuugucuuuucuacagcugcuaugccccucaaauccuggguugucuuccuacuuuggcaccaacuguuguuuugaccuucugucucaccggugguuagagugcacaugugaaugggauguguguguugggaugcaguguuguuuuuuguuuguuuguuuguuuggguuuuuuaaauauauuuuuguuuuguuuucaaguuaaugcugaacucauagaauggguugggaagugauguacccuccuggucucuuuucuucauuuacaccuaagaauuggaacauauguguugucuugcuguucguguuuauugagucuucuuucacauaaacagguuuuucuaguauuuauauauuguauaauuuggguuauaucuugggcacuuuguuuucaguuuuuaaaaaucaaguauuuuauuuauuacuaguucugucaagaguucaggccaggaaauuucauagugaaacucuauuuagaaaacaagagucuggagagauggcucagcaguuaagagcacuggcugcuuuuucagaggucaugaguucaauucccaguacucacauggaggcucacaaccaucuguaacuacaguuuaggaaaauuugacacccucuucuggccucugccccugacugacuaacaaacacacauacacacacagugcauaaauauacauguagacaaaacacccauacacauaaaauaccuuuuuaaaauagaacaagagucacggccacauacgcuuccugggagauagagcagugaacucgaauggcuuccagauaggauuucugguuucuugggacuuuucugucuuuguucuuccagcuagacacugagacuguuuccuggugucagggccaaaagcugggaagucagggagcuacacaagacucgucucauacccugaugaacaccggcucccgucagaaugaagauuuuguucucccuaagugcagggcuccagccuccucuuuccuacgacuuggggguggcugguggcuggcuuaagagagaccaguggaucuccccuugucuugcuagugccagcucuggcaggccuugcauggaagugagcagaaaggaaggguuaaaggcuacugaagccacgccacuugcacuuuccuagcucccugccuucucucguaguccgcagcuagcugagguuugaguucuuccaggugcagcuguaaacagagaagagaccguagaacgugcuuaauucugucagcuagaccuggccuucacauuugggucaguucuguacauguuuuaauuaugcuaaauuugaaaacaucuggaauguugguacccaacucuauuucuacccucguucaucugugcuguuucguguuguuuuuuaaugagucuuaggaagcacagccaauuccauacaagaauguuguuuacuuugacuuccagcaugaaguagagcgagcuuuugagccagacauucagaagcagcuugcugggaccuguuugcaagcaagcccugaggguuucucccagcaguguuugauuguacagugucugcaggaagggcgugggggcccugacagggacagacacagaagagccaguugguugugaugcguuugugacagaugaucuguaacuuuaaaggcaugagguuucuagcacggauggcucagguuuaaagagugcucagugcuggcagcagagcuccugacucuggccuuuggggagccgugggagcugcuaagcuggagacuugagaaggcuugcuugcuguugauuguccagacuaggggugcuccuuaaggcuuugacaaucauagcugaccagucugaacuggaaaguuuuacauccuuauuacaggcaaauuacaauauaaagaaugaaacaaacaugguaagucagaauguccaggugcccauagagaccagacaucuccugagaacuguucaguggggguucgaaagaacagcauaugcucuuaacuacugagccaucguuuuuuucuaacaguaaagacucuuccuacuuuuuuauuuugacaucaugauaguuccaaaaauuuaaaguagaagauagcuguucaauaaaagccuacacacacacacacacacacacacacacacacacacacacacacacacaaacacacauauauauaaauuauacagaaauuauuuuaaaagccugucauauaacagauucauuuggugcuaccaaaaacuuacgauacaaauaaacaacuacaaaggaaaccaucacuaaacuaagacacacaggaccuaugcuucauuucaggggaaaccccaaauaaccucuaucauguuagaggagccauguccaucugccauguucugauuacauacaucucuccaaacccuuuauugcucuuuuuguccauauuuuuuucuuucuauuuaugggccagaguaaauaauaaaaauuaucuuuauugauaacuguuuuuugacaagugaaugccaaaugaugucuuuuguuuauuuuuaaaaagaacuugggacuggugagagcucagcagguaagagcacugacugcucuuccaaaggucccgaguauguguauaugucuuucuguuucauucucugacugcacccaggauucucacauaaguaugugcugauccccaaagcugcauuuguucugacauuuaaaaggagaacauggaagccaggcaguggugcugcucaccuuuaaucccagcgcucaguaggcagagguaggcggauuucugaguucaaggccagccuggucuacagagugaguuccaaaucagccaaagcuacccagagaaacccugucucagaaaaagaaaaaguagacgauggacaugggcuagaaccaguaauguagcaguugccagcgugugaaaggcugguguaccccagccucgacgaaggacaacuagaaagcagacuguagcacauacuguuucucauguuaaaagucuccuuguuucuaaacugugggaucuguugguuacauuugaguugucucucuucuaggucauccacgccuggcuuauuauuucaucucuguuguugcuguucuuuuuuucguucauuuacuuaggguaaguaauacaggguuuuggucucucucuccauuaacucugacauccaccacucccuuagagccauguaccuugcugaugaauuagucuaaguaaucauuuuuucuacauacuguaucuuaacagguacauaaaagaugaguuaguguuggugauggggaccaugugccacaguaugcauguggcagucagaggcuaagugguggcugucagcaggguuuucccuagagagaaguaugggggaggggagaggagacuuguuacgagucuuuauguaaauguauacguaccuagcuaagaguugagguuaguuucauuuuagaauaccugaaauucuuaguauaauauacauugcaaccucauucagaaacuucaacacuuuugcuuuauuuuagaauuuuaaaaaaggagaaaaaccaucuuccuagacagccccaugucccacaguuugugcuugaguauauucucucuccuuugcuacuuagggugucuacuauaguuacaaucuuguagaugauagaguuugugcuccagaagguaaaacaguuuucuuuauauagaaaguuaaccagggucugaggagaugacuaagaugacaguguuugcugaccugaagucacccaugaagaccugaguuuggaugcucagaaccuacauagaagcagaccagugcagggacaauuuccuguaacucuagcaaugggagucagugacagauagaucccagggacuugcuggccagccaagcuagccaaaacagcaagcaucaaguuuugugucaaaacaauaaggugaaugucaacuucuggcuuguacaugugcucuuacaggcacacucacccacagagagcacacauggugccaggcagcgggcuagcagcagcagauccaugcuggagagcaugcucagugcacacgaggccuugagguccaucccagcuucacacagacaagucuagucauccuucuagagagugauaaaucuccugcuguauucuuagacacuguucucaucagugucugaugauguuauauauaguauuauaauguuauuaugaaauaauaucguuuauguucucacuauucauuuuuuuucuaauuucagaccuuuaaaguagaauuucauaaaauacaguaugauaguguaggggauaugauuuucuuuuuguaguuuuuguuuuuauuuuuacaggugugaccugugauacuaugugcucauuuaugugaauaauguaauaccuguuagaauaaguucugcuggaggaaaauguguuauuuaagagcaaggugcuacauaaauaacagcacagcauaggucauaggaaaagcaaauauggaaugugaauaguuaauauuucagaaucuucgcucuaaacaauguguucaugagaguuauugcacauaagucacuucaaauccuugcgugauuguuuucagggaaguauuuaagaccuacaaugucgccguggacuacguuacaguagcacuccuaaucuggaauuuugguguggucgggaugauugccauccacuggaaaggcccccuucgacugcagcaggcguaucucauuaugaucagugcccucauggcccugguauuuaucaaguaccuccccgaauggaccgcauggcucaucuuggcugugauuucaguauaugguaaagcucaagacugacacuuuguccaucacagacucacucacuggugugcuuuccuuccucuucuaguccucuugauuuaaggaaacucuuaaugcuuaucucccguaggcuccagugguuuuccuguuacacugcuaaggauugcaaggcaagugcuguggccugagccccagcgcagccugagagugagaguuuguaguuccuugggacucugagcuggguugaugggaggaggcccugcucagaaggcuuagguucagaacucuucuacccauaugugaggggcuggcuuuaguccccagaccccaggaaacaaagcagcaaagccaccagccgccaccagcaguuccccugaauuuuguaaguugggaacaagucuccaggcuuguaaguguucagcgagacgguggauacugagaugugcuagcagcaggcucacacuguaaacuguucagcucauguuugaaacuguauucuauuuugggggaagggcuuguguccugacugaguguagaggucagaggacugcuucagcagugagugcuccccucccucaggggguccuggggaccaagugaacggagaagggcaggcaugguggcccgcauggcuacugagcugucucacugcccucaguuaaucuucucccuccagagucuuacuuuauuuauguguagugcauuuugccuguaagugugucugugcacugccugcauuccuugugccugcagaggccagagaaggggcucauaucuucucaauucauuuuuaagaucagaaucauauagcaacgugagugcaaucaccccuuuaaagauuaaccucauccugacguguguguacaugugcgaccucagcaccgggagguagaggcaggaggaccagaguuucaggguuaucuaugacugauguaguaaguuucagaccagccuaggccacuuuaaacccuuuuugaaaaaaaaaauguuuuuuaacuaaauaaguaguaaacuauuaaggguaguaauguccuccuguaaucccagcacuugggauuacagcugaaggcagaagaauuagaaguucaguccaggcuauguuuugagagccucucuggagagaaaagcaguucugagagugagguuuacauuuguaaaagaauuccagugccuguuuguuuauugcauuuaaauucuacagaaagaccuguguguagacuccauaaguguugugaagguccucaguaaaauccuauuauuuuagcugggcaaugguggcuggugcacaccuuuaaucccagcacuuggaaagcagaggcagguggauauccaugaguucaaggccagccugaucuacagagcaaguuccaggccugccagggcuacacagagaaacugucuggaauaaaaccaaaaacaacaacaauaaaaauaaauuuaaaaaaauuuaaacauacuuuuuaacagcugcuguccugaaaagucacaauaauacucuagccaugguaacggggccuggcuuuauccuccagcuguugcgccacaugaaagccaaaaaggagucuguugucagggacgagucaguggccacuguuuuacagagcaucuccuuacacugaggcgcguggugacuggaacuggaaacucgucccccuugagcugauggagcaaagccuguggcgcuagaaccgggccaguucuguuguccacuugagcaacugcuuaagucaggguuagaaaagucacccuccacgccucaccuucauggcaacuucaucuugguguuuugucagucgcugagaguaggaguaccauuguaagcuagagagacucagccagaaaaggacuuaucaccaagccugacaaccugacaagcccaggagucacaaggcaauaggagagaaccaauuccugcaaguuucguguacacacacccuugugcaggcaggcacaauaaauaauauaauuuacaaucccgccccgggagucggcaagguaguuaucauagggcuuuuguugcuaagaagcuugaagguuacagagguaaauuauuugccuggucgcuugcauguggcuugaccuaagagucugaauucacuccaugaguuacucucuccacgaccuucagccucugcucacagcacaggggagaccccgcagcuucaggucuucugaguguggacgugcugggcacccaguguugacauagugacucucaaccuguuccuuacaaggucucaaaauggucuaucagaaguguucugaagccuuuuacguaaauuaauuuucauucauuuuaauugugcuaaaaauaacugaaucuauucauuucaagauucuauaaggggaaacaugucauaaaaccaaaauagguacaggauguggcagcuuuaaaacagcugaagaucucauuaguugcaagcacaggaaagcuugcuuuucucacuugaacauguaaauggaaguguagaggaguguuaccacugugcuguuuuuacguucugcggggagugacugaaggccugaaggaagugacgucagcugucaagucucccauuccuguuuuaccuauaccuguuugauauuuuuaaauguuugagguuuucugcauuucuguaacauagaaaaugaaagacaaacuguaguuuauggggggaaaugguguuagaaccagacauaauuuaggccuaucagggcuucucucagaucaguuuuuaucaccaccagauguucugagaccuaaauauuugugaaauaccuuaaugacuagaaacugaagaaauauuaaauuuugucauauacagagcuaucauuuuauuuaaguguguugcucuauuauggcaaauuccuucguuaugucuacuugcuuuguagugcuagggauugagugcaggucucagggcuguucaaguaagugccgaaguagcucaccccuccugcugucuguaaagcaggacacucuccagccagagcagcacacacacacccuccugcugucuguaaagcaggacacucuccagccagagcagcacacauacacccuccugcugucuguaaagcaggacacucacuccuccacucugcucuugguacuacgaaaaguugaauauuuggaauggugucuauuuguaauuuauaggugaauuuaaaaaacaaaaaaccucccugccauuucugcuuguuccacaaugagaacuauucuagaauaguucugucuugcugucucugccucuuuccuucaggcuaagaagaaacaugucuagaccucaguaaucacacacuguagauugagcacacagugguacggccagaguauaauuuacacaggucuucuauggguucuguuuuauuuuguuuagguugcuuuuucucuuggcugcuaaacugcaaauauuuucauauuuacccaacacuuaaaaaaaaaaauuagacuuguuucuucagguaaguccuccccugcguauauccacuuacacaaucuagucaguauacuuuauugggugucuuuuuuuauuuuucucuuucuagauuugguggcuguuuuaugucccaaaggcccacuucguaugcugguugaaacagcucaggaaagaaaugagacucucuuuccagcucuuaucuauuccuguaaguaugcuggagcaaugcuguguuagugcauucaguguuaaggugcccguggaggucagaagucagaagagagccuuggaucccuggaacuggauuuauagaugguucugagucaccauaugggugcugggacucaaacccaaguccucugcgagagcagccacugcauucauggcucaacccguaagccaucucgccagccccaguacauuguuuuauguuuguuucuuaaccugcaaucuuguaugguuuuaguccugaguuacuucugcacagagaccauuguuuucuguagagaagugagccucuugcuugcuagagcaguguccuggguuuaggaacucaccugcagcuuugucuuucucaacagcaacaauggugugguuggugaauauggcugaaggagacccagaagcccaaaggaggguacccaagaaccccaaguauaacacacaaaguagguggagcuuguuuauaaaugcccuaguuuugcagguccauugucauuuguagauaaauaauugaaaugaugaaggaguaauuuuaaccuucgaagucuuuggucacacucuccuugcugacgcucagggccagagcacuugucugagaagcccuggauguagggagaaucgugauaaggaaagauaucacgagagucuccuagagaaacaggcucucccuaguaaguacacguaggacuauucacggagcugaaaucccccccccccacacacacacacacugugaguucaagacuaacccugacuguguggggagaucuugucacagaaaggggugggagugcaagggucucuuguccaguauguccagaauaacugaaaacauuaggugggagugcagucaagguuacacuaggaaggucaguaguauuucaguggccuggguaauggugacaaccaaggacugugauacugcagaaggcacuaaagaaaacaucagaagcucugucagaaagaagugaagaacagggugguguaaaacugaagcagaaaggagcuuucuuaaaaagacaaaccuuagaaaguugaaaaagaaaaguaagauguuaggccuaauuaaggcuauaggccuaauuuaaaguaaaauaaauuuuaucuuauaugcauacauauguguauuuauauuuauguguuugaguguuuggccuacauguauguagugcacauacauggcugguaccuguggaggucagcagaggacauccgaugcccugggcuugggugcuagugagccaccauguggacacugggaacaaaccccaagucuguuggaagagcccucuccagccccacgugucauauugagcuaaagagaaaagucgugacugucugccuuaaucagggucacuauuggggugaaaccaaaccaucauggcuaaagaaccuugggaagaaagggguuuguucagcuuacacuuccacaucacuguuggucagcaaaggaacucaggacaggaacucaaauaggacagggaccuggggcagcggagggcgcugcuuacuggcuuacuccccauggcugucucagccugcuuucuuucucuugaacuuguaccaccagcccauggaugucccacccagaauuggcugggcuuucccccaucgauuacucuuuaagaguaugcccuauagggcugccuucagcuccagcucuauuguguggaggcauuuucucaauggagggucccuccuccgugaugacucuagcuugugucagguuggugugguagccagcacauuauuucuuguguauuuuuggugaguuaacaaaugcugacugauucccuaggagugugcucaauguuuuccuaggcucuggggagagaggacugaacaagaugcuuccuguugguguucacaagggugcagguucuucacgauuccugcucgccaccuuugacauacuggguugucggcugcccucauuucccugugguccugacagucacagugcugggcauagccagaccgcaugcagggaacauggaagccauuucuuccuuccuuaaaaagaggaaauaaaggagaaaaugucagcccuccuagacauugccacaucauaguuccuccacuggagaacuuacauggagaaaaggaauuccugugcuugccuuaacugauacuccgcccucuggaacguggcggcgauggucuaaggauuaagugcucugauuaaccuucucucuuaaaggagcggagagagagacacaggacagugguucugggaacgaugaugguggcuucagugaggagugggaggcccaaagagacagucaccuggggccucaucgcuccacucccgagucaagagcugcuguccaggaacuuucugggagcauucuaacgagugaagacccggaggaaaguacgugcaucaccucugccugacaucacggcggugacaucacggcggucugucaguggcaggguuaucugucuuucagaggauguugaguuuuucuggggaaauagcuuauucagguguuugccacacaaacauaagaggcugaguuuaaucuccagcacugugugugugugugugugugugugugugugugugugugugagugugugugugugugugugugugugugugugagugcgugcauggccucagacaccugugcucccagcacugggcagguauagacaggacgaccucuggggcuugcugaccagccgcucuaacugaaccauuccaguuccgugugcuaugccagcuccaaaacuaagcuagagaaugauucaagaagacaccaggcaucgacguuaggcaucgacguuuggccucuaggcaccguggacacacauagcacacccccucggugcccuucuuuuaauacauguacacaaaagagagagaguguggugaauuaaaaugauaagcagauaaucugaacagcgccaaagcaggaaggugggcauugagauucuagggucacacagaaucuaaagcagagagaagguaaagaaggcaaucuuucugcggccugaacuguacacaccacuuacugacuucucuuucagugcgggacaaagugucaccgagcugcccaggcaggccucacacuccuggucuuaaacuauccuccuccucagacuucugaguagcucagagugcaggcucacaccacccugcccagcuugggaucauagcuuugaauuaugaaaucacagaguuggguguggugguacacacuuguagcccuagggcuugaguggcugaggcagguucacagguucaaggccagccugagcuacauaacaagaccuugucuggaaaaaaaaauaagaaagaaugacaaacuuauucuuucuuuuuuuaggaggaguaaaacuuggacugggagauuucauuuucuacaguguucugguugguaaggccucagcaaccgccaguggagacuggaacacaaccauagccugcuuuguagccauacugaucguaaguauaugcuggcaaaaacuggucaggaaacugauucugcauaccuuuaugguaauuuucuuuuaaguguguuuguacacagauacuguggcagucgugugacagagagcauuuuuccuuccacuugaggcagggucucucagagaacaaccuuuugggagcuggggcuuuccuuccaccugugggagggugucucguguuuuuaccaugagccaccgugcacucuggccuauucuaauuccccaucucuccauaggacacuaggauugcaggugggcgcccaccacauccagcuucuuacaugacuuccaggggucaaacucaggugucguguuuggguggcaagugcuuuuuaccugccgggccaucuuucuagcucagagaauucucuuuuaauuccaggcaggcuaagaagcuuuauaacgcuuuuuuaaaauggauaaucagagccugccugaguaucucuccacucuggccacacauuaaaaucagccgaugcuuccagccuagcugugucuuuucugcggaauguauugcugaggaugagcgaacaggagcaccaggugccugcuguauucuccuccugcaccagccuggucucagcccugugcucaccuuugccccgcccuuggguaguuaguugugaggaguucuuaagaggucuccaggaaacugugaguacuucucauuagaaaccacugugagccaggcgguaguggcacacaccuuugaucccagcacuugggaaguagaggcagguggaucucugaugagccugguuuacagaguggguuccaggacagccaggacuauucacagaaauucugucucgaaaaaaaaggagggguggggaugaaaugaacagcuuugagaguccagcuguauagggcucaacaaaggcugucauaguccacgggcugagucagugaauggccagugccuuuacaucugaugcacagccugcaccaugcuugcuugggacagcagguguggagugagaggggcaagcccagugcauaagcccacauucugucuugcuuaugauggcuguggcuuucaaacaugacuuagagcacuggauguguuggcgugcaccuuuuaauccuggcauucuggaggcaaaggcagguggaucucugaguucaagaccaaccuuguuaaguucuaggcuacauagugagagccccaucuuaaaaacaaaaaccugacuuacuaauaacaaaugaacuauuucuuauugcuuggaguugggguauauaguucagcugugagcgugccugcauaguccaaagcccugcauucaaucuccaagcacauagugcaggcacggggccacaucccaacacuacggagaugaaaggagaaggguccgaaguucaagguccuccuuagcuauaugggggaucugaagccagcuugucucaaaaaaaagguuuuuuuuccccuuuaauccaggcauuauggugcauacuuaccuccuggcacuuaggaggcugagggagaaagauacagaguuugaagccagucuggguuguguguauauaaaugaagaaaaaaaacaaccucugcauuuuuuuuuaaaauauuuauuuauuacauguaaauauacuguagcugucucccgacacaccacaagagagagucagaucucauuauggaugguugugagccaccaugugguugccgggaauugaacucaggaccuucagaagagcagucagugcucuuaaccgcugagccaucucuccagccccaccacugcauuuuuguagagggccacacucccaugcacaggcccugggcucugucuucagcacagacuuuuuucuuguuuuuccauugcaucuccuccugucuucucuuucccgucucccucgagccagcuuucgcuguuguccagccuggucucagguucuggccucagacaguccugccucagccuccugaggagcugcugcgugaccgucaggcccagggccacaagcuacgcuuuucucucgugacuccagaguucauaagauguuguuguaaaaguuaggccucaaggagaguauucccugagcguggugcugaugcugcguggcguggggaugguccugagugcgccucugucuccacagggccugugccuuacauuacuccugcucgccauuuucaagaaagcguugccagcccuccccaucuccaucaccuucgggcucguguucuacuucgccacggauuaccuugugcagcccuucauggaccaacuugcauuccaucaguuuuauaucuagccuuucugcaguuagaacauggauguuucuucuuugauuaucaaaaacacaaaaacagagagcaagcccgaggaggagacuggugacuuuccuguguccucagcuaacaaaggcaggacuccagcuggacuucugcagcuuccuuccgagucucccuagccacccgcacuacuggacuguggaaggaagcgucuacagagaacgguuuccaacauccaucgcugcagcagacggugucccucagugacuugagagacaaggacaaggaaaugugcugggccaaggagcugccgugcucugcuagcuuugacccgugggcauggagauuuacccgcacugugaacucucuaaagguuaaacaaagugaggugaaccaaacagagcugccaucuuccacaccauguuggaaauaaaacacguccuagcugaacccuuacuguccaggagguuccguguggagguggcacugggccgggccucccucucaggcuccuuugcugcccacuuguaaguuuaaauaaggacaccgcccuacacaaaccucaccccugucacaucagugacucugaccacuuuuguucucaaacucucucacuauuaucugugguugccguuucuucccaaggccagccuggacgaauuugggguugcucuauccugagaguuguaaccucaacuuccaaaguuuauauuuucuugaaaugauggaucuauugcucaacagucccugucauccuuaagugacuucuggguuucccacaaauuccucacuuuuagacacacucuaagcuuacuucuggccuggaugcuuccucucccugucucucccuugccccacagcgguucccugacagcagacaaggcagcucugggagguagcuaguauccaauaacccagggguuuccucaugugaugcaaauacuacguguccaaccaaucagugcugucaacgggcugccauagcuccuucgauggcaaauaggaugugugcccaaagaauuaaagcgaugaguggcuggugaagcgcucucuguccuggcugguuuuuugucaccgcaauccacugccaaaggcagaauuuaaacuaggggcugagggauagcuccgaguaauguccaaugcugggag

SEQ ID NO: 6738 - RNA, 2284 nt, Mus musculus
ggucugucguuuuaauuuucaugcauaugucaggacagcccuauggagucagcucucuccucaauuacauggguucugaggcucaaacucaggucaccagguacguacgcuguaggcaagagucccuaaccagcgcagccaccucaccagccccuauucuaagaccuugcuacucacacacagacggcagauuggaaguuuugauucaaggcacuuuugucagucucagcuagagcgguguauguaagagccccaagugugucguguguuuggugauaagaggguaugaacgggcuguguuugugugcacaagagggguggccacgagccaggcaucaucuggaauaaagccacugaccccaccugcuuaauggaaagacagugggaagaaaugcaguagcuuuagggcuuuggucugaugccuacaggauacgagagccagcuucgccaucagaggcuggagaggaagggcgcuccuuccuguuuuugauccugcuggguuaaagggguucuagguacacagcuuucauacagaaugacugcauuucuccaagaggaagagagagagagaagagagagcaaaagcaaucuauuagagagagagcaaaagacaacagccaaaagcaaucuauugacuucaccacaaaaggagcaaaggccugugguuuugcuuauaaacuugacuugaaaguuaaguauccuuuugugauagaugcccgagugaauaguauguugacugcuuguucugucuguggauauuaguuaggguccucucuuguguagcccgggcugaacucaaauguauaauccuucugccuuuaccuuacaagugccgggugucacaagacauggaccaucgugucaaguuacauauauacuuguguauguacauacaugcacauacauauuacguuuauuucugcacagagcauaugccuacaugaggucagaggucagcuaacagcaggugguucucuccucccaucguguggguuccaggaauugaacucagauccucggcucugagacacaugcuuuuacccccugagccaucucacugggccuauggcuauuccugacccuaacuuauugaaugugaaauugauauuaacugccaaauaaggucuuccaaggccaggcuucuagugggagucucugucugaagaaaagcugaggaacugagggcuuuauucagucuccugugugcuucgcucgaugaaggaggcucacuugcccucuuuccuaccucuuucccucccucccccccuuucccuccauuuccuguucauuccucuucuccuuucugaaagaaaccccaggcucuugugagagccacucuguagccaaggaugaccuugaaccucgauccuaagugcugaggucacucccacgcacacugagcccaguuuauucugugcuggggaucaaaccuggggcugugccugcuagccaagcacucuaccuacugagcuacauccccagaccccacccguccugacuuaacuacugaggcuuacaacaugaaugcuguuaagagaccucguuccuucagaagcccauccuuuuaguaagccccccacccaguuaaaugagcuuuggggugcucuauacagaucagccggagccaccucuccuuacucucuguggguccuuaauguugauuuugaagacaacuuggaaacugaauauuugcauucacccuugggauggaaauaauucccuaucuugaugauaagauagagucuaagagcaacccugggguuguccugugucuuuuuccaaaccugggcaguucuacaaacacaccaaaggaaaagcacugguuuucguucuuugcagcccuucuugauagugccagccagauacccaggggcugucccaucucagggucucccgcaccucguccgucuacuuggcugcuagaaaccccaagucugaauauugcaaagcacaccccggugcugacguguacccuuuccugacugucaaagccguuuacaggacuucggggucgcagugugccucuuguggauacccguguccccuugggcccuggaguguagugcuugcacaugucugccuagcaggaaggauuucccugaaaccacuucuauuccaauccauacugguugaagggcacugcagaguggugagggcuucugagggaucauucacucucacguggucacggccuggcuucuccuaccauggguacuacuuuguacauaacagacugugaauacaacuuuuugaauaaauaccuuucaaacucuugggaagcuau

SEQ ID NO: 6739 - RNA, 2297 nt, Mus musculus
auggucuuuggcacuuuuuuuuuuaauaaaucugacguucauacaaacuuaacgcgcagcacacugaccccagcucagccccgcaaacugaugaaauagaacccaaggaagcaacuuccauauaaaacccccaaugucuccagcagaauggcccagccaaugcuacccgguacacuggacacuguagggaaugaagcuggugcucugaaaggacaggggucagggccacuucugccacgaacuuucccccucagcuucaauuccuguguuuacuuuuacaccuagguaaaaagguucuucuccagccugaagucugcgacacugaaaaaauccuaaagguaagcacaaccauacugaugcuuagcaagguaagaacccgaccucuuuaaaaagagaggcaacgguaguggagagucgcaacggcacucuuuccagccauccucaaaaaacuaacucggaacuagaggugucuuggugaguagcagccccuuaucauauaacaugguugccaaggagagcuggucuuccacacugucacauggcaagucccccacucucacaaacuccggguaggagcgaagcaagaguuccauggcgucggcuugcuggggguggauuucuaagcacuuggguuccucuaggugauaaacucgagaguuuuccaccgugugauacaggaacaaucggccucccucucccaccagccgagcuacgccguccugaagcauguggacuuggguuucaguugucagcugggcccccacauugacggguucuccagccucccagcgaacugggagcccgugaacacuuagagcccguucccuaucggucaacacagggggcagggaaucgugaaugaagucuuuugcucucuggucagccacagcaucgacaggagcaaagugucccaggcgagcaaccaagacccgcaccuuuuccaugaaagcuguccuucuaggauccuuagagucggaaugcugggcccccauguaauccaugaagucucggggcaagccucugcggaacuccacguucuccucuauggccgcuugcacugccagaggcaguacagccuccaggaagucaccccauguauugcgcugguagguggacaaggugagguguagggaguggacuccauccugacauucagcuuggugaaugaagccccgaggaaaauagagcaggucuccagguuccaguaccguuugcagcacaggcucaccaagguccuccuggcugaaguugggacuagaugucagggccaacuccucacucgggucccgcggucgguagacgcgccagaguuuccgaccuuccagcugcaacacgaaagccucgaugucaucguagugaggagcaaagcccugcgaguccgggggcgugagguagacguuggagcccgccaugcugccaaacugcuccuggagcacggccagaaacugccacacggugggcgagaaggcuugcgggcacaggaggcgcaaggagcagccggcucgguacaaggaccacgcggcggcgggaagcgcgcggcccggcggguucaaggucucccgccguccaucgacguagcgcgcggcguccagaugcugcccgaauugcacguccucguagcgcagcaucgaguccaggucggcgguggagaagagacccucguaguagcugcgguccugccgccgcaccagcaccgccucccgcucccacagccgccgguagaagugguccggaggcaggggcgccaggagccacucgaagaggcgggcggcgcgccuccggcugcuggggaugccguucagcuccgucaguaccugcugcagcggcgaagcccggggucgccccggcucauccgcgugcgagcccggcggcggcggagcggccguccccagguuccgggagagcgcagcccaucccuccacgcggcucggcagcgucgccgaagccgaccucgggcgcgcugacaccggccgcggcuccgccgaccgcgaggccuccagcagcucugccggccucuuccgcuugccccgaaccgaggccaccgccacuuucgaguccgaguccucgcuccggagcgcgcgagcucucagcgcggccacgcgggacgccgccgcacuuuuccggugccuucggaucuuccggggccgcaagggcagggccaagaccgacgcgccgcggggcugcgacugcgggugccgccggcgccucccccgcccgcgcuucagcagcgccgcaccguugccauucgguagcucguccauagcggggcggccggcgggucccacgcuuccgcggcc

SEQ ID NO: 6740 - RNA, 2361 nt, Mus musculus
cagcugcacgccggccguugcgggagcgcgcggacauaagcgcuaggcagagcugccuccagccgaguuucucccccaucccgugcuuccugccgcuuggguucccggugcucggagugccgccucuccccacguagccaagccacggccucgcgugacccucagcccgccggcgugccggggagaggugggaggagcugccacgccccgcgaccgcacccagccaucucccgcccggagucaucagucuugagcccaccuugcucccucucuuuaagcggugacgccagacacagcugcagccaguucagcccucccugcccggaccaaagggggcgacauucgagugauaggcggagugucccguggcucccgacccugacuugggacccggaagggacaagaaggaacucuggugucuuuugguaauugugguugccugaagcuugucgcccccuggccuaccgggggaggagagcauguuguauuguccuaggcccuauagccucgugagccaguccaagcagugucuguagaacuggcacuuuuaauaguugggugaaauggcuaugacacuauuggaagacuggugcaggggaauggaugugaacucucagagagcucuguuggucugggggaucccugugaacugugaugagaccgaaauugaagagacccuccaagcugcgaugccccagguauccuaucgagugcuggggagaauguucuggagggaagaaaaugcuaaagcagccuuguuagagcucacuggggcaguggauuacucccugauacccagggagaugccaggcaaaggagggcucuggaaagugguguuuaaaccccccacuuccgacgcaguuuuuuuggaaaggcugcaccucuuucuagcuagggaaggguggaccgugcaagauguugcucgugugcuuggguuucagaacccugcuccagcuccaggcccggaaaugccagcagagaugcucaacuauauuuuggauaauguuauucaaccucuuguugaguccauaugguauaagaagcugacguuauucuccgggaaggacauucccgggccuggcgaggaaaccuuugauuccuggcuggagcacucaaaugaaaucauagaggaauggcaggugucggauauagaaaagagacggcgguugauggagaguuugagaggccccgcugcugacgucauccgcauccucaagaccaacaacgccgccauaacgaccgcagaaugccugaaggcucuugagcaggucuuugggaguguggagagcucuagagaugcacaggucagauuucugaacacuuaccagaacccaggagaaaaguuaucuucguauguuauccgucuggagccucugcugcaaaagguaguagacaagggggucauugauaaagauaacgugaaccaggcucgcuuggagcaggucaucgcuggggcuaaccacaguggggcccuccgaaggcaguuguggcuggccggggcugaggaagggccugcacccaaccucuuccaguuacuggugcagauucgagaggaggaagccaagaaggaggaggaggaggccgaggccgcccucuugcagcuaggccuggaggggcacuucugaguccuaggacuggccaggcugcuuuugauauaccugugacguuuuaguaagccugccacucaaagcaagcacccagccuccuccuggcuugguuuuguuuccugagggaugggauggggaagucaggcccgcauauuccuguaacauucacagaagugugugauugucaggagcugcaacgguaaaggugguccuuacugccuaaagugaaugcuugaugccagcccuccuggcgacaucucugacagcugugcacaaacgugaagcugugacacuuccugucaaggugguugcgaagcugcagguucugaugcuaaccgcgcaccagguucacagacuguacaguacaaacucuuguguuuguuacuaacacuguggaugguuuuacuguaaauuguucccaauuuguaucgauggaaagaaugugauucuauuagaagauauuacucaucuugaaaaaugcggauuucuaauuccucacggcucaacgcuggaaucaguuucccugaaaaggauccucggacuaaaaguggcauguuagaaaaaaccaggccuuuaccgagcugcacaaucaguuccucacgguggaagacagaaguccuagggggaguggccguggccagucuacacuucccccacuucaaagacuagucauuuaauaauuggucagcgcuaaggguucuaaguuugaaguuauugaauagauguauacaaauaaaaauuugaaaauucucau

SEQ ID NO: 6741 - RNA, 2846 nt, Mus musculus
ccgcacaucagcaggcgcugagagaagagagcggcgaaggggagaagggcugaggacccugcuggauccuauugccgggcuccccagcaccccagucccuggaaccucuagaaggggccaggagagggucacuuggacuuugcucugcagaacaaacccgauaaugaaaaauaaaccggcucuuuuauuuacaaaggccaaggacaguguuaagggcugcaggauccaguucucucaguaucugguuggucccgaguucugcuuucccggagccuagagaggccgggccacuuggaaugggcuagagcucuacagcugcuucucugaucucugcuguugcaucugugccucuuucaucccagguccuuaguaagccaccacggcaagccaagcacaagcucgccccauggcagcauuguuccuccuuccgcagaggaccuggaaggcugugcagacuuuuaucuaagcccccagagggacuccuuagagagcgguggccuuaacaccuguguuguccuugugcugucaugcucaggccggaguugcuccaacaaucccgucuggagguccccacuuccuuaggcguaucucggagggcuauuuucaaccccuuugcugcuuguuaacagcccgucuggggcugucaaaguuuucucagaaguuuggaguucgugcccugcucucagccuacuacacggagaggaacuguucagaggccagaagaugcagagcucugcccgagagaucuuuugacaaacucaugacuagcauuuuauaccuuugagucccggaggcugcuaaaggagccucaagcagguccuagagaggccuggccugcucuuuggugccagcuuccuucuugccugucgaguucucaguagcugccagcugaucccaccgcaccccacucaauguugauauucacaguccucccuccccccaauacggcaugcuggaguuugcuggauucuucccugggagggugaugucuccuaacuagauuagacaggagccuucauucuguggcuuguugucauuugggaacuauuuauuuauuuuuuuuaauauuuaaguuuuaacauccucagggaccaggggccucuugcuuuccagagguccaagugcauuuaucccaaaauaaggcaccuuuuuggcauccccaagcccucccccaguuccauggcccuggggucccuuaccuuguggcucuuggccgcaggaaugacagaaacugaucgggcugggaaggcggggaguguuaucagucacaggaagccagcagaugugggugaggucaaaggcaggucucuguccugccuuuucuguacuuucaaaugcucgagggaguuggcaagaggccagaauucuaguuuugguuaucagccucgauucuggcuugaagaaaccauauuuggcuuggaauuacugaaggguuggaauguucuagaguccccuucgcuuuccaguucaguaggggccuaaagccacuuuucugauaucaucacuuaauuuuaguuguacaaaagagagucuuaagugaccgugugucugacuguuuagaauguuaguaaggagcggaaauagccuacagcccguugggaauuggaaauagagaugggguuuuguuuugaagcuguagacuauuggguauuucuuacauucauuuacacauuaguaugguucuaugagagagcugcggguggaaauaacaaaccugucccccuagauaccuagacaguuaccuuaaccuucaguuuccccgguuuguuuccuucauaggcuucuaucagcucgaagucccgggauuacaaaaaugugguacccucuagaagcaggagggcaacaaguuuaggaucucuucuaaaucacuucuauaacgcgugccuucacagcucagccccaaagugccacuuagguuucccaagguucuuuucuauuuaaaccauaucuggcucaggccccuugguggacaggugauagcagccacaugagauccuucagccacaugagacuccucugcucagugguaccaacuaauccuuagaaaucuuaauuaaaaacagcaaaaaagcaagaacuuuucuaaguucacagagaccagaugacuauagccgggguggggguggggggauaaagaugguaccuuuagguagugaucccaccagacacuguuuuagaggggcccaugcuccagcgcgcccguguggaaacugaacuaguucaaagcggagaugcacgugcggccggaggcuggcgcaggcgcguccuuacuggugcuuucucguacgaacacacugggcuuggcuuuuguuguucuuucuauucagagcucccuguuugacaauaacgucccuauacagugucacccugccugucccccagcuuccaccugcauucagagaaggccaugacacugaccgugccuguguucugggccaucucugaggucucuugcccucacugcuguccuccaagccuucagcagcccccuuagagcuaaaguacccacccacccaccguccuugccgccccaccucccaccccggcacagaggcccugugcucaugaugucuaaagggauugccuauauuuaacugccucagucacccaaccucuuucuucucaugugccagauguuaaagacagaggaggaagagugcaauaguacucaagccucagcuguugaaauguuuuuauuggggcucacuguucuggguuauuauuuauuacuagacuggcaaagccuaaccccuuagguuuuuacaggaaguaugcauauuuuuauauaaaaacaguugugucuaacccacauuuggcuguguuuguugccucaaaaaaaaaaaaau

SEQ ID NO: 6742 - RNA, 3618 nt, Mus musculus
auuuuuuauauauauacgguuuuauuaaaguucucaccaaaauuauucacuuguaugcaccaagugcagguacuguguagguaucaggguuaccaaggucuaagcugugccuuggaggagcucugaucuggcccacgaugcucugacccagggaaggucagaaaaacgguaggacgaugauggaauaaaggaccaguguaggacuggagacugagaagggguuuggguacccgcgcucuuccgaggaagugcuguuaagagagagggaaaugacaguuaagcaagggcuagauguugcaguugcagcccacaggcagcccugcaacacagacagcuacaccccagucagucccaccagaggcuccucuggugggggcagcagcgaccuuuuagccagcaaugcaguugccagccuggugaaacaaucccgggagagagaacucuaacccugugucugcaugagcuucccuggcuuggaggagugaaagaaggcauccuggacgugcuagaaaccguagucugcugggagaccugcgcaugcgugaccugcagcugaggagaagaggggaagcaggagcgagguggagacaucuuggggaaccucagguugccugucuguguuggguggggacaggcugggacguuggauggucccaggaaugugagugugcuaaccagucuaguucacggcgccagcuuucugcaguaggugauagaaacuaccaagaacucagcacucuauaacgguuuguggaucguacagcguguacggccagaagcaaagagacuaguuaggaggugaggagaggacagucaccucaaagcaaggaccuggugugggccagccauuuaaaacucucucuucuuuacuuugcagaggagcaaauagaauguuuaaccuguucaaauaaggcuaguguaaggcaggauuuggaauuagaccugagcacugaauuuuggauuucagcccaugacuuaucaauauuaguuuuuauuuuaaagcuugcuccguugcgcacuuuggaucucuggggaucccuuucuucuuggcucacugagaugauguagggagauugaguucuagccgccagcggcaggcguuucuccagggcugguucuacaguggcccggggacuaugcuaaagugagccacccagaaagcuggcaguucuugucucuugaagaaagggugucucugucccuuggcccugcuggucagcccucccuggcagccacaccuguuuuguucuucucccugcggccagccagaugucucucucccagagugacaggagcaacuggggacaucuauagaagcucccuuucaguccccacaaaggcacuaggaaccuggcuaggccuguagaggaggggcaggagggaaguacccagggaugcagacagcugggggcugggguggcaggcauucccuggaacaggugaaguaacugaagcaaagaggaggcucccugcuugucagggguaaaagagaucgaaugcaggagcugagauucucagcuuaacuucgugacuggguggcuuuaagcucuccacucugucaggaaggaccugguaaggccgagggagaagacacagccaucagaggggugaccuuaaucaacucaagaccauagcaugguggaaaggauacaaaaggcauggagugggggcagccuuggaaggacacuccccccccccccccccagauaagacaucaaauugauguuggaaguagucucucuggcggagccccgcagaggcuuauccuggggccuuuuuuaggugggaguguguguaaggaucuuuccuggaauuaaguucuugaaaggaagaagugggguggaauaaaugcagagaaauaacaguuguaaacccagaaaaaccgaauaugguggauuuguuauaggcaaaaagaccaaaccaaccaaaccaacccagaaaauccaacugaggggagcuugacaauggucccgagguugcgcagcacguucguuuauuucagacagaauccagauucaguccugguuuccuaucuuuuccacaacuuucucuacucgucuaacucuaggcaaggagguccuaaagauagcaucuuuauuuugcaaagggagauaacagugggacauagggaaccuggcauuguggacauaaggagcccucaauagugucuguuugcccagugaauguuaacacuucgccuguacugaguaaggaaagggauggaaaaagagcaggcaugcaaacuuggggacuagagagaagaaaacucucucucucucucacacacacacacacacacaugcacacacucacacacacacacacacacacacacacacacacacacacacacacacacaaaauaguauuaguauguagcccaauauaccuccaaacuugauuuuccugucuuggccuugugaguucugggauuagagugucugcuauuacugucuccuucuccacauaucccucucuuccuccccuagcaaccacaugcaaggucucacgcacugagcaacaucccagcccuauaacgcuacccuguagugcacagugacgacagaaacguaguggaggaggaugggcaguaagccccuggcuucugggaagccucuugcccgucuucauaaaauuuacugugauuuacucacucaccauacaauucaacuuuggaagaguuuuuaaagauuauuuaauugcaugaacguuuuugccugcauggaugucugugcaccagauaugugucugcugucuguggaggucagaagagggugucagauuuucuggagcuggaaucacggaugguugugagccaccauguggaugccgggaaaggaagcuggguccucugcaagaacaacuaguguucugaauuguugagccaccccucuacacucuccccaccagucccugaaguguguaauggguuggaccuaggggguggccaucccgagcugucuaagcugucucagcaagauggcagcagcgcaggaaaccucugugaggcuacacucugccuccgauggacucagcguggaguccgguccucggcgcuuuaugcuaacuagagugucucuuagccucgccuuccucucuucccugugguuugugaagaaguggggugguaggggaaaaauggcauuccaugugugauccuccccacucccccagcucaccucaaucccagcucugaaaggccaccgucuugguugucccagaggcuuguaggaagggccuggagagcuuucacaagucagugauucugcuccgccauaccugcagaaagacugacccccagggcuuucccagaaaggccauggcuucccucauaccaccccauuuacuuauugagagggagacuucuaccaccgucaggacagcccuucuccuccuuucucagguggcccaaguuuagaaacuuuguugagugaagaaguaugcugcuguucaagguaggcagaguccagucuccccuccugcucccacguguuguccuuguugugucccccacuccacccccacccccgacuguucuuucuuguacaucuugccccugccucuccucccccuugcugcuuugggauaggcccagcagccuguguggaggaagcccuc

SEQ ID NO: 6743 - RNA, 751 nt, Mus musculus
ugccuggcuuuuuuuuuuuuuuuuuuuuuuucaggaagcauuuuauuguugcuccaaggacaagagcucacacgggugacagucucucagagcaucucccgcauggccuugcugagcuucugaaucuugcucuuugcagacauaacaagguacuucuccccaauucggacaaucauccagcccaugauugacgggccagucuugaucuccaguuucaguauuugguuuggacucaggaagcucuucagcaccgucuuuaacucagagagaacagcgucaucuagaggagaugcuguggucacugugcacggcacuuguccucgguggacacucaugaugguggaaaaggcagagaugauacccuggguguugccuaggcgaccauuuucagcaaguaaauucaugagguuggccgucagcggggagaacuuuuccuuuuuugugaugucauuuaggcuuuucacuuugauggugcgcuugauguagggauucagaacagccagagauacuuugggguccuucaggaguugcccuacgcgcagcagcuccuucuccaccugguccagcuuuuucuucuuagaugcagcagaguacagggcgguugcauagcggccuucgaugccauagaccuguacagggggccuuacaagcuuggcaaagggcccgaccacagauguacugaagcuccgaaucugucgagacagcccggacgcugcaggcgcggccaucuuuucccgggcgccucaugccu

SEQ ID NO: 6744 - RNA, 3223 nt, Mus musculus
guaaaaucacagaagaaauuauucaaacuaauuuuauauguuagacuucuaacagacauauaguaacauuucucuuuucagacaacaaguuuuguuuuucuuucaguugcauuccaguccaugaugacagggggcaacguagggaaacagaucgucugcauuucagaagauucuucucuguagucuuggugugucuucaucaaggaagcccuccauuuuucacuucccacaaagauucuuaacaugcauuuaaaaauaaucuuucuguacagauaguucuugauucuagugugauaauauuuucuuuguuguauaaccacuuuaucuuccauaucauauucacucuacauuuaacaugugauugccugccauaauacaggaguucucaagcuguggguuacggccccuccggaggaguuacauaucagauaucucgcauaacagauauuuacauuauuauucauaacagcaaaauuacaguuauaagguaauaaccgaauaauuuuaugguugggggucaccacaacaugagagacuguauuaaaggguggguguauuaggaagguugagaaccaaugccacacuagauugaaguuaguauuacuuguuuuucugucuuuuuuacuuuguuuuugaggcaagaucucuauaugacauccacacuggccuccaacuugugauccuggggcucugucuccuaaguccuggaauuguaggcauguaccacuaugccugauuauuuuucuuauaauaacuaauaauauuguuuuggagaugggucuguuaguuuagcucaggcuggacugacuccucaggucucccacugcugagccugcugggaugccaggcagcugucacucacuaauauguggcuaauuuuguuugugaaaauuaauauuacauauauuuguaucaaauauuuaaaaaaccugggugguuuuuaaccccaacuauuaguggaucauauauauauauauauauaucuuuaaauuacuuuuagaacugaauaaacagucuacgaauucuaaggugagaagcaguuaacauuuguugaacugguaacauuuuuaccauucuuaaacugaguauuagaauugagaaagccuuuccauauuuuugaugagagacuuuaaaagucuuuacccgaauguuugucuguacaccacaugcaugucuggugccuacaguggagaguggcuggagaggguauuggggcauuggauccccuggaacuggagagagucugaagccaccaugugagugcuggguucuagaaugcagauccucugguagagcaggagaugcucuuaguguuggccaccucuccagccugucuguacuuaauggcauaaguacauaggauuucgggcagcauugggaguauuuacagauuguggaacaguuugggguaggacguuuugggcugggaguggucugagaagauaaaugagugguugggagucuccagagacaagguuuacauccagggaugauguuuguguucugccaaacaacuaauugaguagcaagccuaacaacuuacuacgugcugauaaaagcuuguguuuauuuuaggaauuuuuuuuuaaagacaagagucuguuagguagcuugcuauguaauccaggcuggccuggaacucaaagauauccacuuggcugucugccuccgagugccaguguuaaaggccuguauccccauucugggcuuauacuuuggagaacuaauagauauaaacaucacuaagaguuucacugaugaaagugagucggaguggucagggcagaacacugaucaguacucuaggggcucugaggucaauccccaaugguaccuucccacaacaagccccaaguaaucaagcuccagaaagcuauaggauuaaguaaauuaaccaaugguuauagacaugacuauuccagauauacugauguaucacauuuguuuucuuaauuuucucaaccuuuagaaaaauaaaacuggagauguuuucugaguaugacuuaugaccacuuuuuuuuuuuacagucaauauauuuuagaggcaaaacaaauuagcagccacuaaaucaaauuuugcagcguucuaaccuuguuuuacauacuuucucuggaccccaguuuuucuuucugaacaguucuucaucucuucauauagugguaacugguaaaucuuuguuuuuuaauccuuucuuaaauuuuaggauuuuagcuccuaguaaacaucuccuugccaccccaagauuuuugucccagauacuguguaggccaguuguccuugucauggccauccucaaaugggaucacagucaugcuucucagugcgcaggacaaacuguaucgaggaaauguuuucucccggaacauuuuguaccaaaacuaugacucccuagcucauccagacuccuggcuuaucucuaacuugaaaaugagcgccuucagagaacauuauaucucacaggcacuaucuuuaguccccuacucuuccacaccgcaucauguuuuguuguuguuguuguuuuuuguuuuuuuggacaaggucucaacuauguagcccucguucaccgggaacuccuggaguacugggauugcuggaguuacaggcgugugccaccacugcagaucuuaaguuucaugcagucaaacucgaaaguuucaacaagaacuauuauccagcuuggaacuuaguuaucugagcccucagucagugcauccaagaucucuggagaauucuuaaauguuucuaacgcuguacgugugccuaaauucacacccaguccuaggggcaaugcaaggcuugauuuccaggucccucuuugggccaugaacauuucaggugcucuucaugggcuuuugguguuucgggagcugucacagguccucagcuccggagaaagcuacccuccaccccgcgccgucucacccaucccagccgccgcggccccugcugaacagcuccgcucagcgggaaggcagugacgucacggcuagacugcacugaccugguuucagauuucgcggaccugagaacccugaagggcagacaggaggggacggggcgcugcgguuccucggccgggagggaacccugugugugucucgggcuguguaugcguguguauguagcggggagcgaaggaucgcucucaagcagcggcccaagagucagcgccuccuccugagaaacacccgcgggcggagaagaaagcgaguggguauguug

SEQ ID NO: 6745 - RNA, 16522 nt, Mus musculus
aucaccuaugaguacaaaaucaguuaaguuuuauuuaaagugaacucugugcugacauacguauucgaauagugucuuuagagaacaguagaaaagaacugccgcucugcauuugcuaucgacuugcauaauuauccucuaguguggagacaaguuccuagcaauuguuuuucuaaaauuaccagucugugcuuucuacaggagugcuucccaaucugggacauuuuugcucucuagagaccauuuggcaauaaauggaaacauuuuuguuugucaacaaccugaagagggguguuacaagagggugaggaagaaaacauccuauagggggcuggagagauggcucagugguuaagagcacugacugcucuuccagagguccugaguucaaaucccagaaaccacaugguggcucacaaccaucuguuaugggauaugaugcccucuucuagauuugucugaagauggcuacaguguauucauagaaaauaaauaaauccuuuuuuaaaaaaaagcuuauaaauuaauccuacaaacaauaagaacugacuuguccgagugugucagaugcuaaugauaaggccuguacuuaagguugcagaugugggcugagaaucauguuuuauuucacacacaguauuccuauguuuagcugcuaagauugcagguuacuggaagccgaugagaauguauuuagucuggcuguccuggauuucuguuuccuuauugccaccuauuuucuuaccucuguuccucuuauaccuacuugauagaugugggcucuacuuguauuuucuauaccuacuucuaaguguaaagugcaaagcaagagccuuuuacucugggcuaagguacaucuacccucggauccacuuugaucucugaaguucuguucuguucucccaaacccuaacagaugacucuaaacucaagcuccuccacacuugguugcuuggugcucugaugugauauggugagugaccuauuucaacaagcagauugguuagccauugcuguuccagccuggggccagcaggcaguuguaaagucuucuaaauugagccgucaaccucggaugcugaguuuuguagcuucauaguugcugaaaaaaacaguauuuuaaauggaaaggaucugugagguuuaagaaugguuccaacauuuucauuauuauuauauuuuuugguagaauagaauuuuaaagagaaaacaggaauuacuuggacuuaauaaaacuggaaauaacagcagcacucugcuuuucucuccuugccuuaugauacaucaguuaugaaagaggugaugcuggggugucagcuguaaggagcagggauggcagccgagcagccaucgccucacauagacaguguugcucaggggcuuguggaugcgcuuuuguguaagugcagggcuguuaucucacgugagcaacuucucuacguucccuccuggucgcguccuuagggauaacaccaauaccucuuaaccggugagauuccuugacuuuggcuuucucuucaucacacugccucugugccuugacucuugguucucacaaacuccuccuccaggccggccugcuucagggcgucccuauagcgcucuucugcuucuuuccuggcgagggccuguggaguggaagugacaaguaugacucugaguuacuuggggaauccgucuuuaaaauauugcccuuuccaccacccacaccuuuagugcuggacaaagcuggcacaggaaugacuuagagccuuauuguuagccacaguuuauaaaaugagucccauggggaucuuguucacauacagguacaaauacaauuucauaucucuaacacuucuaggaggugucagcuccuaauuaauuugagaggcacgcccuugaaaagcauccaaaccauccucaggaagacuaacauaucacaaaugcuuagcaagaggaguguggucuguaaguagcuagaaggcuaccuuguuuuacauaucuaagaacaaaaccacaggcuacuuuguguuuucuacaaaaggggaccuaaaggaguggaccauaaguauguuccggacaguccagcagggggcagggccgccuggaggaggaggagagccauuaguaccuagggaugccacaugcucugagauggaacucaugccuacagugaaccacagagccagauaccacacuaaacugccugggguggguccuucuggauguucaagggcucuagagcuuccuuagggagaucucaacugaauucaccuucuuaaaguccagagaauauuuuucaaauggcucagccuaauagccacuuauucuggaaagagccuugaggggugcuuauaaagcacugugaucuuuaaggaccuguauuuggaguaaaaucgcaucaauaaagcaaguuaagaaguauauaagcugggugugcugguguauggcuacaaucccagcaccggggauauuaaggcaugagggugguggguucaaguccagcccggacucaaugaauuauaggucagcuugaacuccauaaaaagaaacccugucucaaauaucagauguuuaaguccauggucccuugggccugucacuuuggacuuuggccagacaccauuauagaggugaagcauaugguagcugcugccaugucauguuggccaggaagccaacagaauguccaugugucugugccuuuuauuccaaccgagcaccccaagccuaggagaccaugcugucuauauucaaggcaguucuuccuuagcuaauucuuucuggaaacacccucagacacacccugaaguggaguguguuaauuuucugggucauccaggcacagucaaauugaaaagauuaaccaccauggaguucaauuuagaggaucugaguuuuaagaaaauaaucacagaguaaaaucuuuucacaauuucuaagaaaccuuugacccaaggcaggaaaacguugagagucuggauuaccuugguaacuuguucaaagagauagggccuuguuuguauucuuuucuucauuuccuccaguucuuucuuauauuccuuugcucuuuuacggucauugcuccuggaauuaacaagguuucuagaagcaaccaaucucuuucaaaaucagaaacccuucaugcaagcuaagcagaggcauucccguguacacuaaauuccuauugccugccaagccuguaacuucugcugaugguguaguuuacuccaaugacuccauuuugccauuucacagccaucgaugugcuagaacccaauucaggcaacccccuuggaccguggaggacacugaccgguucucuuuaagcuucgcuuugaacaccucuuccaggcuuuuguggggauccauggccuuggcccucaaggucacugauuuagacauggcuugacaguucuuuuugugcaccuccaaccacugaaugcucaugucugauuuguccuucuuuucaagugacauucuaaaggagagagcagagauaguagaugaccugggcacaugcauaagcaaucguaggaccuucucugcgcucaguuaugucuucucuuuucuuucuuuaagguguuuguuugcuuguauauguguguauuuggggauagggguaugugcaggucugaaugcaagugcccccagggucuagaagaaggcaucaggucuguugcagcuagaguuacaguugugagcagcccaguguggauacugagaucuauauuuaaguccucugcgguacaugcucuuaaccacggagccaucucuccagccccuaguggguguuucuaugaauaugauuuucuauacaucugccacaacuguuuucagaaaaggaugguucuggggaugggcguggcacagaccuguagucccagugcaggaggaaccagauguucaggaugucccagcuacacagugacuuucaugccaggauggccugcagggaaccccaucucaacagcuauucugaggcgaaaaccaauggcagaugaugcuuuccuacuuucuggguucugugauuucccacagaagagaaauccauugauugaacagaaaguauugaguaaaauggccauacccagcuaggagucaauagauuguuaguuguuucccuuggcuggagcaguacucauagcuacuauuuacagagcugccaaccaggaaccaaagacuuuauaucucgcguaacucucaccaggcucugaggagguagacauacuaggcccccuuccucugagggggacugaaagucagaaagccucuuguucaccgcuacuuacuaugcagaggaaaagccagcacaaccaggaugguggaucucugaguuugccccugauugcuguacuauaaacaguggucaagcaaugacuuagguucacaguucuuuuggaaauacaaaucgccauuuccauaaagaucuggaaacaggcuuccuuuaauguagacaauuuggguucaacuuauaguacucaguuuguauaaacuauuuuagaguucugagguggguuccaccaaaagacugcacuuaaaaauacauucaaacagaucaaggacaagggcacaaaagcuuaauuccacccccugauguuggaaaguagaugugauaucuucugcaggugggcugccucucauuugcaggaaauuguccugggccuuggaauacugauacacuuggccuacaguuaguauaaaugugaaaaggaagcaagccagcaucucuacauccuaaauauucuuacgaggucuuaguguagccaugcuacuguugugacuuuugcuucuccauucuauuuaaugucuuuuucaggguuuucaggugucugaacugagaacagaacccaauagcaucaccucuuuccuguaacuuggguaccugagcccuuucugcuccuggaccaucucaucaucuggcaccuuguguccuggaguuccucacccgagucucgucaucucuacccacagcucugugaagcuuugucuugagccuugacuuggccaggcuugcacguuugcugcagggccuggagcuagcccccccaacccggccccccauuugguuuuccaauggcaggaaauugcuuuggauaucucucuuggaccuaugcccuuugguccaauaacaaaccuugccacaucaccugcacaccccuggaaauuuaggccuucuuucugguuuauauuuagaaaaaaacuauuguacuuagagauacuuuguucauauuuucuuucaaaugaccauauuuucuacaauuaaagcaccagacauuuugagaucugagaccucuaguggcuuuucacagucuuuuugcaaauggccauaccuuccacaguuaaagaucugaaaccuuuagcugugacuuucccauuauuguggcauuauacauguuagaaccaacagucaucucccugauccacuuuucuauaggugcugcccuugccguuaguggccugauaaccuuuuugcauucuguuuucauucucaaaugucagagucucaauuaucauuacucuugcaucauagucugauguggcuuuguucaccuuuguaaaaaaaaaaaaucaguaaagguuuccucugagccuuguauaauuuucauaaauaauauacaauucuuuccuggcuccucagcuguuaaaugacauuguucuaugauugugucuucaaacugaccuccucuuguauauuagcauaccgaccugccccugucaacuggccccucacugcuaauuccucuugcucuauugugcugcuccaauuuccuggauucuugucuccaccaugacaaccaaugcaauugaguacagcuguuaccaauccccuccaguuuugggggaauacuuccgaguaacccaauuacuuagaguuuguuuuacauagggcaucccauaagacaucauugccuuuuuaaaccaccuuagguccauucuacagaaugccaugcuguuuugucauuaucagcacuaguaggcauaugcuguauaacuacugggaaugcuguuggugauuuugugacccagaacugccuguccucaaaaggugcuguggcuuuagcccugucuccuguccuguccccucugaccauucugccuuucacuucucugacugcuucccuuugacccagguccuuccccucccuguaccuggggaaaaccucccucucuguuucugacgcugggaaugaaucuguucgcccuuuccuugugcuugacuuuuuuccaguguaucugccucuacucuguuucucuagcugcacagccaacucuguuacuuuuucagaaggaagaaagaugaagaagcccucuguuuucccguucccuucauuucugauucucaggcuuccauccccgcccauauuuuuucaguugcucagcuacgcuuucaacccuuuuauaaagaaaagagccuaaaaugaggaaaggagaggaaaaaaacugcugcugaaaaccacggggugggggugccccaacaacagccucaacaaaguauccaccccuccuuuuccugccuuuugcucugugguacaugaaaucagaccuuccuuucugccuagacccauguuggaugacacuuauaaaauguguagguuuuuucuuuuauauugucuccuuuucuuacaaacagaaaccaguucucauagcuccuugccaucccaccucccaguuuccagcccagccccuucaaagguuguuuuccuaaccauuccucccucaguuccccaacaguguguguaagcaauuccuucucccuguuuucccuaccagccgcucuaaacuguaacuguucgagccuaucugcucagcucagcuucugacucaacggucuccuuuuucacucugcccagucucucuucugcacuaucuuuucuuuagcccuacucagcccuuuuucuaccccaagucuucucaaagccuacccucugacccuaccuagaccuuccuccuccucuucuuccuccuccuccuccucuuccucuuccucuuccuccuccuccccauucuuccuguucuacuucaucccccuccucuccucagcuuaugcuggcuuuuuuuuauccuuuccugcucacagaaguccaagaggcaacugacagugaaagucacagggucaaacuguucuuuuuaaagggccaaacacauaaaauaaaucacacuacaaaguaggguccugcucuccccugggagccucccaggaggcacugaggcauuaguccuuucaccggccuuggcuuuaugcuggagcacagcuccugcucaccucagcccuggcagaggccuaaaugagugcacacggccaggccagcagaacugguaaaauccagacgggaaugugacucaguugcagaaggcccuggguuugaucucuagugcugaagcaaaaggggagaaaaggaaggaagggaagggaagggaaggaaagaaaaagaaaagaauagaaaaggaaaauagacuccugcuucccagagacucagacauugcccaagugaaccucagcacuugagugucugggcaguggcgcugcauccugucuauggugggcucugcucccugcaccaugcaugagccuggcuuugccuucgcuauggcugcccucuccuuucauacaggucuugguuugguuuuagaaagaaaagggcauugaucacacuacaaggaacagccggcuggacaauagcuaacgguucuacucauggccucauauacagacuuacacauuuguuuucuggaaucuucuuuucucucuagccuuugucugacuuguuccgcuuucuccuuuggaagggcaguucucacaguauguguguggaagucgaggguaacuugcaagagucaguucucacauucuaccguguggguccugggauugaacugaggucggcaagcuugucagcaaggacauuuguccacucggccaucugccggccccagcggcucacugagucuggaagucccuuacugccuagccuggcuguccccaggucagaggaagugcuucucucugcccacugcucaccuggaaguacaagacuugcuggcacacuggcacacuggcacacuuuuacucgggugcuggggaccugaaugcuggucuccaugccugcccagcaggggcuuuaccaucggagccaucucccagccccuuccuccuuauuccucagguuuuacuuuagacaugugucccaaaagaugugagaccagucaugccccucggcuucccugugcugucauuguccucugugcuugcccugcucauaacacaggguaaucacccugaaaaaucccaccuuucagacugcauguuacguuguaaauuuucuagggccugucuagcuuaacccugugucccgcacagacugaaaggaugauagcacauaguccagccccaucagagaauucccucagcccugagcuguuucugaucaugagacccugccauagggccaguuccaguaaacuuggggcuaaaagcugccaggacucugcuguggucucuuacucaccggacugcagauucccgcuuccugguagcaucagugaugugcacagggagaguguuggcagaaaaagaagcgagaccacucagagaacgacuccuuggcaggggaguagcuguuggcugaggggacuucugcaagaaaggagguggcauuggcgacaacaugauugguuucuacucuaauuaggacucgguuucagggaggacuagaacugagaaucuuugacccccacccugggguaaagugaacaagauacuguuuaguuacaaagcccgcacucgcauggcgggccgaaugguuuaaucaaccgagaagaguucuuuggaaugugugauuagcuuugucaguuuaauacacuuuagaauuacuugggaagagaaucucacuguggagcugucuggaucagguagcccuaggggcaugucagcagggucuucuugacuauguuaaggugagaagacuucuguguuagaguggagacagcgcagcagugugcauucagcucuuugcucuugacuguaaaagucacgagccacuucaagcuccugcggcucugucuucccggucauaacauacugcaaccugggaauaaagugaaaauaagccauuccucccuucagcugcuguggagaagguauuuuaucacagcaacaggaagcaaagcuaaaacagauugggcucagaggcuggcuuggacucacguuugcacaaucccucuaggaaggugugaaggggauguucuuguuuucaguuuacagaccgugggucugcgugcaacugagcagguguucaaaaaauaaaaaauaagacagaaaagugucaagacaugugccucccuuugagaugugggccuacucuguuacacuuuaggauguagacucugacccucccugcucccugccuggguucucaccuucccuccaccagcgguagcagcaucacaggaucguggagugugacucagguuggcaguucuuagcaagaagggcuuauuucugguugucucccgggucucccuccucucggcagcucuuuucuggaaagccuuguaaaggcccucguagucagggaccacaggguucaccuucggcuggaauucgaacucagucuguagaaagcucagcuucuccuccugggugcgggcagccguucggggagcccuguuucgggcggugcugacaggggaggaagccauccggagaguguccauggcccucaucuggauucggauuuuccugaggagcuccgcuucugugaagaggcaaucaaagaagaggaucuggagaaugcuuccccguccccuuuagagacagacucacuucguagcccagaucagucucugguuuaucuaaacccuccggccuugaccuccugacucugagggauuacaugcguaggcaaccacaagcccaugcuuucccccuuuaaacacuaacaguagugugcuaauaccagugguaaaugcaaacaaacaaacaaaguuaacaauugucccccugaggaauucacuccucuccgagaugagggcuggggagguggccuucccaggggcagcaggcuggagguggcacugacugauggagguccuuuaugucgcgugguguuugcuuccauaccuaugcgaguccagaggcuguagugugugcuuacugagaggccaccaggcugagccuggggucagggcugcugugggaccgcccuacagaucagugguucucagucagugggucuccaccccuuugggggugggugucauguaucagauauucuacauaucagauaguauaucaugauucauuacaguagcaaaauuacaguuauggaguggcaaggaaauaauuuuaugguuggggagucaccacaacaugaagcacuguguuaaaggggugggggucaccacaacaugaagcacuguguuaaaggugugggggucaccacaacaugaagcacuguguuaaagggucgcagcauugggaaggcugagagccacugugggacggacccagcucacggagcacagguuaucuaucaccaucccaccguaaucccugaacugacccugaauuccugcagcaccucugggaacaccagcccacagguagccagagaugccaagguuauccuuacccuggaguuugucgccaagggcugguucuagaauggacuuggggaucuuccuagaaguggccuucuuuggggagaccuuggucugagccacagcagccgagucucucuguggagcgucuuccuuuugcuguucuuucuucucaaggaagcugaagggcuucaaggaggagagaaggaguuccuuucucuuccgaaucccagcgcgccuccuugccucucugcgcuccaugaucuccugauagaggggcagguagacgugugccggcacaggcugggcccggaacugccgauggcacuccgccucuuccucgcccugcuucugggccuguagccuuuccugcucaaaagaggcaggugaggccagccacugggccuucuuccgggccucacgcagugucaugcggaauggcugagggacggugauggaagaugcccaagagcaaacacuucugugcugggagggaggcccagagucugagguuggcaggauccgagccuugggaaugucagagggaaggcuagucauggagcugcagcgccucauggagccaugccuggggagagagugguucuguguggacccagcaaacaggaggugagguuccucccagagacccuccuccauuuccucccugcccagcagaucguaaccaagagacuucuuagucuugaucccaaagccccaaaggccucuaaguuuuuaacccuaucagcuagguuucccuucuugcuacaacacaggcacuccuagcagcccaacaggaacuaucuaagaauucauacaggaauugccacuugcauucugauaacugcauacaguguagucggcuagcacagggccaccgagucagaaggauccaauuggaacgucagguuuuuggauuucccauguagaguggcagagaucuuacccacuuauaaggucacugggaagggaguacauuacauuugguaaaggcagugugguggcaugacaggccugaagccuuugagagcuguaacugggaaguucaagaguuuggggccauggacuacaugagacccuggagagagagagagagagagagagagagagagagagagagagagcgcacauauaugauuugagagaugugucacagacaauaaaccuugucguucguggaggaaaagauguuugggaaaggcauccuuugcucaguuccacuaacucaugaacuaaguguugcccacaguuacuaaggaucacuggguaagaaccaagacacgcgggcuagagagauggcucagcaguuaagagcauuugcugcucuuccagggggccuggguuugauugccagcacccacguggcaguucagagcugucuguaacuccaguuccagggaauccaauguuccccugcucuccguggugacuaggcgugagcaugguaugcauacccacugacaugaauauauuuaaaaggaaucacaccgugcagcagauccgagaacuaacggggcugcgucuuagauaagugguaacgugcagagguggccuuacagagggaaaggcaaggcccugagacaugguaugacuguucuggugugcuggagcauggcagccacugagugcaaugccuuaccuaagagauggaggguccuggaccuguggcuucccccugcucuugucuuggaagaagcucuccaagucuuccucauccucagcgucguucagaucacugucuggaucagacuggaagagagacuccaauacaucccaccggccucucugcuucggaaccugugggguucuauaaaagcuccccguggagucggaaguagaaucuguguccuccuccgggcugaggaacucauggaguuugccagcucugggcaaaaccagcccuucuccaaacugcucaucuucuggcucagugucugaggaggacgacuugggaggaaauaucuaaaaaaaaaaccagacaucagugagacuuaaacucuaauuucaaagguucucaagacauggcucuagcuucacuuugacugcuucgguauaucagggaccaggaaggggcaacagaaaguaagaugcauucuucauucaaaaggcacugaacaacacagcguguguaugugccuggcugugcauagcaaaggcugcagaagagcuaagggcaguucucugcuccauucagcacagaaagaggacucuggguaccuaaccugacccacacaguaugcuuccagugcuccaggaauccugcccaugaccuggcuacauucugcucccaguucacuugaacuuuauauaauucuuacccuucuuccuuuucuuauuuucucacugacacccuuacuuuucucauacucuaaccaguuuccacaccaucgccaggaauggaugauuaguggggagacgauguaucuuggagaaagagcagcauggaaaguggaacucccaaauagaguuuaaagguucuaagggcuacgagugaagugcaguggccuugccuagcgugcucaaggggaucaaacgugggccucauuucccagcacuguaaagcaacagcauuguauuggcuaguuuugugucaacuugacacagcuggaguuaucacagagaaagaagcuucaguugaggaaaugccuccaugagauacaacugucaggcauuuucucaauuagugaucaagggggaaaggccccuuguggguuggaccaucacugggcugguagucuugguucuauaagagagcaggcuaagcaagccuggggaggcaagccaguaaagaacaucccuccauggcuucugcaucagcuccugcuuccugaccugcuucaguuccaguccugacuuccuuuggugaugaacagcaguauggaaguguaagccaaauaaacccuuuacuccccaacuugcuucuuggucaugauguuugcgcaggaauagaaacccugacuaagacaagcaucaaauuacauccauccaugugugcauacaagauaacauggguugggugccuagugugccauugucuuagauaagaguuucuauugcugugaugaaacaccaugaccaaaaagcaaguugggaagaaaggguuuauuuggcucacacuuuccacauugcuguucaucaaugaaggaagucgggacaggaacucaagcagggcaggaaccuggaggcagaagcugaugcagagcccacagaggagugcugcuuacugguuuucuccucuggcuuguuuagucugccuucucagaaaccaggacuaccagcccaaggauggccccaccaaccaugggcugggcccucucccauugaucacuaacugagaaaugcuuuacacuugguucucauggaggcauuuccuuaacugaggcucuuuccucugggaugauccuagccugugucagguugacacaaaaccagccuguacagucaugaagucuguuuuccggugagagcagagggagaacacgggaggguaacguaaggaagugugcgcuuggaaggcuugucuguggcuacccgucagagggcacugggagggcaccaauacucaggauuaaauguaucaguuuguugcacaacaucauggaaaacuauagcaaaugcacagggauggacuaggaucagcauguucaggcuguuuugagaggagggauagggaagagggaucaacucuugacagguacugugaugaaugagaauggucgagaaagguagagagcugugcaauaucuuagggcaaagguaaacagcugauaaggaugcauaauccuuuagaagacagaacuguuaguaagucugcaacuaugguauggacccaggaaaagcacugccgcuuggugaccuugcuccugcccuuggcuguaucugcuaggcagaguacagaugcucuuucacacaugaugcaucgucuauauccagauaaguccauucuaagucacaguaguuuaaguaaaaacguacuaauacauuaaccuacugagcagggcacuuagagaauagcuauuguucacacuccugauugugcaacucacuagaaauagcaagucccuggacacugugucaccaaagcagagaguguauccuauugcuauuuaaagaaagacugaaaucuagagcugggaauuuagcucuguggagagcacuuaccuagaaugcacaggacccuggacucaguccucaguaccauaaaaauagaaaaauaaaaguauggaguauuagccaggcagugguggcgcaugccuuuaaucccagaacuugggaggcagagguaggcggauuucugaguucgaggccagccuggucuacagagggaguuccaggacagucagggcuaaacagagaaacccugucucgaaaaaacaaaaaaaaaguauggaguauuguuucuacugagcgcaugcuuguccaucauuauaguguggagagcaaucugaaccacugagguugggggugucugacuuugaguguuagggugauuuuuauugucucaguugagucuuguagugauagagggaaggugguguggcuggaggacaguggccugagauguccuuagagugguagguacaaggccaccaguggacuauugaugauuaguggcaauuggagcaguccaucugaguuagagauaagugugugcucuaacccuagcucugcugcugaagaacaugugaucuagagcaaaacucucuccuuccccugccccucucucucuguugugacagggucaaagggcgaccuugaacuccuuauccuucugcuuuaguaauuugaguuguugggauuacaaguuugagccauaaugcuggcucuuucguuuuaaaaacaacuuuauugaaacacaauguccauaguguacaagugagccauucaaagcguacucuccuccaguuucuaaaacagccagggucaucuagcaaucacaguagaagucagaccauuuucaccauuccucuaaagcaguguccucaacuguucuaaugcaucgacccuuuaauacaguguuucaugugguggugagccccaaccauagucauuuucauuguuaauacuguaauuuugcuacuguuaugaauuguaagguaaauaucugauaugcaggaugaucuuaggugaaacagauugagaaucucugcucugaagcaccaguguagcauuuaauugucacuuauaucccuuaacccucccacaucuuccucucaaccugucagcccuaggcaacuaccagccuacuuucuguuuucagagauuucggggcaaauugcuuaacccaucucuuuucuuuucuagaaaauggguuugagaggauacaacacauuaaacacauucaguuuaaugaauuuuaauauauuugaagagcugcguuucggugcguuuuccuuacucuaaaacgacaacaaaaaccuuggaagcuuuuagaagucucuccucaccuccucagcccuuuuagaagucucucccuguuucuccucaccucagccccaugcaaugacgcgcccccuagauuugccuuuucuggauaaucauauuaagauagagaucgcuuuuaagauuuucaagguuaauucgugguuuguuauuaguacgauuccugauaucagagccugguacaagacacaaaagacccacgucccccaagacugguucucuaagugcccaagcgcugccaauuuuaauucuucgcccuuugaugacacgccccugacucugucuccacggcaacgcuaaacaguuuccacucuugaggauuccuugcugaggcauccgacuuccuccuuucuccacucaccucacggcuccacucggcgcacucaggaccucccgcaguccuccccacagucaucuuccuaacuagagagagagagaagcagaggugaaagcagcagugacaaccgugacagcggcgccggcgguuagguacugcuag

SEQ ID NO: 6746 - RNA, 35175 nt, Mus musculus
cgaggggcggggcggagaucgcuccgaggcggcgggcguccgcgccagggcggcgcgcgcggugagugugcacgagccucggcggcgcucccgggguuggagccgggcgggaggccgggagcucggcaggggcgggugucgggcgcggggcugcggcgucuuagccucccacgacuugucucgcgcccccugaggcuccauggccggcggcucuccgaccgccccgcgcgcaucggagcggcgccagugaggcuugaagcgcuuccagucgggcgggcggaucuuccaagccucuggcgcggccaccguggcgguccugcccgcaucccugcuucugucucgguggcggcgcccucgcugcccgccucaugcuuaccuccccuccauccucgcuucugucucgcgggcucccuggaggacagugcacccggggacaucccaggccaaacgcuuucagggaggcaguugacuuuuccgagggcgguggcuugagugaggcugucagccuccgaggguccgcgggcuccggugcucagacucuggcuccccugccuggagcgguguggcgggggggggggggggggaucguugguccccggaucuagguggcaggugcuuggcuccagccgaccgccagguuccuguuaguuaacaucgcccacauccucuagugccugaagucccauugcugcaaguugcauaaaguugcaagcacuugccucgcacccggguucccgaggaguaguacuccauccaguauucuaguugguucagaagaggaacccugugauuaugucuucauucacugagcgugagugagucauuacggaagacagguauuguggcugccuugucaauaggcuugggagugaagcgcgguucugcuuuaucacuccgcuucaaauuucauuuaacauuuauuuugaaacaucauuguuagaacuccuccuccccucucucuagggagaccuuaguuacuaagccccuaacuguaaggugacaucuuugaccucuaaaucucucuuuucccaccucaucccccccccagagggcgugguuugugugguuuguaaauuuugcgguuagaguaagcaaguagauuugaugagagaccuuggaaaccguuugaaccuucugcuagcacggcuauggccuauuuugacuauauuucuggugacaugccaugaacuuaugaguagaaucaccucuacaucauguaccuucccuuagauaauguacauuaccucugagaagcaaucuauaaagcaccuauugcuaacuagcagaaagggaguaggggcauuuucugucauagguauguauauuuagacuuuuuauuuauuuguuuguuuguuuguuuuacaaaaauugguuguaaauaaaagccagucccacauuuaccauuugaauauacuucuacagauuaucucagacauaaaauuuugacuuaaaauaaaagugucuuuguuuauuuuuuucaccguuauuuuuauuuuauauauauggacguucugccugcaaaucuaugugcuagguguaugcagugccucuggaggccagaagaggucguuggaacuugaauuagagaugguugugagcugacauguggaugcugagaaucaaaccugggaccucuggacuagcauccagugaucuuaacccagagccaucucuccagaccaucacccccucuuuugagauccagccucacuauguguguuuuccuggacuagaacucucaaagaucugcuuuccuuugccuccgagugcugcaauuaaagauguggagccugggaacguugcuucuuaacauaugcauagugcuuuucuuauuuuauuuuucuuucccaaaacagaauuccuccauguagccuuggcucucucuguagaccaggcuguucuggaaaucacagagaucagccugccucugccucccaaaugcugggauuaaaggcaugugccaccacagccagguggcagguuuguuguuguuauuguuguuuugaggcagugucuaguauacagcuucggccuucuaggaacucaagguguagaccaggcuagccuugaacucaucugccugccucugccuccggagugcugggaucaaaggugcgcacugccacauuagcuaugcacagugcuuuaaaguacuuauaguuaauuguauuuuaucaaacaaauaauguuuuugauauuacaauaaaauuauaucguuuuaacucuuuuuaguuguuguuguuuuugcuuauuuggguuucuuugaggcaguguuucucuauguauagcccuggcugcacuggaauucucuguagaccaggcugaccuuaagcucucugagauccccugccucugccuucugagugcugggauaaaggugugugccaccaccaccuggccucauuuuacucuuuugugaauguuuuauaaauuaauuuuuauauuaaaauuuaggguguaaauauauaucaaauuucaaggucuaccuaaauuuauugauauuucacaacccuacucaaaaaccauuuuuuaaaaaauuaaaauauaaaacauccauuccccuccccccuuuuuauuccauucagcuguaaccaaccccauaucccccuagcacuuacuuaucuucucucucugucucugucucucucuccccccuucucuuucugguucguggcuucuuuuucuuuaacuguuggugcauauauuuuuaauuauauauauguguguguguauguguguguguguguaucuuauauauguaaccauauauuauauauauagcaaauaaaagcaacaugcucaguucauauuauguuacuuacuuguauguauaugaucaagaugaggccaauagacuugcuaacauggcagggagaaaucucacagggccccuacccaacccuagacaagcacuacaggcaacuaagggaugcugagauugggagaaauagucuuacccagggaagaaccucccauugguuacucagucccagauggucagacaugaauauauauuuuaaaacuugugaauuuacucucuacaugagucuguguguguguauauaugugugugggcaggugaguguguguaugaauauguugugugcauaaagucuauucucuccuuucuggguucugggaauugaacucagguugucagguuugcauagcaaguacucuuauucacagagccaucuugccagcaccauguguaaucacuggagaaaggccaagauacuucauuuugguagaaguaguucuagaaacuacacuguucuccaccaaagaacuggguauuguuauucagucagcuauugacaagaagcaacugauagcacggaguaugcaguaggaaguuccucuucagaagcuuaucuguuaucauuuccuucugggauugcugguggguagcuuuacuguuaaguuucagggaaauacuuuguuuuaugaauuugcuuugucucauuguugggaauguuaaaugcuuuuaagacauaagcuauauaguguuuuguugacuggggcuuguuaacuuucuauguucaauccuuacaguucuugguugacacaggaaugaagaguguauuggcugaaucuucaagcagaggcgaucauuaugacccugguaaguagacuauuuauccagauguagguaccaccucagcuagcuuaaugcugaauuuguacuucagaggcuucuggguaggaauuguuuguuuuauguuauuccugaauuugaccaccuuuugccaaaagauuuuuuuuucuuucucaaugauuguauuauugucagaugucaguucaggauuauuuuguaucaaaauuaauaguauucauaaucuuuucuccagguguuuucauaacucuuuaaucauuaguuaucugugauuuuacugggcuuuacuuaaaauuuuuacacugaaaacauuguuaauuuuauuuucaugaagccuuuuauuuuauuuuauuuuauuaugguuuuucaagacaggguuucucuguguagccuuagcugaccuggaacucacucuguagaccaggcugacuacgaacucagaaaucugccuaaauaagauagcuuaucgccucauauguucacuauaauuguuuauuggggcaguauaaaccccucuccaauuaaugguguauucuuaucuaaaagacugauuuucaugcguggcugagaaaagaccuugugauuggggcgggaggagcaguugcaacagcugucucuggaagguaauuauuguagcucagucaggcucaaacaauggagaauggaggcugguccugccagauucauuuugaucuaaagccacaguuucauuguacagagugagcguuaugggcaguagugaucugcgugugacgcuguucugaaaggaauaagauacagaaggaagggcuggugagauggcucaguggguaagagcaccugacugcucuuccgaagguccagaguucaaaucccagcaaccacaugguggcucacaaccauccguaacgagaucuggcgcccucuucuggagugacugaagacagcuacaguguacuuacauauaauaaauaaauaaaucuuuaaaaaaaaaaaaaaaaaaaaaaaaaaaaaaaaaaaaaaaaagauacagaaggaaggaauugaguguaagaaagagcuuuacauuucuuuuuuuuuuuuuuuuuuuaaagauuuuuuauuuauuauuauauguaaguacacuguagcugucuucagacacaccagaagagggagucagaucuuguuacggaugguugugagccaccaugugguugcugggauuugaacucuggaccuuuggaagagcagucggguacucuuacccacugagccaucucaccagcccccuuuacauuucuuguaacuagcagcacacggauucuaaaccucuacuggaguuagaggauuugauuugaggacuggaggaauguaugaagaaggaaggaucauaaagaacuuaugcuucacugauggccaugugcucugacuaguguggugagguuugggcugagcccuugaggcagaaggacuucccugccccgacccccagcgugagaugacucuccacacagagaaagucugacugcuugcuccugcuguuuccauuuacacagauuuuuaaauaacuccuugcugaugcuuugauaaaaaucgauuuuucauuaagccuuuuuauuaguuuuauugauacuucaaaugacguauggucauguguuuuugugauuuucaaagcugugucgguugucaaucuuaacccuuucuaccagauaccucuucuguacacuauuaaucuaccacugucugguuagagacauuuuuauguauguacuguaaaguaaguuccucuucugcuuauauuuuuccucugaguauuuaguuacaguagauuguucaauuauuuacuaauagaaauagugcuuaauauucauuacucuuucagaaauguaccugacuuuuauuugaaauuuuuaauuuggcuuugcuuauaaaaaugagcagaauauuguauaacauguaguuuuaaaaguuggauucuuucccuuaaguaauaugaugagacuauuaacauaaaauaaaaaacuucaagggauuuuaaaaaacaguauuaaauuuuuacuacguuucuucuuuuuauugccuuuuuguuuguguuuggguaacucuggaacuuccucgguagacuaggcugagcaguaguucacaaagauggaaucguagugagaccugggggguggggagcauugcccugucuccacugcaugcucccuuaguccguuuggggugcauucacucauaucuaagguucaaugaguguuacccguguccacaugcuucagauagcaaggauuccgaggcccugaccuuggcguuaguuacgucccaccccagaugaggcuucguuuacagcugaguucucucacgcucaccuuauuagguccccucccuuugguuuaguguggccuuggccauauguagugccauaguuaaguuuauuauucgaaacuguuaccuaguugcauuuuaaacuugcccuaugcuuaauguuuaacccuguuaaagacagcuuuccuguggccucaggugaaucagcaguaggcugguuucccugcuacugauuucagaacuauagguggacuucucuaguguccuauccuauucuguuguuuauaauuguuggcaaauauuguccuuuuauccaaguuaaucaguacugcuaucugccuagggggagaauagagagacuuuaauaauuacuuuagggugucaccaggaaaagcaugccugucccuugaacagucugaguuagugucuccagaacuacuuccuugcauuugucuucuuuauucuggaauacccauacuuucuaggcauucauuucccaugagucaccucuucaggugaaugucuucuuuugacucaggauuugccuuggcccuucauccuuuaagaagcccucccaucaucuccgacccccauccuuccccugcuaaccaacucuaaucaucucuuacccccaucgucuuucccuucuaacagcaccaacucucuccccuccuggcuccuugcacacauuucugccagagaacuggucccaacacaugguagccauuaguguacccauuuuucaccgugagucuccccacuaaaacuggugaccuuuguagaucuauacucuagccugaugccugacauauuagacacuuaguugaaaaacugaugcccagcuuucuagaguccagucugggaauggaaacugucuuuuccaccaccuaucuaauauaaaaacaaacccagggaccagagagaugcucagugguuaagagcacuuuuugcucuuguagguuccagcacccagguggugguuaaugaccaucuggaaccucagcuucaucacauacagugcccucuuuugaccacaaacacauggcagacacaacaagguggacacauacacauaaguaaaaaacaaaaucuucaaaaaaaaucaaaauucaaggacuuuuuuuuuugagacaggguuucuuuguguagcccaggcuguccuggaacucacucuguagaccaggcuggcuucaaacucagaaaucugccugccucugccucccaagugcugggauuaaaggcgugcgccaccacugcuuggucaaggauuucuuuuuauauacuuauuuuuguuuguuuguuuuuucgagacaaaaucuggccuuuugagcucaugcuggccuugaacugacuguuaucccugggugauuucagacuugcaaucuucauaucgcagccucucauucucaaaccacaggccuguucuaccaagccccucuagaauuuaauuuaauuuuuaaaaaaaauguacuuacgggcuggugagauggcucaauggguaagagcacccgacugcucuuccgaagguccagaguucaaaucccagcaaccacaugguggcucacaaccauccguaacaagaucugacucccucuucuggugugucugaagacagcuacaguguacuuacauauaauaaauaaauaaaucuuuaaaaaaaaaauguacuuacucauuucguguaugugaguacccuguccacugucaucagacacaccaggagagggcaugggaucaccauuacagaucaccaugugguugcugggaauugaacucaagaccucuggaagagcagucagugcuuuuaaccgcugagccaucucuccagcucccuagaauuuaauucuuaauggacuucuacccuaugggcuauuggugcugcacaccuuuaauccccagcacuggggagguaggaacaguaggaucuccgaguucaagaccagcuuggucuacaaagcuccaggacagccagaacuacacagagaaacccugucucauggcggggagggcagaaagaaacuucugcccaauggacaauaauucuguugguuaggauuuagcaauucuaaaaguaaacaaaccaaucauguaugcagaaaaaaagguggagaaguuaagaguaaaagauaaagaagagaaugaguuagcaaaaaucuccucaguuauaaaguagcacagggugacucauuugugaagcaaggcuuguuucagaagggcuggaccaggagcaaagagcaaaggcaauccuggugcuccuggugaacucaggcacucacagcaaacaggcaggcaggagcuggugaguacccgagggagccggggccuccugcauuguaggauccccuauucuacaggacugggggacugaggaaugagcaaaaggugaggcucuagaaggcuaggcauggagacuaguguuuggucugguuguaaacaaacgugacacacucaggaggucaaggcuggaggaucugaguuagagacuguagcagaauacaaacaaacccaaacugccguugaaaagaccggagcaggaggugggaaugcaagaccugguaccaaagauuuaaagcaacugaagaggcugugcuggggagagaagagaaugagcaagagauuauugaagagaacaguucugaaaagagugggcuuagauauauugugguguucuucccagucuguaaaaaggaaacaacggucugcauuauuucaaguagcagauaaagccugaugcauuggacaaaaugaaaccuuugugugaucuacacacuugggaagauagucuguccuuggcucauggagcuguguccuccagaguggggugauuaauccuguggaaaaagucaagcuccugaacuguguuaaauggaccuagagccugagcuguagguccgauuuuaucucuucagaggauuuauccagcacucuucagaguguauuauccaucuuuuagcaauaaguacaucagaggcaaaaaucaaaacucccuguggcuggggagcucacguggggauggaaguggagaaagggggaguguggagauagagguagacugguguggggaacaguaaaggacgcacauugggccagcugaguuagaaaguggcaugugagcgaaggcuguuaaaaugugacugagcaagcugugcaagccggucacagggaaggcagugcccuccugugagucccacauggcaagcccuucuaaugccaguuucaaaaucaccaaacuuaaagcaacaggugaugccagcgguguuagaaggcagggcccgagggcagaggacaucucgagugcacacuugcuuucugaucaacccuuugccugaccuuuuacuuacacaagugugacucugcaguuucucacuccguggaaacagauacugcguguguuacccccuuuuaaucucuucuggaagagagcaaauguuuacucagugagauguucgcuggacugguuuauggagccuacaguaauauagcaaaucugagugaccccugaaggggcuaagugacacacugagaaggcuggugccugggccucucagagagaagagagagaccaaguguuggaccaaaucugaaacagccgggcacgguggugucugcuguuaauuacagcagcgggacucggaggcaggcugggcucuucgaguucaagcccagcuaagacuacauaacaaaaaaccuuaugaaaaccgcaucucuguuuucagcuuuuuaaauuggccugcgugacccgcccacuugguguaaaagaagaaccggccaaagggagggccugaaggagugaguacagagcuggucaggcugguugcuggggaugcaguugucccugugugggauucuggaggauuuacaguucccuuguuucuuugccuacacaguagcuuucauucuuggccacgggauagaguugaaccuugguguucaaauagauauucaaacugccauugcuguguguuaguguaacuauaguucuuuuaaauaguuuuaaacugcaaaugcaauugacuuccauuugccuuacuuuauauaauguaucauuucuguggagaggaguauuuugauuaaacaaauccuaaauuguuaaccagggagagucaucauaaaccuguauacugcaaaccuaccaaguguucuguuagucaucuacgaaagauagagggccuggaaaauagccuuggucucaucuugugaguuaaccagcaguugugacuuaacacagaaaaauguagaaaugaaagugggaucagaagaccguuuggaauaaauacauaacagcugacuaagcaagacuuaaccguuggaggagagcugucaggaaaacguacggccuaaagcuggagauagcuggaaaugucuggagucauuuuuugguuggcacauuuggcauacuaggcagagguggagugagcucucuaugggugucuagugaguacagaccagagaugcugcuaaacaaccuacucuacacagcacagcuuaugacugggaaccaccagccagacgguagugcucguuacagguuaggucagcuacaaguccucaaauaccauccccugugguuuucuuuuucuuuucuuuuuuaagauuuauuuauuuauuuauuuauuuauuuauuuauuuauuuauuuauuuaauguaugugaguacacucuacagaugguugugagccuucaugugguuguuuggaauugaauuuuaggaccucugcucucuccagucagcucugcuugcucagucccugcucgcuccagcccaaagauuuauuuauuauuauacauaaguacacuguagcugacuuuagauacaccaaaagagggugccagaucucauuacgggugguugugagccaccaugugguugcugggauuugaacucaggaccuucgaaagagaagucagugcucuuacccucugagccaucuugacagcccccauuuuguuuuuuauuuagugucuaucuaggaaaaaaaaaaaaaacaauguuuaaagcaaccagguagacuugguuccauuauucuaaugaaugcuacuacuuuagguuucuucaauugagauuuauuuuauuuuaauugugugugugugggugaguacuugcaugagggugucagauccucuggaucuggaauuauaggcaguuacaaacuacccucugagcaugcugggaacugaacucagguccucuguaagagcagggcauacucuuaacuucugagucaucucucuggcccugcuaaugaggucuuuaucagagacuucaagaacauucacaacuuccuuuaauggcuuugaugcacuaugaugaaaaaaaacuccagcuucuuguacauuuuaaaaugucaauaauaauaauaacugauaacaguauaacaauaauaauaacaacaaauucauugucuccucccauuccccaugucagucuagagaaagauuagaugauauuauaaaaaaaaucuuuaaauaauacuguauaauuuaaaaacagaaaaccacauaggaaagaaaacagaacacuggcucguauucucacguuagagaugaggcuguggaggcucagaggcuaagggaaagcaccaggcuggcgcucaugacugacugaacaguugugcucgauccacugugucagaugucuuuaugcuagguuuccagcagcguguguaaccuaacccccaccguacacaaauucaaagcaaaugauuaccuaacacaucaccguuuuccucuuuucugagggcacauuucaaaauacaguugcuuaggccaggugugguggugcacaccauuaaucccaguccuugggaggugcaggaaggugggucucuauagguuuguggucaguccggucuacagagugaguucuaggacagcuagaguuacacagauccugucucaauacacaccuuugagacccuacaauucaaagcaaggugugggaaaauauccuuuagauuccaguuuccucuuggaaucagauacucuucagaagaggggcccagccugugucgcccuggccuagccuguuguacugguuauucgaaauacaucaggaacaccucagagacggguaggauuuccauaaggaguuuauuuguuggugguuuguuuguucaacauaaguuaaccguaaacgccagccgacauaccuguguaucuuuguuucugaagccuccacaggagugugagcagcacugcuucagcaacaaagccucagguccacaucuugggaagaauauggccacuuccuggggggcugucuucaugcugaucauagccugcguuggcagcacugucuucuacagagaacagcagaccugguuugaaggugucuucuugucuuccaugugccccauuaaugucagugccggcaccuuuuauggaauuauguuugaugcgggcagcacuggaacucggauucauguuuacacuuuugugcagaaaacagcagguaaguacaucugggacccuuugcaggcugugugaguccguaccuuagcaucuucucccagaaacagaugcugaguguggcauguggauguagagauguaacugagcacauaguuuaguuuaguguggaauuaagagagacuugugugggaagacugaggcuuagcucaguuaguagagcauuugccuaacauucacaaagcccuggauuugauccauaguuccacauaaaccgggcauggaagcacuuggaaggugaaagcaggagaaucaggaguucaagguuacccuuaucuaccuaggauauuugaggccaguguacaauacaagcugucauaccaagcacugcuucuccccugagauggcucgagagugcugccccuacaccacugugaaaaggcagagccaaguccaaagcgggagucacacagugguucucagguccccucucuggguaccuaagggcagagagagggaauugagaaccagggguccaccggucugccuuucccucuggacagcugucuaccaggcagagaggggaaaggcagauccccagacgguggaaccccaggcugauuuggagcaagugccaagaguauggagaaggccuuccuugggggauuuagacccaggucuuuaagacaaaggucuuccuuaaugaagagaugauccuggcuuguucauacugguuuauuugauggugggugugaauguguacacuuuauuuggggugaaccagggauuaaauaccuuuuuccagaaagacugcccaggaagggaagcucauugacugaaugguaucuagauucuucaugaguauggagaacucuggguguuuaugcuaugugaccccgugcccacgguccucaguggggugucaugguuacaugcuccaaaguagacaaaggcagguagggaguggcuucccuccugcaguucucaauucugagauuccugcgguuugaacucauccagccuuaucauuuuuaugccugucugggaacaaggucccacaugcccuacaacaggcauugucucagaaaggaaagagggggaguuuuuggugcaaguauagcugugauuuguucuucaucuucucuaaagguuaauaccgcaaaagucuagaguauugagaguguuggagugauuccgggagaagcauucuuucacugccauccuuggaaaggggacugacgggucuuugacuuaacuuuuucugaauuaucuggaaagcccagggagcccaggcaggaggacuacaauccagcuugcguagggaguucaaggccaguuugggccacauauugaaacccugucucaaauuuuuacuaacaguuuaaaaaauacagaguugggagaaagcagugagagcuaaagucccagcagagaggccgucacagccuccagggcugcacggcagccuguguucuccuuccuaaugcugcagcaaagcacuccgcagaccaugggcggggaucacggggaugaaacagcucuggauggagacugugguagucuauuaaaccauguacuaaugucauuagcaucugaagcagucuacccucugacaaucaucuccucuuuuucuucuucuucuucuucuucuucuucuucuucuucuucuuccuucuuccuucuuccuucuuccuucuuccuucuuccuucuuccuucuuccuucuuccuucuuccuucuuccuucuuccuucuuccuucuuccuucuuccuucuuccuucuuccuucuuccuucuucuucuucuucuucuucuucuucuucuucuucuucuucuucuucuucuucuucgcccucucccucucccccucucccucucccccucucccucucccucucucccucuccuucgcccucgcccucucuucuucuccuucuucuuucuuucucuuucuuucugucugucugucugccuuucuuucuucccuugucuguuugucuuucucccauggacaaaauaggacagcuccccuuucuggaaggugaaauuuuugauucugugaagccgggacuuucugcuuuuguggaucagcccaaacaggugagucuuacaaucugauggacuuuguuucuauuuuauguaucugagggagcaaaccccggagggagugugugcucuguggcugagcucuguccaugaacccuuuccauuuuuacuugagauagcaucucacuaaguuggcauggcuggcuuugaacucacucaguggcauaagaaggucuuauaauugugauccuacugccucagccucuugaauagcuguaauuaggccaacagaaccaggccuggcuuaauuugauguuuaggguucugaaucuuaauaagucuacaacaccccugucguuaaacaucuccugguguucaggaguaauacugaugagaggugaggucauuuucccuucuuggugagucuucugaaugaccauaacuguauaucccagacucccaaggaguggguagaaggccggaaaguagauuuucaaagcugagcagaugccucccugaguaagaguguuugcugugcaagcgugaggagcugagcucugaucccagcaccgucauaaaaagcuggccauagcguuucaugaauguuuguaaccacagcucagugggaaccaggccagagaauuacugggccuugcuagcuuccagcguagguagggguggugauucauaccuguaaucccagcacuugggaggcugaggcaagauuauuaucaggaguuggagcccagcuuugacugaaauagcuuggccuuugugugauuugacaucugagagaccuugucucaaacaaacaaaugaccagaauagugugagccugaagaacggagacacacuuuccagucuagcagguggaauggcaaaugugcuaaggacugaccuguugaaagcaguuacaucagcagaagacggucugacauuuagggaaggugauuauacggugcuugcuaaggggagaguguggcggcucacaccugucaucucagcaugguggagucugaagcaggaggaucaggaguugaggguuagcucuggcuacauaaucacuuugucucaaaagguaggggcagcuuguuaccaggauacauuuucacuuaggaaaacuguggguuuaaaucuuuuucauuuuguauguguauggguguuuuuccuguauaucugucuguggucaugugcauacaguguccgugguggacggaagagaguaucagacacccccaggaauggaguugcagacaguugugagcugccaugugggcgcugggaaucaaaccugggcccuuacaagagcagccaaugucuuaaccacugaacuaucucuccaacuccaaaaacaauccaaaauaauaguuuuaaauagucauagguuggugguaugcugagugcccugcauguugguauuagugauagugaaaaaaaaagaaaagaaaagagaaaagaaggaaccaacagagagauggcgcaguuaagagcacuuccacagguccugaguucaauucccagaaaccacaugguggcucacaaccaucuguaauggaauccgaugcccucuucuggugugucugaggacagcuacaguguauucuuuaaaaaaaaacaaacaagcaaaacaaaacaauaacaacaacaacaacaaagaaccuaucacacuguccuagaaauuacauaaccgcuaugguagcauuuugugagcaccgugccucauccaguguacacagcaguuuaguggcaauaugagacauagcugccaacccuuacccuagaaacccaagcccagggaaagcugaguaacccacacuaggucauggcuagcgagcaaguccugcgacuccagcucuugaauucucugucugacuuucuagcuuaaaucuaauuuacagaaacauaaaauaacaauuauucaaaauggcagcucuguaaaagaaaugggggucuccuccuugaaaaugcuccauuucucuagguuuugcuucugaagagcagagggguuggaacacuuggagcacucguucuaccagagagccguguugcucccugccucucucuugaaggaagagaccagugcugcuaagugggcugccauggguugacugugccuucuuucuuacagggugcugagacuguccaggagcucuuggagguggccaaagacucgauccccagaagccacugggaaaggaccccggugguucugaaagcaacggccggacuccguuugcugccugagcagaaagcccaggcucugcucuuggaggugaguuugaagcuggaucuuggauaacgcuugucuguucuuuuaaggagcccgucagaguggcagcugcuuucggugaccccucauugcucagucaugguggugaccaggauaguaacuagucauuuccauuuuaaaugaucacccuugaauuuaaaguguuuccccaaaaagaucaaagcacuuccuuccaugauguuuuuauugcaucuauuuguuuauuuauuugugugugugugugugugugugugugugugcgcgcgcgcacacacuuauaugugccaccgcacagcuugccacagaggacagcuuacaguucguucacuccucccaccaaguggauccugggggucaaacucaggucaucaggcuuggcagcaagcgccuuuacccacugagccauuuugccugccccccuacauagucuucugccacagaccaccccagccggguaugggggucccuggaaugaggguccucgaagcuagguggguaaggauucggcagugacaaacagaaacaaacacaggcaguuugaaucugaguauauuucgcagcucucaagcaggggauuuuauacauuaaaagaauucuuagaagauguguucagugaagcaaucacaaauaccaucauuaucauuuggcacaguaaagcacacaaaucaagcaagcauuacaacucugaaaagauguauucagugaaucacaaacagaacaggugacaucaugauuaauagagaucauccaaguguaacaacgcugaaaggguguauucaguggggcagucauccaaggcuaggggcauauuuccaagagcagacuaauaaaucuuuauggucaauuauuguuuaauaucuaauaccugauuuuuuuauaaaucuucaaugcagaaauuuaaacuauuuuaauucuuuuucuuuaaggcuuucuuuaccauugucuuagucaggguuucuauucugcacaaacaacaugaccaagaagcacuuggggaggaaaggguuuauucagcuuacacuuccauacugcuguucaucaccaagggaagucaggacuagaacucaaacaggucaggaagcaggagcugaugcagaggccauggagggauguuccuuacuggcuugcuuucccuggcuugcuuagccugcucucuuauagaacccaagacugccagcccagaaaugguccuacccacaaggggccuuucccccuugaucaccaauugagaaaauaucccacagcuggaucucauggaggcacuuccccaacugaagcuccuuucuuugugauaaccccagccugugucacauaaaacgagccagugcaaccauauaccaaagcccaccucugaugauacacguguagccauaugaaauuuuauuguugggaaaguuuuuauaaugucauaauacuauuauauaauuuuguaaaugauuuauaaaguaaagcguugguuucuccagagauaagaucauguuaguggccccaucucuagggaugguuucuuacccauuauccuuacuuaagaucuuggccuaggcugccaggaacauguaaaugagaaaaagaauaagagaaaucaaaacauaaauugccaugagaacuaugucucaauauuuugcuccagccaagaguuccacaaccaggaggccuuccccuuuugaagccaaccaccucagucuguggaacuugucacagauucuacugggguuggugugguauucuucauuugaauuuucuaacaguauaauauagaaaugguuuuaaauaaacucuaccaaagaaaauguauguacagugaagggcuggggagauggcucagucaggaaggcgccugucaacacaugccugagcgccuggauuucauccccagcacacaugaaaacaccaggcacgguggcacacacugugcggggaaugaaccccaggucccggugacagaccuugggaaaagaaacucaaaguuucuucuuacguuucauacaaguggaauuauauagcuuauauucucugguuuuguaagucugcuuuuuuuuucucucagauaaaauguuuaaacuauuuuuaaaaacauuguucuucaaauaaaaaaacaauaaguauaguuuuucaagcuuaauauuuuauuuaucauacaaacuuauaaacauauuacaagauuucauguuguaaagaacauuuauagguagaaucuuguuauaauaaaaacaaaucacagcaaagugggauucugcccucuaaacuaaagcggccaccuaaaucguguucuuuucccacuuugaggugaguuguaagcacagucuuacugucaacagguuuucugugacugucaacagguuuucugugacugucaacagguuuucugugacugucagcacagaggguuuaagucccuuguccagcaucgagcaucuagcauguuugggagaauucagaucccaacucuuuuuuguuuuuguuuuuguuuuuaaagauuuauuuacuuauuuauuuuauguacgaguacaguauagagcugccuucagacacaccagaagagggaggacaucagacuccauuacagaugguugugagccaccaugugguugcugggaauugaacucgggaccucuagaagagcagucagugcucuuaaccacugagccaucucuccaggccccaacucuuauuuaaaagcuuuuucuucagauguauuuauuuuuguuuuaugaguguuuuacccguguguguuucuguguaccgcaugcguaccucuggccguggaggcgagaagagggaguagacccuugaaacagaggauggauuguugugacccucaaugggguaauggguauggaaccuagguugucugcaagagcaaugagugcgcguaaccucugagccaucucuccaggcccucauaccccaguucuucauccucauucacucauucacucacucauucauucauucacucacucauuuauucauguguccaccaucugagaagucccuggggauacagacaaggagcagaaaggacacagccagggcccauguugaacuuauguucuaguuuuaggaagacagaaaauaagcaacgaaauagguaaauacagagugcuucgugcccuguagguucugugaagagccauaagcaggcucaagcauguggggagugcgugaagucaggaaccgcuuccgugaaguccuguggccggcucgauaagaggaaaggaagcagucaggaagugaucaggaagcugggucacgggggauuugucaugugagcauuaaaagacaaauagaaagucuucuucuuuuuuuuuuuuuuuuaaggaggauaccaggaaauuuggaacuaaagagaaauaguccguuguccacuuuaaaaacaguguccuggaaacagcacaagcaugagaacuucaguuccacuuccuagcaucuacacaauacugcaggcauagcagcgugcaccugugguuuccaccccccucccccgcccccugcacugggaagacagacaggaaggucgcuagggcuugugggccaguuccucuagccagucaccgaccuccagauucagcgagagacacugucucauugaauaaggaggaggugauggaaaagacaccugagguugaccuuuggccuccagacacacaugugcucacacacaaauacguacaaauaaguaaauaccaugcuccgugcuguguugaaaauaaacuuggggcagacggggguguagacuguaggcuuagguuuuucaugaccuaguuuaacaagaguucuuaaacacuucaaccucccgucuagcccaccacccagcagaggucauaggaaagaaugguuauuagguuauggaggaaguggacuuguuuagaaauaguucuuuggggugacuccagucuuuguugucaggauaucagcaguucaguuuccuagcaaaccaccaaacacaaagcagcagcagcagcucuauccaggauaaacugguuaggcgcagguccggcaagccgcuggacuaucacuggcaagucuuuggugaguuacucucuacgaagucacaacaaggaaagucagcaaccugguguuaaggccaaccagugccgaguguugccaguggagaccagugaaguguaacaaggcaaaccaaagcacccggcuugccccaccgcauguggucauauuuauauacuuuccaaacagcacguguccuuucaugugucuacuucagcaagacauuuccccugugucugcuuuagcaaaacaucacuugucauaacugaguucucaaagaaaccagcaauuuccacuucagagaaggcuagagcagaguuugcuuauuucuguuugcuugucuauguucuuuagagcuugucuauagaucaccugacgagcugguuucguugcugaaauagaggcuguagggcacugcuugauaguccaguggcuugcaggacucagucuauccagguuaucccaucagaccagagaucagcaggcuggagagagcccuuuuacuuauauuuggagaaucccucaccuauaguaguaauguaaaaauaagcuauaacaucggucaguuagaugagucacccuuagaggugagugccaccauucugguaacauggguuuugucccuaggacccacaugcuagaaggaucaaacugagagcugaaaguuguccucuagacucuguucaugcuguggcaugcacaggcacacaugagugcauacauaugugcacagucucacauagaauccauacguguaaaaacaccuaaggccaucaugcaugugucagaggccuggaucgguggaaaaucggaagcacgagugucagguugugauucacaccuccugaaauaggagucuauccauaagcuaggccugaggccucccuaagugucugugggccagccgugacccgaaauccugcagagggggagagccucagcuccucuacuguggccggcccgucacuuauccaagagguggcauggcgacagguccucgaagugguaaaauucaucagggugcuaacacaaucacagagucuugacuccaguuggaaggcacaauuacguguucuuccuuggccuaguugguaguaagcuagaugggcuucuuagggaauccucacgcuuguguuuuuguaagaaaauagcaacuccaugucgaguuccuucucugguuucccaggaaaaaggaaugagugcugcuaguguuuuaccucgggaagugaacuagagugacuuacagaacguaggggaggugaacuaagacguacagaaagcagccaagugugaucauuuguuuuacugcccccauggaacccagauuuuuguaucuuuucucuagguagaggagaucuucaagaauucaccuuuccuggucccagauggcagcguuagcaucauggauggguccuaugaagguggggcagaugaugagauacacacuuguugggaaagagauggagucagugcaagauccaguuaaagggacuggggguggggaugcaucaugagaggaaggggcgcaaaguaaauaagcggggagaccgcgagagacgugagccccagagagaaguagaacagaagaagggaucuggaguguaaaccuucuuuuucucuccuguaggcauacuagccuggguuaccgugaacuuucuaacagguaaaacaacccuugaaguuucucuuacaaccuuaacuggcuuuuacagguagaccaggaggguaaaaaaaaauccacuucucuuuuccuguacuguucuuugauugagagaaggggguggggccagagaaauggcgagcaguucagucuauuccuugucaguucccagcaccacucggguggcuuacagcugccugugacucgggcuccagggccuuagcucugugcagccacacucggcuguauagacccauacacauacccagaauuaaaacuggaaaaaaccccuucuuuaaaaaagaagaggggagagagacaagcuaauucuacagucugcauucaaggccucagcggcucaagaggcucugcguuuacauuagccugccagccuuuggguucagggggcagugggucuucacaagacagcuuuggaguccaguaagcaggagagaaccugcagagaauggauggguagccgggguacucacucaucccuugcucucauuaacaggucagcugcauggucguggccaggagacuguggggacccuugaccuggggggugccuccacccaaaucacguuucuaccccaguuugaggugagucauuuuuauccaggccuuucuggcaacacacuuagaaagcuaaguaucacgcugcucugagacaacagcucuacagugacuaggucacagagucgauaaaugacuggagaaagucucucuggcuccuggagccuugggagacauggcguuuaaucuuccccaugucugguuuaggggaggguuguggauggcgguguuauaaucuucuuaugauugcaggugcugaauagucuuuuugcucuuucugauuugcagaaaacccuggaacaaacaccuaggggcuaccucacuuccuuugagauguuuaacagcacuuuuaagcucuauacacauaggugaggagggguaggggaaauaacaguucacauuaugucauuuuccuuacuucucaaagcauuuuaauauuugucacuguaucuugccagccucagaaagccucugccaguccccuaagcccugucuacugaaaccuaauccauaccaaaccugagaaaccuaggaggcaucuccagucugggccucaagcguaugugauguaagagucaguuucucuuuaguugauugcaugugaagaaggcucagaccucagccagcgcucuguaccaacucauucaguaagggcuucugggcuucagagaccagucugcaauggauaagagcuuuucuggggauggcucucaggcugggccaccgggaacaaucucauuccucgguaucacaccugugagcaggucuuacugcacaucuuagcccagacuacagaagucuuccuuuaguguccauugagcaaauacagcacagagauggggcaaagcuuccauccuucccagggagucagagaaaccacgucacauuugaagaaggcggcugugggcuaaaaacaucuaggacagccugaaacugucaaccuuguguuuuucaguuacuugggauuuggacugaaagcugcaagacuggcaacucugggagcccuggaagcaaaagguuugucagucccagucuguggugggagacugggagacgccaaaacacagcucgcccucuucccuugcuuggcauucuuccuauggagcaaagggcugugcuggccugggaaguguguguugcauaacagacauaaaagcugccggggcuguggugugcauucaucaccuuuagagcaaagguuacuacacaggaguaaggaccuguagcuacaaggcuggaaccuccaccgugucucguaggaacuugcccaagccuuugucaggaaaccaggucuuuucuguuugccaaguggagugacugagcaauuccuuuucugucuucacuguugggcacaggcagaauuggcugcagucccaguuguguggcuggggacaaaucagugacccuucugugcccuguucuucaccuugcacaggagugugugucuaaugcacccagacagugcucacaguaaguggguucugggcugaggcgcacagagcacuucaguuugccggguuaucuucaagcgugucucuuuuaaccucucaacuaccaguggaggaauguuccuccauuacagggaggaacuuacuuuacuaugggguuuuuauuucuuugggaugugauaagcuuuauaauuccccuggcaaaugugcaugaaguuugccucuggcucuagagaguuuaccacuaccacaaagccugugaagacuccaugucgcaggacacagccgagggacuacucugacaagauuauaaguccccuucaccccaucggccacaagagcuucuugcuucuaucucccucucacagaccgccuucuccuguuguguucuuucagggacugauggacauacguuucgaagugccuguuuaccaagaugguuggaagcagaguggaucuuugggggugugaaauaccaguauggugguaaccaagaaggugaaugguguuucuucacugguuaaaauuaccuuccuagugccuguucugggaaguccuauaggaagacuccagagcccaggggagauuugacuuauucuagagguguugguauguccagggccagcaagcaaggcagcucccgcucugcauacuguucugaguuccaugguagcgguaggagucuguugucaccuguugucuuaggcaggguuucuauuccugcacaaacaucaugaccaagaagcaagcuggggacgaaaggguuuauucggcuuacacuuccauacugcuguucaucaccaaaggaagucaggacuggaacucaagcaagucagaaagcaggagcugaugcagaggccauggagggguguucuuuacuggcuugccuccccuggcuugcucagccugcucucuuaucgaaccaagacuaccagcccagagauggucccacccaccaggggccuuucccccuugaucacuaauugagaaaaugccuuacagcuggaucucauggaggcacuuccucaacugaagcuccuuucucugugguaacuccagcugugucaaguugacacaaaacuagccaguacaccugucuaaugcagcagugacaaucccuguuucagguccggggaauguguaacaauuucauuuauaguaaaacucaaaauugagauaagaaucuuucgucuuagauauuaacaucaggggaaauuuuguuaccccagagaaggaaacaagcuuucuggaccaugaaugguaaugccaggccgagcacgguggcugaggcuacagcuguggcuagagcugguuuugaugaagaacacuuaaggggaggggcuuccacgcacaagcggugagguugaagaaaguuacauagcuguuugugugugugugugcgugugugugugugugcguguguauguguguguguguguguguguauuuuauacauugccugcauguuuguaugagucuaguacccauggaggucagaaggagucagagccccuggcaauggagauacagacaguugugaaccuucacguggguugcugggaacugaacccagguccucuacaagagcaggaaguuggcggggggcggggggacgcugaagagauugcugcucuuucagaggcccaggguuuaauacccagcacccacauggcagcuuacaacugucugaaccaacaguucuauggcgucuggacuccgaaggcaccagauacgcauauggugcacacacacaugcauguaggcaagcagacuuuuuaaacgagcaguccgugcucuugauugaugcaugucuccggcccccaggcuuugggcuuuguuguugaggcagcuccaggccucagcugcaugcuugcacggaaggugugcacagcuguuuuugcugcugcugcuuggccucaguuucucagacuuggugagcuggcaguaccuggcucuggucuuccuggaguacagguccaggcauuuuaugccuugcccauguggaauuuccugaggucuucucucugaguacaaugacagagaggacacagucaugcacuuguggacaacucauaucuuggacagcuuggacagcauuccaccugucacuuuaaguguugugucagcuccaccucagauugcccugcuguuucagagcuccgcccccaccuugcugugaggguaccucagccauagcuaacccgcucccaccacugcugcucagaggcuaagagucagccuccuugcuuucucgaucuucucucuguggcuccagcagcuugccgcugagagugauuguugccccauccuuagucucaugugauguauacucuugcccugacaggggagaugggcuuugaacccugcuaugcggaagugcugaggguaguacaggggaaacuucaccagccagaagaaguccgaggaagcgccuucuacgcuuucucuuacuacuacgaucgagccgcugacacacacuugaucggugaguucaugccuacggucagccauggaggaagagaacgggacuaagcucaggaagagaaggaaaggcuguguugguugcaguggcuucccaguucuuucccaguagacgggaaggagaaugagggugcugggcucuuugggagguggaaaaugaccuaacuguaugaaaagucuguuggagguagguuuuuacuauauauccuucacugauacugaagucacuauguagcccagguuggccccaaauuuguagccauccuuuugcccuagacuucugaguuauaggguuacacaaugugcccccgugucugacuuuguaugugaagucuuuuugcauuuuuuuuuguacugggauugaauccagaaccucugcacaugagaguucaaaguugcccaugauggcuuugagacuuuguagccugugugugccuuguacuugugaucccccugccucagccuccugaggagcuaggaucucaguugugugcuaccagaccuagccugcuuucuguccucguugagucauaacuguacuagcucuuuuguaaaugugaguaaguacugagaggauugucggaggacuaaggguuucucccggaucacaguuucagaggguucagcaaccucuuguuucugccauggugaggcgaaaaauaaugguggaagguccuggaggagcaaacuugcuuaccuccuggcagacgcaaggagaggcagggggaugggcccuagagcaagauggagcccucaacuacacauucauuccuauugggccgcuccccacccaagcccuagguccagagguucccacuaccuccacuacacuaucauguuagcuguaacuuaauucacugaaggcagauaccccuccccgcccccccccccaaccccguggaccagucaccucucagugacuggggacuccagugucuggagaccaagccuguaggaggcauuuccuauccagaccauaacaaguugacacacaguaaaugcauguguuguuuucauacaguuugccaaaccuugcauguauguaccugugaaaccucaccacauucaagaugauauacccaucaccccaauuuccuauucuucuaggacuuuuuuucucuuaucacagaagcuguguuuuuguuuauaugugagaguauacacaagacuugagagacgauuuccuguccuguuuacucuauuuuuuaauguauguguacaugccugcaugaguucauaaguaccauguauguguaggugucugcagaggccaggggaguuccagguggguguaaacgaccuaguauggguucuggauccaaaccugagcccucugcaaaaguagagagugcucuuuugucuuuccuuucccucccucccucccucccucccucccucccucccccucucuuucuuuccuccuucuccuccucccuccuccucuuuuuuuuuuuuuuuuuuuuuuuggguuucccuguguagcccugacuugccuagaacucacuuuguagaacaggcuggucucgaacucacagagagcugccugccucugccuucugagugcugggaguagaggugugugccaccacugccugccuacaguaaaugcucuucaccacugagcagucucuccagccuuuggaauaacacuuugucuguggcuaaauauguaauacaaaaugggugccaugcauuaacuguaaauaaaugagcagcguggacuuauauuguagagaggccgugagucucuuguuggaaauacugcauauuucuaguuuguauuauuauguaucccugggauaaauguccuuauuuccuugaagcguuugauacuaucuauuguucuguuucauuuuagauuaugaaaagggcgggguuuuaaaaguugaagauuuugaaagaaaagccagagaagguaagcgugggcaugagguguggcugagguguggcuggguguggaagcucucgggacuggcucccuucugcuucuggucugauggaagaugcacuaggugcugccaaagaaggacauggggaugugagacacuuuagggaaaugguucaaacgaacaaacuucccacauuucuacagauuuuccuauuauuauugccacauuacuauuauuuguuuguggggacuuuuguuguuguuguuauuguuuuggguuuuuggggguuguuuuuguuuuuuugguuuuguuuuugagauaaggucuuauguagcccaagacagccucauauuugcaguguagcugaggauaaccccgaguucugguucaccuuucaaaugcuaggauuacaggcaugaguuacugugacugaucuaugugguaguggggauggaguccagucuccuggaugcugggcagucauuguaacacccggacucgcugcacacucagcuuggcaugcucucucggcuucccuuaaaauugaaacaggcuuaugagcaguaauuaagaccugagcaguggaauggacugccacauggacauccuugagagaaugagucagaaccaccaaugaucucuuccagggaccacaagagaggagggcuaaaggacauuucucuguucucuggguuuaccuggggacuugguacuaaguagacacagcaagucauagaaauuugaaaaucggggugcugagagugaaccucccuggugugugccaggcccuggccugguuucuagcagugccuuuccccugcucccuuaucuccccuaaguggcaaauaagcuaagauguauguaaaaugaauagaugauuucauagcggaaaugugcagauccuaaagaagggagcacaccagcuaguuuccaguuagcccgggcagcaccuagagacgucuuggccuacccagguccuaccucuaucuagggaagaaaagcccccaccccaucuccuaucugcaagugaaugcuguccucucacuuucagugugugacaacuuggggagcuucuccucgggcaguccuuuccucugcauggaccucacuuacaucacagcccuguugaaagaugguuuuggcuuugccgacggcacccucuuacagguaagaaagaggcagagcacugccguugggaaacacuuugguaaucggagcagcagauguucuuguuggggcuguagccuaggcacccugcuagguacagcagacacugggaugggugcaguuuagucucugaguacaguacaagacaugaguauccccccccccccauuuugcacagaacagaaagacuuggagcccagugaagauguucaagucccguaguuuaugaagucaguuuagaacccagugagaagcacugagaaagauaaagacaagagaaauaagcauccagaauacagcagaggcaaggcgggagagccacgcuucccgaaucccagauuucucauccuggguugguacucccucaucugccacugaucauguggcuauaagaauaucaguuugaucaagagagcacaagauaacaagaagcuggggccaucacacagauuuauauucagagagccccugaggcaggaauaccuggcuggugacauuggcauaccuuguuccauuuugcacaguggugcuaacacugagugcuuagugcauuagugucucagacauuuguagugcauccuguauauucuaagucugauagauagcuaguuuacucucuucuaauagacucuaugcugcuugaggucaagggucagacuuuagccuuugugaauacaguuuguaaucaacaaugguauagaaaguaagaacacuaacggugugaaauucauaagcuauguuuuauuggugcuauagagauggcuuagugguuaagagcaguugcuguuuuugcagagggucccuguuugguucccagcuuccacaugguggcucacagccacuuguaacuccaguuccaggccaugugacccugccuucugcucucugugggcauuaggcacacacauggugcacauacauaccuguggucagaacauugacacacauaaaaaauauaaauaccuauuuuuaacuauauguuuuaggggucuggagagauguccccacaguuaagaauacuugccgcucuuccagaggacuguguucaauuccuagcaccuaggucagguggcucacaaguaccuauaacuucugcuccaagagauccaaccucucuggcuugcauaggcaccuguacucgaagggcacauacucacgggaagacacuuacauccacacauaauuuuaaaaaauaauaaaacugaaaaucuuuuaaaaauaucuguuuuacaauaaacagcuuaucacagagccugaauguacugaaaucuauggggagggacaggaaggagucuaaaggaaacagcuuuauagacaguaaucuaaacccuuuucuggaaucgagggaucagcuguaaacuauccagaaccaucgggacaaucgagugcagaaugcuccauuugguuguuagugcucgagggacaguugcuuacauagagccagaaagcugagugugugcuucccuacccuaaacacccccagcucuugccagguccguuccucucacacccaugagcacuguguuaugauuggccuggucagaaacugaccugugauucagaagacaaggccagaggugcuguucuuuuuguugaguuuaaggggcauccauaagcccgucugacaaaggcucucuagaacugucuggauagcaccacuuccugagcuugcagauguggggcaguuagggcucggcccacgaucacucuuuauagguagcggcuguccaaagaccaugcuugcauauuuugaaacugcaugagagugugaagacuucuuucuucuucuucuucaacagcucacaaagaaagugaacaacauagagacugguugggccuugggggccaccuuucaccugcuccagucucugggcaucaccagcugaggccaagcuccaccucugaagccugcauuucugaacaguuuucucacaggaaggcguggacucagagacauuuucugaccucucuggaaaagccuggcccgaaacccguuaacugguuuuauaaggagggagggguuuuuagaugagucuugcucuugagccuagugauuugggcuucaaugauuugcacaucuaaugugaauagcuccuaaccacuuggugggugcauggcuggcaccagacuguaaaucuuuugggauucuuuguuacagaguccugcaaaggaaaaaagagaaaagguuuggaacuccaugcuagauugcgaguucagagacaggucccuggggaccaaagaacaaucucguuucaacccuuggaugccucauugcuuugaauggauucauuuuugcuuauaagcugauuuacugaaaucccauaacccaucaaugcuguuaauuuuuuucuuccuacccuuauuacauucccuacccuaaaagccugggggaaauaccugguuuugcuucccaucuauaauugagaaagaggggggaaaagauacuguauuagaauuugugugauccuguggcacaauagaucaaccaacccauuuaaagcuuagagcuguccucaguauuuuauuuuuagacaagggcuguguuguguuuguuguucaggcuggccuggaacucaguauguaacccagguugccuugaauuaccaauucucccgccucagccuccugaaccuugggcuugcaggagugagcuguuaugcucaugucauggcccaucuuagcaagacggagagaguagcucuuaacugccuagaguauaagcaaggagaccgucgggucucaagggauagcuguugccacucuggacguaaugaacauuccgcccuggagaugcgugccuauccagugucagucagcacugccucccaagcccauguguuuauagaauuaaacacagcccuaaacugugugccuuuguauuuccgugaaguacaaaugugcccuuguuuucgcucugcaguuagaaguuaaugcgugagcucuuugugucuaaagauuaccaaugcuuucaguuguccuuugggggguugagguguggaaagugcugggaaucgaacccaggacuucuugaauguuaagcacaaugugcuagcacuaugcuuguauaguccugcuuuccugccuaggccccugcugaauuuggcuauuuucugaauucguugucuagcucaggaucucagaaccccuuuccagugauacccaaauuugguuugguuggcuauuuugguccauauugguacaggucaggacagugaguagcauuagagaaccauguuuucucucucaggacguuuucuggguugugguugaacacaggucaugcaugcgaggcauggguacucacucuacugcauuauuuagcucuuuaaagucauuaccugaaagaucuuaaacuucugucacuaugucguuucuaguauuacaucacuggccacagggucuccugucgcuuggcuccugucacagcacuuugcccuccucuucucuuuccagcccaggaaguuuucaucuccccuaauguaauuuuuggccaccuacuuuuccuucugcucuucacaaaggaugugacuaugccugggcccaugguagucccuggggaaccuuguuuuuuaagccauuacaucgagucaauaauauaaagaaaaagguauucgaccagucauaguccacuaaaugcuaucacaguugugagaaaccaagcugucuccccaagaguaagcaagcaaugcucauuaagaugccuuuauaacaggccuuauggcgcaggccuguaauccuagcuaccuugaagcugaggcaggaggacugcaaguuauaggcuugcugugggcaacucagugcaacacucaacaaauuuuaaaagggaugaguuagaagacaguguucaguggcaaagcuaguuggcaugccaggcccuagauucaguccccagcacuaaagacaaagcagacuacugcucucuacacagcuggucucugacaccucagacacaggggcccuagcuauaaaguguguauuguuccacagacaccuaugguuaccuuggauacugccagaacuccuaaauacaugaacuuuuaccucagaaauuuaucugcuuauguccuguuaaucuucaaggcuuuuuguuuguucuuuuggagacaggguuucugucuguguagcucugguugcccuagagugggucucuguagaccaggcuggccucaaacucauagaucugucucugccucucuaguauuagaaugaaaggugugcaccaccacuacccggcaacguacaccuuuuuuauuaaggggcuucuauuguguucugaaguuccaucucugugacaacauuaauauacuuuaaauaccugggauguggucugguacauacaugguggaugcuguguguguauuauauauacuacuauauuaugaacaccugagucauggaaguccuugcaaagugugccuuaaaauccucaaccuuuuuaacuuuucucauacaucgaagucaguauucuuaugaaggcccccauauugaaaaaagucaccuuguccugagagguuguagccaucaucauuuuccagcggcugccaucuuuuauucugggaacguuuucuggguucacugacaucauuacuuuguacuaaguuuuccucguugcuuaaaaggcugcucuguagcaacaacugucucaucccuucaaagcuuuuccaaagcaguuuagcuuauuugaaaagggggcuuucuuacuucaucuuuucaaaauaaacugcugggcaugccguuucuguaguguuguuaucuaacacagcucagggucucuucuggaggccucuuuggcacuuugcaguacacacacacuucaaaaccccaaauaaugaagcacucagccacacaaggaggaccugugcagcagcugagccccuucugacugguugcugaggccucugcagcugugcgugcgaugagaucguguauuguuuuauuacuggacagagaaugguaucccagagaggagccauaaauaaaacugaacuguggagccgugauaaggaaggagaaauagcaguacuaauaagaucuggcuguuauuuaucuucgugucccccuuaaauccaguguacuuugucaaagcaauuuguauuuaacuggcaugccaguguuaauuuuaaaacaacagucuaacaaaaauguaucagguauuucuaauucuuacucugucaagauaauuauauaaauuuaugaccagcauuuaaguacuuuauuuagaaaggucuguugccaagugaagugagggagaacaucuuggagauuccuuuguuuguguaguaauaaaaagcuccuuuuaauuaaauaguuuuccuuuggguuuu

SEQ ID NO: 6747 - RNA, 20838 nt, Mus musculus
uguugaaauacuauuuuuuccuuuauuauagggaugaaaauaaccuucuagaucaaaccuucaucacccagcaagcgccaguaucagacuccaauagaauggugucacccgauguuauuccucaaggauuacaggacucugacauaguaaggaaucugcucucuaaucaaacaauauaugacuguuagcuuucacuaugugaugucuugcuaguucaugguucucugcuacccaaagagcucucagggaugaucauaggcaauguuauaacaaugcccaugcuaauaaggcauauuaaauaacuggcgagagccuguagauuacuuguggaauaggcagcucugucagaugugcacugcacuaucacuguuuccagugcuguggagugagccuuugugcauacuagggcaaaugcccucacuugugaagucacccuccauccuaucuuuuauauagguccuuauaagucuggccccaagcacaaacacaaaucacuguaaccuagagaacaaaagaaggaaaagaccacuuuuuucaguacuguauuuuuccuaaggcuuuuuuauuuguacuuuguuauucauaaucaguauagaagcucacaaaauucagcaaagacauauaaggacaaaaagggaaaaugcugguuuucucauuuaaugauauuaacccaaaugcaaccaaauauaaauuucaucuaagaaacaagaaacccuuuugagcacaaguagcuggucaaaucuguugauuaugauuauaaauaacacaauuuggauuaguuguaauuuuuuuaaaguaacuuccuuuauaucuaaggaaaauauuaggagucugugauuaaauucuacuuggauuuagauaauaaccacuuuucaacccagcccaaaauuguuggauuaaauuaaugugaacuguguuuuauaagaaaacaaaaugcauugcagucacaaaguauaaaugucuacuuagcuuuaggauggaaaacaaaagaaaaucagaguuguguuuuguuaaagugacugaagcucugaauucugccagggcugguuacuuuaauaaucuuagcuccaaagaguagggaauguccagguuuuuuuuaccaccuuuuauuuuaacucacuaaacccacaauggacuggagcagcacuguccacacauggcuauacagaacagagcacaguaaugacagcgccacaccucacuaagcacuaaagauuaagcagaguccauagccaucuaguuuagaaagucaggcuucagacaggucagacagacacacuguucuguucagcacaucagucucuucugacugaagguuuagauuaucagagaagcaagcuuaaaggcagcugaauaacugguuaaguugaauaaggugacuggauacugucaaagcaugaaacuuugauguuucuaguagccuaaucaauuauuccauaugaagaguucuuucauuaaaaaguaucaacuaaugagaaauacugccaaaagaagaauaacaaaauuuggcaaauaauagguuaagccuacuuaaggcaagaguguauucacuuucaugaugggagauccuuugauuucugggucaaaaucauuuguggaaagauuuuaucuaaggaucuauuuguaucugcauuaauggcuggaguauugauuuaaugguugucgaggcaaaccaugaagaauggcacauguaacuaaaagcuaacuuaucacuucauccugagguauccuugagaaguauuuuaagacacaagaacauggacaaugauagaauuaaacaguggccaugaaucacgcagaagaaaguggcauugagcagagagcagucgucacaaugcuaagauauguaaaacuagguuacauguuaguguggggacccguggagggcugcauuugaggcucaacuagaggaugaccuguuucagugauuggaagaucugucccuacauugacauuccucucacguucagaaaagaauaguuagaagacaguucuaagcucgaauucuaggcaaacacuucacacuuaacaacaauuaccuuaaaaacuguggagacauauggagaacaaugaaggccugguauuaguguuauccugcacucccuacaacuuugaagggauugagaguucugagaaagaauuuaguugcaauauauuccauucucauagaucuguuuugagcaaagauggcacaugaaggccgccaagagugaugggaaauuacucaggcuggacugagucuugaagaacuugcuucuaacgccccaugguaggcaugacuacagcaggggaggaaagcguagcaucuucuucuuuccacugagacgugauagucuuuaacugcguguaaaacuggaugcccuuuaaaaaaaaucacagagaaaaagagagucaguguauacuuccucuucucaaauuagcuguugucgguggugcugugagcaguacucaugcuccuaucugaguaauuggugcaacagaacccacuguuguucaugagauguauauacaaccauuuaugagggguagagaggugguuacacuaucaaaagcugcuguuccucuagcagaggaccaaggcuuuauugccaguagccacauggcagcucacaaccauauguaacuccaguuccaggggauccaacacuuucuucuguccuuuuagggcaucagucacuacaugguguacagacauacauguaggccaaaauguguguguauacauauacauuuaaucacauauaauugacuauauaauuuacauacauaguauagacuacauauuuaauuauauguaaucaaguauaagcuauaaauauauaaucuauaagaugcaugagaucgggagguaaaggucaugcuuggcuacacagugggcaggaggccaucugaggauacaugagaccaugucucuccgaaaaaaaaaauaaucaaucuucggauacguguuuguggguaaagcaguugccacaugaccauuaggaccuggcuccgacucccagaacccauggaaaggguuagacugcaggaugcuuucuccuccaaaccuauugccuugaacuacuccugaagacauuugguaaaauucuguuaacuuuuaauuuuuuuuugaggccuaggaaguagagcagcacagcagaugacuccacaguagaugcaggaagacccuuguguauguaaccuugcucugaacauguucaagacaguuucucaaagaaaaagacaauuccagcucaaagguuaccuguuugccauagaaauuggugucuccccugaaggaagagcgagagccggugaaggaaaacaucggcaaaggcacuggaauggggacauucacacccaccuaaagagaacaaacacacaucagugucccagaguaucccucaaaggacucgaacacaguguccugcaggacaaaggcaacagagagucauuuuauuuuugcuuugauuuuuagauuuuguuuggcuuggguuuuuuuugggggggagauaucaauuuuaaguagucaucuugcaccugugcucuacccuaagaacuuuuauuccugaggaagagauggggaauuguggguaauuaaaggggcaguguucaaacaagcugaucauuguuuaucgucuccucuucagaaacagcuguaagaaucucuaaaaguccuagugacagaccugucccacauccaccaugugagcauauuuccgggcgguggcuccauugguggugaagauggcaguuccauuuccauauggguugucauuuacaaucuugauugcuucauccaguguuucugucuccaaaaccacaagaacuggaccaaauaucuccucuuuguaacaagucauacuuggcugucaggagagacagagccagaaaagaaagaagucagcuuuuuugaguauuuuaugcuuuuggcauuccaagucacuacccauugucaccaaaagcugcuuucaugcuagugaucuuuuuucuuauuucuguucaaaagguagaaaccuuuugagcuaccaccauauaaaccacuuggacuucuugcguucuuugcuuuucaguucuauuucaaguucaaggcccagcaccagcaccuguacaaccuguuucauuacaauuuuacugaagguuacacgaaaagucauuuuugugaaucaaacauauucuaaguauaccagaacuuuucuagaaacuucuugcuaaauacucuguaacaaaacaauccacucucacucauuccuuuguguuguggggaauauuaaaaaugaacccaacucuccaugccacgcuggaucacagggcucccuccgggacaucucucgguaccccccccccaguuccucuugcuaccacgaaacgccccacacaccccacagucggucaucucaacaccuaacuacccaguagaaucaagacucuuaaagcuuaauuaaccuaucagauuuauccgccaauacaaauaauuucagagccaauugauaaugcuaaaagcuuuauuccaauauuucuaaccuuuugugaaaucacagcuaguugcagcuggaaaauaccacgcagguaaauguccacagccacgguuguucuccuccuacucugucucugcaacucuuagcuccaccucccuuugcccuguccaaucacaggccuccucugcacuaauauaauuggucagggaaaauccugcuacaccuuuguuucuaaauaagucuccaauuuugacauugggucuucuuaaacauucaggacacccuuuaccucagcaccuagccagcuguguuuguugacaauaaguuuuccucugcaguucagaagcaagaaacuccaacccaugaucuuucaggaguauguaguaaggacauacaacaaaaagccugccucaauuagucaugaacguuagcugaagacugucacacuuugguaaaaaaaaaaaaauuaacacccgauuucuuuuguuucagucugauaacaugggcacagaggaaggcagucaauaaauacugggugguuacuauauugauugggacaagugaacaaguaggaaacagaaguguaagacaaggguuuuaguucauuauaauuuuuaaauaugauuuauuuuuauuuuauguacauugguuuaccugcauguaugucugugugaggcugucagauccucuggaacuggaguuacacaguugugagccuccaugugggugcuggggauugaacccugguguucuagaauagcagccagugcucuuaacugcugagccaucucuccagcccccagugacuaggguuuuaauugcuguuuaugggccaaauauaccuguucuuacacaguccacaagcuaagaauaguuucuaccuuuuuuuuuuaaugguuaggaaaaaauucagaagacuauuucaggauauaaaauuacaaaauucaaguguguguccauaaauaagauuuucuuuuuuuacuggaauacagcuauguauuugugguugauuuuauacuauacaccagaaugguugugacagaaauuguauuuuuugaaagcugagaaauuuagccuuccauggaaagucuauuguagugguuaauuugugucaucuugauauaucccagucaccugggaagaaggaacuuuaacuggccuccuucagaugggcagugggcaggucugugugguauuuuccuaaugauuggggagagaggguccagcccacuguggggggugccaccucugagcaagugguucagaguuauauaaaaaaagcaagcugaaccagccauagggaacgagucaguaaacagccuuccuccauggucucugcuucaguuucugccuccaaauuccugcccugcccuccucccucccucaguggcuaacuguaaucaaagcaaaacaaaaccaaccagauggaccccuuucuccuuauguugcuuuuggucaguuuuaucacagcgauagaaagcaagucaggacaugugccacauagugaaaagagcucugguuggaagccagagagagagauuuauuuaguuuccagacagaauaacugagcagaccuggcaagaguuaugaucuuaaauaucuucacuuagagaggagugagauuucauagcccuaaagguguuuuuagcucuuguauuugugaaguaauucagaguuguuuaccuuaacauuugagaugaugguugguccaacaaaguuaccauuuucauagcccuugacuuuaauucuucgcccauccagaaggauggaagcucccucuuuuguuccgcuaucgaucagauugcagacucucucuuuggccuggggggugaucagggggccaagaucagcuccaggcuggucuccuacaaaccaaguagaagugucuaaggauuuuaucauaaaacuugacugcugagauaaguuugaauggagagaagaauuaaggagcgguaauacuaggaacauaacugcccccgcuccagcaaggccaauaaagaauuuagugccucagaagcaaaggcuaccugcauugcugacugauuacucggcagcugacugauaucugcauccugauugauuaccugcauugacucgcagauuuuuggcccgaucgaccaguucuggcagccacuucuuagccuccccuacgaggauggcuguugaaagagccaugcagcgcugcccagcagcuccgaaugcugccccgaccagcugguugaggguauuuuccuuauuggcgucuggcaugacuacuccaugguuuuuggcucccuaaagaaacgcagaaaguacacacguccuccuuagcuaaauucacuuaaaccaaaaaaauuaagcaaagauucugauauaugagaacuuauagaacgaaauccaucuuuuguuauuuuuuaaguuuuaacuuuugaagucuugggaauuaaaccucggccucaugcaugccaggcaaauaucggucuuuuauuuugagacagucucacugaguugucaaagguaguauugaacucacucuauagcacaggccagagauuauuuuuuacuacugcugacguuuaagcaauacuaaacgguuccauguuucuuuaaucuccuugagaagcugauauguauuuauuuaaaucaaaacuauuagcauggucggcauugacauaaauugacagguugaaaaacuaauagaauacaaaaguaauccagguauuauaugaggacauaugagaaagugccuucuguggacuagcccuuuccaacuccuuaacaaaaaaacuggucaugguaaagaugaaauaaucuuagggauaaccagcucuuuaucuuuuuuauuuuuuuuuauucuuuuuuguuuguuuguuuguuuguuuuuucaagacaggguuucccuguguagcccuugcuguccuagaauucacucuguaaauuaggcugcuuuugaacccagagaucugccugcuucugccucacugggauuaaaggcgugugccaccuggcucucuaccauauuuuaaagccauaucacuaguagaggacacuuuuuaaagaagcaauaaauaaggucaagaaaguaaaauuuggcugguaauacuuaaagauuuagcaacaguuuugaggaggacugugcccuuugucaccaagaucuauuguauaugaugaaagauaauuauaacaaaaugucacaagguucagagacucagggagaagacgaucaggaugaaaugaccaacacuggccuuucugagacaugggaugaguggccugucuacugcaggacagucccuaggucuuacauacacacauagccaaguuugaggagcuaaagggaugagaagucaccauauuggcuugaacccucuugccauuucuugauccucuuucgaagauguacucuccugccugguuggaucccacaaagcugauugccuugaugucuggaugaucgcaaauaaaguuuacagcuuugaaaagaaaagaaaugaucaccacaaagaauuaauagcccacaggcuuaacaacagcaaaucucuccuuccuccauauuguaaacuaacauucauacauuucuacauggaaaucucacuuugguguacucuuuuuuccucuuauaauuuguuuuguuuuugaaacagggucucacuauguagcccuggguggccuugagcucacuagacuaggagggucccaaacucacaagagacccaccugcuucugccucacagauauugguauuauagucaugggccaccacaccugucauuaaauuacaaaugguauuuaacuuguuuauucucauuaguaucccagaauuuacaauucuaaucucugaaagccauaauuucuuuaaacuguauuuucauuguguguguguguacacguguguguacacguguguguacgagugcaacagagaacagcuguguggcacuggcucuuuucucccaucuguaugugaguccuagggaccaggcuuguguggcagaugccuuuacacgcugaucccuuuagacaagccauaaagccuacaacuucaauuuccucaaauacaauaacauucuuucaaaacuugaccuuuucauuuuaucuuuaagaauauguuauaucuaagauucucagauauuuacacccucauacaagaggugauagagaagaguaaguaagagccaguccuccaggauagacagauccuaacuucccuacuuccuguuacaacuagggaaacuguagcacaucacguuacuuaaaacaaacuacuuaauugcacucugccuuuaucuucuuaucuguaagaugauaaagcaccuuccuuaaaggguuguugagacauuaaacgagaacauaaacuuccucuuuaaucucaucuuucaaaguguuccacuguguggacuagaguaagaaacauggcuucucccuauuaguuacuuuagcucacccagauggcaagaugguuaagacaugugaccuucaaacgugaaggucacuauuaauaaauccuucauccuaaaauacccaucacagagcuggagagauggcucaguggguuaggaugcuucccauucucccagaggguaugaauucaguucccagcacccacacugcacaccucacaaccaacuguagccucaguuucaggagcuccaguacccuuucuggccucuguggguacccacacacauauggcggacacacagagucacaugcaccuuaaauaaacauuaaaaaucccaaccaauuuuuucuuugggagucagauucaguagucauauaaaagaguuaccaucauguuguccauggauaauguucaguguuccgucaggggccccagaauccugaagcaacuuagcaaggagcauaguugcuccagguacucgcucugaugguuucauuaggaaaguauuuccacaaaccauagccaugggaaacauccaaagggggaucauggcaggaaaauuaaauggugcaaugccugcacacacccccagaggcagacgguaggaauaaagguccaugucuuuggugauagauggcauggucucucccagcaugagggaugucacacuacaggcaugcucaaccaccucuggaagagaaaagacaucagugaggucaccaccuuuccaugcuaaauacuacuuagcuuugucacacuccauucgauccugacaaucaggggugggucaugccacugacagcgauuuguccuuccauguuccucagauucucugaggggguaaaaaagauaguaagauguauauauauucugaaauaucauuugugcuuaaacaaaucaguaaauuagucucaaaaguaccugaccaauauugccuuaaaauuauguuaaaagguauugcugggcaugguaguacacaacuuaaaauccuagcacaugggaggcugagguaggaggacuguaggucagagccagccuuggcuacauaguuccaaagcagccagugagccucuaccuuaaaagaugaaauauauauauauaucacaugagagcaaaaucuacacaaagaauccaccuucccagugugggggcugccucccauauucuuuugaucccucccacaaguccagugaggggcucccagcuuacgaaggccucggaauacaucuccuucagcaucagcaagagucuucccuuguuccagugugauuaaccuggcaauuucuuucuacaaagaaaacauauaaauagaaacuaaucuaaggauguuccuuuauuuaauuacuugcuugcuugauggggaucuacuucauguuuugagacuagaucucauguagcucugacuagccucaaacucauuuuguauuugaggcuggccuugacuccugaucuuucuaccuccaucuccuaagugcugggauuacaggcaugaaccaccaugucuggcugaauccaggguuugacucauguucacuguggugguuugaauaugcuuggcccaugggaaguggcacuauuaggaggugugaccuuguuggaguagauguggccuucuaggaggaagugagucacuguaggguuggguuuugagguucuauucaucuuuuuuuuuuauuagacauuuauuuacauuucaaauguuauccccuuucccuguuucccucccucccggaaaaacccuaucacauccucccucccccugcuucuaugaggguguuccuccuccacccacccacccacccacccacucccaccucccugccuucaauuucccuacaguggggcaucauggagccuucauagggccaagagguccuauucuuaaucucugcccacaaugaaagagaccuucuuccuggcugucugcugaagacagacuucuccuggcugccuuuggaucaagauguagaacucucagcuccuccaccaguaccuugugugccuacagacugcagacaugaugauaaugaauagaaaccucugaaacuauaagccacccuguacuggcuaguuuugugugucaacuugacacaggcuggaauuaucgcagagaaaggagcuucaguuggggaagugccuccaugagauccagcuguggggaauuuucucaacuagugaucaaaugggagggccccuugugggugaugccaucccuggacugguagucuugguucuacaagagagcaagcugagcaagccaggggaagcaagccaguaaguaacaucccuccaaggccucugcaacagcuccugcuuccuggccugcuugaguuccaguccuggcuuccuuggugaugaacagcaguauggaauuguaagcugaauaaacccuuuccucuccaacuuguuucuugaucaugauguuugugcaggaacagaaacccugacuaagacacauccccaauuaaauauugucccuucuaagagcugccuuggucauggugucucuucacagcaaugaaacccuaacuaagcacaaagucuaccacugagcucuauauccugcucccauuuuccuccaaggaagaacgaagcugagggagaacucggaugaggagaaggguccugaccaauguccuucuacguuguagaguuagugaggacagcugaacaaagcucugaagaggugaccaacauacccuaagaaacaggcuaggagacuauccaaauuucuuaccagguuuucuuuaaugagcugcugauaacgaagcaggaccugcugccggcuuaaaauagaugugucugcccacgcagggaaagcacguuugcaggacucaacggcugcguccaucucagcuuugguggacugaggaacccuaccaacaacuucauugguggccuaaaaagaagccaacacacuuuaccaaugccucacuuccccagcagcaacauugugcuuuuugggcgagcuccgagcccccacuuugucccuugcucccaaaauucuagguuagcagguuuaaguccccaaaaaguuuugcuuacuggguuguggaugucaauccauuuaucacuuuuugauucaacaaauuuuccaucaaugaagagcuuuacaguuggcuagagaaaagcacacauauauacacagaggcaaagaaagaaaaaaagaaaaagaaagaaaaaagaacuucaguuaauuauuuugcuucucuuucucuuguaaagaaagaguuccgguggauacuuggaucuaauugcugagcuuucucucaagccccuuucccaccaaaaauuuaaacuuccaguagcaauggaaaugcauauaccuuaugacacagcuagugaaguucaagacggaaauaauccaaaagaauuuuaaaacugcauaaaaacacuuauuucacaacacugaaaaacugaagcacacuaaaaguuauuugagaaagcuuaaauuaucuacaccugauggaauauuaugcagccauuaaaaauuaaaaagaacauucgcaacacugaaacuguuuaaaacauaauagauauaguuucugauaagaaaaccaagauaagauguuguucugggcaucguggcauguagaggacugaaaaggacuugugcauacagacaagcacugggaaagccagaaaugcuaaacacacagcuuaccucucaacggaaugagguguguagcugcucuuccuggaaugccaggaaugccggagcauuacaaccuggugauccuuuggugucugaugagacagguucugccugugucucucagaauucacucuuugacuuauccuacacccuuuccuccuaaaucuugagcauugcuuuuaagccauaaaaccuauucuuaugaguaaucucauuuguauuuuauaacagccuaagugacuucuauguuaucuuagaugcaggccaauccugacacccacaggaguuagguuugucucagucaagcuugauauacccaaacucuugggcacuaucucugagucaacaguauccauucuugugaaagaagcaagauguacuuuguaaagaaucccaauguaaacaugucuuaaacuguuguacacucagggcugaguuaauuguuaucugaauacuuuuucccccaaauguacuuuauuuaaauauuuaaauaugacuacaguaaaaugaucugggccagacuuuauaagucuuggcauagugcugguuacaagaaagucagacugagucaaguuucauucuuaccuccuucugaugggcuuuuucccugucagcuguaaagccugcaggggaaucgacacaguggcacacaucuguuuaucuguugagcauuugcacagguaggaguugaaggcuagccugaucuacaugaguuaagacaugccagggcuaccuaaugagaccuauuuuuaaaaacacaaaacaaggggcuggagagaugucuccgugguuaagagcaccgggagcucuuccagaggacccagguucaauucccaguacccacgcacaaacaccuguaaccagcuccaggacacccucuccuggccucugcaggacaugcagguaaaacaccaauaaacacauaaaauagaaauuuaaauuaaaaaaacaacccacaaaacuaaaagucacauuuugaucacaaucagcuugaaaauuacacuggauucuuucucagaaguccaucuuuaucuccuaaguuacuuaccacugaugaggaagagaaggaggaugcuggauaccauguggcauuuaccuuagaagaaaccuaugggguuaaaaaguaucugauaaaugucugaugcagugguacacacuuucaaucccagcacucaggacacagacaggcggucucugugacuuggagauaagcuuggucugcauugugagucucaggccagcuauggcuaauauaccaagacccuauuucuuucuuuuuguuuuucuuuuuaagguuaauuuauuuuuuuauguuauguauacgaguacauuguagcugucuucagauauaacaaaagagggcauuggauuccauauagaugguuaugagccaccauaugguugcuggaaacugaacucaggaccucuggaagagcagucaaugcucuuaaacacugagcuaucucuucagcuccaagacucuauuucaacaaaacacaauuugauaaauaagccuagaaaguauauaaaacuugacaaauggcuguuauaaugcucaauaucauauagcuacugugauugcagaaaggauuuaguauuugguuucaaggaccauauaauuuuguuuugagacagucucccucuauagcccuggcuuuccuggaacuguagcugaagcuggccuugaacccaaugauucccuucuagccuccuaaguauaggaguauaagcauaagccaccaugcaaugcuuagggccauaugccuuuuuauuuauuuauuuauuuagagacaggugucucucaagaaaguccuggauguucuggaacucaauauauagaccgugcuggcuuucaacucacaaagauccucuugccucugccuugggaauaaaggagugugccaccauuccuggcauuuuuuuuuaaugaaguuuaguuguagguagaaauacugagacuggaucucccugucccuucccauuaucccccagguguuaaggaucaaaccaagggucuuauguaugccagcaagcauuccaucacugagcuacaccccagcuuucgcugaauagucuuuauuuaaaagaaaaagacaaggccaggugccauggcacaggccuuuaauucuaacccauugguagguggaggcaggcagacuucugugaauucaagaccacucuggucuaaaaagugagucccaggucagccagagcuauuuaugagacccuguuucauaaaaaggguugggguggauaggucaccacaaacucaaggcuagccugggagucuacacagugaaggccccagacacagaaaguuauagaaacgauaaaucaugaagaucaaguccuagcuuuccaaggaagucuuaauuuaaggaaccuuuuguaucauauuuugcaaaaaacagucacuacaaaucuaaaaguacuuaguauaauaucuaaagaaaguguugaagacaguauaaaucaauauaaauauaauaaaccauaaauaacauugucucuacucaauguaacuacagauuaaauagcaauaaaauacaaguauaugcucacacauacuugaauacaaauguucauagcgccuuuauuuucauuugccccaaacuugguagugacucaacuguccaccauuaguuaauauaaucaaggugcagaugugugaaaauaucacaaugggaccgauuuuuauagaauauguuaguaacauuuuaauaaugcagcagaugaggguggagaugcagcagaugaggguggagauccuucaggaagcugagccucacuuacuccaggccagucucaggcaccaagugagacucuguuccaagggugaaaaacagcgagcugaaacacuagaugauucauccauauaaagcuagggaucccagcucaucucuaacaucaucagauuugucggcacccuuggcugaaagggacagcaguuaggagagcuaagaggguucuuuuuggaguaguggauauuuuuauuaucuugugauacuuucacaggcaguaugucuuaccaaauggaauauaaacaucuuauuuugggucaauuucacuuuauaaggcuauuuuuaaaacgguacagguaccucauggcagacgaacauguuauuuuguaggauaaaaaaaaaucagggaguggagggaggcucaauuauaauaauguuaaaucucacacuguauuucuaaaacaaaaauguucaacguauuacaaaaguugacuugagaaauaucccaguaaaagauguaaaggggugcugggcugaugguuucuauggcagcuggucacucucgccuccugagaaggugauuuaucacagugcuccccugggcuauuguccacuuucaccaacagagugcuucacuucuauguauacuaugagugucucccuugaguucuuucgauggcgaucaacaaggaaggaccagggagcuggggagagcaacacaaagucccugugagcucuggguucucacccucacccugagaucuucgaugcugccaccugaguuccuucucucaacuaucugcacuugcuuaacucccaacagcucuuugaucuacuccaaccuucaugaguaaguucuaaccuucaugacugcuccuaaguccuccuuagacuggaccacacagcagaggggacuggcuaauuacucuccgucccugaaguccuuucaguugucucucaugaugcccugcugucuucuucaccucacccucccuccuuuuuuucuuuguagccccuccuuaucucuuuugcuggcucauucuccucuucuggccaucaacuccacugcccaaggcuuagucccaggauuuucuucucauucuuuucauucucuuuaagugaucccagcaauugcaguggacugcaauuggauccugcugaugcccaggucugcaguccucacucagucuuccucuucagguaauacccauauaacuauuuucacaccucuacuugggaucaugcucuccucccaucugucggcuuuacuuccuagagcccacccaccugcgcaauggucuuuaguuaccuggcugaccaaggcacauucugaaagucaccucaucaucucccuuuugcuucucaguaaaccaaacaugucuuggcacaagucacaucuaucuuccuacaagucucugaacacacuguccucuccucucgccacccuguccuuuuucaagcccgauaaccaucucugucucuucuuuagaauucaauaauggcuuuccaacaaaacucauaguuucuaaccuaauaugaucugaaucuaguuucuauucuucaaauggaaauaaauagggucuuucuaagaggaauuaggcaaaacauuaacaaauucucagucuauucaaggaugcauauuauucccauuuguagaacccuuccaugcagggagugcaccucagccuuaaaguagcccguguuuauaagggccaggguuccuuagcaacucaacauaaaacagcaacaaacccucugauggcuuucuauugcccuugcaguuaagauuaaugccccugguguucaguguacuuuugcuucuuaaacuucacaguuugcucgcuacuucauccuugcucucugucccaaccauccuggagcuagacauuacacaguuuugucccaaggguagcccaagacuucuggacauguuuuaucuucuuuguuguacauaugcugacccauucugcugguuucauuccacuuaccuggcucauucuuaacucucucuggaacucucaacccccagauaugggauaaacaccuaacugugcaguucacugagcacccaaaugccuccauuuuucauuccacauucuaggauaauagcuugcuuaauuauuaagugucucuucaggucaggagaccauuguguucucugccccuagcauaauugcuugaacagacugaggacuuguuaauguuuugcagaaucaagggaugaauagucaucaagcaguaauuuguuacuaauauuguuuguguucucccuuaagaauagaaaguguacagaucaggucauuucagcauuccaaaucaguugaguuucgugcuuucacuuguacacugguagacaguguacccaauaaaaugaaauaggaccuuguagcuuucacagaguuagaccucauauguuuugcucacuagcacaauucuugaauaaacuagucuaugacuuucacugucuaggguagugguucucaaccuuccuaaugcuacaacccuuuaauuccucauauuguggugacuccccccccccaaccauaaaguuauuuucguugcuacuucauaacuaugauuuugcuacaguuaugaaucauagugcaaauaucugacaugcaggauaucugauaugaaggguugcucaagccugaggggucuccucgacucaaggaucgagaaccacugcucuagauauuaauuuccuaccugccguuuccuuugucuucucuccuuggcuaaugacuugauagccucgaaacaaacccagaauuauccccuuugagaagcuuguggcgaauuggacagguugagugugggacucuucccuucgucccuucaguacccucggcacccccaauuguccagcgcuuucauugcauuauaguugugaaugugaaaagucuaggauggggcaaaggaggaaggaaaagccugccaagaucuaaguccuaaacucuccgcuucaucaauuacuaacuaggugaccugaagugccagccaauucacuucaccacauuuuaaaauucuaaucuucacagagaaucuuaaaacuagauagaguuagggcuaaauucacagauuugcucugcaucguggaggcaggacacugggucucuuuaaaacugguugucauaucucugaaugggaaagauaauaucacacaaaacagaggggcgagggcuagguuaaauucuucuaauuccaaaacagaaaagauaggcugaacacuuaaaauaacugagaacucaccgauuacuuuguaugcugcccuaaaaaauaaaauuuaaaaacucugaaauauaauuugauccuucuuaguuucuucuguuaguuccuuuaagauucgcggcugucagaauguacaacauguucucuuuucuguguagcuccucccccccccgccccccuguguguguguguguguguguguguguguguguguuaguaaguuauccagguguuuuguugucguugauuuuguuaagguuuuuuuguuuuuuuguuuuuuuuuuaguuuuuguguauauaugauuguaugcaauaugcauacagaugcccuuggggaccagaaggcauaagaaccccuaaugcuggaguuagagacaguugugagcuaccuagugugggugcugggaacugaacaccagcccucugaagaggaguuagcgcuccugaccuuccagcuaccucucuagcucugcauuugauuuuagaaagcauuuuuguugagguuuuguuuuguuuuguaaccauugacugauuacuagguuucauugaagugucuucaggcaugucaguauacaauguugccuuucauccucuuauuuaacugcucuccucauuuccucuccugcucucuggaggguucccuucucaggcugguugugaaggucucaagagauuuuccugccuguguuucuccaaaaacuaggccugcauacauguaccauaugaucacauagauuagccuuuaucaaagugucagauuacaguaacuaauuguuuaagaacuauuucuggucuuuuuccaagucaguucagagguuucuacaauuugguuuuuagaaagaaaaaaaaaguauuucuuccaaaaaaggagaaauucugcuuuuaugcaaaagacaaaauaccucaggauuuucauugacucauggugaugggguaaugacgagaggggagagauuuuuuuuuuauauauauaaaggauuuuaagagguugggaauagaaaaccuagagaggaaaugcucuaucuguuacuaggaaaagauaccagaacagaaguaggggagugaggucacgccaaccuccaaagaccuccagcucauucucuacacugucccauuaaaugacauucaaaccugacccuuuggggacuccaccaagaaucaaacacaugcacacauuucugcaguagaucuccuaaaaaccugaugaguagaaagaaauuaaaguuuauauaaaagugcaacaggagacauuccuaggcuggaugaguaagagauagugucgcuuaauacuggauuaugaaucuugccaggaacagagcaagucuugccucagauucuaaguccaugcuaagaugcaaacacagggaaaagcuauaaucaaagcuggggaucgccggcauacagcuucuggaacucuacaacuucccuugcgcggcguccgugggguuccaacugcagccuagaagaggauaugucggcacuugagaacugauuuucggaaggugucuuccuaggcucuuauuuucuaccaccugucugggggaauguuuagucuuuugaaugaagcaguauuagcaaaaccacaugcccuuauuuaccuccaaaaguuuaacuucgcugagaaaguuuaacuuggcccagggcuugggaaaaacacuaaaagccagaauguuugugaaaacuaacaaauggcugccuuuuugauaugaaaaccuaggguacaugucuaggagauucaaaguuccuucucugaucuuaguuccauguccuuaaugagcucccauccccucuugccucacauagaggcuggauggggggaagggacgcuccuggcaaaggaaaguacucuauguacagcgaccaaaaggaggaguuucuggggcacagagguggcugguacagaggugaaagagagaccgugggaggaaccaaaaaagagaaagcaagccagcaugugacagcaaggacugagcuggacuggaggugggugggucaaagcuaaaaaagaaaaggcucaggaguaaaggggaguggggagcaggcgugaccguccggggcugaaucucggggccaggcgguacagagugacagcccugacgcacgggucugguggaacacaaggggcugcaaagaaggggcugggccaagaagucuguccggcagaagcaugguuuagagacggggcggaaaggacccauuucuaacaucauggucccucgucgccacccucacucgccugcaggauccgggaccgcauugcugccgcugccgccacugccgccgccauggcucaccgacucugcccagcucgccugcgucucggcugccagugccucccuugaagcaacaccguuaagccacgcccagaacacg

SEQ ID NO: 6748 - RNA, 10439 nt, Mus musculus
cugugugaggacaaaauuucacuuuauuuucuuuggguuuccaacuguguggcuagacaaugaaaaaaaaaaaucaauuccccaccagccuuguaaccuuguagcuccuugcccaaaaugugccuuggcgucugaggcggcucagcagguccccaagagcagccaggcuggcagacgccugaccugaagagaucccccccagcccccagcagaggaagcaggaagcucucuuuggggucuccagugccuaggggccuucccuggcuuagagaucacugucguguguucugugaagcucaguccuucuccaccgaggguuugaggaagcagccacacagcugccucaggcucaguccccauauuccuuuggaagacaucuuugagggggggaaaaaaaagauacaacccuuaaaaagaaaaggcacauauauuuauucugacaggaaauaauggucacgcugugauacuuuccuugugggcccaggaaaagcugaaagcagccaugucacaaucaugacagagcuuuaacacugacgaggggcggaggggguccugccaacccaaauuaauggaaaaagcaaaaugaaacacaacaaaaaccuaugacccagccaacaaccaaagagacaacuggcccuccuguagcuuuugucagagcgagcggcugauucccaccccuccaucaagacguuacaaaaggcagagcaaaggacauccuagucaggaggcagcucggcuccccuucuuccccucccaucagccaucaaucagugugagaccuucauagagcgcccgcuuccacauguaguagguggagcgggcagugagggggaagagcgccuggaacuccuuguaggaggggaaagucuuagacuggaaccgcuucugcaggaacagcuuggccugggccuugaaccucguggugguaagcauguccaucaccagcaccugcccaucacugcccccgggugccuccgccagagucuggcuuggcaacgauccacuaugggguuggcucugggucauagcugccucuugaaugauguuucccucucuggaaggcccuccugggacaucuucuggagaaguagccacuggcagugucuccgcuggaggaaccaccauagccgguacauucugaucagcuuccauagccugugguucaacuggcuucugccgucccucgggcuucugccgucccucgggcuucugcuguuccucgggcuucugccgucccucgggcuucugccgucccugaggcuucugccuccucuggcucaaagagggaaucugcaucccgggcgaucuccgggaaagacuuuuccauacccaaaaaguggaagguaacagacuaggauagcggaggcggaagcgacagaaggguaggugcccauuuagcaccugcuugcgggcagcccugcguagucgucucugccaacgagauaagggcaucuuuggggauaugagcccccgggaagucagaggagccccacuuccugcuuuuccugucuccuccucucccgcuucucucuucaaagagaagggggucucuuucccaacaucuguuggcuggagagacucagcaguuucaaaagcugcuugggacaacuugaaacuggggguccuucugagggcuuuccgccuccaguuguaguagguagaccucgagaugccagggaaccugcauuugaagcagcgauaugguaccaguuuguucagagagaugcaauacuccaagaaagacuuggcacgcugcauuaagaucauacuaggagggcucaacaucgcugcugccagugaggagcaccccaccuccucagcagccuuuuuccccgguggccucuccaccuccggcacagccagugccucccuggauggaguggccgggcccagggccgaguuggcaccagagcccagcaacucaugcuuccaagcauaguagguagaacgggagaucucagggaaucucugcaggaacugcugcaauggcacaaagcccccacgguggaaacuguccugcaggaagugcuuggcagagaagcggguggcuaccuuuugacggugcucuugggucugccgccgccagcgguagaaggugcucuuggugaugcugaugcggucacagaggugggaguagcugaggccagguucacgguugagcagcuccaggguuuuagcgggugguagcagaggacccagguuuggaggaacgggguucaggcuagcaguacagucagccuccaccuccuccagcccaacaacaggggcaaaauacuggugacggaagagguggcuagugaggggcugaccagcccacaugaugugcagcauggaggucacguggguggagcagcgaggcaugauaacacgguuaaaauagggucggaucuugauguugcgcaugggguagauggaguagauguugcauucaaggauggaggcgagggcauacaagugccacacauuggagaagcucguugggaagcacguagccuuuacaucagcaucaaagauggccuccaguguggcaaaagauaaguuggucaucucaggggacuccucagagcacaaggaguagcgcacagccugcagcaucaccuuggagucgaucaugcccugcagauaauagugccugugcagcagcaucuccaccacagugcgggcucgcagcuccaggcugagacccgugugcccccacaacaacaggcuggucgcuucaaacaacaggcuccccucacccuugcacaccaagggcagcauguuccgaggagcauccuccggguacagacucaaggccacugaguccaccuccagcaccugagcgccagggccgcccuucuggcagaugggaagggugaaggaagauaggaccugcuuggccuccagggcagcaccgaugagacccucuaagcccucggacuccacugccuccugcaggucgcgcagcaccugcugcaccagcugaucccgagacgucauccugacaagguaaaggagagaggguagaggucagaggaauggugggugugcgcuggcggcuucgccagcagcagcaguucucaaccugugggucgcaguguauuagauauccaggauuuccgauacuuacauuacgauucauaacaguagcaaaaugauaguuaugaaguagcaacgaaaauaauuuucugguuggggggugggucaccacaacuugaggaacuguauuaaagcagcaagcccggcgugagaguaguggugcgcgccuuuaaucccagcacuugggaggcagaggcaggugaauuucugaguucgaggccagccuggucuacaaagggaguuccaggacagccagggcuacacagagaaacccugucucgaaaaaaaaccaaaaaaaaaaaaaaaaaaaagguaaacaagacaaaaagcccauagacaaucccagcagugggagagugaaggcaggaguucaaagccagccugggcuaccuagccagauucuaucuaaaaacaaaacaacagaggaugaagauacagaggaguagacagacacauauacuuaguuugucucaugucccucccuagaacagcaccugauacaaaguaaagcagaauugaauguuagugacugcacagcaauaucgacuacaauacauauuauacagcagauucaugagcugcaccucuacagggcaugcugugcaugcuuuuaguccuagugcucaccugggaggcaaaggcaaccagaucucuucgaguaccacgccagccagguuuacaaagugagacccugccucaaaaauagauagauaauuugccuucuuauaaaaacuguguuauuuuauggugccgagugguaauucacuccuaugauccuagcauucugggaacugaggcagaauacuuacaugagguugaggccagcucagacuacaaagugaaucccaagccagccugggcuugggugugagaacuuagcuuuccuaucaggaauaaaggcaacagcuucuaauuaugaagucauguucucccauuacagagacagaaguggguucuauagacucaggcguaucugagagauauuagcuggagagaugauggcucaguggcuaaccauugcugcucucccagaggaccugaguucuguucccagcacccacacaagcaucaggagauccaaacccucuuccggccuccuuggacacuagccaugcauaugauauauacgcacaugcaggcaaaacacucaugcacauaagauaaauauuuuaauuuuuuaauaagaaaaagauucaggugagccuaccucuucaaaguuaacucuaugacuauaacguaauuuuucaccuguaaauggggaggggaaccuccagacagagcccaggaauccagagcuagcacagggaacacaauuuagacccuaucucaaaagauaauaauaaagccaggcauggguggcacauaccgguaauuccagcacuuggaaguuaaagaccagccagggccuggagagacggcucagagguuaacagcacugacugcucuuccagagguccugaguucaauucccagcaaccacacgguggcucacaaccaucuguaauggaaucugacgcccucuucuggaagaucugaagacagcgacaguguacucauacauaaaauaauaauauucccuccauuuuuguuuugagaacauacaucuacuacuacugacauaaccuugacaacuuccuaauaccuaaguggucuuuauacuguauaaccacagugucaacaucucuauuaguuauauuacaaacaagacuauuaucacauaacugaggaguagccuuacaaacugcuuaaaauacacaaagccugaccauaguauuuggaguggguacagcaagauacaaaauguuccaggguacagucucuuguuuugguugugagccuagccuuuaacggcugagccaucucuccagcccgucucuuguuuuacuuucccuuaaauagagucuccugccucagcaccacgaagagcugggaauagauaugguuggaaagcuugcauuacaacuaaacuuugaggguuggggauuuagcucagugguagagcgcuugccuagcaagcacaaggcccuggguucaguccucagcucuggaaaaaaaaaagaaaagaaaaaaaaagaaaaaaaaaaaagacaacuaaacuuugaguaauugccaugcaguuuagauagaacagcaaaaacacacagugggaaagcuaucaaagccccuuuaaauagggauuaaauucagagucucagggcuggugagauggcucagcagguaagagcacccgacugcucuuccgaaggucuugaguucaaaucccagcaaccacaugguggcucacaaccaucuguaacaagaucugacucccucuucuggugugucugaagacagcuacaguguacuuacauauaauaaauaaauaaaucuuaaaaaaaaaauucagagucuccuaaauuuuuuuuccccaacaaaauaguauaugggaacagacugaugagagucuacuaaacugguaucacagaggucugagaaacuauaaaauuauguuuucuuuuuacuauggaaacuuuucuuuuuuaaauuagugggggggggcagggggggagcacgcuggagagauggcuccgagguuaagagcacugacugcucucccauagguccuaagaucaaaucccagcaaccacaugguggcucacaaccaucugaugcccucuucuggugugucuaaagacagcuacaguauacucauauaaauaaaagcuaaaccccggaccuugaacuugcaagaccaauaccccaccucuguugcuuuaauuugaauacaguauacauugagauaucaccuauauaaaaaacaagucuucaagcuccucacauuuaaagagcuaacagagcagagaggcgguggugcaacacuggagaggcagaggcaggcgaacggaucuuuguaaguuugaggccuaccugauuuacagauggaguuccgggagagccagggcuacacagagaaacucugucuccaacaaacaaacgagcuaauggagaucuugaaacuacaaaaaaguugagaacugcugucuguacuauguaauagauggucuuucacagaggcagcaaggaagacagaccgucuggugcagagaacuguugaauggagccugcuuguauuguauucugacccuuacagcaggacuauaggguuggaacuacuggggauauagcucaguggguaaagcacagcaugcaggagaccuuccguucaaucaguaguguggaaaaggaaacagauggggagaacgcucaguugguacagcgcugacccagaaccacaagggccugagcucagaucaucgggauccaaguuaggagccaggggaagcucacaccugcauagagucaagaggagcccugaggcuugcuggccagucaaucugccuguucugccuuagugaaucccugagcuccagguucagugagagaaccuaucucaaaaaggaggauccagagcgguacaggaaagacacccagcaucaaccccuguuccccccgcacccccccccacacacacacaugcucauacacucacacucaaagagauggcucaaugagcaaagugccugcuaccagaccugaugguccgaguucaauuuccaggacccacaugacagaaagagaaaacagacucugggaacugucaucugaccacuacauaugugcuaagacauguaugcccacuacauacaaaauaaauauaaaauuuuuuuuaaugaguccugggcucggugguuaagaugucccagguacacauccuaguacccacauggcagcaccuaaccuccauaaucccaguuucggagaauccaacccucugccaaccuccaccgggcaccaggcaugaaugugguacacagacauauauucaaguaaaacacucauacacauaaaauaaguaauaaauaagcgagucucugauuuuaaaagggaguguaaggggcugcugggcgggagcuugccuagcaugcaagaagcccuggauuccauuucuaccagcacauaaacacguguggcggugaaugccuguaauuccagaacaggaaaccccacacucaccuauaauuucagcacaugagaaguggaggcaggaggaucaauguccaagauaugugaaguuggucuggauacuucagacccggucuccaaaugaaacaggcuggcacuaccgauagccccaauucacagguggagaaacugaggcauuuggcagcacccuaauuuguucaagguaucacaaaugagcuagcuagccagccuccccuccaacacaggccaaucugccuaacuccaguaacugccaagcagaggcacuccuuugagaagagcuuuugaaauuagaaaagagaauauuuucuucuuuggcuucucagaccugguccucagagcuuaacacauuguuuuaauuugccccccauuuuaaaaaugaguuuucauauaagugcuuaaguuuaacaagcuguaugcuuaaaagaaaugcacucgaaugugaauugugguugggucaaggugaggaggaaaagaauuuuaaagcgcugaaggaaccgccagaauuuuaccugacagcaagaacauagagccuuuccaauagugauaaucagaagcauccuuggguaacauucuaagcucuaaagaucuucaaaguguguacauacuaagggaaaaaaaaauacagcacagugguggcggcacauguaugccuuuaaucccagucgaggcaggagaauuugaguuccaagccagccagggcuacacagagaaaccccggacucaaaaagccaaaaaccaaaacugaacccccaaaaccaagcucuaaagacaaagaguuccucgcugucacauauauuccaagaaaggggauaauauuccuucuguuuccuuccaugaugucacuuucuuaagugguguuacacagcugcacgcagacgagcauuuugagauacuuugcaaacaaaauuaggaaaauagcugccacuuaccgacucugcacuaacccauuuaaccaaagucucagaaagaacaauuuaaacugugcgcgugacucuuccugccuccacuccugagugccugcucagaagugcagcguccccccucgcccgccccccccccgcccccgugaucacaagugggcuuuuguggggguggacauuugauuucagguuuucucugagguaauuuuauuacucugcgggucucaccuucccuccgcagcucugucacaccuacccggaucaauauuccuggcucacaccuggagaaggaggcggcucagcaggaguuaagaaagcacagcuauuaaaagcugccaaaccuuaggcgccgaaccacugcaguccuccgaggcguuuguuuaaaugauccagagaaucugacauuuugagauacaccuagucacuuuguagacaaggaaacggagguagagagaauaaagcugacuugccugaauuccuccaguguccaacacagcgucggaugcaacacacuuccagcacacagaccuuagccccuccccacccuacccgggccuacuguccuaccucaucuucccuggccuagucacauccaacuccacccuauuucuuuccuccuuucuuuccccccaaaaggagauguuaguagguaaaaaccccacuucuggccuccucaaaacgcucgccgagagcagccugcuaucucagcgcuugcgaggcuaucgaguucaaguccagccuacgcuauauaggaagaggcuguuucuaaaauaaaauuaaaaaguagcuucaaaagaaaaccuaaacucgcaccaucccucagccaggcuggaccacucgaaggcagccaguguggaaaaggcaggcggcugcaggaggaagcccuuaaguagauaaucggugauggaguucagcugcggcgcuuugguuaaaggugcccuucaugaaaggcacucagggccagaguagcuacucccaggugcaccgaagaaggaaugaguccaguguauggcuggccuccccgaaccccccacauagcugcuggaaagggucuguaaaaguacuaaaccaaugaggcgcacccucccucgccccccuacccccgcgauacaaacuucaaguuggaggggagggagcaaagccggggcaucaguuucuaaacguguuagcgccuggaaaggacuccggacucucauaggauacguggaugggaaaagcacucucaccuuuacucgggcuagcuucccugucgcaugagcuccccauuugcaaauagauggagcuucagagccggguuccagccuccagcccccguauuuuaggagggguaaaucagggcucuguaugggacccggaagggaaaggcuggagggccugccuguagaacaaauucauucccuaccaauuguaaccugggcuccaaggaacccgacuggaauccagugcucucuggagaccucccccacucucccugucccucucaaagcacauugcagucucuguaaucuacugcacccacaaguaugugggccacgugguuaaggcucaauaaggcaguagaguuugaucuaccacaaccaaccuggacagccagcuaacucuucagccagccucgcuccaaucaccggggcacaccggcuuggcugcccaggcugcaugaccaagggacugccagccaucuugguucccuccccuguguccuggagacccaacuaggcauaggaggacacuguagagaaucacuggcaggucuuuagaugcuaacuucccaacaaaacucccacaaccaagugagcgcuaacgggugcaccugaggccaucaaacuaagagccuccuccgggguuaccccaaguucagucgcuugacuggacccuaugucucugaaagggacggaaaagagugagggcuaccagucacccuuggggggugccaggagacggugggugguagagagcuggcccaccuggagcugcagaagucagggaccuaaccugagaagaucuuuguggucuggggaggagcuugaggcuauaccauugugcuugccggguggggagggaagacaggauagucgguggggguggggaaagggcuggagguguggggguagggagaaccuaagacaaugccuggcgucccugucccuacacuuccguagcaucuuagaccuaacuaaucccuuaggauccugaagucaaccccuaggugacuagagcaucaagcugaaugaagcaccgaccccuucuaguuuugagaaaauauucuacuuuacugaccucgagggugguccagagcccuggggggcauucacucuucucuccaccuuccagccugggucauuuaaggcacccuaccgggagaggucuucccggagagcgucccuugcugaucuccac

SEQ ID NO: 6749 - RNA, 18596 nt, Mus musculus
cugaaaugauuccaccccuugauuuuuauuaguaugaagaucagaccauagcauuggggaucuugagauuuaccugccucagauuccuguaagggaagagugggucuaagacucaagguuugcacagagacaggcaguagaaaacacggggcccuuuguaugcuuaggauucaaggcuucuguguuaaugacugugaacuuucuuguagggaugaccuuucaaacuaauccucccaugggagacuaccuaucucacaacugcaggcuccacugagccucccaguggcccguaagcaaacaguccuaagcuguugggucaccuccuguucugaugaggacacaagggcacuaacagagcuuccuccucccaccccccauuuuuucggguuugagagcuguuaguugcagagcuaaaaaggcaagaagaaucuguugggaaaagggagucagcaaacacagaagugaguuucuccuggccccucagcaagcucccacacagacgauagcuauguuuuucugagacacauuacacaugagauugagccuccggauuuuccuauuucuagacaaaaagagcagccuagcacaauggcucacaccgacagcguguauaccgcacgcccugacucguguuuuacaugccucauuucacuucacauggcgcuaccauugucccuggucaauggauuaggaaaauccaaauugaagcacggagagauggaaucacuuacagcucacauucacagcugaauaacuggaggagccaaaauuuaaccacgggcagcuggaagcaacgaccucagcagguaacuacuuuuggaguucacaugauucugacucauaugggaagauagggugggcucagggugaaaggauacacaaaagaccucuguacagugggugaacaggucaccgguaagaacuucauuauugacccauugcugcccccuggugguuugccugggaaacucacagguaaaaaaaaacccgcaagccuccaguccuaugcuauucggauuuuaugaaugggggccuacacuggcaaucucagcacuugagguagaagcaggaggcucagaaagucaagguucuccgauacauggcuaguucaaagccagccugagauacgucagaccucaucucaaaaacagcgugugcauucccuaccaaaaacuaugauccaugaccauaccugucagucaucuugagauauaguaaagggaacuguuaucugcuaugauguucucucuccccaucugagacuaggucuccuuuagcucaggcuggccuugagcucauuuuguagacgggguuggucuccaacuugcagcagucuucaugccucuguugccuucuagaacugaaauugagucagggaagggugggacggcagagugguuaaguccaggcugguguggaacucacgacccuucugccccuugucggcuugggccuacuucuuuauuuaaauggaucucacuaugcugccacucggacuggccuggaacucacaucccuccugccuccauagagccacagccucuuccucccucuccuuucuaggcuuccccaugagggcgcguaguguccccgucaccacgccuccucaaguggugcuagguggugguugcugcuucaggcacacugacagcaaugcagaacaaggccacuuucuauggauaaagucuagcugguauaaauaaaaacgaggaaagaggcggugcccgugaguccugugagucacaucuucucuagagcuucggaacuggguggcugccugcuauggaccuaggaggcugccaucuggaagaaguaggcaaccacagacugaacacacacgcaggaguggcaaguuagaauuuauggggaggcucaaucuuacaugcagagagaggauacagacaaauaccguuaaaaaacaaaaccaagcaccugcaaccaaguauuggcuuuaaugaaaacuaccaaagaacgagagcuaaccacaaagacacagccacucagagacaaauuucugcggcagacugccccucagccagucuggauaccgaggagagcuagucgcuacugcugaagcgauggggcagaggcuaccaaggagacucaucugacugauaagccaggggcuggggacucaggaggcacuuagaaacaggggagguaacacccccaggcagccagaagacucugggaagccauccuucacaguggauccauagcccugggucaaguuaucugacaucccuaagcaaccccgucccauccugucugguggaaccugccuguaauccaacagcaaacagccauggacaccaaucuaaucuuuccaguuuccccuuucccucccgaagccuccccagaggcuaucucgggggacaauggcucugagcgcgcucucaagaguaguaggcuugcaguuacugcuuuggagguuaaaaggcauaaaacagcauucuugaaauucuguucaucauauggcacugauuccauuucgggucugauuucuguuucuucccccccacuccguccauggccucucagcccacacagacacaggcgccaaggagccuagcuugugaucugaacugggaucucccagcagaagagauuauucuuuuugucaucuucaaguuuccauuccaccaccaguuuuaucuggaaaagagaaaaagaauuggaaaaaaugaaacuggaaccuugauuuuuauccauaauuggcuuaagcgugcacuuucaauuccgguucuuuuuaaguccuaucuaucaccuugaagccagauuaggguagcccacuaccugugaucuuaagcucagaagagugagcccuguuagucaacgguauccuccaaccuaguccaguuuaugaacguagucuucuaagugugcuauuucuuucccccuucuuuccugcuuacauuaaaaaaaaaaacaaaaacauuuuuuauguguaugaacauuugucugaauguguguguaugugccccacuugugucccugauacccacagagggcagagaagggaaccaagcucccuggcacuggagaugguugugagcugccucuuggggcugggaauugaacccugggucuucuguaagaacagcuagugcuuuuuuuuuuuuuucccgagacaggguuucucuguauagcccuggcuguccuggaacucacuuuguagaccaggcuggccucaaacucagaaauccgccugccucugccucccgagugcucggauuaaaggccugcgccaccaucgcccggcucuguuuucuuuuuagaagauacagucuuguuagcuagcuagauuagcuuugaauuuacuauguaguauggccuuaaauuugugguaacccccuuacuucagucccuugacuacugggauuauagguggaucaccauaccugauuaucaaacguaauucuaaaauccuucucuuuucuuuccuauuuuucuucccucccucccuuuguugaaacagaguuuuugucacacagcuuuagcugaccuagaacuugcuauguagcucagacuggcuccaaacuucugguccuccggccucugccuccugagugccgagauuauaggugcacauucccagguuucauucuuagaucagaggcguauaaacagagucucauaagauuccuugcuguaaggaaacuuucuuguuagcuagaaauggagauggccaagcacaagguugguccucagcuugugggucaugaccccuuggggagcuguaugacccuuucacaggggucucccaaaaccacggggaaacacaaacacuuacauuacgauucauagcaguagcaaaaguacaguuaugaauuagcaacaaaaauaacuuucugguugggggucaccacaacaugaggaacuguauuaaagggucaaaccauuggaaggguugagaacccgugguccaaagacauguuuaacugaauaaugucaagggucaccacccugugaagcaaaagaacuucacuucaccuccuuaaacugugucgucccccuccccagcccccacuccucccuccucuccccaucuugcuuuguuucuucuaacgcagguucucacaucaaagccuagacuggcuuggaacuuaucacacaacccaggcuguuuggaacgcacagugauguuccugccccgccuuuuugagcgccaggauuacagcaccaccgugcacaggucuuaagaugauuucugcucaucucucauuugagaucgccaccuugacucuucauguugaagcuaugagcuguguuguuguuuguacuuuguuucuuaagacauagucucacuucuucaucccaggcuagccuggaccuccagaauacacuagauagcugaggcuggccuucaacccauagugauccuccugccugagcuuucuauguguuggaagugugagccauugucccuucuaauuuuguaggguuuuuuuguuuuuuuuuuagacaaucucacuauguauugcuggcuagcacugaacucagagauccgccugcugagagcugggauuaaagguguucaucaacaggguuguuuguuuguuuguuguuuuaaagauguaaugagccacuaggaccaguugugaguaugaguguuuugucagaaaguauauaagagcaccaugugcacgcaguguccuaguagaccaguagagggcauugaagccccuagaacuggaguuauagagagcugugaggggccauaggcaucugggaacuaacugguccccuagaagagcaucaagugcuccuaaccacugaaccaucucuccagcccccacuucuaauucuaaucaaguagcucuuuauucaugguuccucucuaaccugagcacucagggaaggggcugcccaucauuaguuacagacaccuuugucccucaaacugucuucacaauguaacacuugagggacaauaacaucuacauucuugaaaaccuggcuuugauugcaagacuugugugccaccacacccggcguuacuguuuuuuuaaacuaacaguuuaaacuuuucaaacuaaauacaaaguaccuaccgugaaucaggcucugacagaucucugcauacugacgcugccaccuauaaaucuuuagggucuccaacaacccuuaaacuagagguucccaaccuuccugaugcugugacccuuuaacacaguuccucauguuguggugaccccaaccaaaaauuuauuuucguugcuacuucauaacuguaauuuugcugcugucaagaaucauaauguuaauaucuguguuucuuaggugacccucguuaaagggucguuuaggccccaaagggguugagaaccacugucuuaaagacuacugauauuuuagucuucuacuucucuuucuagaaacaaauuacaucuggguucuacuuggcuuccuuaaaaaaaaaaaaaaaaguaacaccugugaagauuaaugacauaugucuguaauuccagaauuuucgagguugaggcaggaggacugccuggaguucaaagccagccaaccugggcuaccaagugagauuuuuuucugaacacaaacaauucuagaacaaaacaaugaaguaacccccuuuuuuaauggggggggggagcacuugcuuuauguccuuuauuuuuaucacaaucccuaccuaggggacaccacuccagcaccuguggcuagcgaguauguaaagucggcuuggaggggcgcccagcuccacugagacacccaagugcugcugcuaagugguccugcucucuccuuaagaauauggaggagaaaccaggauccugaagaugcugccaaggcaguuucuaccuuuaacuauuuguuaccuggcuaaaaucgcugcacaggcuuuggacuuaggagucuuaccucuaaaucuaggugcuaagacuucuugguagaguggacuuggacucuguauuauguaauaccagaagcuuaaaauucuucgcuuguaagucagaaauaauaucgccacuacacagggaggcggugagggcuagggcuauaaaaauggcacccuugggucccucaacucaucuccucucccuuaggccuucccagcuccaccaccagcucuuugccccagucucugcaucucacucccagccccggggcgggccuggugcccucagccacggugucacuuacagagggguauucauucuucaccggaagcuuauucagguagcuguagaccuugucuuucuggauggggcaguugauuccacucuuacaaccgucaggcucaggaauagggaaggggacccggaucccuuccaggaugccguggaccaaggccgugcuguucugggacugagugccuaggaagacagggagucagguggaaggcagcuaugcguuugugaauucuaagucaagucgucaaauacaucaucaaaugcuggaauggugacuccagaagaucagguggucccgaacuauggggucuccaucccuaugagucacauucaauaccuagcccugucacgugaugaaggaagcugguaucuuuccuugcucuccaucaagggaaucaggcuacugggacagauaaccuuaucucucucccaggaccacugacuucugucauugaguuuuaaauaccacagucuagcacagcaguggcagguaauccuucagaugccauggaagauuaaaaagaaguucauuucucuagccccuacacugcaagauaagcagaagggaugaaaguauuauuaccaccgcgugccucccucugacuaucaggcuaugaaaacaauguaccccaagaaauuggaauuccccacuggaagaagggaaaagcugagcccugguaccagcagaagaaggaacuugccauguaggaaggucacaggguucugacaacuuggagacaggccaggagcugagcuaaggauacauuaauaccuugaccucuugccuucuauuuagaccuaagccuugucagugacccggaagagcucacuaagccucuggauuuguuccucuucccagugugaccacacucaguuuccucucucaagcuuucacugucuuuuuagacacacggaggacaaggcugccggggcccagacccgucuccuccaguaacauuacacauuguaagggcauuuuagagaucuaggguauuagcugggucucacuuguuucauuuuuaaauaauaacaaugccuaaauuacauuaguacacguagucagugggggagaggucacagcauaucuacagaggcgggaggacaagauucaggagucagacuuccuguucaaaguguggauucugcgguucaacuucagggugucagccuuggcgacagagcaggcaucgucaccugccaggucaucaucagggacucuuuuuuuuucuucuuaagauuuauuuaucuuauauaugugaguacacuguaguugucuucagacacaccagaagagggcaucagaucccauuacagaugguugugagccaccaugugguugcugggaauugaacucaggaccucuaugaagagcagcagucagugcucuuaaccgcugagccaucucuccagccccucucagggacucuuaauuuuaguuuauuaaagacauguuuauucagcaucaugauuagacuauuacucugaucaacaacacagaccaagaaaacuguacauuaaaacccuucacuuggggagggagcaacggagaguaacccaggcagggaagaaggcuuguuguucuuccagaggaccaggguucaguucucagcaucuacaugguggcuuacaaccauccauaacacuaauucuaggggauccaacagccuccccugacccuugugagcaccagacaugcauguacuaaauaugcacacaugcugguaaaaacuauagaauaaaucuaaaaaucaaaacuaaaaaaaccaaccaaacaaacaaacccaaaauccaaaguuauaauaacaauuaugaaacagaacaaaacacucccccacccccccaacccccgucacuggaauguguuacacuuuccacagaacagaaacuaaaacaacuuguuucgcaauuagucacagaaacagcucagauacacgaggagucucuaaaacaugucuucuucucaccaccacuacuguguuuugcugaggucuuaacuuauaaccugaggcuuccccgucacuuccugggcucuccucuccugcuaagcuuuacuuccuggcuauaacuagaaccuucugccacagagagcuccugcacuggcagcuuggucuugugguuuagcuaggcaccuuuuuaccaccacaggcuccagagcuucugccuccagagcuaccucccaucacaggcccagcaucugaagaugaauuacgguaacuaucaaaauugcugcugugucuacugccuccaaaauggcuuccgaauccauuacagccauccccacuggcaucacacacagcacagcuaccaccguuuuuagguuuucuccauaccuaaaccuaacccugccacugguaccaaaccaacuugcuuuuuuggucguggugauucacuugcagcgagagaaacccugacugaggcccucacuaccccuggagcugggcugguuccauucaucuuuccagccggccagccucugccacccacugcccugaaugcacaggcgcgcaagugccuguguggccacacccggcuuuuuauguagguacugggaucugaacucaggucuucacauuuaugcagcaaguguucuuacauacugagucucuccccagccucuagauuuuuuucuuaaacaaacaggggauagggcauaugaggaaagaaagcggagugggcauucuucgagcuuggaagccaacagugcugagaacuucgaguccuacacaguucacgggagaguaagcaaaggaaaaguuuccaagcagcugcucucuccagagagaagcauuuugcacgugucuagauaucuucauuuaucuuuaugugucuguguguaugcacacauauguuuuggugccugugcaagggggggggagaagggacucgauccccuugagcuggaguugcaggugguugugagugggcaucggaaauccaauugagguccucuucaagggcagcaagcucucucucaacugcugagccaucucucuguggugcaacaccggccccacacccccguggguguguguauggggggcgugucucgagugugacacaaugcacaaguggagaucggagaaccacuugauggauucaguuuuuuccuuugacugucuggguucucgggauugaacguaagucaucaagcuuggggacaagugccuuuacccacagagccacuucacacagacccucucucuugagauaaggcagcaguucucaaccugugggucuugaccccuuugaggggggucaaaugacccuuucguagggucacaugucagacaccccacauaucagauauuuacaccaugacucauaacaauagccagauuacaguuaagaaguagaaacaaaagcaauuuuguggcuagaggucaccacaacgugaggaucugcauuaaagggucggagcaugaggaaggucgagaaaccacugagauaaggucucucuauguaguuucaucuagccuagaauuaccuauuauaugaagcugcucuugggcuucccccacagccuggcuggaaugaagguuaugaaggaguuuugagguuuguagaauuaaguuucuacuaucauaauguaaauaacuuccauucuaucgucagcugauaccccucuaagaguccgaugugcauuaugggucaagucagacaaaacgccaagcuguucucucuaaccuguggccacagcagaaucaagcuguuugcuuaggaggagucuggcccucacuggugagauauauggaagccuguggggcgcagggaagccuggagggaguguauggagcggauggaaccccaggugaacguguauaauugaaaugggcacagccauaccaaggacccaaugccuuagacccacgggaaacucaaaccucccuguagguagagugugaauccuggcaguacaugcaaaacuagaacugcagcucccccucccagaaguuuacagcuugaggcuaccccgauauagugcccuccuacauagacuagcuaaccucuccuauaacucuagguaccacucuagcguggcugucauucccacacugccaccucggucaggcuuccaggaccaggcugcaccugaaacagcaggagcccagagcgugaaggguguuugaggacacagugguggcccuggggguuuccugcugugagacaucacacacaucacacagcuacccuggcaucugagaggagcucuggaguaguucugacucacagcuaagguuucacauucccagcuuuggcgucuguuuuauauguugugaaacuacuauuucccccccucccacaucuagcuggaauuguaaguugaacgcccucccucccuuucaucaacucaguccuccagguuuccuuucagaacucgacaaguaguggagaauuauggacccagacuccguccugucugagaacauagcgaauucuagcuuuguguacguugucaggaaggaggcugacaaaucccuugguccccuaugcucacuccuaugccuuacauacauuuuuuauauuacgggaucggcaugaauuggagggagacgccacaucuacucaccgcugguaaaggugauguugacacuguaggacuggccuuugugcagcugacagggaucggugggacaugggcucacauucaccuccuuuauaacucccaccuuagagccugaaaaaaaaaaagaaaagaaaaaaacaaaguugaguuugacuagggaggaaaccugcaucccgagucugcccggugcccucacuuggggaugcuucugcuuuccugagaugaacuuuuuuuuuuuuuucgagacaggguuucucuggcuguccuggaagaccaggcuggccucaaacucagaaauccgccugccucugccuccugagcgcugggaucaaaggcgugcgccaccacgcccagcucugagaugauuuuagaaugaaggagcuggggcgggguagauggcucaggagguaaaacacuugcugcacagugugagggccugaguuugagccuccgagaagcugggugugguggugcgcacaugugacuccugugcuuaaggagagaugcgagcagagagagaggaaacucugugagcuuucuagucaguuacauugcagggugcagccagcacagcggcaauaaaaccgggaaaaaaaaaacgagagagaagguaaggaccgacacacgaaguuauucucugagcucuacgugugcacauccacacacccacauacguuacacacccaucuucucucucucucauacacacaccacacacacacacacacacacacacacacacucacacucacaacuugagacucucaguacugcuaaaaucgauccuauaaauugaauaaaaaucuagucgauuuuuuuuuggcaaagagaauaccagugugugggguagugccaggaaacuugguaaggucgagcagguucagagaccccagcacccaucugagaacgguaggcaccuccugcucccugacaagacuccuggucuggaacaugugaccacccuccucacauaggaaaguaauggucucaaagaucacaacagaggccccgaggguuuagccaauaaucuucucuucuaggacauuccuuccuguagaagguauuuaaucucugacccacccuggggaagugauaugcacccacacuguaaauaaacaauaaacacuauggauaagcauggacugucucaagaacccuguggggcuuggucuacagagugaugcuaaguuucccuuggaaggccuuuccacaguccuggacucacuuccucugaguuaagcugcccccucccccgggccuccugcuuccuccuccuccacagcucacuguccucagccugcagggcccuuccaugacuccucacuuaguuuccagugggaucuggaugucugggagucagagaaccccagcuucugccucaggcuguguuuucccaaccucugagcgcuucccacaagccuggcuagguggaagguaggaucacagcaauauuugucaaauuaaucauagugagaccauauucacacaacacuguauuuaaaaaaaaaaaaaaaagccaggcaugguggcuuacaccuuuaaucccagcauuuaggaggcagaggcaagcauaucucucuugugaguucuggccagccuggucuacagacugaguuccaggacagccugaaauacaaagagaaacccugucugaaaauaccaaaccaaccaaccaaccaaacuuggcucuauccucuucuucuacagauaggucucagccuugguggcaacaccuuuauccauugagccaccuuguagaccccccucuugcauucuuaaaaggagacucaguuuaaaauuaagccuugaaacuauuugucuagaucuuccuuuuaauuaaauaucccuguucucccaucauuuucuagcagagauaagcauguaaguuugaugaaaguuggagacuauagaaaaagccacaucauaugccagaaaccugguaccuaaacugccaaagagaaggucaucuuuccgcuaaguucuucaaaauguaaucauggauguaagcagcuauuuguuagcaagccugccagaccucagaaggcagaggcucugggcuggagagguggcucagugguuaagagcaccggacaaucgucaggagucguuucucuccuucaaccuugaaggcccuggggauuaaacucagaucaucuugguaacaauggcccugagcagcugagccagcucacaggccuuuucuagcuuaaaggcuccagcuguacacagcuuccuaaagcaauaggcaguuguauaguggucuggguuagucagucaaacuuagcuuuguagguuggugguacauacaacccgcugacuugugagugagugguuuauggaacauaagagaaaccaccuaucucaacccucaguggaggaauggcucuaaaaggaggaaccggcucuuucuacagagggaggacccucccuuaaagcuaacguccuccacagcacuucugccuuccuguuagucauguucucugagggcaagggcggaauccaagaggaucaaggagcacucuggcucuaagucaagucuugacuagaucauuaaacuaugauuuucuccauaacugagcagaggaaggggggggacagagguuuuauaguucugccgaaaacucuuagggcccggacuggccaagguacuacaggucagucaguacucugagucagucaagcugcugaggcaggagaaacacggauugagacuagcuuuguuucaaacaaauagauaaauacauacauacauacauacauacauacauacuugggucccaagcacggcugauucacucagccaagauggacgcaaacccagcuacaccgaccggcagaguagccauccuagcugggcugagauuacugaaacagugaacccccauggcuugugggggaaggugaaaccuuggugccagccagaggagagaccugcuccccaggaagggauuucacacaguuccgacaacuuguuaggccaccuaggaggagagaccugagcugucggccuuauuacuccuuuacauaggaaccucuuacccgugcccaagacugacugggggacauuuguacauucuucuuuccagcguggccacacuggauaaaucuuucucagcuuuucaauguugcuugcucuuaaaauuuuuuuucuguaagguuuauuuacuguauguguaugaaccuguugccugugcauacauauauacacacaguacccauguagaucagaagagggcauugaauucccuaggagcuauggaugguuguaagccaccucgaggguccugggaacugaacccaagucccuuggaagagcaauaagugcccuaagccacugagccacaccucuggcccccuuuaccugacuauuuauuuauuuauuuauuuauuuauuuauuuugguuuuucaagacaggguuucucuguguagcccuggcuguccuggaacucacucuguagaccaggcuggccucaaacucagaaauccgccugccucugccucccaagugcugggauuaaaggcaugcgccaccaccaccuggcuuuaccugacucuuuaacuggcauuugaacccuguggucacgccuagcguguaggggugaccaaaacccaggcuuguucacacuccugcgacaguuccaguuauggguacuugaccguggauuucuuuuccucuccaguaaaauuacuaagcuaaggguuacauaguugcuagaaauauuauacuuguaaacacuacuuauguugauaaaauacugguaggaaaaagaauaauucaagccccugacaagguagguuaaugauacucuaaggcucaucaccugggcuugaagucuuaccagcucagcuuuccacuguguagccucaaggcaagauacuuaacaucugggcugcccuagggguagugggccagcguaucuacagauuucagauacuuaucuggaacgugguggugccauugaaguuguagguuauaauuaccaucacucuggauucgguccaugagcuaaaguaccugcuccuggguggguaagcaaagcuccucucgcaccaaagcuacgccucuccuuaaauauacuucauagacagaaauaacguuugcaacccacaguccagacacuugcugucuggaaaggagaauggagagagaguagacaaaucacaagcagggaccacacugccugcuacguaguuaccacauuagcucagaaacauucaguaaaacuagaaaggauaaagugaaaaugugaaugcacuugacguucucuaccggggcuugcccucaggcuggaaggugcucuucaaauucccucuaaggccacaaggcugguguauggaggucaguaaacagcacuuuacaauccccaucucgcaacuggccugcacagcacgcgcucaguacccugugugagaagcaucauacaccagccccugaguugaaaauccauguucacgugaacuucagagcccagcuccacccugcuucuucaaagcugggucacaugaucucacaggauggggggugaggguggggggaaggguacuuacaguuccuuugugcagguuuuucuccugccuccccccccccccccacaagagguucccggacuucaaaagucaauagaacauacuccucaguucccacugcaaacauugcauaagcagcucacuugguucgauuuuacacuuaaggcgaucccagcccagaaggugggcauagaauggaauguaaaaucuuucaccugggugccuacauuuuuacauuauauuuucuaauucaaggaaauucaagccgggcaugguggugcacgccuuuaaucccagcagaggcaggcagauuucugaguucaaggccagccuggucuacagacguuccaggacagccagggcuauacagagaaacccugucucaaaaaaaccaaacaaaacaaaacaacaaaaaaggaaaaucaaaaaucagucauggcgcacacacaugcauacacacacacacacacaugcacguacaccccugcuuuucuuuaaguucucucuaggcccgagagcuggcuuagcaaguaaagggccucacuaccaaggcugagaaccugaguucaauuucccgggaaaaacugacuucugaaggcugcccucugaccuccacaugucugcugcacacauguggguccuccuauauacauacacacagauagauagauagagacagagagagagauagacagauacaacaugaaaauacaaguucuuccaagguguauaaucugucaaaaaaagccaggcaugaacaugaacacgaacauggccaaaguagaggcaggcaaaucuuugugaguucagccuggucuacaaaggugucucaaaccaaacaaaauccaccaccauuaccaccaaaauaaugaaguucagcaggacagugaggagggggccccuuuaaucccaccucucaagaggcagaggcaggcagaucucugaguuugaggcugccugguccacacagaucaaguucuaggacagcuagggcucuguugcauagagaaauccugucucaaaacaaaacaaaccaguccaaguggcuccuagggacuuaucagcuaucaacuuaucaacuccuuauaaguccuagggacuuaucaacuuaucaacuccugcugauuagcuguagggucuuagacaaguuggucugugugcuuuaguuuccuucucuguaaaacagauggugaagaauaaguuaauaaaaugaauacagugccuucaucccagacucgguccucaauaaaggaguaggggguaauaucacuguggauaaagugaaaaccugaguucaauucccagaagccacauaaaaacgccacuuaugguggcacgcacacgcacgcgcgcgcgcgcgcgcacacacacgcacacacacacacacacacacacacacacacgcaauccugacccugggaggucuacuacgucucaaaagaagugggcugugcucuugaggaugacacuugagagguuggacuccggcuaccacaugcuuggguacacaugaauacacacacaugagaaauaaaaugaaaauuuaagaaguuuaacagaagggaaaaacagguacuucaaagaaacagccacucugagcuagccuccagguuuagugaacggcaucugugaacuauugauaggcaguggcccuuauuauuuaauccaguuccacaugcccaccguugcuuuugcuuuaacagaacuuuuaauaucauauuagagguaauaugaauucccuuguuuccuuuuucagugaguauuuauuauuuacuaucaucccauaguacuggauacuggcuacaaagaagcauauuuagcuugguuccucacucagcagugugacuacagaaggcuuuaauccaccucccacucccaccucuaccuccuuaguuaggggugugugugugucugccugggagugcagguagguagcugagaaggcccagaguugggguauaagcagguauaaccugaugugggaauugaacucuaacccuccggaauaguaguuccccuuaaccacuaagccaucucuccaguccuaauaacucuuuaacuuacugcuucauuauggucuguuucccccugcucaaauauuuuacaaaaucaguuugucuuucgaccaucacugcugccuuuuccaccccgggccccugcacugcucccacaacuaaguguacaggcuugacuggacaaacucagaauuucuacccucuauuauauuuuccaauaaagaguccaggggcagcguugggagggaggcaucacaugaugucacuagaaauacgaauuuuauaggagacaaggaucaagaaucaugaaauucauuagaacaauggaaacccuacuuuguaaaugaauguuaugagaaggagaacuagcuuuugucucguuagugggggugggguggggaggggagguggaugguacuucuaagaccagagcaggauugacagggauuuggaaggccaaacugggcuacagagugaggcugccucagcccgcucccaaccaaacuucaaacgaacaaagggagaaaggccagugacgauacaaggcauaaaucaaaauaagucccgugccuauuccuucaauccguguuggaugcagaccugcugucuauccuauuguuuuauuuuuugcuuuuauuuguuuacuuuuuucagacaggguucaauaaauccaggcuagucuuaaauucgcaauccuccuccguccauugaaaucucaaagcccuugagcgcugcaauauaugcccgcuugauguucacccaagaaacuuuagugaacuucagcacacgguucgccuugugaguguuuuagauuaucccaaaacacgaaaugcaaggagaaacaaaguugugcggagggguuaaguuucaucaagacuaguaccuucggucccaaccuagucaauuccacguuccagcaacccgcccaauccacccccgggggucuccucgagugggcucagggcucaccgcaguccuugaagugcaggggcuccgccuggcuggcagcgaccagcgccagcagcaggaucguggcggccagaaaacgcaucguggauaugaaagcucugcaaucuaggaaggaaaagcagcccgagcagucacaagauaaacuugucccggaccgaggguggagccagaucaggccacuugugagcaguaaccagcgaaggcccgcccgcgccccgcccugggcuccggggccgccuggccugcagcucgcccuuuaucuccgcccaucucuuccgcuuccaggcagggccuacggagaacucgcucuuugcguucgccccgcucuauugguaccgacccacuucggcaaguggaagcguucucug

SEQ ID NO: 6750 - RNA, 3989 nt, Mus musculus
ccucgccgugcagccgcgggucgcugagggguuuccaggcgcgcgacagaaggugcagcccuggcugcuaucugcugcuggccccggggauggcuucuccgagucuggacagguggcuggacucgacgcagcugcuggguucgggguggccuccuggccucggccucugcgagccucccaggguuccccugggccggcugguuccacucagagggcgacaagccggggaccggcgcgucaggcucucggaacagacuguacaccuuggcugcagccgcugcgggguggcugcccacggggugccacaaccgauucgcaucccugcuagcugguucguaucucccuauggaaucccguugggcaugacuuguccccaucaagacagccaggacaaguggcaggaagccccuccaacgcacccgucggaugcauccggagcagcgagcgguggucggcgcucucauggcgccagaguggcugcagagcugugggcaccggagaccucgcggggaggugcuuuccaucguucgcuccacagacccgccuggcgacuugccccuucccgucuaggggaccucugaaacagccguuuggggguccagggguuccuagguaagggcuguauggcgugagcugcccgggcugcgcaccgagcccgagccugccgcaccuucgcucccgcacugccgccgucugaaggggaaccgaaggguuuuauuuuuggaaaccgcccccugcuuuuucgccucuuuuauccacgccaugccccccuccuuggagggacagcucggcccccuuauuacgggagacaagaauuccagcaacacccucuuuggcaccgagaagcgagcgggcggcgaggggauuaacccgugaggagcugcgggcgacagggcagacccggggacuggaaagacagauggcgucugccuggaccagcgcaccugagcugccuuuuuccuguccugggcaaacucaaguuguccaccuguccuggauguauuuucuguuccugaccucacggacccagaugaacugcuucucgggccugaaggaagcuggggaagguacccagaccggaguaauggggaccgagcccgaggcaugcgcgccuggucucguugcuuccaccucugaccgcugggggcgcuaggcgagaaugcaggugucccuggggcagcucccaagagccgguugccuauggggaagggcaacuuggggcgcgcgcccccugguggagcuggucacacccuuggccaccguguuuuguagcgacacacucugccaaccugcuuagagccuagaucuuaaucugcuuccuguggcgccaagccuugaccugggccuauggugaugguggaugcccgcuggaagaguuguucucuuuuuacaaagguaggcauggagccucuugaauaaggugacuaaaggagaguauugcuaaagauggaaauaaaacccaggcuaguggccucuggcccacaguccacucuuugaacuccuaccaccgccccucauuccuuggagaauuuccccaaggggcugcaugagccuuugagcccugcugggccggguucucacaccuucuuguauugaaggggacagggauguccguugccucccaccuaaauuaaccuucuucccugugucccaugccccaaagccuaaaaggcuaggcauauaugguuuuccugaaaguguuuucacagccuacuggcuccuaagcagacaggauaaaagagccuguaaaggcaccaauuacaacuucccauaccagccccucccuucccagaauccuaaguaauaccuaacuggauuagaaagucucaauauuugacacuggccuacggaguccucccugcccggcugguuuucugaccgaucugaacuuacuccugcucgguauucauuacacaguacccucacagucucugcuuggcaaauguuugaugcauugugacggcucaucucucuaccuagaguauucaucuccaagaggucuucaggacuaccucuucauuucaccucacagagcaaacaucggccccuacaguggccauguguguucuuccgcuucccauuccugugaggaaauacccaagcuugcccacuuacaaggggaaaucauuuccuggggcuuuguuguugucuuggguugguuugguuuuuguuguuauucuuugguuuugguuuuucucaagacagaguuucucuguuuagcucuggcugucuccuuuguaagacaggauggccuucagcucagagauuugucuguccccugaguacugggauuaaaggcauacggugccaccucccaguucuucccuccucuuuuaaaacauauuuuaaaaaauuauuuucagcuauguguagguguguguauaugucuacauaugggugugugcacacgagugcaggguccuuuggaagccaguuacacaggaucuccuggagccggacuuacaggugauugugagccacccaagguggcugggaacuagggaccucuagggacagcaagugcucuucaccaccagcucucuuuagcuccauucuucuuuacuuaauacaugucagacaggguccuuggcuugccaauuucuaccagauacaagaacuaaguaacuaaguagccuuuguaacuaagaucaacuuuagaagcuaaagaguugaaagcuauucaauuccaucacgaucauaucuaauuuaauccucuuccucuccccacuguauccucaugaaaaagcugcaggcccuauaguggggaaagugggguggguggggucggaucuguucuucagacuccccuuucacgcucuggcucuccagggucauguuuccacaggaagugucagaaaaggaguaacaaagucuuauuuagcugaugcccaagcauuggucagcucauucauaggcauguguggguucuuuggguguguguguguguguguguguguguuccaccccaaacugucauagcaaagucaucuuugaccaaccucuuggcaauccugcauuccuugccccaagagacauuccagucccugccaggccaggcaaugguaagguggcuacuuaacuucccuaccauguagacuauucuagcaaaguuccacaguuacaauucuccaucaggaagugcaugugaguuucuucauauguguucuugcucaguuucuaaagaugcacauuaguagcugccaagaacucucuuacugugucuuggcaucuguggugguggggagaucuguaauagccaucgauugcccgagcaccagaaaaaaagacagcagucauagcaucuccucuucugccagaugguggccugcauuaggaguguccucaggcucagggaaaccugaaccccggcuucuaaguugaccagagaguucuugccccaguggcuaacuccaucuuuuucaccuaugggcaggaaccaagguaguugguaaaagaccuguucuacuuaacuguguccuauacuucucuucagaaggcccuguuguucuaggcucugucacuugaguggacaguguauguuugugugugugugcgcgcgugcauguucaugugggguugcauacaugugugguagccugaggucacccuugagugucauuccucaguggucauccaucaagaucucucacuggccugggacuuacugauuccacuagacuagcuguuuaagaagcccgggagauuuaucugccucugccuucccagugcuggaauuaacagacacaugcuuucaugccugguuuuucauuucuuuuuuccuucuucuucuucuuucucucuuucuuuuguuuuucgguuuauuuuauuuuauuuuauuuuaaccuguguucuggggaccaaacuuagguccucguguuugcaggcaggcaccccaucaacugaaccaucuccccagcccagcuucagcagacacacuaaaaccacagaaagaguccuguuccacaaucuauaaaauuacucaucagucu

SEQ ID NO: 6751 - RNA, 76842 nt, Mus musculus
cgaccgcgggcccagcuccguagcgccggcgcacuggcgcgcuccguucacacgcuccgcggccuguaaggcaccgcgaguuccggcugucgccgucaccgccgcggcuccuggaggucgguugcgacgaguaacggcgccgggacgagccccgcgccuucguuuccuauauguauccgaauuggggccgguauggcgggagcagccacuauccgccgccgccggugccgccgccgccgccaccgguggcgcuucccgaggccucgccggggcccggguacuccaguucgacggcucccgcggccccuuccucuucaggcuucaugagcuuccgagagcaacacuuggcgcagcuccagcagcugcagcagaugcaccagaagcaaaugcagugcgugcuccaaccccaccaucuuccuccgcccccgcugccacccccgccggugaugcccgggggcggcuacggagacuggcagccgccuccgccaccgaugcccccgccaccuggaccagcccucaguuaucagaagcagcagcaguacaaacaccagaugauccaccaccaacgagaugggccuccggguuugguuccaauggagcuggaguccccuccugaaucucccccuguaccuccaggauccuacaugcccccaucccagucguacaugccuccaccucagccaccacccucguacuaucccccuuccuccgcucagcccuaccugccuccugcucagccauccccuucacagucuccaccuucccaguccuaucuggcgcccacuccuucuuauucuuccucguccuccucacaaucauauuugagccauucccagcccuacuuacccccuucucaggccucuccuucccgcuccucccagggcccuucuaaaccccagcuaccaccaccaccguccaucccuucugggaauaaaacagcuauccagcaagagccuuuggagaguggggccaagaacaagacugcugaacagaagcaagcugcuccugaaccagaucccucuacaaugacuccacagguaagcacugugucacaucuuucauuuaggcuuuacgugagcaggucuugggcuuuaaccagcuaaugccuaucguaauuccaacagccaacgacuagcccauucauacuccaaagauccccuaagagucagcccugaaagccagguuuuaaauugaccauagauuaccaaaagaagaguaaagauaagacuaggcacuugaaguuguaguagguuggcacuagauuuauuucucaaauguaugccuuaguuuucuuugaccagcauucaguauuuauuguugcacagagcuuuguuuuaauuuuuuuuuaaacuaagauuuucauggggaggcaguauaaaagaaaauucuuaaaggacugauguuuaaauacauguaaauauugaccaguuaauuucuuaggaccagcaaaauaugcaggggccagagauagcugucuguuuccagaaguggguucucagcacauaaaagauggaagucucaucaugacauccuaacugauguugugaguucauguggacuccauaggccucuagagacuugauccuuggagaaucuguuguuauauuucaaaaccaucuccuaaggauaauuuugccgcauggugaauuugcuacauuucauuauuauuaccauuuacuugaaaauaauagccuuggaauuuggcugagguuuugaaaagaaaguuuugugauggcugcuccugugagagccaucccaaaacuuuuugacaaucuguuuugaagauguugcauuccacagaccaguaagaggaugacaggguugcaggaacauagaaguugggcauggaaaccugugccuccauccaguauuuggucaacagaagccagaggaugggagaguuugaagccagccugggcuacauagugagacccuguaucaaaaauaaauaaguaggaauagaucaucuauugugacuauuugaccucaucuaccuuaaauucacuaagaaucuuaugauauucaagcucaggguaauguauaagauuccaaaagguaauuguuuauuauuguaguucaguauuuaagagaagcagggucugcacaggagacacucacaggacgguagaauaagugauuuugcugucuuauaccaaaguuacaucagcucaugaggauuauuuccuccaguugcccaguuccuucaagcuaaacuaugaccucagucugacuuuuucugggcauguagagaaacacaugaguuacauaguugacuuguugugcuugggauugaacuuggugccuuggguaugcuagucaagugcucuaucauucagcuacacccucagcuuuggcuuuuaaaaagaagaaugugcauaccagacuaucuuaauauaaguacucacuaggaacaaauacugcuuuuguuuuucugccucaucugaaaugaacuucuuucaguguuuugaacauguagugcuuuugauucuugcugaaagauagaaaguaacagcagggugaagcuuggggucuggguguacaccagaucaagaagagccuugcccaugacuauagagcucauugguggagugcuugcuuaguauccccaaagcccuggauuauauuccuagcacugcauaaacugggcaucgugauacaaacaccugcagucccuagcacugguggcagaggcaggagaucgggaguucaaggccauccagaugcuacuggaauucaaagccagcugggaauacagaaggaggaaaugaaauggggcuuugcaugcccuuuauuuuuaacuuuauggaguuuaucccaauguccuuaacuucucucucaccuuuaaauggaauacuuucaaagcacaucucaaaauucagucuccaugagccauacaugcaaaucacucaugugauuuggugauguuugucuucuuaaugcucugcagcaccuaggacagugccuugcaaguuguagaaccacuauaaagauuuguuguguaagauucaagaguuaucauucuuuacaccuaagguacuugcuuuacuagaugauaaacauuguauauccuucuguauguuuucauucauauuuuagauuuggaaaauguuauuaaauuuauuauuauauaugaugggagugugggccugcugcacauguacaugacauggcucagugugcauauggaggucaggaggugggaggacaacuucugggagcuaguugguguucaggguauuguauuaaaaaauguauggugaaagauuuaagcauuaaguagagaaaauaucaugaacauaauuuuaaauauuuuaaagcaaaucuuacaucuucuguccuucacucauguuuuuuuuuuuucauuuuuuuauuagauauuuucuucauuuacauuucaaauguuaucccggaaguccccuauauguuuugggguuuuuccccuuuuuuguacuggaaucaagccacaaggccuugugcgugcuaguuaaguagucugcaaagcuacauccuccucuccaguguucuacauucuuaauuagguucuuaguugguuuucuuaaaagcauuuuuuucuauuacauuuuaucauuuacugggugugaguggcagggguggguggggugcaagugccacuguguacauauggaagucagaggacagccugugguugucaggcucucucagaugucuuggucuuugcaacaaguaacuuaacugcuaagccaucucuagagccucaguuaccuaguuuuaaaaagaaagaaaagaacgagggugggagugaccuuucaugucuuaaaaaauaaaacgcagagccgggcaugguggugcacgccuuuaaucccagcacucgggaggcagaggcaggcagauuucuaaguuugaggccagccuggucuacaaagugaguuccaggacagccagggcuacacagagaaacccugucucgaaaaaacaaaaaaacaaaaaacaaaacaaaaaacaaacaaacaaaaaaacugcagccucaguauguagcacuggcagcuagaacuugcuauguaaacuagguuggucuccagcuuacagagaucugucugccucuguuuaccuaaaaggcaugcaccaccaugcugagucaagaucuuuuuuagacugaguacauuauaaaagcuuaagucuuuguauuaucuaaugcuuagucucuuuagauuucccucuugucuccuguuaucagaauucagaggaauuccuuauuaaauccuccaauugucucaguaauauuuuguugguuuguucaaauuaagauccaacaugggauaagauaaauagaagauucuuuuuuuuuuuuuuuuugguuuuuuucgagauaguguuucucuguguagcccuggcuguccuggaacucacuuuguagaccaggcuggccucgaacucagaaaucugccugccucugccucccaagugcugggauuaaaggcgugcgccaccacugcccggcguaaauagaagauucuuaaucguguagguuaggguuucugagucugagcacuguaaaccuuugggacuuguuaugggauuuuuucccuauacauugcagggugguuacugaugucucuaacaauggugccaguagugcucucccuguuuugagagccagaaauguuuguagacauugugagcuacaccaccauaaguucuggagggaagagagagccgccuucuuugagaacuccugaucuauaucucuguuucuuguuuccuuuuucccccuacauuaugcccugaauuggaugaaaaaucugucauucuuucgaauaucagacauucugacucugcuucuaucuugauaauugugccauuuuauuuguugagucuucuauuuucuuuuuauaaauuagaauuuaacuccaaagcacuagacugaagauuaguugauguugacaaauguauagaguauagguguuacacuauacaagaucuuuauuugcacccaucgugagugccugguugucccacaguucuucugaugcugagcuugaucaauggauuuaggugggggcagucuggcucucacuguuggcuucucuugucagucuuguaucuuucuaguauuucucuagugacuuacucauugauggucuuuguaugacuaaaucauuucauuggaauuuucaguagugugauuguaaauccuuucugcaguuucuuccugacuuaguggauggaauuaugagaaaauucacuugugaacuagagcuauuugauugggaauacaguuaguacuggaaagaugggacaaauacuucacuauuuuccauuuauucucuagauacuugaguaaaacauugauaacuuaaugggauauucuuucuaaagaguuaguuuuucuguuuaagggguugaccaguuaaguguauaguagucuucucaaugaguugugguuuuauuucuuucauucuccaaauagcccauguaaaauguugacauugaguguagugcucagaaguguccuuuaagaugaagcacugugcuuaguacuguacauacgauggugagcagcauagcugugguucuuggugucagugacuuuauuuuaaugaggagaaauacaggaugccaugggauuggaaaauaugaaauauuacuagaauauaagaaacuagaaaagguagguuuaaaaaguuuuauuauuguuuauuuuggcuuuuugagacagugacucuaguagcccaguuugguauuaaacuuggugaguagcuaaggcugacccugaacuccagguccuuguguuuucucuuccugagaacuggaauuacagacauguacucucacacacacacacacaaauucacacacacacacacauacacacacuguuguucacaauucuuuguacacauuggaagugaaaaacagauagauaccuuuuaaaugauugacuacuguuaggagcuguauccuaauugaagaagccaccuuuauaaaauaauauuuagcuggcuugguggcauacccuuaucccaacaaucaggaguccggggcuauauagagcgguugaggccagcuugggcuacaugagacccugucucaaaacaaaaacaaaaauaacagaaaaggaaaaccguguguguguuugagagagagagaccaaaaacaaguucaagaagggucucugacagcacagguucuaaauaauagguauguauguaauagagaaagcuuuaaagacuauuuccaagacuguaguuagccauugagggauuuuaagaaggcaaaugugauacccugauugcuuuaguggugcgcagacagguuaggcuguaccacugcgcugcuccucccagccuagaugggcauuuaguuuuuuuuuuauuaauuuauacuuuaugcguauggguguuuuaccugcauguaaaucuguuugcuaccuguaugcuaaucacuuguggagcuaagaggguguuagaucugcuguaaccuggaguuacagauguuuuugagccaucacgugggugcugggaaccaaaaaccugggucuaaugcaaaagcagccagugcguuuuguuuuguuuuguuuuguuuuuuuguuuuguuuuugagacaggguuucucuguauagccuuggcuguccuggaacucacucuguagaccaggcuggccuggaacucagaaguccccaugccucugccucccaagugcugggauuaaaggcgugcgcuaacacugucuggcagagccagugcuuuuaaccacugaguuaucacucuagcucugacaguuagaaagauugauuuuuauuuuauuuuauuuuauuuuauaccauauguauacacugccuauagaggccagaagugggugucagaaucuucggaacuggaguuauccacaguuguuagcuauaaugugagugcugggaaccaaaccuagguccucucuaaguauagcagguccucuuaacuuucuucagccccuggauuggcauuuuugaaagcuugcccugcuuuugguguggagagugaaauuaaaaagcaaaagaaugauuuaggauaaauacuuguuaguaauuuaggcaagaaaacuggggguuugggcauggaugguauuaguggagauguaaagagguaaaaagacagaagagaugucuccugcuagaauccauccaguuggauagucauggcaagggaggcaucaaggauuggugggcuugggggugggcucuuaauagcguucucacgcccggccaggaagaacacaacagaccagaaucuucugcggcaaaacuuuauugcuuacaucuucaggagcuaggagcgcaaaaaccgcagccccaaaagcgaaagccaccccuucuuacaucuuuaggagccagagcuccggcgcgccaaagugcagagcgcgcucuauuguuuacaucuuuaggcagcgagagagcgcagggcgcgcagagccagcgagaugccagcgagagcgaauggcggaaaacccguccccuuuuuuaggagcguuauauuucgccuaggacgcaucacucccugauuggcugcagcccauggccgagcugacguucacgggaaaggcagaguacaaguagucguaaaauacccuuggcacaugcgcagauuauuuguuuaccacuuagaacacaggaugucagcgccaucuugugacggcgaaugugggggcggcucccaacagugggcuccugggugauuaauaauaccacuuaauaaaauacaaaaccuagaggacgagaaggaagaaaaggcuuagggaugcuguggaaaauaggaguuaagcuuuauguauacuuagcuugagauccuugggcauaaauuccaaauggagcuauccauguagaaguuagauucagacauagagucuagaagcaagaucuugugaauugucaguauaaaacauacauauacaauauguucuaagacauauuaauagauaagcucuucgggggggugguguaugagauaagaguggaggcuacaagaccuguggcuagccucagaaucaccaguccaaauaaccaguggagaaaaggccaacauuagaaggauggaaaaugaaagcagagcagggcuacagauugugaagggaagauacuucuggagcaaggaguagccagcugugucaaguacuacuaaucggucaagcaagauaaggauucugaguuaucuuucccccuuacugacauagagauuauuguugaccuuggcaggagcaguucauagugacugaagccauauugcauugauuugaggagugauggaaggugaggauggggauggugaguauagaguaugcuuuuaagaaguuuuuaacugaaagggagcaagagagaaugagggcaggaacuggagaaagaggaaguaaaggaauauucuuuuuaaaaauggaaacuaaauauaccuggugaccuuaguucuuaaaggagaaugugaaucuuaaugauauuaaaaguagucauuuuaaaccaauuucaaaaguagauguuugauugauaaggcagguuuucuuccaucauuuaagaucuacaaagaauacagacauuauuacagguguugguaauaaccuagauggggaugguaacuuugcaauauucaucuuuaaaauagugcacacagacacacuuuauaacauucccuuucuugcaaaaucauguaguccuugguuuuagguaguuagugcugccugaauaaauuagcaucuuuauggguaacaauauuuguggcaaauaguucuagaguucucaaugucucagaccccuuuauucaguuucucuguguugaauggugguagugguggcaacagagugugugcacuugugugcacauacuguggaggcuagagguugauguuggauaucuucuucaguuguucuccaccauauaaauauagacacgggaucucuuacugaucuagaacucugauuuggcuagucuagcuagcuagcuuguucuuuuuuuccccaagugugggauuacaggcaaaacaccaugcccauacacauuuacacaggagcugggaaucaaacccaggucuuuguguuuucacggcaaguucuugaccugcugaaccaucucucuggcucccagucggucucuuaaaguaacguaugcuacccuuuccucuuuuuauaaaccaacaucccauaagacaugaaauuaucuuauauucugggguguucagaagaacuggcucccagucuauuguuaaccaguccaaacuugacuuuaccucgaggucacugaggacauuucuaauggcauccuuguucauuguugagcuucggaaacauacugacgccuaagacugaaguaguuguguuucucacuuacuggguuuauaauaauagaaagugaccuacuaaaacauacucugagucaacagcuacuuaaacccuaacagagcuuauauacuggauuugaucuaagauaaagaugaagagguaagaagagguuguguuuagauucaagaaucuagaccugugucauaggcagauggcuuaguagauaaaacaugauggucagauccgugugaaagccagugugguagacaccacuaaucccaacauacugaggaguagaaacaagauccccagggccuaccagacacucaaccagacgaggcuuagcagaauuggcuugcuucagguucagugagagacugguuuuuuaagauuuauguauuuauuuuauguauaugaguacaccauugcucucuucagacacaccagaagagggcaucagaucccauuacagaugauugugagccaccaugugguugugggauuugaacucaggaccucuggaagagcagucagugcucuuaaccaccaagccaucucuucagcucuagagauucugguuuuguuuuguuuuuguuuuuguuuuuaaaugaaguguagaaaaauugaguaagauauuuaauauacuucugggugucauacauaguacauacaucuucaucuauaucuguucaucuuuguagccauuaucuuuuaacuugugaaagagcuggugucuuugucuuuuagugaugcuuuaagcaacugaaacagcuacacauggcagcccuggcuccaaugccaguauuggcagacaagcaaguguuugaggccaauuucucaccaauaaaaaugaagccuugguuucacuugcuuugcuuuuucauaucuuuguucuucuuuuuuugggagaggggguuguucguuuguuguuuuguuuuguuuuguuuuuuguuuuucaagacaggguuucucuguauagcccuggcuguccuggaccaggcuggccucgaacucagaaauccaccugccucugccuuccgagugcugggauuaaaggcgugcgccaccacgcccggcuucuuuguucuuuuaaaaaauauuauuuuauguauaugaguguuuuugcuguauguauaucugaaccauggcaugccugaugcucauagaggacagaaguggguaucaaaucccuuggaacuggauuauaggugguugugagccaccauguggguacugggaacuuaaucccaggaagagaaacugucacucuuaaucacucaguaauaucccuagcccuuagccccaacauguaccccauuggaggcaaauucuccauguagaccugguuagccuuuaacuggcuauuaagcuuagaaugaugacuuugaacuuauggccuuuuuaaaaauuuuaaaaaauugugugggugugucuugugugugugugugugucugugugugguucauguggaaggugaaagacaauguucuagauucaguucucuccuuuguuuauauguagguuccuggaaucacuaggcuuuugcucagcaagcaccuuuacccuauuugcugucucauaaccuugaacuuuacuaucuucugccucugcuuccugagugccaacauccuaggcaugugauaccuugcuugguuuuauuucaugcugggaaaagaacucaggaauuagugcauacuuggcaagcagauacucuaucaacugaugagcugcauuaucagucccugacuuaguuuuuuaaggugaaugauguaucuauugauauuuucaauauauucuuugguuuuucaagucaggguuucucuguauagccuuggcuauccuggagcucacucuguagaccuaucugacuucaaacucagagauuagacugcccccacgugcuaggauuaaaggcaugugcuaccacugucuugcuuacuauuuuguuaaaguaguaaaggaaguugaauucuuuuuucuuuuguuuuucuaagaucgggauucuuauagcugagucugauaaugaacuuacuguguaguugcuucuaccaagugcauauggugccaugccuggcugaaaaaauguuuuaauauuucauuauugcugacuuuuaauuucuuuuauuuuuuauuauuacuauguuuguuuuuuuuuuuaguaguaguacuauuuuuuugagacaggguuucacuaauguagcuuugacugaccucgaguaggguauauagaccagaauggucuggaacucagagauaugccugucccuguuucccaaacuucaggguuaaagaugugugccaccacacacuuuuuucuaauuugaguaguaaaaguaauauuguucugggaacugaugauuauauguaugauaauaagagccaaaacaauuaguaagauaaaauuuauucuugccaauaaauuagaaagguuuuaggucaaaauaaguggcuuuugguggucaguaucauuuauugauauccuguuaugugauuuagcacuuuccuaaaguuacaagacuagaucacaauagcagaggaugagcuguggcaugguggccgcaccuucaaucccaguaagucaucauagcagaggcaggcuacauaguugcacccuaucucaaaaaugucuuuaaucaaagaaaauuacacuguguaagugaacaaauaacaaaucagucuaguugggaaaaaaauguaucuauuaaguauauuuuauacaucucuuugcacacagaaaauuaggagagauuauaaaauaaaauauuaacaauguaggaacuguucacccaagaucaaaauuggguuagaaaguguggccaggugugguggcgcacaccuuuaguccuagcacugugaagcaggagcaggugagucucugucugaguuugaggccaggcuguucuauagagcuaguuucaggacagccagaacuauguagagacccuuccucaaaaagccaaaaauaaauaguuaaaaagugagcauguaaaauuaacccuuuugacaucagcggaaugugguaguguacaccuuaaucucaguacucaguaauaaucagagauagguagaucuuugaguucaaagcuaaccaggucuacacaggaaguugcaggacagccaagauuacauagugaguuccuaucugaaaacaacuaauugggagugggacauucugauucaaucuagauuaacaagauuauaacaauaaauaaauuguuuuaaauagauuuuuguaaauuaaaauuauaucuugagcuuuagaaagaacaaagaauaaaauguagagugagguuuuuuuuccuccuuuguuuuuuuuuuuuuuuaaagacuuauuuauuuauuauauguaaauacacuguagcugucuucagacacaccagaagagggagucagaucuuguuacggaugguugugagccaccaugugguugcugggauuugaacucuggaccuucggaagaacagucaggugcucuuacccacugagccaucucaccagccccuuuuccuccuuugugauaggagucuguguaucaccaacuggccuagaacuugauauguagaccucacuccccucaaacucacaaauucuuauaccucugaaucagaaaugcuggaauuaaaggcauauuuuuguguauacaccacacccugcuagguuggguuucaauccugugugcauacaaauauuuuuaaaauuuauuuuauuuauguauuuaguuaguuuuugguuuuucaagacaggguuucucuuuuuaacucuugcuguccuggaacucacuuuguagaccacuugccucugccuuccugguguugggauuaaaggugugcaauaccauugauauuagaccuuuguuguaagaaaaauucagaugaaucuaagcuucuaaucauaucuuccucaacauauaacauguuuccccucuaaaaccacuuuauuuuuuagauauuguuaauucauuaguauuuagcucuugguagacaguaaugcuuucuuuuuuuuuuuaagauuuuuuuuuuguuguuguuguuuuguuuuucgagacagaguuucuuuguauagcccuggcuguccuggaacucacuuuguagaccaggcuggccuugaacucagaaauccgacugccucugccuccggagugcugggauuaaaggcgugcuccaccacucccugcgacaguaaugcuuucuugaaugaaguuuauggaacauauauuuucuuguaagggcaaucacagccugcuuagggauacucgacagcauuaagcauuauuacugggcagccuuguacuuuuguuuauuuacuucuuguuuguugauuuuugaggcagguucucacuguagaccagaugacuggucugccugccaacauuccugagugauugggugugugugugugugugugugugugugugagugaugacauuuuaaauaacuagcaaaacauuguuggauuuuguggcaguaacugcacuaugagaugacaguguggccagaaggcuacaccaccuuguucucccucagcugggaacacaccuaguaggcugcucagaacuuucacuguucuucaucuguuuauaaaaugacuggaaaagcuuagcaaguccuguuaguggaguuggaaauaaauuuuagcagaugagcaaauucacauauauagugucuacaaauaaugagaauugauauuauuuuuuucuauuucuguguguaucugcauggaugcaaaggcacuuggaggcaaaggguugguugauacuggguugucuaucuucaguuucuuuuucuuuuuuuuuuuuuuuuuuuuuuuugguacagggucucacugcacgucaaguagggaauuuuaguuagacugauuugccagugagcuuccagggauccuccuguuguaggacauuugaucacacugugaacccggagaguguguuauuuacuggaaaaaccuguuuuuaguugugugucucugcuuuugcacaugucuuuaauccaagaguuuucugcuugaauauuguaaacagaucaacagaucaagcaaccaggugacaggaagugaacauagggaaaaaaaaccauagagaguaagagucagagaugcaaaggagauagaagugagggacacucaguuugagcugggucagcugaggaaggucagcuuguucugccucucugagcuggcaggcuuucacccuagcaucuggcuccugagucuucauugguaaaauaaaacgauugagauuuuguuuaaagaauaguauccuucugacucugccuucuggcauuuaggcugcagaccggcacugcagugccugucucuuuuguggguucuggaaauugaagcucagguccucauuuugcauaguaaacauuucauccuuaacuaccuucguaguuugguuguguuuaguuugacagacuggucucauacucagaucaaucugacacauacccucuuauaagucuuuaagguuuaugcucccacacccaccccucagaaacguaaauuuacuuauuuaauuugguauaugucagugauuuaccuguauauauguauguauacuacaugcaugccuggugucaaaggagguaagaauagggcauuggauucccuggagcuggaguuaaagaugguugugagccaccauguggguacuaggaacugaacccaguucucuuacugcugacucauuauuuuucaaccagaaacuuuuuugguuuuguuuguuguuuuuuugguuuuguuuuuuguuuguuuguuuggguuuuuuuuuuuuuuugaggcagaguuucucuguauaacaacccuggauauccuggaauucauuuuguagaccaggcuaccaugugugucaucacgccuggcucagaaacauuuuguuuguuuguuuuuuugagacaggguuucucuguauagcccuggcuguccuggaacucacuuuguagaccaggcuggccuugaacucagaaauccgccugccucugccucccgagugcugggauuaaaggugugcgccacuacacccggucagaaacauuuuuuaaaaaguguuauggaucuggagagaugguucauugguaagagcgcugacuguucuuccagagguccugagcucaguucccagcaaccacaugguggcucacaaccaucuguaaugggauccaaugaugcccucuucuggugugucugaagacagcuauaguguguguguguguguguguguauaaauaaauauauauauauauacaucuuauauauauauauauuuuuuaaacuguuauguuagcuggguauaauaacaggcuuauaauugcagcugcucaggagacugaagcugcuggagcuacaggcgaaguucaaagccaaucuggacaauauauugggauucugucuaaaagauuaagaggagaucugucucuguaguugguagugaaaaacuugccugcacuacacaaaaccaucaacucaauccuuagcacugucuuaguuaggguuuuacugcugugaacagauaccauggccaaggcaacucuuuuuuguuuguuuguuuguuuuuguuuuucgagacaggguuucucuguguagcccuggcuguccuagaacucacucuguagaccaggcuagccuugaauucagagguucaguccauuaucaucaaagcaggaaugugguaucauccaggcagucaugguacaggagaagcugagaguucuacgucuuuaucugaagguagcuagcagaauacuggcucccaggcagcuagaacaaggauauuaaagcccacacccacaaggccacacccauuccgauaaggccacaccucccaacagugcuacucccugggccaagcauauacaaaucaucacaaauacugaagggaaaaaaccagaaauauguucaauuaugauguaugguuuaauuuaaauuuauaaauuugagaaaacuuaaaaccuucucugucuugcuaacuuaucuuucucuguccagcuuuguuuuuuucuuucauuagauacaugaauguauauaaaugugacucugucagcaccagcugcagagauaugugauuauuaauuaacauucuuaaaaaugaaucaaagaaaugggucaggaaggaaggcguuuauugucaugccugaugaccugaguugugucccuuggagcucacauggcaggagagaaccaucuccugaaagcuguaccuggccuccccuccgcacacugcaugguuucgccuauaaacacacuuacauacggaauaaauaaaauaaaauucuuaaaaaugcuuuguauuguaggagcaacaacaauauugguaucgacagcaucuacuuaguuugcagcagaggacaaaggugcauuugccgggacauaaaaagggucuugucacagcaaaggauguaccagaacccaucaaagaagaagcuccggggccagcugccagucagguagcagaaccucuugcagcugagaagcccccauugccaccucccaaugaagaagcaccaccuccgcucucaccugaggaaccccagguaaucauuuuguguuuauucagucauguaaauuuuguaaacacuugugucaagaauggauguauauuuucaugugcucagguaccuguaaaauucuacuuuugaaguacccagaugucagcuuaucagguuuagcaaaggaauuaugugaagguugacugaaaaugaagcaauaagauacucuugucucagcacaaaagagaaauguucaugcggguucaugaccacaguacagagaagucauuuauccuuagcuuuuauggucaguugcccaaacacugcgacucuggacagauuagcuaaucauucucuacuaguguacucaucugaagaauggacauagucauuuauaauagccgucuuacaguguugaagcaucacaaaugaccaucuucgucacauugagcuuguugacugaagcuuggaaacuccccacauucucacagcuuugcugagcuauauaucguagaccacuagugaacagugacagggagagagagggcaagagaaggaaggcauggagguucucuacugcucauuggguugaaaguacuagacuuguagauuuacuuccugcuggggaaaugguuauccuaucuagugaagaugguggcucuuaaaccccuuguccuaccauccacaauaacuauguagagggggauuuguguuuugucuaaauauaggagagcaguucucagccugaguuggagggauucuaggcccgauugauuugguugcuguuuuaugacuuagaaaaguuuguguuucucuuauuuagucagaagacucagaagacucggaagacucugaggaggaugcuagauuuaaacaguugaaggcuauagcagcacauuggcaggcugcagcagcacauuggcaacagcagcagcagcagcgagucggcuuccaguaucaaggaauaaugcagaggcacacacaguuacagcagauccugcagcaguaccagcaaguuauccagcacucaccacacauacagguaaguguuuccaaaauaaguaagcaggaaguauucccaagaugcauaaaggauuugucgcuccuaaaagacuugugaguaugaacaacuagcaauaaaggaaguauugacugugggggcuggagagauggcucagcgguuaagagcauugacugcucuuccagagguccugaguucaauucccagcaaccauaugguggcucacaaccaucuguaaugggauccgaugccuucuucuggugugucugaagacagugacaguguacucgcauacaugaaauaaauaaauaaaucuuuaaaaaauuaaguauugacaaguagcuguuugaaaggauauuagaguaaugugauguuguuuagcccaagggaagaaaaagaucaucacuaaaagggucuagcaguuuuaucuuuccccuuggaaauguuuuuuaacuuccuaaaauuucauguagucuugacuuauuaauguaaguugggacuaaugcauacauggcugucuugaaagaauguuuguccuuuauuuguagaccaugucucuggaugugcagcugcgacauuaugagaugcagcagcaacaguuucaacaucucuuucaagacugggagcgagaguuucagcugugggaggagcagcuccauuccuauccucauaaagaucagcuucaggaguaugagaagcaguggaagacauggcagggacauaugaaagccacucagaccuaucuccaggagaaagucaacucguuccagacugugaagagccaguaccuggggaacauggcaaugccaccuccguuuguuccguauucucagaugccuccaccucugccaacaaugccaccuccaguauuaccuccauccuugccaccaccagugaugcccccugcccugccuaccuccaucccaccaccuggcaugccuccgccugugaugccaccuucucugccaaccucuguccccccaccaggaaugccuccaucucuuucuucagggccaccuccaguucucccuccaccugcccucucuucagcagggucaccaccaguccuucccccaccggcucuaccugggggaccacccauccuaccccucccaccauuaucuucagccacaccucccccaggaauaccucccccuggagcuccacaagggaugccuccucaguuaacagccccacuuccaccagcuucugguucucagaacucacagaucccagagaaaccuagacaagcacugcuucccacaccugugucuuuuggaucgaccccaccuucaccauaucacccuccaccucagucagaacaagugaauuccaaaccucugaacaagguguucucaucugagcaaggacugggcgagucuucugcucuaucucaguccaucauugcagcuaaggacacgccagugaagucagguggacugcuugcagacccuccuaagggcaguuucuuggaagguccgagagguccaagguaggucaaugcucuuacuguggccaauuuuauauaagcuguacuggaauccaaacauuauacaguuuuuguauuuccuuuguacuuuuauguauacacucaugacuuuacaguuaaaauguuaguauuauuuguuaauuuaaccugacauaacuuagaaaagauugcauacuccuguuccuuuaaugugacuacuuuuaucuggcuauaguagucuagaaugaauguauuuuagaguaaugcugaccacuuuuacugacuuugcaguuuuagaaauaauauuuuaagccaaauauaauggcacauuuguaauaccagcacuuggaaagcagaggcaggagggaauuaggauuucaaggauuauccugagcuauauguaaagucaagcccaggcuuagccuaggcuauaugaccugcugucucauauaacagaaaggauaagucagagacagaaagagugggaauaauacuuuaaauuuaacuguuuuucuuuuugauuguuugacaauugaauuagcaaguaucauuugcuaggcuuguauaaggguaaauaggaccuuuuagaaaaucauuuguuuguacagauuccacaugucuuagggguuuacugcugugaauagacaccaugaccaaggcaacucuugaaaggacaacauuuaauuggggcuggcuuaaagguucagagcuucaguccauuaucaucaaggcaggaacauggcaacauccaggcaggcauggugcaggaggagcugagaguucuacaucuucauuugaaggcuguuagcugacuuucuggcggcuaaggccacaccucccaacagugccacucccuaggccaagcauauacaaaccauccuaccaaguuccugcuuuuacucaaaauagucaacaaaagaaaagucacaaaaucccugccacccuuccaccugugccccugggaccuugcauccuuuauauuuuccuuagggagaugucugucuuuucuuuaggaguggaggagggaaauauauauauauguauguauauauguauguguauauauguauguuagaaaagaaaaaaaucaugguugcuguuuuguuuuccuuuaaaaaaaaaagcauuaaaugcagugggcagugguggugcacaccuuuaaucccagcacuugggaggcagaggcaggcggauuucugaguuaaaggccagccuggucuacagagugaguuccaggacagccagggcuacacagagaaacccugucucaaaaaacaaacaaacauuaaauucagcaaggaauggucuuguaugcuugcaaaccuaguauucaagaggcugagccaugagcuugggaaaaguuccugcuacugugugugaugaccugaguucugucucuaaaacccacaugcugggcagagagaacugucuccugucaguuguccucugggcaccauaugggacaaggaggaugugugcccacauacauacagaguguaauuuuuaaaaaguacacuauacguaguaaggcaagcuuggucugcauaucaagucuuucgcaaaagaaauauguaagauucauguuuccaagcuuagaagagucuagcuuucucuugggaugacauaaaugucaaguuuucuaaggaaaauuuuauuuugcuuugaggcaaggucuugcuaaauaacucugacugaccuggaacuugcuauguagaccaaguugguuuugaucuaucugccucugcuuccccuguucugggauaaaagguguccaccaccacaucuagcuggaaaaauauuuuaauugguuuuuuccccccuggucagaaguuauaguagaaagaaauauauauauuuauaaaauuuaguucuauuauugagagauuuaaaauaucauauacaggauuauacugaaaguuauauaauuucguuuuugucaguuauuuguauauuaguuucugguuucagugucagugcauugaggucauuuuaaauuuaaaccuuuaauauuugaaaacaaaagcauauggucuggguauguggcucagcuugugggaugcuucccuggccuuugcaaagcccugcguuugauccugccaccacguuaccugaguggguuggugcaugcuuauuuucccaacaguuaggaaggagagguaggaggcucacaaguccaagccuaguccuuggcuauagaguaaguuugaagacagccuggacuauaggagacccugucucuaaaggaaaaaaaaaauguaucuuuuuuguuuguuuccccaauuuaaaguucuggaacuaacaugaucaaaacuccauucaaagcugaagcucagaaaaaauuaaguguaauuagucugaauuccucuguguacucuggagccauguuagaaccuucauauccauuuuuggggagucuugugaauaaucugugguacuaggugauuuauuuccuauuaccaucuaccgucuggagcggagaagagagcuaacuugcuagaucaguguugcgugacugggacauagaaccaaggcacuacccaaagcaaacuacuuuaagcccugugugaaugccgucauucagauucacgcaguucugacuacaguugugcuguucgcucauuugcaauauagcucauccuguugauuugaacgcaugucugucucaaggagcaagcuuugccuuuuagcaacugguuaucagagacaugcagucuuaccaccucaaaguguguuuccaccucccaugaugccucucauacuguuuuccucuuuugacuaucaaauauaggaccuauuuuaaguucuucccucaaagguacaauuaauaaccguagugcuaaggaauuuuaggaauuaccuauuguagucccucucuggcagcccagguuuauguuguauuuuagcuugcugugccaggucuuguguacaucaccuuauuauauaagucaucucuaaaugacucugugacuguaaagaagguaaagaauuuagcugaaacuugggcugaauauaagugaaauaccagggucaaugagaagguguuuggugguaaaggugauugccagagugugacccuagaaccuacauacugguuggcacagguuguccuugaccuccacaugcaugcugugacucacauguaccugcacacauacagacaaacacaaauaagugauaaaauguauaaaaaucuuaaaaauaauaaguugugccagacuauuauucuaauugagaugagauuggaaucacagccuucugauccucuuuuaaguucauuguauuuuuuaugacaagagguugaugggcugugcuuaaauauuggcauguaaauaaaggaacauugucuuuuaaaacuuuugaguguuuuagaaaggauuuuaaacauuaaaucuaaguauauuaauauaaugucuaucuguucuagaucugccacuguggaacaacacagaguguguuauuuuauucuuuucuacagaauauuauuacagauacuaaaaacuguucuuuuaucucacugccuuaacuuacuuguucuuucugccagccauauaaacgcaaauucuuuucacauucucaaugguucuaguuuuuccugcuuccuuuuuaggagcugguguuuuguuggucuccuucacgaugaacacuuacucagggccugaaguaucauuggccuguuuacagccuaauucuacauaaugcaaauauacauuuuaaggauuuacuuuauguguuauuuauuaauuuauuuaaauuuauaugcauauuaacaugcacacaggugcccaaggacgccagaagaagguauuggaucuucuaaagcuagaguugcauguaucuguuagccaccugauauaugugcugagaaucaaacuccgauccuaucaauugcaacauuuuuuuuuucuuuuuuugaucaguuugauuuauuggugucauuucuugagccagagauacagccuugcuacuuagcucaggucgaccuggaacucauuguguagccuagaguaguugcaaacucucaauccuccugcuucagccuccuccgugcuagggugguagcaugcaucacuaugcuguaacuuugauaagguucagugcuaaggugguagcaugcaucacuaugcuguaacuuugauaagguuggguuuuuagcccuaaaauugaauucugcuuaugcugucuuucuccagcauuaguuugucuccuucccauuucugcccaucuuccuuuacuuauguuuugcaagacaagguuucuuuguguaacccugccuaucauggaacuugcuuuguaaaccaggcuggccucaaacucaaaagaguucugccugcuccugaaugcugggauuaaauuugugggccccucauacggcucuuaagaaacaaguuaaugacuguuacucagaaacaucuuuuuucuccuauauaacugaguuaaaagcaaaaucaacacgaggcugauuagucaagagauuaaguuagaacaaucuauacucuuaaggaaaccgaacuucuuuuauguuuuuucaaguucuguuaugaaugcauaagggauaucuguaagccacacuggaaaaaaaauguccuaaaacaaaacugauagaaagacaagaacugagaauggaguuaaacugauugacuaaaaccacaguaguagaauauuuaucuguucuguuaaaugcauuaaggaauugcagaaguucagauugaggcagcuuucuagacucugaagguuucucaaagucaagugacaaaagcauaucacaguauauguuguugaacacgguguguguguguguguguuuucucuucauugguucuuguggacgaaguauccuuguguuugucugcucucacauaagugaauuugaauuccccagaacuuguauuuuucaguaaugaaacuuugucuugauaauaaauguagaaaaguaccagguuguuacacacagcauuaugaauuuucacaaagacacaacucauaucaucacuacucagaucaagaaauaaaaauuacuaguguuuaaauagucuuccucagugggcuaaagagauagcucaggaguuaagagcuuuuguugaucuugcagaggaccuggguucaauucccaaaacucauggugguucacaaccauccuuaacuccaguuccaggugauccaaugcccacuccugacuucugugagcacaaagcguauugguauacaaauaugcaugcaggcaaaacaaacauaaaaaaguccuccucaucccccuucuuagucauuucuccucaacccaaagauuaccacuauacuaacuuuuauaccaugggcugccuauuuuuugagcaauaggaucauauuuuacauacuucuuugauaugguauauuuugcuuaauauuauaaugugagauuaugucaugcauaacauucuuauugcuggggaguaguccauuaauaugauuuuauuauaaccuguucuaauauuaauuaucaguuaugauuaaaaauguugaaaugucaaguguaucuguauaucuguuuguuuuauguacaugaauaugcacuuguugcagcccgauguagaggucagagaacaacuuguaggaguugguucucucucuccuucuaccguagggaucccaggauggcaccuaggccaugaggcuuggcagcaggugccuuuaccaacugagccaucucauuggccugcaguaugucuuuuggugccgacuauaucuugacugugccugaguguacgcaugugcuuuuguucagauauuuuguauguguaguuguagccacgcucuguguacauucugaguuugucauuuucauaugacuguugcuaucagauucauccugugcuuugcaaguguugcaguaguuuguucuuucuuguucccauacaguuugccauuguguggacauaccacaauuuaaaaggauugcaauuguuuggacauaggaucuggucuguaugugcucugugcugguacauauuguuaaaugguuuuucagaaaggugcuuuuacuuuauucaacaguauuauuucagaguuuuuguuuuguuuauuauuuuuuaacuuccaugacaacucuuaguauuguuaaacuuacaaaauguuagcugccugggaggaugguuaauguuauagugauaaaaguuggaauuuuguauuuuuugauaauaguaaaguuacacugcuuuccauucgguuaucgcuggguuaaguuuccucuuguaugaaacacuaauucaagguuguuuuuuuuuuuuuuaauuagacuauuuuucuauuucuuacugauauauagaaauucuuuauauauucugggaaccaguucuuaauuauauguauuacagguuucucagucuguagcgcuuacuuacuuuaaccccggguauagaagaaaaggugucauuguugacuguauggguucaggggaccacuuuuaguuuaaauuuuacaaaagaauuuaaaaggauugugaaaaacaauuuugaaguuuuaauaaguguuuuuaagaguaaauuugcuuuguaucaaauaguuugacauauaaaaucauaaaagauaauugucauuguauccuuuuagagagucaagaugguccaaauucuuuccacacaauaugcauuaaaagucuuuccuguuuaaugacuaagagguggcaguacugcaugccuuccauugaucagaauguauugcuauuuaaaggaaggggguugggcuggagaaaugacucagcaguaagaguaauggcuacucuuccagaggaccuggguucaauuccagcacccgcauggcagcucacagcugauccagagauuaagcauucucuuugacaugcaugaaaacaaaauacccauacauaauaaguagaauuuauuguuugcuuauugauucuugagcuugagaauguucaucuagaauauaaucaccugaagauucaugguuggcagguucacauacaugaugaauuggauaugacuuuuagagccuggaauucuagccucucugcacauaucuuuugauucuaauaauuuuuaaauuuuuuaaaaauaauuuuaaaaauuaaauaauuuuuaaauuuuuaaauaauuaaaaaauaauaauuuuguguauugugguguuuugauaacauguaugucugggucccaugugcgugccugguguugauagaggccagaagaggguauuagacucucuguaacuuggguuacagaugguugugaaccacauaggugcuggcaaucuaaggcaggucuucuggaagagcucuuaacuacugagccaucucuccagcucccaaguuguagugaauugaagcagcuuuaucugucagcuuucuucucuuuauuacuacaauaaagaaaugaaaguuuugaguuugcauugugcuuaaugaagccccaaaacagugugcuauuuuggguaauucuaaugugauaauguuucuuuuaucuuuguuucauucucuucgaugauucuuuuuguguuguaauuguuuccuuauuuugguuuuuuaaagcauaauuaagaaauauuaauguuaugagcaaucaaaucuaggauaaggaaauuaugaaguguuucaggauauagggggaaaucacuaagaucucaguuuuuguaaguuuaagaaugaauccaaaugauaguugcaagauaauauacacauuacucuuauuuuuuucuuacauguauuguaucuguguguggaaauugggucuuuccuuccacgagagucccgaggauagcacacagucuugguggcaagcacauuuaccuacugagcuguuucacuggccuuuuucugauuuuuaaaaccuaaaauuuuuguuuguuuauaaguuagaccuacaaggaaaacuguuaaugaaguuugguuuuauauauagcuagagcuauuaagaauuuuucuaaaacuaaaacuguacaugaggaaacacuaaggguuaaugauauccuuuugggggggguccaccuuuuauuuuguaugucuguauguuuugccugcauguguauguacuacauggugcaugguguuuuuauuugcaggaaggaggauugagugaaggucucucuguguaucccuggcuggccuggaacucuauuguagaucaggcuggccucaaacucagugaucaaccugccugugucuuucaagugcuaggauuuaaaggcaugugcugucagaccugcuaugccuggugcucuaagaguucagaagaugaugucagaucuucuagaacuagaguuauggguggucaugagcuacuguauguguucugauaacugaucccagguccuuugcaaaagcaucaaguucucuuaaccacagagucaucucucuagcccagugguucucaaccuuccuaaugcuuugaccauuuaauacaguuccuuguguuguggugacacacagccucccccccaccccccggccccccugcccuagccauaacauuauuucauugcuacuuuauaccuguaauuuugcuacuguuaugaauuguaaauaucugauauacaggauaucaaaagggguuuugacccacaaguugaaaaccacugcucuaguuccuguggcuauaccacuguuaauuguucaugguuugauaaguaacucuaugcuccaaacagcccuaaguaaacuuaguggaaugcaaacauggauaugaaggaagggguaauuguuggaaagaaaggguucauucuaaggaguugggaaaaagaaaguaaugggagguguauguggucaaaauacuuaauacauauuugaaaaaaaauuuuuuaaguuguaaguucuuuaaaaagguucaugucccaucguugguaaucuccuaagcaucuaguaguugagcagaguuuccucacugggccauucaggucugaauuugaacugaguuuagcaaacagauauuuuggguuggguugguuugguuugguuuuuuaaaagauuuuuuugaauacacuguugcugucuucagccacaccagaagagggcaucggaucccauuacagaugauugugaaccaccaugugguuguugggaauugaacucaggaccuuuggaagaacagucagugcuccuaacugcugagccaucucuccagcccuagcaaacagguuuuaucagugcugucucagugcaauguucaacacuuccaauuauuuucauugccacugauuuguuccccuuaaugucacaugaaaaccacucugaaaugugugcccaguccaacuuaagauggugugccaucuccuggugaguaaauuuugauuuuuauaagaugauaaucuccagcacagaaugauuggcucuuccuacucugagcagucccucuaguguggggaguagaacucagugcuaaguugcagguuuucucugggcuuuguccucuuaggccuuguucuuccaggcggggauacaagaccauuaaucauacacgugaguggcuucuugcaccuuuuauuuugggaagcugaauaaacauuuuaacuccuucuuccccccacaucucaggcacuguagaauccugacugguuuggauucugcgggcagccagucacauuuuuauuuuauccucuccugcugccaguacaguucuucugaaaauugcugcuuguaauuuuuuguuguuguccuuugucuuccagaauuuacaaacaagggccaagguuauagcacaguuggcagaguauuucucuggcauauagaggcuuuuguugaucuucaacaacuccacaaacuggaaugguggacuaugcuuguauauaauccccauaccagggagauagaggcaggaggaucaaaaguuauccuuggguacauaaggaguuuaaagccagccuggacuagagacucugucuauaaagacaaaauuuuaaagauaacucaaaccaaagauucuggucuacugccuucucuuuauuguggguuuauauauauauucugcuuucuugugauagguuugaaaaguaucagccagguaggcuaaacuucauuaucagauucuuucccauauguuucugauugcacuuguuccuagggagauuuuuauaccuaguaugauaacuagacaaccaaaagcacuuuaauccuuuccccugaaaagaaguguuggcaccauuccauauuaguguugacucccauuccauauccauagucccuuuacccucagcaggaaccucagcugagccugauauuuuuguuggcccauagagucaaggucucuguauuauuguuguuguuguuguuaucaucauuauuauuuguauguaugugugugcauagaggauuccuugggaguggaauuauggguggcagugagcuaccugacaugggugcugggaauuaacucuggucuucuguaagagcagcugucacucuuaacugcuaagccaucugccaagccuauuuuguuuuauuuugugggugugucucuauaugguaugugaugcauauguagauguacaugugugaguguauguguggaagcuagaaauugacauuggaugucucucuuucauaagcuauguuuacugagacuagaucuaucgaugaagucaaaguuggcuaaauuagcuaagcaguuaguuuguccgaguggucccugacuaccuccuguacacaaguaagcugucccauucacucaucauuguuuguuuguuuuuauguguauggcuguuugcuuacauauauguaugcuguaugaguaccucgugcuugccuguuaccugcagaggucagaagaagcuaucagauucugggacuggaguuauagguaguugugagccacugugugggugcuggaauccgaacccagguccuuugcagggccgugauuccagcucuccauccaguuuguauguggggcuggaacgcacaacuccagucuucacccuugcaccacaagccuuuuauccauugagcccuaucuacagcaccuccguuuaauugucaggcauggaaguagugagggcugucuugaaucucuugcacuucagcucauguggcucaguguccucccagaaguuaggauuagcggaaugugguguuacacaccuguaauccuagacuuuauacugacacaggagggccaugccuucuagaccagcucugaccauauggaaggaccugucucagaggggaucagcuccucucagucaacacagcaccuuccauuguguugauucagaaccucaaaguuguaaucucagccucuguuucuuaugguuaguguugguucuguguuauaguagcuccucccuuugaaaccaagacuuuuuuacacuagcaagggaguuaaauauuuugcugaaauuacuuuuauuauucauugguuuuccacacagugaaacaaaaacccuucauuaaaggcaugaaaaguguugacugcuccauagucaccuaaacuauaaacauugccauuguccuaaaugcuuccuuugccauacuuccuuaauucccacuggcuacaaacuguaccaguccuaacuuacuuugcagcaugcuguugcugcuaccuucauuacccacauuguugaucaugaguuuaguggccagcuggggcugcuuagugaggcucuaucucaaacaagcaagaucaacuauucuguaaacuuuucuuccuuauuauuaguuuuuaaaaacuauucuuugaaagcuggacuguauuaagugacucuuaagcaguuaugaaguaacuauaaacacugaauuaaccaguugaauuaauuaaucaaccuuacagagacccaaaggcuguuagagacagaaagagaucucuaacagauuagaaaugucuucucucaggauuucuacaguggcuucggaacugggguucuuuacuguuugcuucaccagcccugacuuagaaagugcaguguaguuguuuggaagcagcauuaaaaagggaagugugaagaggaaucccuaauauuuacaaggacaacccagaagacuaugucagucguuuuccauucucagcuggagcuuggugcaaguccagcuauaagagagguugagaaggagucgacauaagacugaacucggggaggcuggaugagaguuggaagggagugaguuuaggagaugguugguuaguaccugccacacaaggcaaacgaggaaguucuuuuggagacugacaguugccugccucuuugccuucauccuuagcaugcugucuuucugugcauccuuuucugcucuccucugcuucagccacacuacacaaccauuugcauuucuaaacacgauaugugcuucucuuccuuuuucccucucauauugcucucuuagucugagggauccuugccauacuauuucugucaucacuaacacccugucaucucaggugcugccuuucaagucucagcaaagcaucugugcucuggaagcccuuugcauggcagugugccucucaccuggguggugcugacuacuaucucccugcugucuuuucaucuuuucaccuauugacacuuuaucaacacuuacagauugguuugcuuuuuuguuuuuuugauuguugauucugaaggccccaacaacauuuucuuaugucuuaaguguagcauaccgucuauuggaaggaacauuucuuugaucuuugauuagugagugguccccaggaaaccaauuucuguccagacuuuggaaaacuggugugugugugugagauagagagagacagagacagagagacauguguguauguuuguaugacauguauguacauguguguaugacauuaaugaagauuuuagugcuggcuuccacaauauuuacaauuauauuguauuuuccuguuaauugauccauauugguuuuuaguuaaaauuuaacucuaaaaguacucacaguaauggaauuauuauuauuuuucuauuuaaaaaggaguggacuauuccauguaccauggcacaauauuuacaaugcuuuuaacauuucaguaguucagucuugcugccgauugguugaaguauguuagauaaugcugccaugauuucuacaucuagaccugaagucuuccaagcacugcugccuuaacguuugguuuuugauaggugacaugggauuugcuaaugaccgagagucacuguuaaaaacaaagucuaaggcaagagugccuugaauaaucuuacauggagaauuuucuuuuccugcuuuacugucuugaguaauaucuuuuguuuuacuuguagauuugaugguccucgaagauuugaggauuuagggucaaggugugaaggaccgagacccaaagggccucguuuugaaggaaaucgccccgaugggccaagacccagauaugaaagucacccagcagagggcacuaaaagcaaauggggaacgaucccucggggcccagcaucucaauuuuauauaacucccaauacaucccuaaguccucgacagaguggaccacaguggaaaggccccaaagcaacuguuggacagcagcaucagcagcagccuaagcagcaaccuaagucacaagcagaaccucuuucaggaaacaaagagccauuagcagauacaaguaauaaccaacagaagaauuuaaaaauucagucagcugcguuuuccauuuccgcagaugucaaggauaccaaggcagcucagucaaaugagaaucuaagugacucucaacaagagccaaccaaaagccaagucucggaagggcccguagagcccucuaauuggaaccagaauucucaaaguauggagacugaaauggacaaagcagaagguguuacucagccuguaucccuugcaaacaaaccuguaccuacucaaucuacuuuccccucaaaaguagggagcauggagggaggagccgcagcagcagcacugacugcagacgauuucaaaccuuuggguguugguuugucccacucagaaaaccaccaagaaaaagaucuuccucagccagacagcagagaaaauagauuagaaggcaauaaaggcagcagcucaucauauagagguccugggcagaacagaguggaagagucacgggauaaaggacuaguaaacagaggucguggccagauaauuaaccgugguccaggucuggucaagcaagaagauuuccaugauaaaaugauggguagaagagaagacagucgugagaaaaugaacagaggagaaggcaaccgggacaggguguuugugaggccaggaagcagucgggauaaaauaccagguggccuacaagacagccaggacaguagagccaacagccgagaaagggggccaccucgcagggcuggcagucaggagagaggaccuccucgaagggcuggaaguagagagagaguacccccucaaagagcuggaagcagggagaggguaccaccucgugguccagguagucgagaaaggggguuaggaaggccagauuuuggucaugauagaguuccauucagaucagaacuaggagaugguggagacaaaguguauccuuaucaccgagaugaaccuucuagggcuucguggaaccauggagaagagagaggacaugaagaguucccaguagaugguagaaaugcuccaauugagcgagaaagacucgaugacugggauagaaagagauacuggagagagugugaacgugacuaucaagaugauacacuagauucauacagcagagaggacagguucucagcaccaccaucacggucucaugauggagacaggcgaggcccuuggugggaugauugggaaagagaucaggauauggaugaggguuaugguagggaaauggacagggacuuagacagagauguggaucgcauuagaagaccuuuggauauauaugauagaaauguggauaacgagugggacagagauuaugggagaccacuggaugaacaagaaucacaguuucgugaacgagauauuccaucucuuccaccuuuaccaccccucccaccucuuccaccuuuggauagauaucgggaugauagauggagagaagaaagaaaucgagaccauggguaugaccgagauuuccgugauaggggugaguugaggauucgagaguauccagaaagaggagauacauggcgggaaaagcgagauuauguuccugacagaauggacugggaaagagaacgguugucagacagaugguacccaucugauguggauagacauucccccauggcggaacauaugccauccucacaucauuccucugaaaugaugggguccgaugcaaacuuagacucugaccaaggccuuggagggguaaugguucucagucagaggcagcacgaaaucauuuugaaagcugcacaagaauugaaaaugcuucgguaaguuuacuccuuaagaucguucuuuuaguugaaacagauuuucauacugcucuuuuuuaaaaugaagugccuuuuuugguuuuguuuguuuguuugguugguugguuuuucaauacaugguuucuccguuuagcccugcaugucuuggaacguguucuguagaccaggcuggccucaaacucaaaagaucugccugccucugccucccaaguacugggauuaaagaugcaugccaccacaguccagcugaaugaagucuuuuaauggaacccuuuaaacccuguuucuuaucauacuuugaauuuguauuucugguuauucagugcuguuuggggguuaagauggguauuuggaaacuguuaauuauucacauauguccuagggugugcaaauugauugcuguucucagucauuguagauguguugcuggaugcuuugagagugcaugucucaaguguuaaaacuacauuuuucauggggcuuuguguauugagccaucguugcuuucgguaggcagcgucuguucuuuggcauuggaucugaugggcugcacagucccugcuguuugaugcaauggugggcggugcucucuuuucucugcuggaguuaggaguggucaccuggggacgucuucagauuuuacugacuacugagacuuuguguggaggauguucaucuuugauuuuaacuggaagcagauuuuuuuuuccuauauuuucaucgugaaguuggauuuaaaaaaaaccaaaaaaacccuacaaucaacugugugggcauuauauaauguuucucauauagcuauaacaguaagacuuuuuaauuuuugucuuuuuuuuccaaacagguuuuugagaaaaauaaaugguuaauuuuuugauagauuuuaauguguuugcuucaucugucaauuguggucuauguuugugaguuauacuaauugaauuuguaacugaaauguuaguaguagggaaaugugauggcaaagcauaacuguaggaagaaugaaagaaugucuggagguuccgaacagguggcaagcggucucuucggucuguaggcugaggugguccucgauccuuuuucucgguuacucaugagcaugaugugaggcuugcugcagagcguuuagcuacuugcuucuaaauugugggcaccuuuaauucacauaacuguuccgggcacuacacugauccucccaucuuaaccucgucuguccaaaagcuugcaacgaaaaauaguaucaucgccauucacaauaauacuaagacuugcuaaaguuuacuugguuauuaaaugcaggcccagaauuugaacugucugacucugaaaucuauuuuauagagaacauaaaacugauuggugauugguuacuaaacugccaguuucuuuucuuuccuuacuuaaaaauuacuuuuucauugguuguugcuuugcauagauggcuggaugaaaggugcugcacguucaccccuuuuccuucaaccccuuccuaggcagcaaaaccuaacaacauaugugagcuguuggauaguaguuagcacaguuagagcacacugguuauagugugccuuuagagacgaggaauaccauaagcaguguuucuaugagauaggaacaucccuuauagacuuuguguccccuugggucacaaugcuguauguaaagagauacuguaaacauucuggagaugguguaguggauauuauaaauguagacgauaggaauuauaagaaaaaguaaagggauguuagcuagggauuaaaauaaaggaguauauaauuaaucuuuaggaauacagaguauuauuuuuaagaauauagaccugugaguguugucaccaucuaaagcaaauaguaaacuaauaugcauucaggaguuagacaaguggggcuggagagauggcuuagugguuaggagacugacugcccuuucagagaauccagguuccuauauauacucagcacccacauggcagcucuguacaacugucucuaucaucaguuccaaaaggauccacugcccucuucuggcuuccaugugcacugcaugcauaugguacacauacaugcagacaaaacauacacaaaauaaaaauaauguaaaaaaaauuucaagacaggguuucuucauguagcccuagcuguccuggaacguagagauccaucugucucugccucccgagugcuggaauuaaaggugugcaccaccacugcugggcaugagacuuuuuuuuccucccuuugggggaaaaaaaaauuuuuuuuuaaagggucagacaaguuaacagaaauaaauggaagugugccaggaggaacucuggaguguggcaaugacuugauagacugcuucaucuaacauggucggccguggcuccacacagcuacuuguugacagaauauaggugcaguauuaaucaaaaugcuuuaaaaacucaauuucuauguaaaauauuuccuuuauaaauaaugucagcuaauucaaguuuuaaaaacugaugugagagguagguauagugguacauacccuguaaugcaagugcuugcacgagagugaugaguucaaaucuauuuggccguuuuaagccuagccuagguaccugaaacuguuccacccccaccucccaaacaaaauaagccuccugugaaagccuaaaaugccuucuuagacuguuauuuuauacagaguccauuuuguaaucuguagaauauugacagcaauuagcaagaaaaaauuugggauuucuuaaaagagaaacaugguggguagguaacauccuaugaaggcagguuguagaaucaauuguugaagaucauugauaauuuaugauuauaggucuuagaugguugauggguuaguuguguaaaagaagagaaugcuaccauaacugaggugcuguaugguaugggcgcugcauagaacuuuagucuuuagguguuuguauuuuuuuuuaaauuugauuuuaaucauaguuguuugggaugguguaaacaugcuuuaaguacaaagacaauuucauuuguuuacagagaacagaaagagcagcuucaaaaguugaaagacuuugggucugagccacagauggcugaccaucuaccacccccagacucaagacuacagaauccaucaagaccugggauguauccgguaugggaaaaugugugcucagaaaaugagauucuuuuuuuuuuuuuuuuacuguguauguuuauaugauguaggauuuauuuuguuuuguuuuguuuuuguguuucuagacaggguuucucuguguaguacuggcuauccuagaacuuccucuguauguagaccaggcuggccuuaaauucauagaucugccugccucugccuccagggugcugggauuaaagucaugggcaaccaaugcuuggcagugauguuggauuuuuaaaauuccaauaagcauacauuuuuauuguaaaaacauaaauuuuggaaaagugaaagcuuugaacaucuuuaaaaguaguuagacauaugcaagaauacuccuuucccuaggcuuuaacagauagaccaagcacagcugaaccguguagcuccguggucccuggauucaguccuggucacagucuucucaaaaccuccacaguuuuaaagaacaagggcuggcaagauggcaccugcugccaagcuaaugaccuaaguuugauuauaugauuuucuuauuuguguguguguguguguauguaugcguauguguuauaugguguaucuacccuuaugggggugguguuuccuguguauuugcgcacauggaguccagagaucaacuugaauuaucuuccuucaucuuuuaaaauuacauuuauuuaucuacuuuguauguuugaggguggaggaggugcauaccauagugcccaugguaaaaucagaagauggcuuuucagagauguuucuuuuuccuucuacccuguggcuucccugagaucacucagguuauuaacuuggcagcagguaucaucuuucuugcccacauacucuaaaaaugggggugggcuggggagaaaagugcaguucugaggacugaauccaguguguugcucccauagagucacuccuaggcaagugaucuaccacugagcuaaguccccagcccuaccuacuacuuucuaaauuauuacuauuuuuagauguguuuaguaugugugugaagguuuugccucuguguauauauguguaccaugagcuugccugguucccauuaaggucagaagagggcuucacacaccuagaacugguaaagauacagaugguugugagucuccaugugggugaugggaaucaaccugguccucugaaagaguaauaagugcuuguaaccacugagucagcucucuagucuuaguguuuaacaacuguauuggccagugccuacucucugcuccacuuuagauaauacuaauauauauuuaaccaaacagacaauaugugagagagauaaaugucucuguguguugaaguuuauuuacaugcuucugggugccuccagagcucaaaaaauuaugucagaugcuugggagcuagaguuaaaguccguugugagccugaugguggcugcuaugaaccaaacucuaauucccugcaaaaaacagcaagcauaccuaacugcagaaccaucuaaauuugauuugugugugugugugugugugugagagagagagagagagagagagagagagagagagagggggagggaggggaggggagaggagagaggucauaccacauguaugaaggacaggacaauuuguaggagacuacuaauuuuuccagaugacuucuuuuuguuguuguuguuguuguuguuguuguuuucugagacaggguuucucugugcagcccuuguugaccuggaacucacuuuguugaccaagcuggcugaccuuaaacucacagagaucugccgccucuguuuccuccuaugcagugcuuuagucaaaggcaugcaucuggcaggguuucaccauguagccaugguggguuuggaacuuguuacugcauagacuaggcugaccucaaacugacagaaaucugccugccucugcuugauaucaugccuggcauucgaaacacuuuuaaaaacacgaguuucauuauguugcuuccugccuuauaacuaacugcugaggaugcagcucuguugcuagaacgccugccuaguauacgugaagcccucgguucagucuccaguaccacauagaacuggguaagauaccacaugccuuuaaucucagcgcuugggagguagaggcagggggaucaaaaauuugcuauauaguaguuucaaggccaaucugugcuugacgaaacccugacuauaagaaaaugucuucaggauuucccagucgcucucaggauacaaucuacuuuucauugguauuuuguuuuuccuguacuuuccgguccccuccugugugcauuuuucucgaucccccccucuucaucugguugguucugguuuaucuuuuccaaucucagaguggucccaucagcauuuagcauuguuugauuuguuuauuuucuuaucauuauccuuccuuucuaaagugagcuccuaggaugaaaacugucuuccuucuucacgucuuguggcaagugguagagucuagaucuucaguuaucaucuucugggucgcaaccccuuuccgcacaucagauauccugcaugucagauauuuauguucugauucauuacaguagcaaaaucacagcuaggaaguagcaaugaaaugauuguaugguuaagggucuccacaaugugaggaacuguguuaaagggucacagcauuaggaagguugagacccacugcucuagauuauagauccauauuucuguuuugcucaucugacaaaucacacuuucccauaucccaacauguuacuauuuuuaugcacaguaagucauggaacuguucuauuuauauuggcuauuuucuucugaucuuccacgauuauuaaugcggcuuuaaugaauuucucuguaucgggucuuuaauuuggguaccucccagauauuuguguaucuuccuagagugggaaacuuuagucaaaaaguacacguucuuucugcucaagaaauguugcuuuuuaaaucuauaccucccaggcacacacagagacaacuagccucauauuuguuaauaaaauuauguauugacccaccaacaaauaaacauacaaauaauaaaaaacauuuaaaauuuucucuuaguacauuuaagcaacucucuuacauagcuguauaacaucaauaccauauccagacaaucaucagcuacuuuauauuuuggaaaauauaacaccacuuuuuuuuuuuuuuuagguuuuuuugagacagguucuuuguguagcccugguuguccuggaacucacacuuguaggccagcuggccucaaacucagagauugccugccucaaccucuugagugcaugugccuggcaaguaagagagagagagagagagagagagagagagagugugugugugugugugugugugugugugugugugugauagaauuucucucuguaacaaaacccagacuggccuugaacuuguggucuucuuuccucaguuucuaaaauuuaggcaccacucucagccuuuaguacacuuguuuuuuuaugaguaugugcauaucugugugaagugugugucaugugcauguggauauucuagaagcccagaagagaacuuucauuggauccccuggaacuggagcaaagaugguugugagccccgcaguucaugcucugagaccaaaacccauggccucugaagugcagugagagcccuuagcuccugacccaucucuacagcuucuuauacauuguugauaaauaggaacauuaauauuucuucauguuaacauuccuuacauaguagcaaaguccaguuuuacuccaaauguuucuuuuuuuaagcuuuauuuuuaauuuuaugaguaugagcauuuuccuauauuuauuuaaguauaccacauaugugcuucaugauaucacauaugauagauccuuuggaacugaaguuacagauuuuugugagcuuccuugugggugcuggaaccagaauuagugcucuuaaccacuggguuaucucuccaggcucaaaaaucuaauuuuaaagcacagccuacagaugaguaaauacauaaaauauauauauauauauauacacacacacacacacacacacacacacacacacacacauauacauacauaccauuggcuuuccaugguccaaaauagcugacauuaaaaaauaaauaaaccauggccagaacuaagaaaaaugggaaguauuugcauugggcauuuuacugacugagugaucucagcacaucacugauuuuuagauuaaauuuacugagcaucugacacuauaaucuaauuucaaagaaccuucuuauuucaguaaaauaucugugcuaguuuauaggguuuuuaaaaauauuuauuuaucuuauguaugugaguacucugucacugucuccagacacacgagaagagggcaucagaugccauuacagauggcugugagccacaguguaguugcugagacuugaacucagaaccucuggaagagcacucaguacucuuaaccacugagccaucucuccauccccuauaguucuuagacccaaguaguuuaugguacauuuucugucucucuaguuuugcccuuuugagcagcucauauaaauugggucuauguaacauauaguccuauauuucuggcuucuuucauuuagcaucacauuuuugaguucauaucauaguaugaguuaguacuucacuucuuuuuauugcuagguaacacucacugaauagauguauuccacauguuguuuauucaugcaucaguuuccagacaucuggauugccuacuuaaagcugcugugaauauuuacgugcuagucuagguagagcaggcuggucuugaacucauacagauccacuuaccucugcuuccugagugcugggauuaucagcagcaugguauuugcuaggauuuuuguuuuuuaaagagacaagguaucauagucuauguuguccucaaacuuguauguaucugaggguagccuugaacugauugauccaccucuaccaucauagaagagugaauggguaugcugccauacccagcuagaguuauaaaguuuuuuuuauauuaauuaauauaacuauuagggaugacuucuguguuuuuccuuuucuauggccuaucuucauuuuucugcuagugucuuugucuaugugugugcacacguguacauaugugcauauguauggaagccacugguugacccaguuauuguuccccaagcauuuguuuuuuaguuaguugauaucucacagaccugagacucaccguuagguuaggcuuccuggccagggaagucccggccaggaucuacucugucucuguuuccccagcuauaggauuauaagcaugacccaccauauccaauuuuuaaagaagauucacuccaagcagugguggcacacaccuuuaaucccagcacuugggagacagaggcaggcggauuucugaguucgaguccagccuggucugcagagugaguuccaggacagccagggcuauacagagaaacccugucucgaaaaaacaaacuaacaaaaaaaagauucacuuauuuuuauuucgugaauguauguauuuuguuuauaaaugugcacaggugcauucaugcccuucaaaggucagaagguaucuggucccauaaaacugaagucacaaaugauugugagccacuguggggggugcuggacauagaacuuggguccucuucaagaguagcaagugcucuuaaccguugaaucauccuuugaaccugugaccaaaaauguuuaugugaguucuguuccuuuaauuaagguccucagauugccuagcaggcauuuuacuggcagaguuaccuacccagcuccugcugguaucuuuuauuuaaaaaaaauuuuuuuuugagacagaguuacaguauguaguccuggcuggccuagaaaacacuauguagacuagaccagccaugaacucauagaaaucuucaaguguugagauuagaggcauauaccacuauaggugugugugaguguguguauauauuugugugugcaucuguuuugagugauguguauaugugaggcagacauacuuguaggugcccacagagacuacaguucuuaaaucuuccuagagcuagaguuacagaugguccacucagcauggguacuaguaaaugaacuugugcccucugcaagaacagugagugaucacugagccaucucccuagugccuacuagugucuuuaaaaacacaaaagauuggggcuagggaaauuaauugcucagugguuaagaauacuggcugcucuuccacacagccuggauucaauucccagcacccaaaugucagcucagaacugucuguaacuccagucucagaugauaugacacacugacauacaugcaggcaaaauaucaaugcacauaaacuaaauaaguaaguaaauaaaaaaaacacaaaagcuuuacauuuugaauaugacuuguauauuaauugauuaaaaacuagguauuaguuuuuacugauuugugaccauguagcaacuaucuuaccauuuacugucuucucuagccuccaggauccuauagaccacccccuccuauggguaagccaccugggucaauuguaagacccucugcuccaccagcaagaucaucuauuccuaugacuaggccuccugugccaauaccaccaccgccuccuccaccuccaccaccaccaccuccuccuccaguuauaaagucaaaaaccucaucugugaaacaggaacgcugggaugaagauucuuucuuugggcucugggauacaaaugaugaucaaggacugaauucagaauuuaagcgagacacugcaacaauuccgucugcuccgguguuaccacccccaccuguucauucuuccauucccccuccuggcccaaugccuauggguaugccaccaauguccaaaccaccaccagugcagcauacaguugacuauggccauggccgaggugaguaauauggugaauuuauggcugggguucuacaggaguuguuugguggugguagugguguuuugauuuugagauaaucucuuuggcaaggcuagcuucaaacucauuauguagcagaggauuucuguccuaguuaggguuaugguugcuacaguuaaacaccaugaccgaaaagcaaguuggagaggaaaggguuuuaauaggcuuacacuuccacauuguauuccaucauugaaggaagucaggacaggaacucaaguagggcuggaaccuggaggccggagcugauggagaggccuuggagggaugcugcuaacuggcuuucucuuuauggcuuguucagccugccugcuuucuuauagaacccaggaccaguccaggcauggugccaugcagaaugggcuggaucuuccuugcccaguaaucaacuaguuaagaaaacacccuacaguuggaucuuauagagacauuuucucaacugaggcuuucuccuuugagaugacucuaguuuguaucaaauugacuagccaggacagugaccuaaaacuccuguccuuaaccucccacauucugggauuauagguuuguaccacagcaccugacaggaauuguuuuuccaaagaagagacuuuaaguuuuucaagacccaaucuugcuggcccuggaacaccacauucccccaagcucuggguccuccugccuuaacuuccugggggcugggauuauaggauauacuaccaggccagacuucuacaggaauuacuaauuugagauuugguuuucuuaagcuucaugcuuauauuucaucccugguuuucuuugccagauaugccuacuaauaaaguugaacagauaccauauggagaaagaauaacucuacguccagauccauuaccugaaaggucaacuuuugaugcagguaggauucccagagaggagaguaauuuuaagcuuaacuugaggaccuaauuauuacaagauuuuccuuuuaacaagguuagucuaguuuaauaucacugaaagauuccuaaauuuaagacuaauuuacauucucaaguuaaaauugcacgucuugcuuuaauuucugaaaaugcuucuaguucuuaguuuguauuguuuuuauagaucaugcaggccagcgugaucgcuaugauagagauagagaccgugaaccuuauuuugaccguccaaguaauauaacagaucaucgagauuuuaaaagggaccgagagacacauagagauagagaccgagaucguguucuugacuaugagcgggaccgauuugacagagagcgcagaccccgagaugacagguaugcugugaaaaauaccuuugcuauauauacauguaaaauuucuuguguaaauccagugaaagucauuuguuuguuuguuuguuuguuuguuuguuuguuuuuggauuuggggguagugguuuuuguuuuguuuugagauaagguccucucuauuauauagcucuggcuuuccuggaacuugugauuaccaggcuggcuuuaaacucaaagagaucugccuucccuugucuccugaaugcugggaauaaaggcaugugccuccuugccuggccacagucaguguguugaaagagauuuugugaacaauguacucuucccauuauauguauaguuuggaaaaggaagaacaauuucuaggcaaguacauacuugaauucuccucccuugaauuccagagaauuaaauugaaauguagacagcaaaauugaaagaaaguaaaguacaaccaguuuuuuacagacaagcgauuuaacaauucuugauuuuuagguagauauaagugaaaaagcaaguuuaauauuuaaauauagacaguggaauaacugcccauagagacagugauguguugcaaagcagagaccuuccaaguauuuauguuuuaccaaaacuuccuguuacacccuguaggaaucaaucauaucgagacaaaaaagaccauucuucauccagaagaggaggguuugacaggccauccuaugaccggaagucugauagaccacccuaugaaggcccacccauguuuggagguaaaguaaugccuuaaugacaggaacuacauugcuaaugcaaacacauagaagguguuucucauuguagcuaugcauuuaaacauucacaguaaacuguacuugaagauagcauuauuauaauaaauaggacugugugacuggagagauggcucaguggucaaauacuguuccuaaagaagguccagguucaacugucugcacccacaucaggcaguuuacaacuacuuguaacuacagcacucaagagaugcccugaacuuuggguacacacauauauacagacaauacacacauguacacauaaauaaauaauaaugaaaaauaguaauguaauuaaugaaauaaaauuuaauucuuaaacuaguaaagaaauuuugaaaaacaaaguuacuuauaaucccaccacacaccauaccgaaacacacauuucucucauuuuuucuuaaaaauuacuguuucauuuuuuauuuguauuagugaccagggcuccccuugaaguggaauugugaucuaccauauggggacugguaauugacccuugguccucugaaaacacagccagucucuuaagugcugaauccucacuccagcccucuuauuuucucucauauacucguuuaugaaguuauaaucaaggauagaagcuaggaguuuucuugaguuuugugcugcccugggcaucacauccugagccucaugcacggugcgugaguugucuuuccacccuagcagcgcuguuguuauguucuucuucaguucaauaacugcaucauguacaucuucccaucuucagaccccuugcuggcuccacgacauuucaugggauugauaguguaaggcccuuacaguuggacauugaauuguuuuuaucucugcauugccaugaguugcacuuaaacuagaaacuuuugacuauuaaaaggauuaaguuuuccuaaucgcugacucucuuaaacuauaaagugaaagucauagaauccauacaguaucaguuaugcuuugguuuauccaguaaaauauuccuuuauguccuguugcugaaucuguuucuauacuuaauauaaguaaaggugaauuaaauauuuuauagaacaaucuguucugcuuuuuauuucuccccaaaugggccagucuuuucauuuucuugauuacaauagguuuauguuauuaauuaaauuuaaaaguuaccuucaauucauuagaccugaucugaauuguaauuaagguaagaacagaaaaguuauuagcuuuuuuaaugauuacuguguaaauaauaauguuauucaacuacuuacugugacucuaggagaacgaagaacuuacccagaggagcgcaugccccuuccagcuccugcccugggccaccagccaccuccaguuccucggguugagaagaagccggaguccaaaaauguggaugacauucugaaaccgccgggccgggagagccggccugaaagagugaguccuagaaacuuaacuaguucguucucucucucucccucucucucucucucccucucucucucucucugcuuauuuuaaaugucugguagauuucuucaguuuucugcaacauagaaauacuggcuccaaagccucauagcauccaaaaucaauaaguaaucuuagauauugccuacacuuuaaaaucuuaaagaaguuuagccaauaauguuggaaauuuuuuuuuaaguuuuugagcacaauuaagugcauuuugaaaagaggaaaaguauauuggacuuaaugguauauggaacaaaaggagggaaaauuagacuugauuagguuuaaucuccugauauacucacucuauuaucuauaaucucauauucauaugagaaugagagaauaugccaugauauggauagauauacacacaagcauauauaaacauacacauauauaauuuguaucuauagcuaucccauauguccuguggugguuguacaguaguccaccuucuugucuaugguuguacuuucugcagauauacuuaucugaagucaauaaugauacaauaauuuuaauuaaaauauuaaagugguacuuaguguaguggcacacaccuuuaaacguagcccucagaagacagaggcagacaagugucuaggaguuugaugucagccuggucugugcaagaagacacuaugacuuaaagaaaaaaaagaaaaauucuaaaaauaauugauaaauuuaaaaucauaugugucauggugacaucuuccaguugagucauuccuugccauauccacacaucccuccugcugaucacuuaguaguugucuuaguuaucagauuaacuaucuugguauuaauaggauuugaauauuaucugugauuucaggcaucugcucgggauccuuagaauaugucuccagugauaauaagacacuuguguauaucuuucccaucccugugcuuucaauguguuucuuaaauuacauuuauuuucugugcgugcaccaugccacccuaugcaguggaggucagaggagagccagccuuugggaguugguucucugcuucaaccauguugaucccagggaacaaacucaaacuguagucuuggcaggaaguuuacucacugagccaucucaagagauuucuguuuguggagacucugugugugugugugugugugugugugugugugugugugugugugugugaaguguauuuccuguaaacaacacauagcugaauuguaguuuguguugacuucuuuguuauuuguuuuucuuuuugguagugcuggaguuugaacccagagcaggugcucugccauugagcaauaccaccauccuaguuucuaccuuuugauuauauuguuguugguuuguuuuguuugagguaaaaucucacuauguauacuugacuggccuggaacucauuguagagaccaggcuggccucaaacucaagagaucugucugccucugcaucccaguugcugggauuaaaggugugcaccaccauaccuggcuuugauuggauuguuuaauucauuuaaaguuuuuuuauauaacuggcuuuauuuuauuuuuggcuuacucauuuuagguguagaaauacuaguuccuuuuauguguucuugugcucaguaacauuggugaacuuuucauuuccaaagcuuuuuagcaaauucuuagaauuuuccauauauaagaauaugucaucugcaaaguaauuuuacuuuuucuguuguaaguucaauggcuucuacuuauuuuuuuauuuuuuauuuuuuugccuaauuacccuagcugacaccuccaguaccuuagugaguagauaucuuugaaguggacaucuuugccuuauuuuuguuuuagaaaacauucagucuuuuaccauugagcauguuguuagcuauggauuuuauuauuuguauauguagggaggcacacgugcuaccacagaguuguggagcucacaggacagcuuucuguccacugugugagucucaaggaucaaauggagacacuaagguucggaggccuuucccucugaaccaucuugaugagcccagcugugaauguuuguggcugcauuuugucaggcugaggaagccuccuguuucuacuuuguuguguuaucauuagucacaaaggguugcaggauuuuguugcacggcuuuguuuuguuuuggauuaguugaaaugaugcuguaauuuuuguuuucuaguauuuaggcacaauuuaguacauuaauugauuuucauuuucuguauugcugaauaguucauaauaucauaguuuucuuauaauguuuuugccugguuuugguaucagaguaaugcuuaccucauaauauguuuggaauuauuucuucagauaauuucucagaguauaguaagcuggccucaaacuuaaguagucaaggaugacuuuaugauguugaacuucugaucuuccugucuccaccucucaaaggcuggcauucaagcugugggucaccaaugccagcuucuauucacuugguuuuuaggcagaucucacuauauauuccugguuguucuagaauucacuguguaagccaggccgacuucacagaauccccugccucugucucugccucucuccuggauuacaggugugcauuaccacgcuugacccugacccuuguuuaacucucccagucccccuguuuugucuguuuuguagggaaguuuggucacucacaacaguguagauauugguugguuugaucuaaguuaucuucuuuguuagcacacacuuauauguaucuauuccuuuauaauuucuuuauauuucuuuauauuaguagugacaucuccauuuuuuauuauaguaauuuaagucuuuuuuucuuacuuaaucuagguaaaucaauuucacuguuuuuuuuuuguuuuguuuuguuuuucaaaggaccagcuuuuaauuuuauagauuuggguguguuuguguaugcggcauguuuuugcuuuuuagcucuaauaccugagacuagguucuuuaugaggaaaagauguuuauucagcccaugguauaggaaaugcuugagugcagccucaggauuuguuuggcuguggucagggccgcuuguuugcaucaaaacauaguguauauaucacggugggaguguguaugagggagggaaaggcacugaugaaagaggaagcugaagacacucaaggaucagguuuacgauguauaacauuucaccaucuaggaugcuauccagccucccuuaagaguuaccugcaacgaccuaauuaaccucccacuaauccccccaccugguaaaagcuccauuaucuauauucugccggcuucuauacuguugaggaaaacacaaaccauauccaaacuauaaaguuuuacugacuuuucucuauuuuauuaauauuuguccuaaucuuuguuuucuugcuucuguuugguuaguuuuagcuuguucuuuuauagugucuuagguagaaaaauagguuuucaauguuagaucauuuuucuuaauuuuuaaaagauuaauuugauuuuguguggugaguugucugcaugugaguuugcauaccaugugugugccuggugccuacagagguuaaaagaggauguuggaucuccugggacuaguuaauagccugccaguugugagccaccaggugggugcuggaagccaccagugcucuuaccugcugagcaauuucccacauucauaaaaccauguuuuaaagagaguuuuuaaaaagaagggaggugugugcugaauaaauuugcuggcaccucugagaucccagcuaagcuguggcuccagccccuaaaucuuuuuuaguucuugauacagacauguacaccuaaaauuucucuucaaauauuuguuuaguuuuaucccaugagcugugguaugauguccucauuuuuauucaugucagaguaauauuucugauaccuguugugaaauauuuugagcccuugguuuuuuuuaguaauuuauuguacauauuuaugcacuuccuuuguucuguucaguuuugcuuugucuguucugagacaaguugucagguauagcagucuagucucaggcgucccuauggagccaagaaugacuuugucauugaccuccuuccucugccuucugagagccgggacugcaggcagaggccauagugcugggguggugcuuuuuguuuucugcaugauaggaagcaguuugccaaccgagcuauaucccaaccccucagaaaacaaaaauuuuacccccuccauuguguuucagauuguuguuauaaugagaggauugccuggcaguggaaagacacauguugcaaaacuuauccgggugaguaugggaaaguaaaauaaggaaaaggaaaaaaugaguugcuuguuaaugggguaguauuguauucagguaucucccagugauaacuuauggacguucauggggccuuauaaguuuuucaucuguuuagacaaauaauuuugccucugauugauuugaaaccaccagaaauuuuuauuuuagccacaggugggaacuuuaguguucaucaauuugguucuuuuuuuuuuuuuuauaacuucauuguuauauucuuaggauaaggaaguagaauuuggaggaccugcccccaggguuuuaagucuagaugauuauuucaucgcugaaguagaaaaagaagaaaaagauccagauucuggaaagaaaguaaaaaagaagguauguggauccuacuagaccuguguugggaugugaaggaagauguguucagggagagaugggggagcaguuguuuguuuguuuguuuguuugaggcaggguuuguuuaugguuuguuuguuuuuguuuuugaggcaggguauuuacuuauguagcccuggcugaccuggaacuugucagguagaucagguugacuuugaacucacaagaucagccucaccuacuuagauucaaggugugcacugccaugccuagcuugcacuggguugggguuuuuuuguuuguuuguuuuugaagaugagaauuuccuugucuucuggacacaaacuuuggugcuuaggugggaagaagaggaugcagucauccugcuucaguugagcccggcucagucugguuccuuacuccugcuaauaaccuccuuuucucuguggggucuuagguaauggaauaugaauaugaagcugacauggaagagacuuaucgcaccagcauguucaaaacuuucaaaaagacucuagaugacggcuuuuucccuuucauuauucuggaugcuaucaaugacagaguuagacauuuugaucaguuuuggagugcagcgaaaaccaaggguuuugagguauagucuuaacuuugaagcacuuuuagugugaauuuguauuucuuggccuaauuguuacacauuuuuauuuagguguauuuggcugaaaugagugcugauaaccagacuuguggcaagagaaauauucauggaagaaagcuuaaagaaauaaacaaggugauuuuuagaaacaugguaugcuggagaaucccagacaucauucuuucagcacuaguaaugcugucuuaagucgcucagaaaucuuucugccugcuuuaauaaauguucuccuuucugucuuauaaguggaaagggaugccuagcucuucuuaaagcuagucuguuaaaguuauagcauuaguuguguuucucuugacacucuccuuagucuuuauuggaguaguugucagaguuaacuuguucugaacaucucaauagauggcugaacacugggaaguugcaccucgucacaugaugcgucuagacauccgcucccugcuacaagaugcugcgauugaagaagugaguauacucugccucagggcagugcagauaagcaacaccuucuucacugugaaaaucugaaacuuccagaaaaguuacaugagcacuuacauaccuuuaaauaaucucaaccaauucagguguuaauauuuccacacauuuuaauaaacaccuuauaaauacuuaguaacauuauuucauaccauuacuauacaaucauaugagaauuguguugaaaaaccucauaacccaucaguccggaauauguuguugauggcuaucuucuaagaacaaggacauucucuaauaaauccauuuaauuauaaaauuuaagguaagcauuagcugggcuaauggcacacacuuuuagucccccaaaggcugacagaucugagugaguucaaggccagccuggucuacaaaaugaguucuaggacagccagggcuuauagaccugucucaaaaaaacaaaaaggaaaaaaaaaaguuuacauugauaugauacuauaaauuaaauucuuuuguguuuuuauuuacuuaaccuucucuucccacacccccuaggcaccucuuugauucaguccuugagcagaucgaucaccaccaccccccacccccguuucgacaucaaucugccccaccugucuuacaccuccuugucuaggacuaaucuguuccuucucucucucucuccucucuccucucuccucucucuuacuuucaguuugcucuguccuaaaggaucagacacagggaaguagcaauugauauccucuggccaagaccacccaccgcuugguguggguggaaggccuccaacccucugucugaucccugacagauaacccccuaucuuuuauucuucuugaaaacaaaagaaaaaagaaaaagcccuguuacacauugacuaguaaugucauuagggcuguuggcaguuucucuaaaauuugcagggcugacucacagcugggacuuuggggaauucccugugacaccucucucugaccucagcguuucaaaaaacgcucuauaucaugggaaacuaggagauuggggaggggcaaaaacaaaacaaaaaaagccaccugauugcuuccucaaucguggcaggucauuucggccucacccaaucuaccccucccuccugcuguggaucuggagauccuggcaauucugguuaauauccacccaacccgggcuggauuccuccuccaaagucagauugccaucuuaaagagggaauuuucuccacgggagcccaacagggcaccccagccagcagggucuaaccaucaggugcaccucugugugcccuucacgucugggacagaaugcagcucucaagagcccaccccugccagccgaccccugccagaccgcuccugccaccccuggagggaggagagagggcuguggaggcgaugguaaaggggaggggaugacagaugaagggggaauguaagacucgggggaaacgggagagaaaauucugccaggauaaauccuccaggccaauuggacagaguacacauguuuauuuuuguuaaaauguuuuuugguuuuucccuaauauugggaauaacucaguauuaaaguucccuguaugggaaauguuuguuuuugauuguuuguuuuuucuuaauagugucaaugguucuucuauggaagaaaaaauuuagggcgagcuaaacuuacuaguauaaaacacaacauaaucaaggcauaaaguacuaagccagugcuguuuauauuuccaaagguauuuauuagucauucauucauuguauggaugauucuuauuggcugauucagauguagauaccuuaaagaaaauguuugaugaaauaaaaaggaauauugcauuguuggggauuguagauuguugcuaaagaaauacagggagggagggaguucuguuaaugacccaggaucuaggauaggucugugaggaauccaaccacggaaggcacagauuaagauugagauuguuuacaaacucuuggugacuuucaaaaguuaccgggagauaauaacuagcugcagcucacucuuggauuagcuacccaaacgcuaagucauuuauauucaaaccuuacaaggugauuaaacaguccaagaacauuauuggcugaggcugaaggagaauuggcucugguggagacauuauaggaaggaggcacauguggaucgcuugggucccagcugaauggaacuuuaguuauccugccugcuacucguucucccacagugauucuuauacacaaagaagaugauaucucagaaugggugcuuuuagcaaguaaguaguaaaaaauuaaaaccauauauaagaaggguuucuaaauuaauuauuaaagaagaaggagaaggaagaaggaagaagaaggaggagguggaaaaggaggaagaagaagaagaagaagaagaagaggaggaggaggaggaggaagaaaggggcuggagagauggcucagugauuaagagcacugcugcucuucuaaaguuucuugaguucaauucccagcaaccacacaguggcucacagccaucuguaaugggaucugaugcccucuucuggugugcagcagagcacucaaauaaaauuuggggcaagggacauucaaauuuauugaaaaacacaaugaaaaaaccaauguuuucauuuggguuacagcuaaauuuuucauucauuaaauuagguagcuaguaaaaucuaauaaauaaaaguuuuaaaaaagaaagaguuggacuuagucaauuuauaagaagagacuucacagagaugagugccuuauccugaugcugauauggccuaguuaugaguaaucacuaaaggcuggcaaagggcuugcaauaacauuuuggaagaaauuaacaacaaauacuccaaaagcaagcaacuucaguuuauaaaaagaacuaacuggauucuucuucuuuagucagagggacaccaauuucuaaagcuccuaccuuuuacacagaugccaauaaaucaggaauggcaggccauaaguuagagcuauaugcuauuuucacgguuuagcuguuccagaacuucuuaauauaaucaccgacuuucaacaugcagaaagaguuguuuugcauuuaaaaaaaaacuguuaaacuuauuccagaugauuaaaaauuaacuuuguuauuuauaaucaagcuucauuaccuacugaaaauaacccuaaagguacccaaagaaaugaaaucugguagauggauauguuucauuuuacagaguuuggauagaucugaccacacuuuaaaggaaaugcucaaaaaacaaaagggugauauaaggucacccagagauagauuaaauaaugcuuuauuaacuuaaaauuuuaaaaaacgucagugagacagcuagcauagcugcuggaggggaaaaagcacuggauuuuagaaaggacugcugcauugaaucauccuauacauguuaagaaugugugaaccucagacuggaagucaggaaguguguguaccggggaagagguuuugcucuuguuucaacaggaagcaaaaagcuguggauuccuucaaaauuaagauuagauuugaccaggaagaccuaaaaaucuucggacuugaaaaaaagagauccagaacucaacaggacagguggcauaauugcugacucccuccaugggagcagcucacagacugucugagaugugaaugacugcagaagccaauggaccuuccugacugcuuaagauuacaugucauccucuuauauggcauggacccaucauaccucauauggaugaagacuuacauuacaguuugguuacucaguccaaacugacugauaguugccuuuuaccugcgcaaacauagagccgagaaucaucauuugugcacacugcacauuccauacaugucuuaauacaaaaauguccauacaacauuaccuuuaaaaguuuguguguuuucagaacaaaaggaucaauggaagccuaucugggucccagccagaaaugucugauauaaccccaccaaccaagaagauggccugcaucucacugcugggucagggcaggaggagauggaggacacgccaucccaaccccugaucccguccccagcagaggagaaaacgagggccuuguguuguacugggggaggaaaguugcuuuuaguugcuugguuccuucccuucugugaccccauccuaguuauugagacccucuuuguccugggccccugccuuauucaauucguacagcaacagauaagcaacauuaccaggaccucccacaaauggaugccaauaucuaugaugauacugcuccuucauaaaaagagagagacacagacagacagacagagauguggggccagggugccauggcaccaggaggaacuggucuggagcaagaguaggguugaggcguguccaaaccccgggaaucucauccugagauccgcaggaguaggacuacucccccacuguccccggccugcaugucucagguacauaguccuggcccccuucuuugacccaccagaggaggucacagagucuguagccagguuaaauuuccucucuccuuauaaggucacauccagcaagcacuuggaaucuggaauuucuccuuauguaaaugaugcauccccagcacacuggcccugacuaaugauguacacucucucuaauauacccacaaagguuuaaacgcacacacacccuccugaccguuccugcuuugaucuccuuucaggaucuguccaguugcguggugaugacuaguggagcagagcuaggaacggcacuugaguuaaauuuaaaauagucuauacucaucuccuguccugauguacucuauuuauagguuuuaaccucuuuuugguggugauaggaugaagcauuguaugcccuggcuauccuggaacuccuucguagaucaagcuggccuugaauucacagagaaggcaugcaccaccaugcccagcuuuuguagcacuuuuaugauaggaaaaauggccuacuuaguaaauugcuugccuugaguuugauucccaaccucauauaaaaacugggugcauugacaaaucccaccauuuuggaggggagguaagagaacucccugggccucacuggguaacuggucuaaucaaauuggugaguuccagguucagugagaaaccuugacuccgaaaauaaggccucacacacuuuuaauuccacuacuuuagguuuaaguuaaauagcagaaggucuugggagauggcuaaauggaugauaucauagaggggaaauaacuuauauagauugcuuucugaccugcugugcaccagggcaguggcccauguguauauucacacauacagacaugagugaagucagugaaugaaugaacaaauagacgugugaagacaaaaccuuagcaggaaugcuacaugaauuauguguucucgguucacuacauuugguucacgucauuugagaugacagcuuaccucaaugugauguaggcauuggucuaauccuuagcacaccagucagaucuuuuggguuuuucugcuuuuuuuuuuucauuuuguaauaagugucuauaagugucuauuaauuucuuguucccaaggcauuuucacucauugauaacuugcauaguaguuauuaguuugguggaagaacauacccugaaaggaaggugacuuugugcuucagucacuugugcuucuguuuuguuugaccuuguucuuugaauggugcugucugucguugcugagugagacucugguuuggcagcagacacuugucacccagacuucauggccucacgugaucagucagucaugccaccuucauaagacacaucuuucucuuuggcuuucaugugucuacauucuucugcuagauaucucuaggccaucucaggacagucuccuuuucugacuugugcuuuccaggccuuaaaaaaguuacugagggugcuauccuuagcucaggcuuuacucacacauggaaagaaccuauuucuaagagcauagacuugccaguuuuauauccauccugguuuccuagauugcuuuuuauauaccuuguauagacuggcuugucuaccuucagaguaacaauuuucacgagaccugaugguguugccuuuuaucccagcacuugggagagaaaggcaaacagaucacugugaguuugaggauaguuuggucuauauagccagauccuguuuggggggugggggguggguggaguuaacaauuuuaaguagagugcuuuaaauucuuuuuacaauucuuuucugaagucucccugaaacacaccauguuagugucacacacuugcuccucuuacgggguucucuguuucuuaaguaggagccaccauguuggaaaacaucaaccugcucuucagccagcucuugauggcucucagcaccaugcucugauaucuuuuaacuuguagauccuucucacauccgugugcucccauggguauugaaaucauugugggccacuguuugcucugucgucucuuauauuuguuguugaugugcccuucccucuuuuucacauauuuugaaauuugauuagagggauacuuguuaaaaguuuuuaaaagacuguaaucucuuaaguauuaaaagcccaccuacguggaguaaaggauuuuacccagcuuuacaaagauaaagaugacaaauccaggguauauugcagaaauauuguucuguagucuuuuagucccacuucaaaguucagaguguuaggauucauguaguauaugauaggcaagccccugcugucuugugcucauuccagaucuuagugagccaacacuuucuuaaaugcuuaugcaauccuuuuuaaaaaaugauuauuggcauauuguagguagagauggaagauuuugaugcuaacauugaagaccagaaggaagaaaagaaagaugcagaagaagaggaaagcgaacugguaggagacagaccaaccacuuugagcaaagugucucuuuguuauucuuaaggaguguuauauucagaucuguaguuugauuauugguguuaauacacacucuuuacaguaaagcuuccguccucauccuccuggaggcuauguacgcucuuuauuuuucccuaguccaagaaaaaaauguuguuagggaaauuuuaagaguacuaagaaacucaucuuuguacucaucuaucugugggugguuguaagggaguagacuuuucaagaaaguaauuacauaugaaagggcuuuuuuccauuccagcagguaugugguauagccuacccaacauaugcauacucuuaccucuuugcuguaagaucucaaaacugaguucuguuaccuugaggcagaagaacuuacugaaugaagagccaaagggcugucacuggcugcuggauuuguucuuguucucucuuguuaaaugauggcaaaaaugacuguguaggcaauggauuuuuacccaggcugcugagauacuuaaugaugugaguuuaaaguucuguguaccuccuguaagugcauugauuacaccucuguggagauguuucccuuacucugucacucaagaaguaaaaccuauaaaauuacugaugcuucaguguuggcuaaugagguacauagauuaacaaugccuuuggaugguauugccuuuaaaauccacaguauugcuugguuuauuugacauuucagcucuugcuaaaguugcuucuccuuacuucucuuaaugaaaauguacacaccgagaucccugauuccuauucccuaaagcauagucuacaaggaguggucucuuuaaagccauguaugacauugaagauucgugguagaaauuguguuuauauagcauuggugucgaccucuacauuccuagaugucuuaaaauguggauuaaaagcuaagcuuuaaagguaaugauaauugagucucaguauguuuuuuaauagucucauuuuucuuaaucagguuucauuuugacauacaugauuuaaaaugugaggggaaauuuacauaaagacccacauuguucuuaacaguuaauaaccuuacuugcuacuuguagccaacauaggagagaugcacaguguuuuggcagcuccaucuuuguggcuuuuuuauuuuaucucacuuguuuaaauguagucaacuuggagccuaauuacauguacaauuaccuuuuaaagagaaacacguugcaacacuaguuuuacaucagagaacugguaaaggagccuuaaaauucuacucugcugaacuauuuauuuucaaguggccugcuacuuuaacagcagacggaugauaguuuuaagaaugaauaaagauaguuccagcagggguaaugaauucucuuuauuuuaaucuaaagcuucuuuaacccagucacauagcagaacccagcucuuuuauucuuggaaccuaucccaaggguaaaagauuccuggagaauauuaaccaauaugugaacgauaugucaauaaugugaacgaguuucgaguuuccugucauucaaaacaauuuaacagaaaucucaguaaacuuugcauuuucaguucuguacuggaugaaauccuuagagauuauuggugagauauaucccugccuuuagugcuucugcaaaccuaguccauaugauuuagaauauaaauacauaauuucagugauuagaguuuucagguguuucuagaucacacuuauacaaguuuucucgguauuuguaaacaccaucacuuuagcagagcuuuuucuugauuugaucuaaaguguuuuugggaaauauaauguaacuuauaaucugaaauacuaccuacuaauuccuaguucuggcguaaagacucacaguguauaaaccuaaagauuucuuggaguaagggugcucaagaaaacucuccuguagagauuguuccgcugucuccagcagcuuuuccaacucagcugggugucagucuguuuugugaccuugaacauucucuacaguagagaagaguacucauuuuaaagaaagaaagaaaagaaaaacaaaaaccuugaaucaauuggucugguuuacuaggcccuaauauuaauguuucuguauaauaggaucgauuugaaaacacagucuaaauaaaggaaaugggaguuauaauaaaugacauggaauaagcuggguaguagaauaaacauaguuauaggcacccugggacauuggaaaauguuuggggaguuuguuuaaguuacucaguucuaucuuauguaagcuguaaauugccugugguaauuucugguuuuaucacauacuaggaaauauaauauuacaagauaucagaaauaacuuaauuuucaucuggugaaacagaacugcucugaaguugauucaauaaaaucagccuuuguaugcucaaacugguacaugaauugagucauuuuaagugagugugagcuucauaaugcgguaguugggucaguuuuucuuuucaaguauuuaaagugacacugaaauaccaagugacugucuugaagaacacuuuuggacaucauggcuucaauuauuugagaauagcaguuguacuuugaaaguaccuagcuaguuuauaaauucucagaaugauauugauccuagcucaguaacuguauauucuuaccauaauuguuguccaucugcuguugaggguacaguugugaguccucaacugugcuuagcucaaagcgccuucaugauccuacccugaugacugaaaucugaagucugcaggaaaguuuggugaauuuggucacuuacuuucuucaaggaugauaaaguuguguuuuccauaggauauauuuguaacuauugagugggaacuaaauccagucccaguuuuaaugcuuuuccaauucaaacguguuaugcauguaugugucucuuucuaacccuucgagcuucucucuguguacgauuuaggguuacauuccgaaaagcaaaugggagauggacacuucugaggcaaagcuagguggguauugccuuuuuccuguuuuuauaugugauaccugaugguaauggucauagagcuuuucacugcacacagucaagggccggaaacuucugcuuaaagcaagauuuuggccaacccacauccuucagucaucucaccagcuucugcccuaacugcuuacaccugugacagguuaaaaagcauauugucuacaaaaaauacuuuugguaucauuggaaguuuuugggauaauuagaaauauuugauaagcauaauaccauacugucauuucugaaauucauuuuuuaguauuaaucagaaaugugucccuaacauuuuuuuaaaagauacuuaucuguaacccaaaguugagcuucuuugugaguacuuuaguaauaauuuuaauaaauauuuguguuuuuaaaaguaacugaaaauaccuuggguaauaaauuugguuucugugguaaggaaaggaaaguaaauauauaauucgaauauucaaggagacuccauuuaaauuuuccuucaggcugucuuuagugcuguguuacaagguuaaccuuuuaaaauaacuauuuaaaucaaaccuuugaguugcuugauuuagucaaguaaaaaacaaauuguaugaaauggauuucuucaggaucuuaguuugauauuguaagguaguguuuuuuggguuuuguuuuuuuuuuuuuauuuuuuuacuucacuuaaagagacugauuuaacaugucaauuaagaugugucaauaaaauguuaaggaagcaugccaugccaggccuucugauuaggaaaggugacucuuguauuucuucucuugcugguguacucuuacuccaaaaccaagcaaccaucuaauccuaaauuugcagaguuagucuggcuacucaggguauguguuuuauaucaaaggggauacauuguauacacacuugcaugggucaugccuuggauugugcccaagcacuuggguuagagauagcugguuuugacuagguuguauauuaaaagauaaguucacaagcucuauuauuguauuaugggaauagguguuugcuauaaagucuaaaaaguuuuagcgugugucaaaugaaaauuauuugugguuuauugauguauucaucuauuaaucuuucuugagagaaaucuuaauaauagucaacugucuccuuuccacauacuauagacauuuauuugcuuaaauacaguaaauauuuaagaaaaauaauagcuacaacuuccuuuuuaaaaagggugguguuuuauuuuugcuuguuuugaaagagguuagcccuguuugaaguugcguacuuuuaaaauaaccugugagacuguaagaugauuugauucugucagugcuuuauugauggcaaagaacaaucauaaaaauaagggaauugucagaauggugcauauuuuuaacaaauauucuuccagagccuuguguaauacaugauuugggauuuugcuuuuuuuaaaaaaaugccauuccauuuucuauuuuccuuucuaguuuuagaggagaaaagaaaauggaauauagccaugauagcuguuuaagaaaaacauuauuacuauuuguauucauuucugggaaauuugacuugucuacuauuuauuucucagaaaugugucuuauacagucugucaguuuugaagauauuacacaguaaauugcagaaauggauuugucauaaauccuuucagaaaugacacuaauggucuggugauaaaucuagaaaggggaauuuuuaauuaguuuuaaaaagagugagugauauuuuguauaauuacccggcaccuggcaccgcuggauuaucuugagaacuaauccagccuuggaaaaaagaaaauugacuauaagguuuaucaaagcauuuucuuugcgauugggccaguugggaauucucuucuaacucaugaggaucaucugagaauuaguguauuuguguugccuuucguaucacauugacuguuuggcuaccagguagagauugcuucccugaguacucugccagcguucguacauuucuuuuagcaaugugauuuugcuaaggugggaacacacuugagcuuuaccuguguggcauauugagcugagagagcugaaacuuggagcugaagaguucugaucauaggcgagucuucaguaagaaauacuucuguacucuuccaagcagauugucagaauucuuugcagaaucuugacuugugcuuaauauacaggucagcucgugucuguuaaauuggaagcagcaucaauccaaacaguuucagaaguggccugagcuguaucuaccaugguauuacagugugacuggcagcuaccugaccaguguuaguuacaccugacugcucuguccuaacugggagauagacauaguaauguacaaguuggguuuuacacauacccgcugggcuuuaguugugaagcuacuucaguugcagugaugugaggcuaguuucucacaccuguaagaccuagaguauuggagacugcuaccaucauaacggucucuccagagaaaguguucugcucuugccaucacuucuacucaccagacagacggaaucauccuuucacaguugagauguaauugucauuuauguagacacauaacucuuguauguucacuuggaaaauuuuucaaguaccauuuacauuuagaaaauaauagauguaucuauggaauuuuucuguugugcuauaguaauaugcagcauuuuaaagauguaguaaauucugugacugaccaaguuggaucaaaaauuucauccucuuaaaacuucaucuuuugcgacccaggccucuaaugugugaauggauuggacaccagucuuucuucuguaaccaacacccagaugccucuucccuuacuuuauaccaucugaguguuugggacucugguauuuguuggacgagguguucauccuuucuuccacacucaaagugaaacuugaaacaugaaugcacaauauaaucucaaaucaaggugcucugacuagaaaugcaggcucuggggcuucaaggagcaaauacccaaccuggccugugccuccugccaucaccuagaguacaaggaaauacucuugcagguuccgcccugccuuucuguauuucugccuggccaugugugcucuguuguuagaauugaaaugcgaaaccuucccuucagagaauguucacaccaagucgauuguacuaaguuugggaauccuuaaaguuauuuaaugaguguguuggagcuuauuauuucucuucucauaacacuguacauuguuggacuaaggucagcuuuauugcuuauggggugucuugaguuuucuguuaccauguucugugucccuguguagucaaggauccuguacaauauggccugucaguagagccauggaguacagcauuuaguuaacagaagagguagaagagguucuguggagccuaucaggaaauuuguugaaacaagaugauacaguuuuguaaauuacugucauuuacguuacugauuuuuucaguaauaauugcuuuugugagggaaggguaugggaacuaaaaccuuugccaguuaugcaaaaucguuacugcuuuucagaguuuguguacaguuaguugugugugggguuuguguauuugaaagcauggcuccuccuuccugacauugcuuccacugcaugcuccaugcagaacucucuccaacuuggugcuaaccauuucuaccucacacauucuucauccuuuacagagcugaagguuugcuaugugugucugaaacaguuaagcuuuccuuuauuagccuaccuaaacaauaguguguucagauaacuucagggggugcaagugcuucauugaaacucaaauguauauaacucauaauauuccacaucuguauuuagagucaauauuaaccaauaaaaaaagacaacacauucucauuguguauuauuuaaaacaccuaaucucgugucucaagauuucugaaugugcugcuuauuugauaauagugagcuauuaggaggccaacuucaaaaugcagaaagcaauaccagcucugguuacuugggcugacuugccagcuuuuagcaugggaagucagcagugcuuaucuguauagucaaagcacgggaguggccaucagugcuuuauauuacacucagagaguggggucacagucgucugcucaucaauguuaacucauggaugcuccuaggaaaucauaaucaaacacauccuuaaacuggaucuucauaugacacaucacacaucuuuguagaucaacugagugguguuaaugcugugguaaagaaaaaggcaauaauuguuuuuaaagagaccuguuuuucuuuuuuucagagcaugauaacucaagugugauuuuuuuucugagggugggaaccuaggagauaggaucuuuucuugcuuuguccauauuuauuacuaaaaccaucaaaauaaaaauaugacuacugguacaaacaccaaagagauggugggaaucacauaaaauuugauauuuucuuagccaagaagauagcuugaaucugaaaaugaugcugcauugaaaaauguggauaugcccucuggaaacaauccagcccuccuuuuccuuugugugucgugcaaauucccacacccuuaaugccauggcucuguguuugucccucagacaaguuggauggcuugaggacugguacuaaaaggaagcgagacugggaggcgauugccagcagaauggaggauuaccuucagcucccugacgacuacgagacucgcgcuucugagccugggaagaagaggguaggaggcuuuuguccuuaacuacugaagcaugaagcauuuggguuuuaaaaaguuggggauggagaaauggcuguccauaaaguguuugucaugcaaauauaagaacccaaauuuaggggcuagagagauggcucagcaguuaagagcaccaacugcucuucuaaaggcccugaguucaaaucccagcaaccauaugguggcucacaaccauccauagcaagaucugaagcccucuucuggagugucugaagacagcuucaguguguacuuacauauaauaaauaaauaagucuuuuuuuuuuuuuaacaaaaaaacgaaauuuagucucuuguucccaguaaaaaacaaaaagcgcuacaauuacagacauaccuacccuguuuuaacauagauaagucaguucuucagagcauauuuauuuuuguuuuauugguuugauuguuaaccuacauguauguuguauauaauauguacaugccuggugccugcagagaauagaaggaucaucauaucaccuagaucugaaguuacagauggauguaaucuaccauauacuugccaaaccaaaucaggguccucugcaagaacagcaagugcccuuaaauccugagucaucucucuaggcccucuguauuucuuucaauuuaauuuucuuagugcuugaauauaagacaacauuuuaguaugagagaauaaaacauauuaguagauuauuuuuaugguagauauuguuucaaagacuauauuuuaaagcucauugauauacugcagauaguaagauaugcuagcacaccuauaaccccauuacugaaaaggcagaagcaggugaauaucugugauucguggucagccuagccuacauagugaguuccaggucuguacugggaaauaaaaaaguucaaauacuaaaaacauaguauauaccuacucuugucuguauaguuugaggagauggggaagggaagucccagaaauggccuuaaaccuaugccuagacauacauaaggacuugaacacugaggccagcugacagaauuggcucaagcuaggugugggaaggcacccugcaaucuuaguaccuuggaaauaaaggcaggaugauuguccaugacuugaggccagccugggcugcagagugagacccagugucaaagaacaaaacagguugaacaguaggagugacucugcuuggggagugacuugaguuacaguuuuggugacggaauaauuugaaauggaaacuauuuuucucuauuuuuugcugaaauaacuaugacugucuucaaaaagugauucuauagaguuggucauauuagaaauuaccuaaaugacuagguuuuaaaauguaauuugugcuggugauauuacacaagaguuugagcacuagaaagggcagucucaaagcauuuaauacuacuucaaaggguuagaaagugauugaucuucaagaaauuuuaaguuucuuagaauuuuuuuuuuuuuuuuuuuacaauuaagugacccucuccaucaaaauaaugacaugauguuguaaaucucagaaguaucuuuaggaaaauuagaaggaacuugaacauuuugauuuuucuagacaugguuucucugcguaguccuggcuguccugaaacucaaggacaccuagaaccccugggauacgacacccagcaauuaaaaaagaaaaaaaaaucaugguaauuuaugcagcgugcgugaaugugugcagaugguuagacuuuguggcaggcacuuucacccauugucuuaguuaggguuucuauugcuauaauaaaauacccuuaaaaaaaguaaugugaggaaaggccaggggcuuuccucuccuggaaugcucagcucacacuccagccacugacugaggucagggcagggaccuggagacacgaagcaaagcagaaauuauggagggagcugcuuccuggcucccccugcucagccugcuuuuguucacaacucaggaccacuugcccaaggugacgucucuggguccacccacaucaacccuaaucaaaaaaauacuucacagacuugcccauagaccagucugguaggguuaauuuucucaguccagguucccucuuuccaaaugauucuaguucugucaaguugacaagacaacaacaaaaaacuagccagcauagccaucucagugaccacuaaaaucaguguuuucuucuaaaauaguaauaauaaauaaaaauuaauuuucuguuuucagagucuaaacuuuagauucaaaaguagcaggauauggggcuagagggauggcucagcaguucagagcacuugcuucucuugaagaggacccaaguuggguuccuaauaccaugguggcuuacaacugucuuaauuccaguuccagggaaucugaugcccucuucuggcaagggauacugcaaacaucagcugcacguacaggcagaucacccauacacaguacagaaaauaaaucuuuaaaagacuagcugaauacagugacuuagucuacuuaaccaugcggaugcucugugcauuuuaaauugacugugagcugaauuaacuuuuucuucauucaguggucacugaauaucugcccauccauccuguaucacuuaacacuaguaauauuucaauaaauguguacccuugauccuaaguggaacuaagaguagguaugaauuacuuauagugcauauuuuuuugauauaaagcucaaugauaagacacuuaccuagcaugugcaaagcccuggguucaaucuccaauaccaccaaaaaaaaggggggggguggagagauagauuuucaugcguauuugaaauucccaggagggagaaagccacauuuguuaaagauucccaccaguauaucugaaaauagaguauauaguuuacuuuuuguuuugugccuguaaaacgugaugaaacugcuuccacauuggagcaugcuauuugguacaacuguaaucuguguucccaggccauggucacucauauuuggcucaagaauaaaguauuuaagaagagucaagugugggacuagggagauggcuuggaugaagugcuugccgagcaagugugagaaccagagcucagaccccagaucagaagucaggugggugugcuggccugccuguaacccagcuuccucuggaggacaacgccagggaucgccugcuagccuccacacuggccugugcccugcaccagugcacauguguacauguacagccaaaggcgaaauaaagucagguguuaaccauuuuucccuacugcggcucuguuucccucugaccaguuguuagaagccuaagcauuucacggucagucuugcagcuguuaagaaggaaagucaguauaccuuaaagcgguaaugcacuuccauggccaauguaaagagcacagaauuucaguguuuuauauuugggacauaaaaaaaucacaagccguauuuacaauauagcauauuaaaauauagucuaugcuuugguacuauaugugcaguacagguaacaguaucauaaucucuccuauuuuuugcucuuaaagaauaugagggggcuggugagauggcucaguggguaagagcacccgacugcucuuccaaaggucugaaguucaaaucccagcaaccacauggcucacaaccacccguaaugagaucugaugcccucuucuggcgcgucugaagacagcuacaguguacuuacauauaauaaauaaauaaaucuuuaaaaaaaaaaaagaaaucauuugaagcagggagacccacuuuaaaaaaaaauaaagaauaugagauauaugcauguauuuuaaguauaaauccaccuuuuuaaaguacccauaggaaauacuccugaaccugcacuugaaaccuuaccauaguaacauuugaagcaguggucucuguaguuuaggaaugaaaauaacacuacuagcccccuguuuuuuucucugguuaaauuucaagcaauaguuauuguacaaagauaaagcuuuguccuugaucuaaguguaagcuuuguccuugaucuauaguauauguuucuauuuacauaaacauagucaucaggcaauauggaaauucaaaaguagguaugucaggcuccaaacaagccuggggaggcaaugguuaauugcaaaggauaaaguggggaaggaugucuacgcugacaccaaguagacagggcucagagcuguaaaaugggagacagaggagaguguuuagcucacauagaaugccuuuggcgcuggccagagaugacguggagccgauaggaugugucaagagaccuuuagugguagggcucugucuuauaauuaugggaacguuuugaaacagguaagagucacaacuguguauuuuaaggucacuuuggcggagaaugaaaacaguuuuuuugacuucuuguaauuuuaagucaguuaaucuacccaaauaauaauaacauauuauccaaagagguugccuuugggguucccucccucaaacagcccagucuaaugcuuuuuucucuuuaggugagaugggcagaccuagaagaaaagaaggaugcagauaggaaaagggccauagguuuuguggucggacagacugauugggagaagaucacagaugagaguggucaccuggcugaaagagcccucaaucggaccaaauauauaugagacuuaguuuugaauggagucauguuccucuaagguaagggcacccaggcauagaaaucgccugucaugugguugcuuccaagguacugaggacagcauacuuuacuaaaaaugauuuuucuagcucugaacaaguaaguaugugcuaguacaauaacauuugcaauacagaaaagaaagcagcuauuuguaacccagcucacuuguaaaagacuuaagagagcuuggguucugugucccuagggaagauggagucaugcuaugacagaugcugaggucugcuaagucgucuguguuccuuuccuuuccuggagugaccccguuuucuucucuuuccaggugguucgaugugaggcgaccugaagcucagcccucgggaagcuucuugugucuggaagcuucuugugucuccacguuucaauuuuguuuuguuuuaccacuuucauuuuuaaacguuuuccaguaucccccccaaaauuuuagaaucuugcuauauccaagcaagacauuauuaauauuuuuuuuaaacuaauuuggggagggaggguuagcuuaagugcuaagucagguguggauccacaggaggguuccaacagaguguuuccuccacuguauacugucacagacuaucaucauugcuuuguggcugguuuuguuuuuuuacuguauguaacaaguagcugauuguacuuggauaaaaaacaauaaacuuucacuauaaagccaaugagauucauaggcuguacaguaugggcccuuuucucuuauuuucuuacauuuauuuuuauuguuaauuaaaugcaguauguccugcuugcugaccacccccaaaccaccucuuuacuauugaauauuagcacagcuguuugguagcacauuguaaaacuccaugauugcaaaguguccagugaugaccaaaacauucaacuuuauagauggaguucucuuucuuugugucuuaaagacuaacagaaucaagucuaaauauccaucaauuuucugagacaucucucucucucucucucucccucucucucucucucucucucccucccucccuccccccucaggagggggaaauacgguguuaccucuuuauucuuccuuucucuuugugcuaccuuguuugauuuccucccucuccccccccccccuuuagcugguuuuaaauacaggugaacagaaaugauacauuccauagaacucaaguuguugccuuguuuugaacuugaaucguugcuuucuaagacaggaucaugguaaaggaguaugaaaagucuccagcccucuggcaagcagucuuugagccuggccagcuuuucaggcucuugccagauugcucauuauuguaaaacuuggccuucagcauagaauuucaucuccuguggauaaucccacucagaacccagaagcagagcuuacauccagauaacauucuuccuuaaguauagaaaggaggugcuugcuuuuuaucagucuucacagauagagaugaacuuucuuccucaaacacuauuucuugguggcaagccagcucaacaacuugggaacauguuaacagaugaccucagcauuaugucaugguuggaaaucuuuaguuuuucaaucuacauuaaauacugugcuuggagcuaauauuucuuagcaguucaggaguguuacuuuggguucaguaaugaccuucucagacugaaggcacuaaucguaacaucuuccuguacuuuucccucaaauucugaauguuuaugccuaaaagacuagguucauuaacaaguuaauauugaauguauaauuugcuuaauuuaaugauuugcacuguuuguaauguuuaauaaucuauuuugguggcuaaggacuguaaucuauuucugcauauggauccaucuuagcuaccuuuauuauacuggaaaauguuacaugguaagauagccaaauagagcuauuguuuguacaaagacucauuuaacacuuaucuuuucuuacuaaaguaagacuuguaaaguuauuuuccugcuugagaagaaaagaaggccucuuuguuccucaccuuuaaccuuuguguagcauuugaaacacccgagagaugaguguugguuacccacgaaucaugggucucagcaucgucagccauggccuguggcaguuuucagaaaguaguuagaggagccacagucaagagcugccugcuuucagaaguggguucaucuacagagagucagaaaaaagaaccagaaagcaguaaggaagauaaccaauuaauacuugauucuacaaggccaguaggaaacucuuaagaaauccuaauuuuuauuaucaccuaaaccaacagaauagaaggucaagugguaucuuggggaguuuuggguuggguaaacauuuuguagugagucaacucuucuuaguuacaguacaaaccuagagucuguguguuugcagauuuauuacuguuaucuuucuuauuucagaaagcaauccgguauuauuuugcauuuguauuuaaaucauuuuaguugugguuucuuuuaucuggcuggauuuauuucacuuauggcagaaagagcaagucaaagaccccauccagaguauugacuauacauuuuaaauugaacuaauaguuuuccacuuggguuuccuugguuuggagccacuuggaguuuguguuaaauguuuuauccugguaaccacaaguuacagguauuuguuaaugggcgucuagagcugggcuaggacuauaaaggcagcaaguucucaggagcagacuggcagaucuuagaauuuuagcugaaguguuaaagcaggcuaaggaaggggaaugauuccuuguuuuuguauugauagauugucauacaaacucuguuccucucucagaaccuaugugaccucaagugacucuuaacuuucugaacaccaguuucaucuguagauaugaaaauggaauuauaaaugccuuuuugccuaauacggaucauaguaaaacacaccucacuauucugaggauaaaauuggacuauuaugcucugcugcugucauaggacccagccacaaaguaaaagauaaaaaucaguagucgugcaugauacaggccuuuaaucccuggcagagacaaguagaucccuguguuuucaaggacagcuugcucuccacagagaagccuugucuuggaaaacagaaacaaaacaaaaagcaaaucaguaguaaauuacuuaacuuuuucucggaugcuucugaaacucuuacuucccagcuguccuaaagagaguucugccaccguauagcugcuauagauugagcugagccauggaaacagugcagggugugaggagguggaagaguugaaagcaucuguaggaagcugguggccuauccucaggaccagcguggaagcuugaggggcuc

SEQ ID NO: 6752 - RNA, 76842 nt, Mus musculus
gagccccucaagcuuccacgcugguccugaggauaggccaccagcuuccuacagaugcuuucaacucuuccaccuccucacacccugcacuguuuccauggcucagcucaaucuauagcagcuauacgguggcagaacucucuuuaggacagcugggaaguaagaguuucagaagcauccgagaaaaaguuaaguaauuuacuacugauuugcuuuuuguuuuguuucuguuuuccaagacaaggcuucucuguggagagcaagcuguccuugaaaacacagggaucuacuugucucugccagggauuaaaggccuguaucaugcacgacuacugauuuuuaucuuuuacuuuguggcuggguccuaugacagcagcagagcauaauaguccaauuuuauccucagaauagugagguguguuuuacuaugauccguauuaggcaaaaaggcauuuauaauuccauuuucauaucuacagaugaaacugguguucagaaaguuaagagucacuugaggucacauagguucugagagaggaacagaguuuguaugacaaucuaucaauacaaaaacaaggaaucauuccccuuccuuagccugcuuuaacacuucagcuaaaauucuaagaucugccagucugcuccugagaacuugcugccuuuauaguccuagcccagcucuagacgcccauuaacaaauaccuguaacuugugguuaccaggauaaaacauuuaacacaaacuccaaguggcuccaaaccaaggaaacccaaguggaaaacuauuaguucaauuuaaaauguauagucaauacucuggauggggucuuugacuugcucuuucugccauaagugaaauaaauccagccagauaaaagaaaccacaacuaaaaugauuuaaauacaaaugcaaaauaauaccggauugcuuucugaaauaagaaagauaacaguaauaaaucugcaaacacacagacucuagguuuguacuguaacuaagaagaguugacucacuacaaaauguuuacccaacccaaaacuccccaagauaccacuugaccuucuauucuguugguuuaggugauaauaaaaauuaggauuucuuaagaguuuccuacuggccuuguagaaucaaguauuaauugguuaucuuccuuacugcuuucugguucuuuuuucugacucucuguagaugaacccacuucugaaagcaggcagcucuugacuguggcuccucuaacuacuuucugaaaacugccacaggccauggcugacgaugcugagacccaugauucguggguaaccaacacucaucucucggguguuucaaaugcuacacaaagguuaaaggugaggaacaaagaggccuucuuuucuucucaagcaggaaaauaacuuuacaagucuuacuuuaguaagaaaagauaaguguuaaaugagucuuuguacaaacaauagcucuauuuggcuaucuuaccauguaacauuuuccaguauaauaaagguagcuaagauggauccauaugcagaaauagauuacaguccuuagccaccaaaauagauuauuaaacauuacaaacagugcaaaucauuaaauuaagcaaauuauacauucaauauuaacuuguuaaugaaccuagucuuuuaggcauaaacauucagaauuugagggaaaaguacaggaagauguuacgauuagugccuucagucugagaaggucauuacugaacccaaaguaacacuccugaacugcuaagaaauauuagcuccaagcacaguauuuaauguagauugaaaaacuaaagauuuccaaccaugacauaaugcugaggucaucuguuaacauguucccaaguuguugagcuggcuugccaccaagaaauaguguuugaggaagaaaguucaucucuaucugugaagacugauaaaaagcaagcaccuccuuucuauacuuaaggaagaauguuaucuggauguaagcucugcuucuggguucugagugggauuauccacaggagaugaaauucuaugcugaaggccaaguuuuacaauaaugagcaaucuggcaagagccugaaaagcuggccaggcucaaagacugcuugccagagggcuggagacuuuucauacuccuuuaccaugauccugucuuagaaagcaacgauucaaguucaaaacaaggcaacaacuugaguucuauggaauguaucauuucuguucaccuguauuuaaaaccagcuaaaggggggggggggagagggaggaaaucaaacaagguagcacaaagagaaaggaagaauaaagagguaacaccguauuucccccuccugaggggggagggagggagggagagagagagagagagagagggagagagagagagagagagaugucucagaaaauugauggauauuuagacuugauucuguuagucuuuaagacacaaagaaagagaacuccaucuauaaaguugaauguuuuggucaucacuggacacuuugcaaucauggaguuuuacaaugugcuaccaaacagcugugcuaauauucaauaguaaagaggugguuuggggguggucagcaagcaggacauacugcauuuaauuaacaauaaaaauaaauguaagaaaauaagagaaaagggcccauacuguacagccuaugaaucucauuggcuuuauagugaaaguuuauuguuuuuuauccaaguacaaucagcuacuuguuacauacaguaaaaaaacaaaaccagccacaaagcaaugaugauagucugugacaguauacaguggaggaaacacucuguuggaacccuccuguggauccacaccugacuuagcacuuaagcuaacccucccuccccaaauuaguuuaaaaaaaauauuaauaaugucuugcuuggauauagcaagauucuaaaauuuugggggggauacuggaaaacguuuaaaaaugaaagugguaaaacaaaacaaaauugaaacguggagacacaagaagcuuccagacacaagaagcuucccgagggcugagcuucaggucgccucacaucgaaccaccuggaaagagaagaaaacggggucacuccaggaaaggaaaggaacacagacgacuuagcagaccucagcaucugucauagcaugacuccaucuucccuagggacacagaacccaagcucucuuaagucuuuuacaagugagcuggguuacaaauagcugcuuucuuuucuguauugcaaauguuauuguacuagcacauacuuacuuguucagagcuagaaaaaucauuuuuaguaaaguaugcuguccucaguaccuuggaagcaaccacaugacaggcgauuucuaugccugggugcccuuaccuuagaggaacaugacuccauucaaaacuaagucucauauauauuugguccgauugagggcucuuucagccaggugaccacucucaucugugaucuucucccaaucagucuguccgaccacaaaaccuauggcccuuuuccuaucugcauccuucuuuucuucuaggucugcccaucucaccuaaagagaaaaaagcauuagacugggcuguuugagggagggaaccccaaaggcaaccucuuuggauaauauguuauuauuauuuggguagauuaacugacuuaaaauuacaagaagucaaaaaaacuguuuucauucuccgccaaagugaccuuaaaauacacaguugugacucuuaccuguuucaaaacguucccauaauuauaagacagagcccuaccacuaaaggucucuugacacauccuaucggcuccacgucaucucuggccagcgccaaaggcauucuaugugagcuaaacacucuccucugucucccauuuuacagcucugagcccugucuacuuggugucagcguagacauccuuccccacuuuauccuuugcaauuaaccauugccuccccaggcuuguuuggagccugacauaccuacuuuugaauuuccauauugccugaugacuauguuuauguaaauagaaacauauacuauagaucaaggacaaagcuuacacuuagaucaaggacaaagcuuuaucuuuguacaauaacuauugcuugaaauuuaaccagagaaaaaaacagggggcuaguaguguuauuuucauuccuaaacuacagagaccacugcuucaaauguuacuaugguaagguuucaagugcagguucaggaguauuuccuauggguacuuuaaaaagguggauuuauacuuaaaauacaugcauauaucucauauucuuuauuuuuuuuuaaagugggucucccugcuucaaaugauuucuuuuuuuuuuuuaaagauuuauuuauuuauuauauguaaguacacuguagcugucuucagacgcgccagaagagggcaucagaucucauuacgggugguugugagccaugugguugcugggauuugaacuucagaccuuuggaagagcagucgggugcucuuacccacugagccaucucaccagcccccucauauucuuuaagagcaaaaaauaggagagauuaugauacuguuaccuguacugcacauauaguaccaaagcauagacuauauuuuaauaugcuauauuguaaauacggcuugugauuuuuuuaugucccaaauauaaaacacugaaauucugugcucuuuacauuggccauggaagugcauuaccgcuuuaagguauacugacuuuccuucuuaacagcugcaagacugaccgugaaaugcuuaggcuucuaacaacuggucagagggaaacagagccgcaguagggaaaaaugguuaacaccugacuuuauuucgccuuuggcuguacauguacacaugugcacuggugcagggcacaggccaguguggaggcuagcaggcgaucccuggcguuguccuccagaggaagcuggguuacaggcaggccagcacacccaccugacuucugaucuggggucugagcucugguucucacacuugcucggcaagcacuucauccaagccaucucccuagucccacacuugacucuucuuaaauacuuuauucuugagccaaauaugagugaccauggccugggaacacagauuacaguuguaccaaauagcaugcuccaauguggaagcaguuucaucacguuuuacaggcacaaaacaaaaaguaaacuauauacucuauuuucagauauacuggugggaaucuuuaacaaauguggcuuucucccuccugggaauuucaaauacgcaugaaaaucuaucucuccacccccccccuuuuuuuuggugguauuggagauugaacccagggcuuugcacaugcuagguaagugucuuaucauugagcuuuauaucaaaaaaauaugcacuauaaguaauucauaccuacucuuaguuccacuuaggaucaaggguacacauuuauugaaauauuacuaguguuaagugauacaggauggaugggcagauauucagugaccacugaaugaagaaaaaguuaauucagcucacagucaauuuaaaaugcacagagcauccgcaugguuaaguagacuaagucacuguauucagcuagucuuuuaaagauuuauuuucuguacuguguaugggugaucugccuguacgugcagcugauguuugcaguaucccuugccagaagagggcaucagauucccuggaacuggaauuaagacaguuguaagccaccaugguauuaggaacccaacuuggguccucuucaagagaagcaagugcucugaacugcugagccaucccucuagccccauauccugcuacuuuugaaucuaaaguuuagacucugaaaacagaaaauuaauuuuuauuuauuauuacuauuuuagaagaaaacacugauuuuaguggucacugagauggcuaugcuggcuaguuuuuuguuguugucuugucaacuugacagaacuagaaucauuuggaaagagggaaccuggacugagaaaauuaacccuaccagacuggucuaugggcaagucugugaaguauuuuuuugauuaggguugauguggguggacccagagacgucaccuugggcaagugguccugaguugugaacaaaagcaggcugagcagggggagccaggaagcagcucccuccauaauuucugcuuugcuucgugucuccaggucccugcccugaccucagucaguggcuggagugugagcugagcauuccaggagaggaaagccccuggccuuuccucacauuacuuuuuuuaaggguauuuuauuauagcaauagaaacccuaacuaagacaaugggugaaagugccugccacaaagucuaaccaucugcacacauucacgcacgcugcauaaauuaccaugauuuuuuuuucuuuuuuaauugcugggugucguaucccagggguucuagguguccuugaguuucaggacagccaggacuacgcagagaaaccaugucuagaaaaaucaaaauguucaaguuccuucuaauuuuccuaaagauacuucugagauuuacaacaucaugucauuauuuugauggagagggucacuuaauuguaaaaaaaaaaaaaaaaaaauucuaagaaacuuaaaauuucuugaagaucaaucacuuucuaacccuuugaaguaguauuaaaugcuuugagacugcccuuucuagugcucaaacucuuguguaauaucaccagcacaaauuacauuuuaaaaccuagucauuuagguaauuucuaauaugaccaacucuauagaaucacuuuuugaagacagucauaguuauuucagcaaaaaauagagaaaaauaguuuccauuucaaauuauuccgucaccaaaacuguaacucaagucacuccccaagcagagucacuccuacuguucaaccuguuuuguucuuugacacugggucucacucugcagcccaggcuggccucaagucauggacaaucauccugccuuuauuuccaagguacuaagauugcagggugccuucccacaccuagcuugagccaauucugucagcuggccucaguguucaaguccuuauguaugucuaggcauagguuuaaggccauuucugggacuucccuuccccaucuccucaaacuauacagacaagaguagguauauacuauguuuuuaguauuugaacuuuuuuauuucccaguacagaccuggaacucacuauguaggcuaggcugaccacgaaucacagauauucaccugcuucugccuuuucaguaaugggguuauaggugugcuagcauaucuuacuaucugcaguauaucaaugagcuuuaaaauauagucuuugaaacaauaucuaccauaaaaauaaucuacuaauauguuuuauucucucauacuaaaauguugucuuauauucaagcacuaagaaaauuaaauugaaagaaauacagagggccuagagagaugacucaggauuuaagggcacuugcuguucuugcagaggacccugauuugguuuggcaaguauaugguagauuacauccaucuguaacuucagaucuaggugauaugaugauccuucuauucucugcaggcaccaggcauguacauauuauauacaacauacauguagguuaacaaucaaaccaauaaaacaaaaauaaauaugcucugaagaacugacuuaucuauguuaaaacaggguagguaugucuguaauuguagcgcuuuuuguuuuuuacugggaacaagagacuaaauuucguuuuuuuguuaaaaaaaaaaaaagacuuauuuauuuauuauauguaaguacacacugaagcugucuucagacacuccagaagagggcuucagaucuugcuauggaugguugugagccaccauaugguugcugggauuugaacucagggccuuuagaagagcaguuggugcucuuaacugcugagccaucucucuagccccuaaauuuggguucuuauauuugcaugacaaacacuuuauggacagccauuucuccauccccaacuuuuuaaaacccaaaugcuucaugcuucaguaguuaaggacaaaagccuccuacccucuucuucccaggcucagaagcgcgagucucguagucgucagggagcugaagguaauccuccauucugcuggcaaucgccucccagucucgcuuccuuuuaguaccaguccucaagccauccaacuugucugagggacaaacacagagccauggcauuaagggugugggaauuugcacgacacacaaaggaaaaggagggcuggauuguuuccagagggcauauccacauuuuucaaugcagcaucauuuucagauucaagcuaucuucuuggcuaagaaaauaucaaauuuuaugugauucccaccaucucuuugguguuuguaccaguagucauauuuuuauuuugaugguuuuaguaauaaauauggacaaagcaagaaaagauccuaucuccuagguucccacccucagaaaaaaaaucacacuugaguuaucaugcucugaaaaaaagaaaaacaggucucuuuaaaaacaauuauugccuuuuucuuuaccacagcauuaacaccacucaguugaucuacaaagaugugugaugugucauaugaagauccaguuuaaggauguguuugauuaugauuuccuaggagcauccaugaguuaacauugaugagcagacgacugugaccccacucucugaguguaauauaaagcacugauggccacucccgugcuuugacuauacagauaagcacugcugacuucccaugcuaaaagcuggcaagucagcccaaguaaccagagcugguauugcuuucugcauuuugaaguuggccuccuaauagcucacuauuaucaaauaagcagcacauucagaaaucuugagacacgagauuagguguuuuaaauaauacacaaugagaauguguugucuuuuuuuauugguuaauauugacucuaaauacagauguggaauauuaugaguuauauacauuugaguuucaaugaagcacuugcacccccugaaguuaucugaacacacuauuguuuagguaggcuaauaaaggaaagcuuaacuguuucagacacacauagcaaaccuucagcucuguaaaggaugaagaaugugugagguagaaaugguuagcaccaaguuggagagaguucugcauggagcaugcaguggaagcaaugucaggaaggaggagccaugcuuucaaauacacaaaccccacacacaacuaacuguacacaaacucugaaaagcaguaacgauuuugcauaacuggcaaagguuuuaguucccauacccuucccucacaaaagcaauuauuacugaaaaaaucaguaacguaaaugacaguaauuuacaaaacuguaucaucuuguuucaacaaauuuccugauaggcuccacagaaccucuucuaccucuucuguuaacuaaaugcuguacuccauggcucuacugacaggccauauuguacaggauccuugacuacacagggacacagaacaugguaacagaaaacucaagacaccccauaagcaauaaagcugaccuuaguccaacaauguacaguguuaugagaagagaaauaauaagcuccaacacacucauuaaauaacuuuaaggauucccaaacuuaguacaaucgacuuggugugaacauucucugaagggaagguuucgcauuucaauucuaacaacagagcacacauggccaggcagaaauacagaaaggcagggcggaaccugcaagaguauuuccuuguacucuaggugauggcaggaggcacaggccagguuggguauuugcuccuugaagccccagagccugcauuucuagucagagcaccuugauuugagauuauauugugcauucauguuucaaguuucacuuugaguguggaagaaaggaugaacaccucguccaacaaauaccagagucccaaacacucagaugguauaaaguaagggaagaggcaucuggguguugguuacagaagaaagacugguguccaauccauucacacauuagaggccugggucgcaaaagaugaaguuuuaagaggaugaaauuuuugauccaacuuggucagucacagaauuuacuacaucuuuaaaaugcugcauauuacuauagcacaacagaaaaauuccauagauacaucuauuauuuucuaaauguaaaugguacuugaaaaauuuuccaagugaacauacaagaguuaugugucuacauaaaugacaauuacaucucaacugugaaaggaugauuccgucugucuggugaguagaagugauggcaagagcagaacacuuucucuggagagaccguuaugaugguagcagucuccaauacucuaggucuuacaggugugagaaacuagccucacaucacugcaacugaaguagcuucacaacuaaagcccagcggguauguguaaaacccaacuuguacauuacuaugucuaucucccaguuaggacagagcagucagguguaacuaacacuggucagguagcugccagucacacuguaauaccaugguagauacagcucaggccacuucugaaacuguuuggauugaugcugcuuccaauuuaacagacacgagcugaccuguauauuaagcacaagucaagauucugcaaagaauucugacaaucugcuuggaagaguacagaaguauuucuuacugaagacucgccuaugaucagaacucuucagcuccaaguuucagcucucucagcucaauaugccacacagguaaagcucaaguguguucccaccuuagcaaaaucacauugcuaaaagaaauguacgaacgcuggcagaguacucagggaagcaaucucuaccugguagccaaacagucaaugugauacgaaaggcaacacaaauacacuaauucucagaugauccucaugaguuagaagagaauucccaacuggcccaaucgcaaagaaaaugcuuugauaaaccuuauagucaauuuucuuuuuuccaaggcuggauuaguucucaagauaauccagcggugccaggugccggguaauuauacaaaauaucacucacucuuuuuaaaacuaauuaaaaauuccccuuucuagauuuaucaccagaccauuagugucauuucugaaaggauuuaugacaaauccauuucugcaauuuacuguguaauaucuucaaaacugacagacuguauaagacacauuucugagaaauaaauaguagacaagucaaauuucccagaaaugaauacaaauaguaauaauguuuuucuuaaacagcuaucauggcuauauuccauuuucuuuucuccucuaaaacuagaaaggaaaauagaaaauggaauggcauuuuuuuaaaaaaagcaaaaucccaaaucauguauuacacaaggcucuggaagaauauuuguuaaaaauaugcaccauucugacaauucccuuauuuuuaugauuguucuuugccaucaauaaagcacugacagaaucaaaucaucuuacagucucacagguuauuuuaaaaguacgcaacuucaaacagggcuaaccucuuucaaaacaagcaaaaauaaaacaccacccuuuuuaaaaaggaaguuguagcuauuauuuuucuuaaauauuuacuguauuuaagcaaauaaaugucuauaguauguggaaaggagacaguugacuauuauuaagauuucucucaagaaagauuaauagaugaauacaucaauaaaccacaaauaauuuucauuugacacacgcuaaaacuuuuuagacuuuauagcaaacaccuauucccauaauacaauaauagagcuugugaacuuaucuuuuaauauacaaccuagucaaaaccagcuaucucuaacccaagugcuugggcacaauccaaggcaugacccaugcaaguguguauacaauguauccccuuugauauaaaacacauacccugaguagccagacuaacucugcaaauuuaggauuagaugguugcuugguuuuggaguaagaguacaccagcaagagaagaaauacaagagucaccuuuccuaaucagaaggccuggcauggcaugcuuccuuaacauuuuauugacacaucuuaauugacauguuaaaucagucucuuuaagugaaguaaaaaaauaaaaaaaaaaaaacaaaacccaaaaaacacuaccuuacaauaucaaacuaagauccugaagaaauccauuucauacaauuuguuuuuuacuugacuaaaucaagcaacucaaagguuugauuuaaauaguuauuuuaaaagguuaaccuuguaacacagcacuaaagacagccugaaggaaaauuuaaauggagucuccuugaauauucgaauuauauauuuacuuuccuuuccuuaccacagaaaccaaauuuauuacccaagguauuuucaguuacuuuuaaaaacacaaauauuuauuaaaauuauuacuaaaguacucacaaagaagcucaacuuuggguuacagauaaguaucuuuuaaaaaaauguuagggacacauuucugauuaauacuaaaaaaugaauuucagaaaugacaguaugguauuaugcuuaucaaauauuucuaauuaucccaaaaacuuccaaugauaccaaaaguauuuuuuguagacaauaugcuuuuuaaccugucacagguguaagcaguuagggcagaagcuggugagaugacugaaggauguggguuggccaaaaucuugcuuuaagcagaaguuuccggcccuugacugugugcagugaaaagcucuaugaccauuaccaucagguaucacauauaaaaacaggaaaaaggcaauacccaccuagcuuugccucagaaguguccaucucccauuugcuuuucggaauguaacccuaaaucguacacagagagaagcucgaaggguuagaaagagacacauacaugcauaacacguuugaauuggaaaagcauuaaaacugggacuggauuuaguucccacucaauaguuacaaauauauccuauggaaaacacaacuuuaucauccuugaagaaaguaagugaccaaauucaccaaacuuuccugcagacuucagauuucagucaucaggguaggaucaugaaggcgcuuugagcuaagcacaguugaggacucacaacuguacccucaacagcagauggacaacaauuaugguaagaauauacaguuacugagcuaggaucaauaucauucugagaauuuauaaacuagcuagguacuuucaaaguacaacugcuauucucaaauaauugaagccaugauguccaaaaguguucuucaagacagucacuugguauuucagugucacuuuaaauacuugaaaagaaaaacugacccaacuaccgcauuaugaagcucacacucacuuaaaaugacucaauucauguaccaguuugagcauacaaaggcugauuuuauugaaucaacuucagagcaguucuguuucaccagaugaaaauuaaguuauuucugauaucuuguaauauuauauuuccuaguaugugauaaaaccagaaauuaccacaggcaauuuacagcuuacauaagauagaacugaguaacuuaaacaaacuccccaaacauuuuccaaugucccagggugccuauaacuauguuuauucuacuacccagcuuauuccaugucauuuauuauaacucccauuuccuuuauuuagacuguguuuucaaaucgauccuauuauacagaaacauuaauauuagggccuaguaaaccagaccaauugauucaagguuuuuguuuuucuuuucuuucuuucuuuaaaaugaguacucuucucuacuguagagaauguucaaggucacaaaacagacugacacccagcugaguuggaaaagcugcuggagacagcggaacaaucucuacaggagaguuuucuugagcacccuuacuccaagaaaucuuuagguuuauacacugugagucuuuacgccagaacuaggaauuaguagguaguauuucagauuauaaguuacauuauauuucccaaaaacacuuuagaucaaaucaagaaaaagcucugcuaaagugaugguguuuacaaauaccgagaaaacuuguauaagugugaucuagaaacaccugaaaacucuaaucacugaaauuauguauuuauauucuaaaucauauggacuagguuugcagaagcacuaaaggcagggauauaucucaccaauaaucucuaaggauuucauccaguacagaacugaaaaugcaaaguuuacugagauuucuguuaaauuguuuugaaugacaggaaacucgaaacucguucacauuauugacauaucguucacauauugguuaauauucuccaggaaucuuuuacccuugggauagguuccaagaauaaaagagcuggguucugcuaugugacuggguuaaagaagcuuuagauuaaaauaaagagaauucauuaccccugcuggaacuaucuuuauucauucuuaaaacuaucauccgucugcuguuaaaguagcaggccacuugaaaauaaauaguucagcagaguagaauuuuaaggcuccuuuaccaguucucugauguaaaacuaguguugcaacguguuucucuuuaaaagguaauuguacauguaauuaggcuccaaguugacuacauuuaaacaagugagauaaaauaaaaaagccacaaagauggagcugccaaaacacugugcaucucuccuauguuggcuacaaguagcaaguaagguuauuaacuguuaagaacaaugugggucuuuauguaaauuuccccucacauuuuaaaucauguaugucaaaaugaaaccugauuaagaaaaaugagacuauuaaaaaacauacugagacucaauuaucauuaccuuuaaagcuuagcuuuuaauccacauuuuaagacaucuaggaauguagaggucgacaccaaugcuauauaaacacaauuucuaccacgaaucuucaaugucauacauggcuuuaaagagaccacuccuuguagacuaugcuuuagggaauaggaaucagggaucucgguguguacauuuucauuaagagaaguaaggagaagcaacuuuagcaagagcugaaaugucaaauaaaccaagcaauacuguggauuuuaaaggcaauaccauccaaaggcauuguuaaucuauguaccucauuagccaacacugaagcaucaguaauuuuauagguuuuacuucuugagugacagaguaagggaaacaucuccacagagguguaaucaaugcacuuacaggagguacacagaacuuuaaacucacaucauuaaguaucucagcagccuggguaaaaauccauugccuacacagucauuuuugccaucauuuaacaagagagaacaagaacaaauccagcagccagugacagcccuuuggcucuucauucaguaaguucuucugccucaagguaacagaacucaguuuugagaucuuacagcaaagagguaagaguaugcauauguuggguaggcuauaccacauaccugcuggaauggaaaaaagcccuuucauauguaauuacuuucuugaaaagucuacucccuuacaaccacccacagauagaugaguacaaagaugaguuucuuaguacucuuaaaauuucccuaacaacauuuuuuucuuggacuagggaaaaauaaagagcguacauagccuccaggaggaugaggacggaagcuuuacuguaaagaguguguauuaacaccaauaaucaaacuacagaucugaauauaacacuccuuaagaauaacaaagagacacuuugcucaaagugguuggucugucuccuaccaguucgcuuuccucuucuucugcaucuuucuuuucuuccuucuggucuucaauguuagcaucaaaaucuuccaucucuaccuacaauaugccaauaaucauuuuuuaaaaaggauugcauaagcauuuaagaaaguguuggcucacuaagaucuggaaugagcacaagacagcaggggcuugccuaucauauacuacaugaauccuaacacucugaacuuugaagugggacuaaaagacuacagaacaauauuucugcaauauacccuggauuugucaucuuuaucuuuguaaagcuggguaaaauccuuuacuccacguaggugggcuuuuaauacuuaagagauuacagucuuuuaaaaacuuuuaacaaguaucccucuaaucaaauuucaaaauaugugaaaaagagggaagggcacaucaacaacaaauauaagagacgacagagcaaacaguggcccacaaugauuucaauacccaugggagcacacggaugugagaaggaucuacaaguuaaaagauaucagagcauggugcugagagccaucaagagcuggcugaagagcagguugauguuuuccaacaugguggcuccuacuuaagaaacagagaaccccguaagaggagcaagugugugacacuaacaugguguguuucagggagacuucagaaaagaauuguaaaaagaauuuaaagcacucuacuuaaaauuguuaacuccacccaccccccaccccccaaacaggaucuggcuauauagaccaaacuauccucaaacucacagugaucuguuugccuuucucucccaagugcugggauaaaaggcaacaccaucaggucucgugaaaauuguuacucugaagguagacaagccagucuauacaagguauauaaaaagcaaucuaggaaaccaggauggauauaaaacuggcaagucuaugcucuuagaaauagguucuuuccaugugugaguaaagccugagcuaaggauagcacccucaguaacuuuuuuaaggccuggaaagcacaagucagaaaaggagacuguccugagauggccuagagauaucuagcagaagaauguagacacaugaaagccaaagagaaagaugugucuuaugaagguggcaugacugacugaucacgugaggccaugaagucugggugacaagugucugcugccaaaccagagucucacucagcaacgacagacagcaccauucaaagaacaaggucaaacaaaacagaagcacaagugacugaagcacaaagucaccuuccuuucaggguauguucuuccaccaaacuaauaacuacuaugcaaguuaucaaugagugaaaaugccuugggaacaagaaauuaauagacacuuauagacacuuauuacaaaaugaaaaaaaaaaagcagaaaaacccaaaagaucugacuggugugcuaaggauuagaccaaugccuacaucacauugagguaagcugucaucucaaaugacgugaaccaaauguagugaaccgagaacacauaauucauguagcauuccugcuaagguuuugucuucacacgucuauuuguucauucauucacugacuucacucaugucuguaugugugaauauacacaugggccacugcccuggugcacagcaggucagaaagcaaucuauauaaguuauuuccccucuaugauaucauccauuuagccaucucccaagaccuucugcuauuuaacuuaaaccuaaaguaguggaauuaaaagugugugaggccuuauuuucggagucaagguuucucacugaaccuggaacucaccaauuugauuagaccaguuacccagugaggcccagggaguucucuuaccuccccuccaaaauggugggauuugucaaugcacccaguuuuuauaugagguugggaaucaaacucaaggcaagcaauuuacuaaguaggccauuuuuccuaucauaaaagugcuacaaaagcugggcaugguggugcaugccuucucugugaauucaaggccagcuugaucuacgaaggaguuccaggauagccagggcauacaaugcuucauccuaucaccaccaaaaagagguuaaaaccuauaaauagaguacaucaggacaggagaugaguauagacuauuuuaaauuuaacucaagugccguuccuagcucugcuccacuagucaucaccacgcaacuggacagauccugaaaggagaucaaagcaggaacggucaggagggugugugugcguuuaaaccuuuguggguauauuagagagaguguacaucauuagucagggccagugugcuggggaugcaucauuuacauaaggagaaauuccagauuccaagugcuugcuggaugugaccuuauaaggagagaggaaauuuaaccuggcuacagacucugugaccuccucuggugggucaaagaagggggccaggacuauguaccugagacaugcaggccggggacagugggggaguaguccuacuccugcggaucucaggaugagauucccgggguuuggacacgccucaacccuacucuugcuccagaccaguuccuccuggugccauggcacccuggccccacaucucugucugucugucugugucucucucuuuuuaugaaggagcaguaucaucauagauauuggcauccauuugugggagguccugguaauguugcuuaucuguugcuguacgaauugaauaaggcaggggcccaggacaaagagggucucaauaacuaggauggggucacagaagggaaggaaccaagcaacuaaaagcaacuuuccucccccaguacaacacaaggcccucguuuucuccucugcuggggacgggaucagggguugggauggcguguccuccaucuccuccugcccugacccagcagugagaugcaggccaucuucuugguuggugggguuauaucagacauuucuggcugggacccagauaggcuuccauugauccuuuuguucugaaaacacacaaacuuuuaaagguaauguuguauggacauuuuuguauuaagacauguauggaaugugcagugugcacaaaugaugauucucggcucuauguuugcgcagguaaaaggcaacuaucagucaguuuggacugaguaaccaaacuguaauguaagucuucauccauaugagguaugauggguccaugccauauaagaggaugacauguaaucuuaagcagucaggaagguccauuggcuucugcagucauucacaucucagacagucugugagcugcucccauggagggagucagcaauuaugccaccuguccuguugaguucuggaucucuuuuuuucaaguccgaagauuuuuaggucuuccuggucaaaucuaaucuuaauuuugaaggaauccacagcuuuuugcuuccuguugaaacaagagcaaaaccucuuccccgguacacacacuuccugacuuccagucugagguucacacauucuuaacauguauaggaugauucaaugcagcaguccuuucuaaaauccagugcuuuuuccccuccagcagcuaugcuagcugucucacugacguuuuuuaaaauuuuaaguuaauaaagcauuauuuaaucuaucucugggugaccuuauaucacccuuuuguuuuuugagcauuuccuuuaaaguguggucagaucuauccaaacucuguaaaaugaaacauauccaucuaccagauuucauuucuuuggguaccuuuaggguuauuuucaguagguaaugaagcuugauuauaaauaacaaaguuaauuuuuaaucaucuggaauaaguuuaacaguuuuuuuuuaaaugcaaaacaacucuuucugcauguugaaagucggugauuauauuaagaaguucuggaacagcuaaaccgugaaaauagcauauagcucuaacuuauggccugccauuccugauuuauuggcaucuguguaaaagguaggagcuuuagaaauuggugucccucugacuaaagaagaagaauccaguuaguucuuuuuauaaacugaaguugcuugcuuuuggaguauuuguuguuaauuucuuccaaaauguuauugcaagcccuuugccagccuuuagugauuacucauaacuaggccauaucagcaucaggauaaggcacucaucucugugaagucucuucuuauaaauugacuaaguccaacucuuucuuuuuuaaaacuuuuauuuauuagauuuuacuagcuaccuaauuuaaugaaugaaaaauuuagcuguaacccaaaugaaaacauugguuuuuucauuguguuuuucaauaaauuugaaugucccuugccccaaauuuuauuugagugcucugcugcacaccagaagagggcaucagaucccauuacagauggcugugagccacugugugguugcugggaauugaacucaagaaacuuuagaagagcagcagugcucuuaaucacugagccaucucuccagccccuuucuuccuccuccuccuccuccucuucuucuucuucuucuucuucuuccuccuuuuccaccuccuccuucuucuuccuucuuccuucuccuucuucuuuaauaauuaauuuagaaacccuucuuauauaugguuuuaauuuuuuacuacuuacuugcuaaaagcacccauucugagauaucaucuucuuuguguauaagaaucacugugggagaacgaguagcaggcaggauaacuaaaguuccauucagcugggacccaagcgauccacaugugccuccuuccuauaaugucuccaccagagccaauucuccuucagccucagccaauaauguucuuggacuguuuaaucaccuuguaagguuugaauauaaaugacuuagcguuuggguagcuaauccaagagugagcugcagcuaguuauuaucucccgguaacuuuugaaagucaccaagaguuuguaaacaaucucaaucuuaaucugugccuuccgugguuggauuccucacagaccuauccuagauccugggucauuaacagaacucccucccucccuguauuucuuuagcaacaaucuacaauccccaacaaugcaauauuccuuuuuauuucaucaaacauuuucuuuaagguaucuacaucugaaucagccaauaagaaucauccauacaaugaaugaaugacuaauaaauaccuuuggaaauauaaacagcacuggcuuaguacuuuaugccuugauuauguuguguuuuauacuaguaaguuuagcucgcccuaaauuuuuucuuccauagaagaaccauugacacuauuaagaaaaaacaaacaaucaaaaacaaacauuucccauacagggaacuuuaauacugaguuauucccaauauuagggaaaaaccaaaaaacauuuuaacaaaaauaaacauguguacucuguccaauuggccuggaggauuuauccuggcagaauuuucucucccguuucccccgagucuuacauucccccuucaucugucauccccuccccuuuaccaucgccuccacagcccucucuccucccuccagggguggcaggagcggucuggcaggggucggcuggcaggggugggcucuugagagcugcauucugucccagacgugaagggcacacagaggugcaccugaugguuagacccugcuggcuggggugcccuguugggcucccguggagaaaauucccucuuuaagauggcaaucugacuuuggaggaggaauccagcccggguuggguggauauuaaccagaauugccaggaucuccagauccacagcaggagggagggguagauugggugaggccgaaaugaccugccacgauugaggaagcaaucagguggcuuuuuuuguuuuguuuuugccccuccccaaucuccuaguuucccaugauauagagcguuuuuugaaacgcugaggucagagagaggugucacagggaauuccccaaagucccagcugugagucagcccugcaaauuuuagagaaacugccaacagcccuaaugacauuacuagucaauguguaacagggcuuuuucuuuuuucuuuuguuuucaagaagaauaaaagauaggggguuaucugucagggaucagacagaggguuggaggccuuccacccacaccaagcgguggguggucuuggccagaggauaucaauugcuacuucccugugucugauccuuuaggacagagcaaacugaaaguaagagagaggagagaggagagaggagagagagagagaaggaacagauuaguccuagacaaggagguguaagacagguggggcagauugaugucgaaacggggguggggggugguggugaucgaucugcucaaggacugaaucaaagaggugccuagggggugugggaagagaagguuaaguaaauaaaaacacaaaagaauuuaauuuauaguaucauaucaauguaaacuuuuuuuuuuccuuuuuguuuuuuugagacaggucuauaagcccuggcuguccuagaacucauuuuguagaccaggcuggccuugaacucacucagaucugucagccuuugggggacuaaaagugugugccauuagcccagcuaaugcuuaccuuaaauuuuauaauuaaauggauuuauuagagaauguccuuguucuuagaagauagccaucaacaacauauuccggacugauggguuaugagguuuuucaacacaauucucauaugauuguauaguaaugguaugaaauaauguuacuaaguauuuauaagguguuuauuaaaauguguggaaauauuaacaccugaauugguugagauuauuuaaagguauguaagugcucauguaacuuuucuggaaguuucagauuuucacagugaagaagguguugcuuaucugcacugcccugaggcagaguauacucacuucuucaaucgcagcaucuuguagcagggagcggaugucuagacgcaucaugugacgaggugcaacuucccaguguucagccaucuauugagauguucagaacaaguuaacucugacaacuacuccaauaaagacuaaggagagugucaagagaaacacaacuaaugcuauaacuuuaacagacuagcuuuaagaagagcuaggcaucccuuuccacuuauaagacagaaaggagaacauuuauuaaagcaggcagaaagauuucugagcgacuuaagacagcauuacuagugcugaaagaaugaugucugggauucuccagcauaccauguuucuaaaaaucaccuuguuuauuucuuuaagcuuucuuccaugaauauuucucuugccacaagucugguuaucagcacucauuucagccaaauacaccuaaauaaaaauguguaacaauuaggccaagaaauacaaauucacacuaaaagugcuucaaaguuaagacuauaccucaaaacccuugguuuucgcugcacuccaaaacugaucaaaaugucuaacucugucauugauagcauccagaauaaugaaagggaaaaagccgucaucuagagucuuuuugaaaguuuugaacaugcuggugcgauaagucucuuccaugucagcuucauauucauauuccauuaccuaagaccccacagagaaaaggagguuauuagcaggaguaaggaaccagacugagccgggcucaacugaagcaggaugacugcauccucuucuucccaccuaagcaccaaaguuuguguccagaagacaaggaaauucucaucuucaaaaacaaacaaacaaaaaaaccccaacccagugcaagcuaggcauggcagugcacaccuugaaucuaaguaggugaggcugaucuugugaguucaaagucaaccugaucuaccugacaaguuccaggucagccagggcuacauaaguaaauacccugccucaaaaacaaaaacaaacaaaccauaaacaaacccugccucaaacaaacaaacaaacaaacaacugcucccccaucucucccugaacacaucuuccuucacaucccaacacaggucuaguaggauccacauaccuucuuuuuuacuuucuuuccagaaucuggaucuuuuucuucuuuuucuacuucagcgaugaaauaaucaucuagacuuaaaacccugggggcagguccuccaaauucuacuuccuuauccuaagaauauaacaaugaaguuauaaaaaaaaaaaaaagaaccaaauugaugaacacuaaaguucccaccuguggcuaaaauaaaaauuucuggugguuucaaaucaaucagaggcaaaauuauuugucuaaacagaugaaaaacuuauaaggccccaugaacguccauaaguuaucacugggagauaccugaauacaauacuaccccauuaacaagcaacucauuuuuuccuuuuccuuauuuuacuuucccauacucacccggauaaguuuugcaacaugugucuuuccacugccaggcaauccucucauuauaacaacaaucugaaacacaauggaggggguaaaauuuuuguuuucugagggguugggauauagcucgguuggcaaacugcuuccuaucaugcagaaaacaaaaagcaccaccccagcacuauggccucugccugcagucccggcucucagaaggcagaggaaggaggucaaugacaaagucauucuuggcuccauagggacgccugagacuagacugcuauaccugacaacuugucucagaacagacaaagcaaaacugaacagaacaaaggaagugcauaaauauguacaauaaauuacuaaaaaaaaccaagggcucaaaauauuucacaacagguaucagaaauauuacucugacaugaauaaaaaugaggacaucauaccacagcucaugggauaaaacuaaacaaauauuugaagagaaauuuuagguguacaugucuguaucaagaacuaaaaaagauuuaggggcuggagccacagcuuagcugggaucucagaggugccagcaaauuuauucagcacacaccucccuucuuuuuaaaaacucucuuuaaaacaugguuuuaugaaugugggaaauugcucagcagguaagagcacugguggcuuccagcacccaccugguggcucacaacuggcaggcuauuaacuagucccaggagauccaacauccucuuuuaaccucuguaggcaccaggcacacacaugguaugcaaacucacaugcagacaacucaccacacaaaaucaaauuaaucuuuuaaaaauuaagaaaaaugaucuaacauugaaaaccuauuuuucuaccuaagacacuauaaaagaacaagcuaaaacuaaccaaacagaagcaagaaaacaaagauuaggacaaauauuaauaaaauagagaaaagucaguaaaacuuuauaguuuggauaugguuuguguuuuccucaacaguauagaagccggcagaauauagauaauggagcuuuuaccagguggggggauuagugggagguuaauuaggucguugcagguaacucuuaagggaggcuggauagcauccuagauggugaaauguuauacaucguaaaccugauccuugagugucuucagcuuccucuuucaucagugccuuucccucccucauacacacucccaccgugauauauacacuauguuuugaugcaaacaagcggcccugaccacagccaaacaaauccugaggcugcacucaagcauuuccuauaccaugggcugaauaaacaucuuuuccucauaaagaaccuagucucagguauuagagcuaaaaagcaaaaacaugccgcauacacaaacacacccaaaucuauaaaauuaaaagcugguccuuugaaaaacaaaacaaaacaaaaaaaaaacagugaaauugauuuaccuagauuaaguaagaaaaaaagacuuaaauuacuauaauaaaaaauggagaugucacuacuaauauaaagaaauauaaagaaauuauaaaggaauagauacauauaagugugugcuaacaaagaagauaacuuagaucaaaccaaccaauaucuacacuguugugagugaccaaacuucccuacaaaacagacaaaacagggggacugggagaguuaaacaagggucagggucaagcgugguaaugcacaccuguaauccaggagagaggcagagacagaggcaggggauucugugaagucggccuggcuuacacagugaauucuagaacaaccaggaauauauagugagaucugccuaaaaaccaagugaauagaagcuggcauuggugacccacagcuugaaugccagccuuugagagguggagacaggaagaucagaaguucaacaucauaaagucauccuugacuacuuaaguuugaggccagcuuacuauacucugagaaauuaucugaagaaauaauuccaaacauauuaugagguaagcauuacucugauaccaaaaccaggcaaaaacauuauaagaaaacuaugauauuaugaacuauucagcaauacagaaaaugaaaaucaauuaauguacuaaauugugccuaaauacuagaaaacaaaaauuacagcaucauuucaacuaauccaaaacaaaacaaagccgugcaacaaaauccugcaacccuuugugacuaaugauaacacaacaaaguagaaacaggaggcuuccucagccugacaaaaugcagccacaaacauucacagcugggcucaucaagaugguucagagggaaaggccuccgaaccuuagugucuccauuugauccuugagacucacacaguggacagaaagcuguccugugagcuccacaacucugugguagcacgugugccucccuacauauacaaauaauaaaauccauagcuaacaacaugcucaaugguaaaagacugaauguuuucuaaaacaaaaauaaggcaaagauguccacuucaaagauaucuacucacuaagguacuggaggugucagcuaggguaauuaggcaaaaaaauaaaaaauaaaaaaauaaguagaagccauugaacuuacaacagaaaaaguaaaauuacuuugcagaugacauauucuuauauauggaaaauucuaagaauuugcuaaaaagcuuuggaaaugaaaaguucaccaauguuacugagcacaagaacacauaaaaggaacuaguauuucuacaccuaaaaugaguaagccaaaaauaaaauaaagccaguuauauaaaaaaacuuuaaaugaauuaaacaauccaaucaaagccagguaugguggugcacaccuuuaaucccagcaacugggaugcagaggcagacagaucucuugaguuugaggccagccuggucucuacaaugaguuccaggccagucaaguauacauagugagauuuuaccucaaacaaaacaaaccaacaacaauauaaucaaaagguagaaacuaggauggugguauugcucaauggcagagcaccugcucuggguucaaacuccagcacuaccaaaaagaaaaacaaauaacaaagaagucaacacaaacuacaauucagcuauguguuguuuacaggaaauacacuucacacacacacacacacacacacacacacacacacacacacacacacagagucuccacaaacagaaaucucuugagauggcucagugaguaaacuuccugccaagacuacaguuugaguuuguucccugggaucaacaugguugaagcagagaaccaacucccaaaggcuggcucuccucugaccuccacugcauaggguggcauggugcacgcacagaaaauaaauguaauuuaagaaacacauugaaagcacagggaugggaaagauauacacaagugucuuauuaucacuggagacauauucuaaggaucccgagcagaugccugaaaucacagauaauauucaaauccuauuaauaccaagauaguuaaucugauaacuaagacaacuacuaagugaucagcaggagggauguguggauauggcaaggaaugacucaacuggaagaugucaccaugacacauaugauuuuaaauuuaucaauuauuuuuagaauuuuucuuuuuuuucuuuaagucauagugucuucuugcacagaccaggcugacaucaaacuccuagacacuugucugccucugucuucugagggcuacguuuaaaggugugugccacuacacuaaguaccacuuuaauauuuuaauuaaaauuauuguaucauuauugacuucagauaaguauaucugcagaaaguacaaccauagacaagaagguggacuacuguacaaccaccacaggacauaugggauagcuauagauacaaauuauauauguguauguuuauauaugcuuguguguauaucuauccauaucauggcauauucucucauucucauaugaauaugagauuauagauaauagagugaguauaucaggagauuaaaccuaaucaagucuaauuuucccuccuuuuguuccauauaccauuaaguccaauauacuuuuccucuuuucaaaaugcacuuaauugugcucaaaaacuuaaaaaaaaauuuccaacauuauuggcuaaacuucuuuaagauuuuaaaguguaggcaauaucuaagauuacuuauugauuuuggaugcuaugaggcuuuggagccaguauuucuauguugcagaaaacugaagaaaucuaccagacauuuaaaauaagcagagagagagagagagggagagagagagagagggagagagagagaacgaacuaguuaaguuucuaggacucacucuuucaggccggcucucccggcccggcgguuucagaaugucauccacauuuuuggacuccggcuucuucucaacccgaggaacuggagguggcugguggcccagggcaggagcuggaaggggcaugcgcuccucuggguaaguucuucguucuccuagagucacaguaaguaguugaauaacauuauuauuuacacaguaaucauuaaaaaagcuaauaacuuuucuguucuuaccuuaauuacaauucagaucaggucuaaugaauugaagguaacuuuuaaauuuaauuaauaacauaaaccuauuguaaucaagaaaaugaaaagacuggcccauuuggggagaaauaaaaagcagaacagauuguucuauaaaauauuuaauucaccuuuacuuauauuaaguauagaaacagauucagcaacaggacauaaaggaauauuuuacuggauaaaccaaagcauaacugauacuguauggauucuaugacuuucacuuuauaguuuaagagagucagcgauuaggaaaacuuaauccuuuuaauagucaaaaguuucuaguuuaagugcaacucauggcaaugcagagauaaaaacaauucaauguccaacuguaagggccuuacacuaucaaucccaugaaaugucguggagccagcaaggggucugaagaugggaagauguacaugaugcaguuauugaacugaagaagaacauaacaacagcgcugcuaggguggaaagacaacucacgcaccgugcaugaggcucaggaugugaugcccagggcagcacaaaacucaagaaaacuccuagcuucuauccuugauuauaacuucauaaacgaguauaugagagaaaauaagagggcuggagugaggauucagcacuuaagagacuggcuguguuuucagaggaccaagggucaauuaccaguccccauaugguagaucacaauuccacuucaaggggagcccuggucacuaauacaaauaaaaaaugaaacaguaauuuuuaagaaaaaaugagagaaauguguguuucgguaugguguguggugggauuauaaguaacuuuguuuuucaaaauuucuuuacuaguuuaagaauuaaauuuuauuucauuaauuacauuacuauuuuucauuauuauuuauuuauguguacauguguguauugucuguauauauguguguacccaaaguucagggcaucucuugagugcuguaguuacaaguaguuguaaacugccugaugugggugcagacaguugaaccuggaccuucuuuaggaacaguauuugaccacugagccaucucuccagucacacaguccuauuuauuauaauaaugcuaucuucaaguacaguuuacugugaauguuuaaaugcauagcuacaaugagaaacaccuucuauguguuugcauuagcaauguaguuccugucauuaaggcauuacuuuaccuccaaacaugggugggccuucauaggguggucuaucagacuuccggucauaggauggccugucaaacccuccucuucuggaugaagaauggucuuuuuugucucgauaugauugauuccuacaggguguaacaggaaguuuugguaaaacauaaauacuuggaaggucucugcuuugcaacacaucacugucucuaugggcaguuauuccacugucuauauuuaaauauuaaacuugcuuuuucacuuauaucuaccuaaaaaucaagaauuguuaaaucgcuugucuguaaaaaacugguuguacuuuacuuucuuucaauuuugcugucuacauuucaauuuaauucucuggaauucaagggaggagaauucaaguauguacuugccuagaaauuguucuuccuuuuccaaacuauacauauaaugggaagaguacauuguucacaaaaucucuuucaacacacugacuguggccaggcaaggaggcacaugccuuuauucccagcauucaggagacaagggaaggcagaucucuuugaguuuaaagccagccugguaaucacaaguuccaggaaagccagagcuauauaauagagaggaccuuaucucaaaacaaaacaaaaaccacuacccccaaauccaaaaacaaacaaacaaacaaacaaacaaacaaacaaaugacuuucacuggauuuacacaagaaauuuuacauguauauauagcaaagguauuuuucacagcauaccugucaucucggggucugcgcucucugucaaaucggucccgcucauagucaagaacacgaucucggucucuaucucuaugugucucucggucccuuuuaaaaucucgaugaucuguuauauuacuuggacggucaaaauaagguucacggucucuaucucuaucauagcgaucacgcuggccugcaugaucuauaaaaacaauacaaacuaagaacuagaagcauuuucagaaauuaaagcaagacgugcaauuuuaacuugagaauguaaauuagucuuaaauuuaggaaucuuucagugauauuaaacuagacuaaccuuguuaaaaggaaaaucuuguaauaauuagguccucaaguuaagcuuaaaauuacucuccucucugggaauccuaccugcaucaaaaguugaccuuucagguaauggaucuggacguagaguuauucuuucuccauaugguaucuguucaacuuuauuaguaggcauaucuggcaaagaaaaccagggaugaaauauaagcaugaagcuuaagaaaaccaaaucucaaauuaguaauuccuguagaagucuggccugguaguauauccuauaaucccagcccccaggaaguuaaggcaggaggacccagagcuugggggaaugugguguuccagggccagcaagauugggucuugaaaaacuuaaagucucuucuuuggaaaaacaauuccugucaggugcugugguacaaaccuauaaucccagaaugugggagguuaaggacaggaguuuuaggucacuguccuggcuagucaauuugauacaaacuagagucaucucaaaggagaaagccucaguugagaaaaugucucuauaagauccaacuguaggguguuuucuuaacuaguugauuacugggcaaggaagauccagcccauucugcauggcaccaugccuggacugguccuggguucuauaagaaagcaggcaggcugaacaagccauaaagagaaagccaguuagcagcaucccuccaaggccucuccaucagcuccggccuccagguuccagcccuacuugaguuccuguccugacuuccuucaaugauggaauacaauguggaaguguaagccuauuaaaacccuuuccucuccaacuugcuuuucggucaugguguuuaacuguagcaaccauaacccuaacuaggacagaaauccucugcuacauaaugaguuugaagcuagccuugccaaagagauuaucucaaaaucaaaacaccacuaccaccaccaaacaacuccuguagaaccccagccauaaauucaccauauuacucaccucggccauggccauagucaacuguaugcugcacugguggugguuuggacauugguggcauacccauaggcauugggccaggagggggaauggaagaaugaacaggugggggugguaacaccggagcagacggaauuguugcagugucucgcuuaaauucugaauucaguccuugaucaucauuuguaucccagagcccaaagaaagaaucuucaucccagcguuccuguuucacagaugagguuuuugacuuuauaacuggaggaggaggugguggugguggagguggaggaggcgguggugguauuggcacaggaggccuagucauaggaauagaugaucuugcugguggagcagagggucuuacaauugacccagguggcuuacccauaggaggggguggucuauaggauccuggaggcuagagaagacaguaaaugguaagauaguugcuacauggucacaaaucaguaaaaacuaauaccuaguuuuuaaucaauuaauauacaagucauauucaaaauguaaagcuuuuguguuuuuuuuauuuacuuacuuauuuaguuuaugugcauugauauuuugccugcauguaugucagugugucauaucaucugagacuggaguuacagacaguucugagcugacauuugggugcugggaauugaauccaggcuguguggaagagcagccaguauucuuaaccacugagcaauuaauuucccuagccccaaucuuuuguguuuuuaaagacacuaguaggcacuagggagauggcucagugaucacucacuguucuugcagagggcacaaguucauuuacuaguacccaugcugaguggaccaucuguaacucuagcucuaggaagauuuaagaacuguagucucugugggcaccuacaaguaugucugccucacauauacacaucacucaaaacagaugcacacacaaauauauacacacacucacacacaccuauagugguauaugccucuaaucucaacacuugaagauuucuaugaguucauggcuggucuagucuacauaguguuuucuaggccagccaggacuacauacuguaacucugucucaaaaaaaaauuuuuuuuaaauaaaagauaccagcaggagcuggguagguaacucugccaguaaaaugccugcuaggcaaucugaggaccuuaauuaaaggaacagaacucacauaaacauuuuuggucacagguucaaaggaugauucaacgguuaagagcacuugcuacucuugaagaggacccaaguucuauguccagcaccccccacaguggcucacaaucauuugugacuucaguuuuaugggaccagauaccuucugaccuuugaagggcaugaaugcaccugugcacauuuauaaacaaaauacauacauucacgaaauaaaaauaagugaaucuuuuuuuuguuaguuuguuuuuucgagacaggguuucucuguauagcccuggcuguccuggaacucacucugcagaccaggcuggacucgaacucagaaauccgccugccucugucucccaagugcugggauuaaaggugugugccaccacugcuuggagugaaucuucuuuaaaaauuggauauggugggucaugcuuauaauccuauagcuggggaaacagagacagaguagauccuggccgggacuucccuggccaggaagccuaaccuaacggugagucucaggucugugagauaucaacuaacuaaaaaacaaaugcuuggggaacaauaacugggucaaccaguggcuuccauacauaugcacauauguacacgugugcacacacauagacaaagacacuagcagaaaaaugaagauaggccauagaaaaggaaaaacacagaagucaucccuaauaguuauauuaauuaauauaaaaaaaacuuuauaacucuagcuggguauggcagcauacccauucacucuucuaugaugguagagguggaucaaucaguucaaggcuacccucagauacauacaaguuugaggacaacauagacuaugauaccuugucucuuuaaaaaacaaaaauccuagcaaauaccaugcugcugauaaucccagcacucaggaagcagagguaaguggaucuguaugaguucaagaccagccugcucuaccuagacuagcacguaaauauucacagcagcuuuaaguaggcaauccagaugucuggaaacugaugcaugaauaaacaacauguggaauacaucuauucagugaguguuaccuagcaauaaaaagaagugaaguacuaacucauacuaugauaugaacucaaaaaugugaugcuaaaugaaagaagccagaaauauaggacuauauguuacauagacccaauuuauaugagcugcucaaaagggcaaaacuagagagacagaaaauguaccauaaacuacuugggucuaagaacuauaggggauggagagauggcucagugguuaagaguacugagugcucuuccagagguucugaguucaagucucagcaacuacacuguggcucacagccaucuguaauggcaucugaugcccucuucucgugugucuggagacagugacagaguacucacauacauaagauaaauaaauauuuuuaaaaacccuauaaacuagcacagauauuuuacugaaauaagaagguucuuugaaauuagauuauagugucagaugcucaguaaauuuaaucuaaaaaucagugaugugcugagaucacucagucaguaaaaugcccaaugcaaauacuucccauuuuucuuaguucuggccaugguuuauuuauuuuuuaaugucagcuauuuuggaccauggaaagccaaugguauguauguauauguguguguguguguguguguguguguguguguguguguauauauauauauauauauuuuauguauuuacucaucuguaggcugugcuuuaaaauuagauuuuugagccuggagagauaacccagugguuaagagcacuaauucugguuccagcacccacaaggaagcucacaaaaaucuguaacuucaguuccaaaggaucuaucauaugugauaucaugaagcacauaugugguauacuuaaauaaauauaggaaaaugcucauacucauaaaauuaaaaauaaagcuuaaaaaaagaaacauuuggaguaaaacuggacuuugcuacuauguaaggaauguuaacaugaagaaauauuaauguuccuauuuaucaacaauguauaagaagcuguagagaugggucaggagcuaagggcucucacugcacuucagaggccauggguuuuggucucagagcaugaacugcggggcucacaaccaucuuugcuccaguuccaggggauccaaugaaaguucucuucugggcuucuagaauauccacaugcacaugacacacacuucacacagauaugcacauacucauaaaaaaacaaguguacuaaaggcugagaguggugccuaaauuuuagaaacugaggaaagaagaccacaaguucaaggccagucuggguuuuguuacagagagaaauucuaucacacacacacacacacacacacacacacacacacacucucucucucucucucucucucucucucucuuacuugccaggcacaugcacucaagagguugaggcaggcaaucucugaguuugaggccagcuggccuacaagugugaguuccaggacaaccagggcuacacaaagaaccugucucaaaaaaaccuaaaaaaaaaaaaaaagugguguuauauuuuccaaaauauaaaguagcugaugauugucuggauaugguauugauguuauacagcuauguaagagaguugcuuaaauguacuaagagaaaauuuuaaauguuuuuuauuauuuguauguuuauuuguuggugggucaauacauaauuuuauuaacaaauaugaggcuaguugucucugugugugccugggagguauagauuuaaaaagcaacauuucuugagcagaaagaacguguacuuuuugacuaaaguuucccacucuaggaagauacacaaauaucugggagguacccaaauuaaagacccgauacagagaaauucauuaaagccgcauuaauaaucguggaagaucagaagaaaauagccaauauaaauagaacaguuccaugacuuacugugcauaaaaauaguaacauguugggauaugggaaagugugauuugucagaugagcaaaacagaaauauggaucuauaaucuagagcagugggucucaaccuuccuaaugcugugacccuuuaacacaguuccucacauuguggagacccuuaaccauacaaucauuucauugcuacuuccuagcugugauuuugcuacuguaaugaaucagaacauaaauaucugacaugcaggauaucugaugugcggaaagggguugcgacccagaagaugauaacugaagaucuagacucuaccacuugccacaagacgugaagaaggaagacaguuuucauccuaggagcucacuuuagaaaggaaggauaaugauaagaaaauaaacaaaucaaacaaugcuaaaugcugaugggaccacucugagauuggaaaagauaaaccagaaccaaccagaugaagagggggggaucgagaaaaaugcacacaggaggggaccggaaaguacaggaaaaacaaaauaccaaugaaaaguagauuguauccugagagcgacugggaaauccugaagacauuuucuuauagucaggguuucgucaagcacagauuggccuugaaacuacuauauagcaaauuuuugaucccccugccucuaccucccaagcgcugagauuaaaggcaugugguaucuuacccaguucuaugugguacuggagacugaaccgagggcuucacguauacuaggcaggcguucuagcaacagagcugcauccucagcaguuaguuauaaggcaggaagcaacauaaugaaacucguguuuuuaaaaguguuucgaaugccaggcaugauaucaagcagaggcaggcagauuucugucaguuugaggucagccuagucuaugcaguaacaaguuccaaacccaccauggcuacauggugaaacccugccagaugcaugccuuugacuaaagcacugcauaggaggaaacagaggcggcagaucucugugaguuuaaggucagccagcuuggucaacaaagugaguuccaggucaacaagggcugcacagagaaacccugucucagaaaacaacaacaacaacaacaacaacaacaaaaagaagucaucuggaaaaauuaguagucuccuacaaauuguccuguccuucauacaugugguaugaccucucuccucuccccuccccucccucccccucucucucucucucucucucucucucucucucucucacacacacacacacacacacaaaucaaauuuagaugguucugcaguuagguaugcuugcuguuuuuugcagggaauuagaguuugguucauagcagccaccaucaggcucacaacggacuuuaacucuagcucccaagcaucugacauaauuuuuugagcucuggaggcacccagaagcauguaaauaaacuucaacacacagagacauuuaucucucucacauauugucuguuugguuaaauauauauuaguauuaucuaaaguggagcagagaguaggcacuggccaauacaguuguuaaacacuaagacuagagagcugacucagugguuacaagcacuuauuacucuuucagaggaccagguugauucccaucacccacauggagacucacaaccaucuguaucuuuaccaguucuaggugugugaagcccucuucugaccuuaaugggaaccaggcaagcucaugguacacauauauacacagaggcaaaaccuucacacacauacuaaacacaucuaaaaauaguaauaauuuagaaaguaguagguagggcuggggacuuagcucagugguagaucacuugccuaggagugacucuaugggagcaacacacuggauucaguccucagaacugcacuuuucuccccagcccacccccauuuuuagaguaugugggcaagaaagaugauaccugcugccaaguuaauaaccugagugaucucagggaagccacaggguagaaggaaaaagaaacaucucugaaaagccaucuucugauuuuaccaugggcacuaugguaugcaccuccuccacccucaaacauacaaaguagauaaauaaauguaauuuuaaaagaugaaggaagauaauucaaguugaucucuggacuccaugugcgcaaauacacaggaaacaccacccccauaaggguagauacaccauauaacacauacgcauacauacacacacacacacacaaauaagaaaaucauauaaucaaacuuaggucauuagcuuggcagcaggugccaucuugccagcccuuguucuuuaaaacuguggagguuuugagaagacugugaccaggacugaauccagggaccacggagcuacacgguucagcugugcuuggucuaucuguuaaagccuagggaaaggaguauucuugcauaugucuaacuacuuuuaaagauguucaaagcuuucacuuuuccaaaauuuauguuuuuacaauaaaaauguaugcuuauuggaauuuuaaaaauccaacaucacugccaagcauugguugcccaugacuuuaaucccagcacccuggaggcagaggcaggcagaucuaugaauuuaaggccagccuggucuacauacagaggaaguucuaggauagccaguacuacacagagaaacccugucuagaaacacaaaaacaaaacaaaacaaaauaaauccuacaucauauaaacauacacaguaaaaaaaaaaaaaaaagaaucucauuuucugagcacacauuuucccauaccggauacaucccaggucuugauggauucuguagucuugagucugggggugguagauggucagccaucuguggcucagacccaaagucuuucaacuuuugaagcugcucuuucuguucucuguaaacaaaugaaauugucuuuguacuuaaagcauguuuacaccaucccaaacaacuaugauuaaaaucaaauuuaaaaaaaaauacaaacaccuaaagacuaaaguucuaugcagcgcccauaccauacagcaccucaguuaugguagcauucucuucuuuuacacaacuaacccaucaaccaucuaagaccuauaaucauaaauuaucaaugaucuucaacaauugauucuacaaccugccuucauaggauguuaccuacccaccauguuucucuuuuaagaaaucccaaauuuuuucuugcuaauugcugucaauauucuacagauuacaaaauggacucuguauaaaauaacagucuaagaaggcauuuuaggcuuucacaggaggcuuauuuuguuugggagguggggguggaacaguuucagguaccuaggcuaggcuuaaaacggccaaauagauuugaacucaucacucucgugcaagcacuugcauuacaggguauguaccacuauaccuaccucucacaucaguuuuuaaaacuugaauuagcugacauuauuuauaaaggaaauauuuuacauagaaauugaguuuuuaaagcauuuugauuaauacugcaccuauauucugucaacaaguagcuguguggagccacggccgaccauguuagaugaagcagucuaucaagucauugccacacuccagaguuccuccuggcacacuuccauuuauuucuguuaacuugucugacccuuuaaaaaaaaauuuuuuuuucccccaaagggaggaaaaaaaagucucaugcccagcagugguggugcacaccuuuaauuccagcacucgggaggcagagacagauggaucucuacguuccaggacagcuagggcuacaugaagaaacccugucuugaaauuuuuuuuacauuauuuuuauuuuguguauguuuugucugcauguauguguaccauaugcaugcagugcacauggaagccagaagagggcaguggauccuuuuggaacugaugauagagacaguuguacagagcugccaugugggugcugaguauauauaggaaccuggauucucugaaagggcagucagucuccuaaccacuaagccaucucuccagccccacuugucuaacuccugaaugcauauuaguuuacuauuugcuuuagauggugacaacacucacaggucuauauucuuaaaaauaauacucuguauuccuaaagauuaauuauauacuccuuuauuuuaaucccuagcuaacaucccuuuacuuuuucuuauaauuccuaucgucuacauuuauaauauccacuacaccaucuccagaauguuuacaguaucucuuuacauacagcauugugacccaaggggacacaaagucuauaagggauguuccuaucucauagaaacacugcuuaugguauuccucgucucuaaaggcacacuauaaccagugugcucuaacugugcuaacuacuauccaacagcucacauauguuguuagguuuugcugccuaggaagggguugaaggaaaaggggugaacgugcagcaccuuucauccagccaucuaugcaaagcaacaaccaaugaaaaaguaauuuuuaaguaaggaaagaaaagaaacuggcaguuuaguaaccaaucaccaaucaguuuuauguucucuauaaaauagauuucagagucagacaguucaaauucugggccugcauuuaauaaccaaguaaacuuuagcaagucuuaguauuauugugaauggcgaugauacuauuuuucguugcaagcuuuuggacagacgagguuaagaugggaggaucaguguagugcccggaacaguuaugugaauuaaaggugcccacaauuuagaagcaaguagcuaaacgcucugcagcaagccucacaucaugcucaugaguaaccgagaaaaaggaucgaggaccaccucagccuacagaccgaagagaccgcuugccaccuguucggaaccuccagacauucuuucauucuuccuacaguuaugcuuugccaucacauuucccuacuacuaacauuucaguuacaaauucaauuaguauaacucacaaacauagaccacaauugacagaugaagcaaacacauuaaaaucuaucaaaaaauuaaccauuuauuuuucucaaaaaccuguuuggaaaaaaaagacaaaaauuaaaaagucuuacuguuauagcuauaugagaaacauuauauaaugcccacacaguugauuguaggguuuuuuugguuuuuuuuaaauccaacuucacgaugaaaauauaggaaaaaaaaaucugcuuccaguuaaaaucaaagaugaacauccuccacacaaagucucaguagucaguaaaaucugaagacguccccaggugaccacuccuaacuccagcagagaaaagagagcaccgcccaccauugcaucaaacagcagggacugugcagcccaucagauccaaugccaaagaacagacgcugccuaccgaaagcaacgauggcucaauacacaaagccccaugaaaaauguaguuuuaacacuugagacaugcacucucaaagcauccagcaacacaucuacaaugacugagaacagcaaucaauuugcacacccuaggacauaugugaauaauuaacaguuuccaaauacccaucuuaacccccaaacagcacugaauaaccagaaauacaaauucaaaguaugauaagaaacaggguuuaaaggguuccauuaaaagacuucauucagcuggacugugguggcaugcaucuuuaaucccaguacuugggaggcagaggcaggcagaucuuuugaguuugaggccagccuggucuacagaacacguuccaagacaugcagggcuaaacggagaaaccauguauugaaaaaccaaccaaccaaacaaacaaacaaaaccaaaaaaggcacuucauuuuaaaaaagagcaguaugaaaaucuguuucaacuaaaagaacgaucuuaaggaguaaacuuaccgaagcauuuucaauucuugugcagcuuucaaaaugauuucgugcugccucugacugagaaccauuaccccuccaaggccuuggucagagucuaaguuugcaucggaccccaucauuucagaggaaugaugugaggauggcauauguuccgccaugggggaaugucuauccacaucagauggguaccaucugucugacaaccguucucuuucccaguccauucugucaggaacauaaucucgcuuuucccgccauguaucuccucuuucuggauacucucgaauccucaacucaccccuaucacggaaaucucggucauacccauggucucgauuucuuucuucucuccaucuaucaucccgauaucuauccaaagguggaagaggugggaggggugguaaagguggaagagauggaauaucucguucacgaaacugugauucuuguucauccaguggucucccauaaucucugucccacucguuauccacauuucuaucauauauauccaaaggucuucuaaugcgauccacaucucugucuaagucccuguccauuucccuaccauaacccucauccauauccugaucucuuucccaaucaucccaccaagggccucgccugucuccaucaugagaccgugaugguggugcugagaaccuguccucucugcuguaugaaucuaguguaucaucuugauagucacguucacacucucuccaguaucucuuucuaucccagucaucgagucuuucucgcucaauuggagcauuucuaccaucuacugggaacucuucauguccucucucuucuccaugguuccacgaagcccuagaagguucaucucggugauaaggauacacuuugucuccaccaucuccuaguucugaucugaauggaacucuaucaugaccaaaaucuggccuuccuaacccccuuucucgacuaccuggaccacgaggugguacccucucccugcuuccagcucuuugaggggguacucucucucuacuuccagcccuucgaggagguccucucuccugacugccagcccugcgagguggcccccuuucucggcuguuggcucuacuguccuggcugucuuguaggccaccugguauuuuaucccgacugcuuccuggccucacaaacacccugucccgguugccuucuccucuguucauuuucucacgacugucuucucuucuacccaucauuuuaucauggaaaucuucuugcuugaccagaccuggaccacgguuaauuaucuggccacgaccucuguuuacuaguccuuuaucccgugacucuuccacucuguucugcccaggaccucuauaugaugagcugcugccuuuauugccuucuaaucuauuuucucugcugucuggcugaggaagaucuuuuucuuggugguuuucugagugggacaaaccaacacccaaagguuugaaaucgucugcagucagugcugcugcugcggcuccucccuccaugcucccuacuuuugaggggaaaguagauugaguagguacagguuuguuugcaagggauacaggcugaguaacaccuucugcuuuguccauuucagucuccauacuuugagaauucugguuccaauuagagggcucuacgggcccuuccgagacuuggcuuuugguuggcucuuguugagagucacuuagauucucauuugacugagcugccuugguauccuugacaucugcggaaauggaaaacgcagcugacugaauuuuuaaauucuucuguugguuauuacuuguaucugcuaauggcucuuuguuuccugaaagagguucugcuugugacuuagguugcugcuuaggcugcugcugaugcugcuguccaacaguugcuuuggggccuuuccacugugguccacucugucgaggacuuagggauguauugggaguuauauaaaauugagaugcugggccccgagggaucguuccccauuugcuuuuagugcccucugcugggugacuuucauaucugggucuuggcccaucggggcgauuuccuucaaaacgaggcccuuugggucucgguccuucacaccuugacccuaaauccucaaaucuucgaggaccaucaaaucuacaaguaaaacaaaagauauuacucaagacaguaaagcaggaaaagaaaauucuccauguaagauuauucaaggcacucuugccuuagacuuuguuuuuaacagugacucucggucauuagcaaaucccaugucaccuaucaaaaaccaaacguuaaggcagcagugcuuggaagacuucaggucuagauguagaaaucauggcagcauuaucuaacauacuucaaccaaucggcagcaagacugaacuacugaaauguuaaaagcauuguaaauauugugccaugguacauggaauaguccacuccuuuuuaaauagaaaaauaauaauaauuccauuacugugaguacuuuuagaguuaaauuuuaacuaaaaaccaauauggaucaauuaacaggaaaauacaauauaauuguaaauauuguggaagccagcacuaaaaucuucauuaaugucauacacacauguacauacaugucauacaaacauacacacaugucucucugucucugucucucucuaucucacacacacacaccaguuuuccaaagucuggacagaaauugguuuccuggggaccacucacuaaucaaagaucaaagaaauguuccuuccaauagacgguaugcuacacuuaagacauaagaaaauguuguuggggccuucagaaucaacaaucaaaaaaacaaaaaagcaaaccaaucuguaaguguugauaaagugucaauaggugaaaagaugaaaagacagcagggagauaguagucagcaccacccaggugagaggcacacugccaugcaaagggcuuccagagcacagaugcuuugcugagacuugaaaggcagcaccugagaugacaggguguuagugaugacagaaauaguauggcaaggaucccucagacuaagagagcaauaugagagggaaaaaggaagagaagcacauaucguguuuagaaaugcaaaugguuguguaguguggcugaagcagaggagagcagaaaaggaugcacagaaagacagcaugcuaaggaugaaggcaaagaggcaggcaacugucagucuccaaaagaacuuccucguuugccuuguguggcagguacuaaccaaccaucuccuaaacucacucccuuccaacucucauccagccuccccgaguucagucuuaugucgacuccuucucaaccucucuuauagcuggacuugcaccaagcuccagcugagaauggaaaacgacugacauagucuucuggguuguccuuguaaauauuagggauuccucuucacacuucccuuuuuaaugcugcuuccaaacaacuacacugcacuuucuaagucagggcuggugaagcaaacaguaaagaaccccaguuccgaagccacuguagaaauccugagagaagacauuucuaaucuguuagagaucucuuucugucucuaacagccuuugggucucuguaagguugauuaauuaauucaacugguuaauucaguguuuauaguuacuucauaacugcuuaagagucacuuaauacaguccagcuuucaaagaauaguuuuuaaaaacuaauaauaaggaagaaaaguuuacagaauaguugaucuugcuuguuugagauagagccucacuaagcagccccagcuggccacuaaacucaugaucaacaauguggguaaugaagguagcagcaacagcaugcugcaaaguaaguuaggacugguacaguuuguagccagugggaauuaaggaaguauggcaaaggaagcauuuaggacaauggcaauguuuauaguuuaggugacuauggagcagucaacacuuuucaugccuuuaaugaaggguuuuuguuucacuguguggaaaaccaaugaauaauaaaaguaauuucagcaaaauauuuaacucccuugcuaguguaaaaaagucuugguuucaaagggaggagcuacuauaacacagaaccaacacuaaccauaagaaacagaggcugagauuacaacuuugagguucugaaucaacacaauggaaggugcuguguugacugagaggagcugauccccucugagacagguccuuccauauggucagagcuggucuagaaggcauggcccuccugugucaguauaaagucuaggauuacagguguguaacaccacauuccgcuaauccuaacuucugggaggacacugagccacaugagcugaagugcaagagauucaagacagcccucacuacuuccaugccugacaauuaaacggaggugcuguagauagggcucaauggauaaaaggcuuguggugcaagggugaagacuggaguugugcguuccagccccacauacaaacuggauggagagcuggaaucacggcccugcaaaggaccuggguucggauuccagcacccacacaguggcucacaacuaccuauaacuccagucccagaaucugauagcuucuucugaccucugcagguaacaggcaagcacgagguacucauacagcauacauauauguaagcaaacagccauacacauaaaaacaaacaaacaaugaugagugaaugggacagcuuacuuguguacaggagguagucagggaccacucggacaaacuaacugcuuagcuaauuuagccaacuuugacuucaucgauagaucuagucucaguaaacauagcuuaugaaagagagacauccaaugucaauuucuagcuuccacacauacacucacacauguacaucuacauaugcaucacauaccauauagagacacacccacaaaauaaaacaaaauaggcuuggcagauggcuuagcaguuaagagugacagcugcucuuacagaagaccagaguuaauucccagcacccaugucagguagcucacugccacccauaauuccacucccaaggaauccucuaugcacacacauacauacaaauaauaaugaugauaacaacaacaacaacaauaauacagagaccuugacucuaugggccaacaaaaauaucaggcucagcugagguuccugcugaggguaaagggacuauggauauggaaugggagucaacacuaauauggaauggugccaacacuucuuuucaggggaaaggauuaaagugcuuuugguugucuaguuaucauacuagguauaaaaaucucccuaggaacaagugcaaucagaaacauaugggaaagaaucugauaaugaaguuuagccuaccuggcugauacuuuucaaaccuaucacaagaaagcagaauauauauauaaacccacaauaaagagaaggcaguagaccagaaucuuugguuugaguuaucuuuaaaauuuugucuuuauagacagagucucuaguccaggcuggcuuuaaacuccuuauguacccaaggauaacuuuugauccuccugccucuaucucccugguauggggauuauauacaagcauaguccaccauuccaguuuguggaguuguugaagaucaacaaaagccucuauaugccagagaaauacucugccaacugugcuauaaccuuggcccuuguuuguaaauucuggaagacaaaggacaacaacaaaaaauuacaagcagcaauuuucagaagaacuguacuggcagcaggagaggauaaaauaaaaaugugacuggcugcccgcagaauccaaaccagucaggauucuacagugccugagauguggggggaagaaggaguuaaaauguuuauucagcuucccaaaauaaaaggugcaagaagccacucacguguaugauuaauggucuuguauccccgccuggaagaacaaggccuaagaggacaaagcccagagaaaaccugcaacuuagcacugaguucuacuccccacacuagagggacugcucagaguaggaagagccaaucauucugugcuggagauuaucaucuuauaaaaaucaaaauuuacucaccaggagauggcacaccaucuuaaguuggacugggcacacauuucagagugguuuucaugugacauuaaggggaacaaaucaguggcaaugaaaauaauuggaaguguugaacauugcacugagacagcacugauaaaaccuguuugcuagggcuggagagauggcucagcaguuaggagcacugacuguucuuccaaagguccugaguucaauucccaacaaccacauggugguucacaaucaucuguaaugggauccgaugcccucuucugguguggcugaagacagcaacaguguauucaaaaaaaucuuuuaaaaaaccaaaccaaaccaacccaacccaaaauaucuguuugcuaaacucaguucaaauucagaccugaauggcccagugaggaaacucugcucaacuacuagaugcuuaggagauuaccaacgaugggacaugaaccuuuuuaaagaacuuacaacuuaaaaaauuuuuuuucaaauauguauuaaguauuuugaccacauacaccucccauuacuuucuuuuucccaacuccuuagaaugaacccuuucuuuccaacaauuaccccuuccuucauauccauguuugcauuccacuaaguuuacuuagggcuguuuggagcauagaguuacuuaucaaaccaugaacaauuaacagugguauagccacaggaacuagagcagugguuuucaacuugugggucaaaaccccuuuugauauccuguauaucagauauuuacaauucauaacaguagcaaaauuacagguauaaaguagcaaugaaauaauguuauggcuagggcaggggggccggggggugggggggaggcugugugucaccacaacacaaggaacuguauuaaauggucaaagcauuaggaagguugagaaccacugggcuagagagaugacucugugguuaagagaacuugaugcuuuugcaaaggaccugggaucaguuaucagaacacauacaguagcucaugaccacccauaacucuaguucuagaagaucugacaucaucuucugaacucuuagagcaccaggcauagcaggucugacagcacaugccuuuaaauccuagcacuugaaagacacaggcagguugaucacugaguuugaggccagccugaucuacaauagaguuccaggccagccagggauacacagagagaccuucacucaauccuccuuccugcaaauaaaaacaccaugcaccauguaguacauacacaugcaggcaaaacauacagacauacaaaauaaaagguggaccccccccaaaaggauaucauuaacccuuaguguuuccucauguacaguuuuaguuuuagaaaaauucuuaauagcucuagcuauauauaaaaccaaacuucauuaacaguuuuccuuguaggucuaacuuauaaacaaacaaaaauuuuagguuuuaaaaaucagaaaaaggccagugaaacagcucaguagguaaaugugcuugccaccaagacugugugcuauccucgggacucucguggaaggaaagacccaauuuccacacacagauacaauacauguaagaaaaaaauaagaguaauguguauauuaucuugcaacuaucauuuggauucauucuuaaacuuacaaaaacugagaucuuagugauuucccccuauauccugaaacacuucauaauuuccuuauccuagauuugauugcucauaacauuaauauuucuuaauuaugcuuuaaaaaaccaaaauaaggaaacaauuacaacacaaaaagaaucaucgaagagaaugaaacaaagauaaaagaaacauuaucacauuagaauuacccaaaauagcacacuguuuuggggcuucauuaagcacaaugcaaacucaaaacuuucauuucuuuauuguaguaauaaagagaagaaagcugacagauaaagcugcuucaauucacuacaacuugggagcuggagagauggcucaguaguuaagagcucuuccagaagaccugccuuagauugccagcaccuaugugguucacaaccaucuguaacccaaguuacagagagucuaauacccucuucuggccucuaucaacaccaggcacgcacaugggacccagacauacauguuaucaaaacaccacaauacacaaaauuauuauuuuuuaauuauuuaaaaauuuaaaaauuauuuaauuuuuaaaauuauuuuuaaaaaauuuaaaaauuauuagaaucaaaagauaugugcagagaggcuagaauuccaggcucuaaaagucauauccaauucaucauguaugugaaccugccaaccaugaaucuucaggugauuauauucuagaugaacauucucaagcucaagaaucaauaagcaaacaauaaauucuacuuauuauguauggguauuuuguuuucaugcaugucaaagagaaugcuuaaucucuggaucagcugugagcugccaugcgggugcuggaauugaacccagguccucuggaagaguagccauuacucuuacugcugagucauuucuccagcccaacccccuuccuuuaaauagcaauacauucugaucaauggaaggcaugcaguacugccaccucuuagucauuaaacaggaaagacuuuuaaugcauauuguguggaaagaauuuggaccaucuugacucucuaaaaggauacaaugacaauuaucuuuuaugauuuuauaugucaaacuauuugauacaaagcaaauuuacucuuaaaaacacuuauuaaaacuucaaaauuguuuuucacaauccuuuuaaauucuuuuguaaaauuuaaacuaaaagugguccccugaacccauacagucaacaaugacaccuuuucuucuauacccgggguuaaaguaaguaagcgcuacagacugagaaaccuguaauacauauaauuaagaacugguucccagaauauauaaagaauuucuauauaucaguaagaaauagaaaaauagucuaauuaaaaaaaaaaaaaacaaccuugaauuaguguuucauacaagaggaaacuuaacccagcgauaaccgaauggaaagcaguguaacuuuacuauuaucaaaaaauacaaaauuccaacuuuuaucacuauaacauuaaccauccucccaggcagcuaacauuuuguaaguuuaacaauacuaagaguugucauggaaguuaaaaaauaauaaacaaaacaaaaacucugaaauaauacuguugaauaaaguaaaagcaccuuucugaaaaaccauuuaacaauauguaccagcacagagcacauacagaccagauccuauguccaaacaauugcaauccuuuuaaauugugguauguccacacaauggcaaacuguaugggaacaagaaagaacaaacuacugcaacacuugcaaagcacaggaugaaucugauagcaacagucauaugaaaaugacaaacucagaauguacacagagcguggcuacaacuacacauacaaaauaucugaacaaaagcacaugcguacacucaggcacagucaagauauagucggcaccaaaagacauacugcaggccaaugagauggcucaguugguaaaggcaccugcugccaagccucauggccuaggugccauccugggaucccuacgguagaaggagagagagaaccaacuccuacaaguuguucucugaccucuacaucgggcugcaacaagugcauauucauguacauaaaacaaacagauauacagauacacuugacauuucaacauuuuuaaucauaacugauaauuaauauuagaacagguuauaauaaaaucauauuaauggacuacuccccagcaauaagaauguuaugcaugacauaaucucacauuauaauauuaagcaaaauauaccauaucaaagaaguauguaaaauaugauccuauugcucaaaaaauaggcagcccaugguauaaaaguuaguauagugguaaucuuuggguugaggagaaaugacuaagaagggggaugaggaggacuuuuuuauguuuguuuugccugcaugcauauuuguauaccaauacgcuuugugcucacagaagucaggagugggcauuggaucaccuggaacuggaguuaaggaugguugugaaccaccaugaguuuugggaauugaacccagguccucugcaagaucaacaaaagcucuuaacuccugagcuaucucuuuagcccacugaggaagacuauuuaaacacuaguaauuuuuauuucuugaucugaguagugaugauaugaguugugucuuugugaaaauucauaaugcuguguguaacaaccugguacuuuucuacauuuauuaucaagacaaaguuucauuacugaaaaauacaaguucuggggaauucaaauucacuuaugugagagcagacaaacacaaggauacuucguccacaagaaccaaugaagagaaaacacacacacacacacaccguguucaacaacauauacugugauaugcuuuugucacuugacuuugagaaaccuucagagucuagaaagcugccucaaucugaacuucugcaauuccuuaaugcauuuaacagaacagauaaauauucuacuacugugguuuuagucaaucaguuuaacuccauucucaguucuugucuuucuaucaguuuuguuuuaggacauuuuuuuuccaguguggcuuacagauaucccuuaugcauucauaacagaacuugaaaaaacauaaaagaaguucgguuuccuuaagaguauagauuguucuaacuuaaucucuugacuaaucagccucguguugauuuugcuuuuaacucaguuauauaggagaaaaaagauguuucugaguaacagucauuaacuuguuucuuaagagccguaugaggggcccacaaauuuaaucccagcauucaggagcaggcagaacucuuuugaguuugaggccagccugguuuacaaagcaaguuccaugauaggcaggguuacacaaagaaaccuugucuugcaaaacauaaguaaaggaagaugggcagaaaugggaaggagacaaacuaaugcuggagaaagacagcauaagcagaauucaauuuuagggcuaaaaacccaaccuuaucaaaguuacagcauagugaugcaugcuaccaccuuagcacugaaccuuaucaaaguuacagcauagugaugcaugcuaccacccuagcacggaggaggcugaagcaggaggauugagaguuugcaacuacucuaggcuacacaaugaguuccaggucgaccugagcuaaguagcaaggcuguaucucuggcucaagaaaugacaccaauaaaucaaacugaucaaaaaaagaaaaaaaaaauguugcaauugauaggaucggaguuugauucucagcacauauaucagguggcuaacagauacaugcaacucuagcuuuagaagauccaauaccuucuucuggcguccuugggcaccugugugcauguuaauaugcauauaaauuuaaauaaauuaauaaauaacacauaaaguaaauccuuaaaauguauauuugcauuauguagaauuaggcuguaaacaggccaaugauacuucaggcccugaguaaguguucaucgugaaggagaccaacaaaacaccagcuccuaaaaaggaagcaggaaaaacuagaaccauugagaaugugaaaagaauuugcguuuauauggcuggcagaaagaacaaguaaguuaaggcagugagauaaaagaacaguuuuuaguaucuguaauaauauucuguagaaaagaauaaaauaacacacucuguguuguuccacaguggcagaucuagaacagauagacauuauauuaauauacuuagauuuaauguuuaaaauccuuucuaaaacacucaaaaguuuuaaaagacaauguuccuuuauuuacaugccaauauuuaagcacagcccaucaaccucuugucauaaaaaauacaaugaacuuaaaagaggaucagaaggcugugauuccaaucucaucucaauuagaauaauagucuggcacaacuuauuauuuuuaagauuuuuauacauuuuaucacuuauuuguguuugucuguaugugugcagguacaugugagucacagcaugcauguggaggucaaggacaaccugugccaaccaguauguagguucuagggucacacucuggcaaucaccuuuaccaccaaacaccuucucauugacccugguauuucacuuauauucagcccaaguuucagcuaaauucuuuaccuucuuuacagucacagagucauuuagagaugacuuauauaauaaggugauguacacaagaccuggcacagcaagcuaaaauacaacauaaaccugggcugccagagagggacuacaauagguaauuccuaaaauuccuuagcacuacgguuauuaauuguaccuuugagggaagaacuuaaaauagguccuauauuugauagucaaaagaggaaaacaguaugagaggcaucaugggagguggaaacacacuuugaggugguaagacugcaugucucugauaaccaguugcuaaaaggcaaagcuugcuccuugagacagacaugcguucaaaucaacaggaugagcuauauugcaaaugagcgaacagcacaacuguagucagaacugcgugaaucugaaugacggcauucacacagggcuuaaaguaguuugcuuuggguagugccuugguucuaugucccagucacgcaacacugaucuagcaaguuagcucucuucuccgcuccagacgguagaugguaauaggaaauaaaucaccuaguaccacagauuauucacaagacuccccaaaaauggauaugaagguucuaacauggcuccagaguacacagaggaauucagacuaauuacacuuaauuuuuucugagcuucagcuuugaauggaguuuugaucauguuaguuccagaacuuuaaauuggggaaacaaacaaaaaagauacauuuuuuuuuuccuuuagagacagggucuccuauaguccaggcugucuucaaacuuacucuauagccaaggacuaggcuuggacuugugagccuccuaccucuccuuccuaacuguugggaaaauaagcaugcaccaacccacucagguaacgugguggcaggaucaaacgcagggcuuugcaaaggccagggaagcaucccacaagcugagccacauacccagaccauaugcuuuuguuuucaaauauuaaagguuuaaauuuaaaaugaccucaaugcacugacacugaaaccagaaacuaauauacaaauaacugacaaaaacgaaauuauauaacuuucaguauaauccuguauaugauauuuuaaaucucucaauaauagaacuaaauuuuauaaauauauauauuucuuucuacuauaacuucugaccaggggggaaaaaaccaauuaaaauauuuuuccagcuagauguggugguggacaccuuuuaucccagaacaggggaagcagaggcagauagaucaaaaccaacuuggucuacauagcaaguuccaggucagucagaguuauuuagcaagaccuugccucaaagcaaaauaaaauuuuccuuagaaaacuugacauuuaugucaucccaagagaaagcuagacucuucuaagcuuggaaacaugaaucuuacauauuucuuuugcgaaagacuugauaugcagaccaagcuugccuuacuacguauaguguacuuuuuaaaaauuacacucuguauguaugugggcacacauccuccuugucccauauggugcccagaggacaacugacaggagacaguucucucugcccagcauguggguuuuagagacagaacucaggucaucacacacaguagcaggaacuuuucccaagcucauggcucagccucuugaauacuagguuugcaagcauacaagaccauuccuugcugaauuuaauguuuguuuguuuuuugagacaggguuucucuguguagcccuggcuguccuggaacucacucuguagaccaggcuggccuuuaacucagaaauccgccugccucugccucccaagugcugggauuaaaggugugcaccaccacugcccacugcauuuaaugcuuuuuuuuuuaaaggaaaacaaaacagcaaccaugauuuuuuucuuuucuaacauacauauauacacauacauauauacauacauauauauauauuucccuccuccacuccuaaagaaaagacagacaucucccuaaggaaaauauaaaggaugcaaggucccaggggcacagguggaaggguggcagggauuuugugacuuuucuuuuguugacuauuuugaguaaaagcaggaacuugguaggaugguuuguauaugcuuggccuagggaguggcacuguugggagguguggccuuagccgccagaaagucagcuaacagccuucaaaugaagauguagaacucucagcuccuccugcaccaugccugccuggauguugccauguuccugccuugaugauaauggacugaagcucugaaccuuuaagccagccccaauuaaauguuguccuuucaagaguugccuuggucauggugucuauucacagcaguaaaccccuaagacauguggaaucuguacaaacaaaugauuuucuaaaagguccuauuuacccuuauacaagccuagcaaaugauacuugcuaauucaauugucaaacaaucaaaaagaaaaacaguuaaauuuaaaguauuauucccacucuuucugucucugacuuauccuuucuguuauaugagacagcaggucauauagccuaggcuaagccugggcuugacuuuacauauagcucaggauaauccuugaaauccuaauucccuccugccucugcuuuccaagugcugguauuacaaaugugccauuauauuuggcuuaaaauauuauuucuaaaacugcaaagucaguaaaaguggucagcauuacucuaaaauacauucauucuagacuacuauagccagauaaaaguagucacauuaaaggaacaggaguaugcaaucuuuucuaaguuaugucagguuaaauuaacaaauaauacuaacauuuuaacuguaaagucaugaguguauacauaaaaguacaaaggaaauacaaaaacuguauaauguuuggauuccaguacagcuuauauaaaauuggccacaguaagagcauugaccuaccuuggaccucucggaccuuccaagaaacugcccuuaggagggucugcaagcaguccaccugacuucacuggcguguccuuagcugcaaugauggacugagauagagcagaagacucgcccaguccuugcucagaugagaacaccuuguucagagguuuggaauucacuuguucugacugagguggagggugauauggugaagguggggucgauccaaaagacacaggugugggaagcagugcuugucuagguuucucugggaucugugaguucugagaaccagaagcugguggaaguggggcuguuaacugaggaggcaucccuuguggagcuccagggggagguauuccugggggagguguggcugaagauaauggugggagggguaggauggguggucccccagguagagccggugggggaaggacugguggugacccugcugaagagagggcagguggagggagaacuggagguggcccugaagaaagagauggaggcauuccugguggggggacagagguuggcagagaagguggcaucacaggcggaggcaugccagguggugggauggagguaggcagggcagggggcaucacuggugguggcaaggauggagguaauacuggagguggcauuguuggcagagguggaggcaucugagaauacggaacaaacggagguggcauugccauguuccccagguacuggcucuucacagucuggaacgaguugacuuucuccuggagauaggucugaguggcuuucauaugucccugccaugucuuccacugcuucucauacuccugaagcugaucuuuaugaggauaggaauggagcugcuccucccacagcugaaacucucgcucccagucuugaaagagauguugaaacuguugcugcugcaucucauaaugucgcagcugcacauccagagacauggucuacaaauaaaggacaaacauucuuucaagacagccauguaugcauuagucccaacuuacauuaauaagucaagacuacaugaaauuuuaggaaguuaaaaaacauuuccaaggggaaagauaaaacugcuagacccuuuuagugaugaucuuuuucuucccuugggcuaaacaacaucacauuacucuaauauccuuucaaacagcuacuugucaauacuuaauuuuuuaaagauuuauuuauuuauuucauguaugcgaguacacugucacugucuucagacacaccagaagaaggcaucggaucccauuacagaugguugugagccaccauaugguugcugggaauugaacucaggaccucuggaagagcagucaaugcucuuaaccgcugagccaucucuccagcccccacagucaauacuuccuuuauugcuaguuguucauacucacaagucuuuuaggagcgacaaauccuuuaugcaucuugggaauacuuccugcuuacuuauuuuggaaacacuuaccuguauguguggugagugcuggauaacuugcugguacugcugcaggaucugcuguaacugugugugccucugcauuauuccuugauacuggaagccgacucgcugcugcugcugcuguugccaaugugcugcugcagccugccaaugugcugcuauagccuucaacuguuuaaaucuagcauccuccucagagucuuccgagucuucugagucuucugacuaaauaagagaaacacaaacuuuucuaagucauaaaacagcaaccaaaucaaucgggccuagaaucccuccaacucaggcugagaacugcucuccuauauuuagacaaaacacaaaucccccucuacauaguuauuguggaugguaggacaagggguuuaagagccaccaucuucacuagauaggauaaccauuuccccagcaggaaguaaaucuacaagucuaguacuuucaacccaaugagcaguagagaaccuccaugccuuccuucucuugcccucucucucccugucacuguucacuaguggucuacgauauauagcucagcaaagcugugagaauguggggaguuuccaagcuucagucaacaagcucaaugugacgaagauggucauuugugaugcuucaacacuguaagacggcuauuauaaaugacuauguccauucuucagaugaguacacuaguagagaaugauuagcuaaucuguccagagucgcaguguuugggcaacugaccauaaaagcuaaggauaaaugacuucucuguacuguggucaugaacccgcaugaacauuucucuuuugugcugagacaagaguaucuuauugcuucauuuucagucaaccuucacauaauuccuuugcuaaaccugauaagcugacaucuggguacuucaaaaguagaauuuuacagguaccugagcacaugaaaauauacauccauucuugacacaaguguuuacaaaauuuacaugacugaauaaacacaaaaugauuaccugggguuccucaggugagagcggagguggugcuucuucauugggagguggcaaugggggcuucucagcugcaagagguucugcuaccugacuggcagcuggccccggagcuucuucuuugauggguucugguacauccuuugcugugacaagacccuuuuuaugucccggcaaaugcaccuuuguccucugcugcaaacuaaguagaugcugucgauaccaauauuguuguugcuccuacaauacaaagcauuuuuaagaauuuuauuuuauuuauuccguauguaaguguguuuauaggcgaaaccaugcagugugcggaggggaggccagguacagcuuucaggagaugguucucuccugccaugugagcuccaagggacacaacucaggucaucaggcaugacaauaaacgccuuccuuccugacccauuucuuugauucauuuuuaagaauguuaauuaauaaucacauaucucugcagcuggugcugacagagucacauuuauauacauucauguaucuaaugaaagaaaaaaacaaagcuggacagagaaagauaaguuagcaagacagagaagguuuuaaguuuucucaaauuuauaaauuuaaauuaaaccauacaucauaauugaacauauuucugguuuuuucccuucaguauuugugaugauuuguauaugcuuggcccagggaguagcacuguugggagguguggccuuaucggaauggguguggccuugugggugugggcuuuaauauccuuguucuagcugccugggagccaguauucugcuagcuaccuucagauaaagacguagaacucucagcuucuccuguaccaugacugccuggaugauaccacauuccugcuuugaugauaauggacugaaccucugaauucaaggcuagccuggucuacagagugaguucuaggacagccagggcuacacagagaaacccugucucgaaaaacaaaaacaaacaaacaaacaaaaaagaguugccuuggccaugguaucuguucacagcaguaaaacccuaacuaagacagugcuaaggauugaguugaugguuuuguguagugcaggcaaguuuuucacuaccaacuacagagacagaucuccucuuaaucuuuuagacagaaucccaauauauuguccagauuggcuuugaacuucgccuguagcuccagcagcuucagucuccugagcagcugcaauuauaagccuguuauuauacccagcuaacauaacaguuuaaaaaauauauauauauauaagauguauauauauauauauuuauuuauacacacacacacacacacacacuauagcugucuucagacacaccagaagagggcaucauuggaucccauuacagaugguugugagccaccaugugguugcugggaacugagcucaggaccucuggaagaacagucagcgcucuuaccaaugaaccaucucuccagauccauaacacuuuuuaaaaaauguuucugaccggguguaguggcgcacaccuuuaaucccagcacucgggaggcagaggcaggcggauuucugaguucaaggccagccuggucuacaaagugaguuccaggacagccagggcuauacagagaaacccugucucaaaaaaacaaacaaacaaaauguuucugagccaggcgugaugacacacaugguagccuggucuacaaaaugaauuccaggauauccaggguuguuauacagagaaacucugccucaaaaaaaaaaaaaaacccaaacaaacaaacaaaaaacaaaaccaaaaaaacaacaaacaaaaccaaaaaaguuucugguugaaaaauaaugagucagcaguaagagaacuggguucaguuccuaguacccacaugguggcucacaaccaucuuuaacuccagcuccagggaauccaaugcccuauucuuaccuccuuugacaccaggcaugcauguaguauacauacauauauacagguaaaucacugacauauaccaaauuaaauaaguaaauuuacguuucugaggggugggugugggagcauaaaccuuaaagacuuauaagaggguaugugucagauugaucugaguaugagaccagucugucaaacuaaacacaaccaaacuacgaagguaguuaaggaugaaauguuuacuaugcaaaaugaggaccugagcuucaauuuccagaacccacaaaagagacaggcacugcagugccggucugcagccuaaaugccagaaggcagagucagaaggauacuauucuuuaaacaaaaucucaaucguuuuauuuuaccaaugaagacucaggagccagaugcuagggugaaagccugccagcucagagaggcagaacaagcugaccuuccucagcugacccagcucaaacugagugucccucacuucuaucuccuuugcaucucugacucuuacucucuaugguuuuuuuucccuauguucacuuccugucaccugguugcuugaucuguugaucuguuuacaauauucaagcagaaaacucuuggauuaaagacaugugcaaaagcagagacacacaacuaaaaacagguuuuuccaguaaauaacacacucuccggguucacagugugaucaaauguccuacaacaggaggaucccuggaagcucacuggcaaaucagucuaacuaaaauucccuacuugacgugcagugagacccuguaccaaaaaaaaaaaaaaaaaaaaaaaagaaaaagaaacugaagauagacaacccaguaucaaccaacccuuugccuccaagugccuuugcauccaugcagauacacacagaaauagaaaaaaauaauaucaauucucauuauuuguagacacuauauaugugaauuugcucaucugcuaaaauuuauuuccaacuccacuaacaggacuugcuaagcuuuuccagucauuuuauaaacagaugaagaacagugaaaguucugagcagccuacuagguguguucccagcugagggagaacaaggugguguagccuucuggccacacugucaucucauagugcaguuacugccacaaaauccaacaauguuuugcuaguuauuuaaaaugucaucacucacacacacacacacacacacacacacacccaaucacucaggaauguuggcaggcagaccagucaucuggucuacagugagaaccugccucaaaaaucaacaaacaagaaguaaauaaacaaaaguacaaggcugcccaguaauaaugcuuaaugcugucgaguaucccuaagcaggcugugauugcccuuacaagaaaauauauguuccauaaacuucauucaagaaagcauuacugucgcagggagugguggagcacgccuuuaaucccagcacuccggaggcagaggcagucggauuucugaguucaaggccagccuggucuacaaagugaguuccaggacagccagggcuauacaaagaaacucugucucgaaaaacaaaacaacaacaacaaaaaaaaaaucuuaaaaaaaaaaagaaagcauuacugucuaccaagagcuaaauacuaaugaauuaacaauaucuaaaaaauaaagugguuuuagaggggaaacauguuauauguugaggaagauaugauuagaagcuuagauucaucugaauuuuucuuacaacaaaggucuaauaucaaugguauugcacaccuuuaaucccaacaccaggaaggcagaggcaaguggucuacaaagugaguuccaggacagcaagaguuaaaaagagaaacccugucuugaaaaaccaaaaacuaacuaaauacauaaauaaaauaaauuuuaaaaauauuuguaugcacacaggauugaaacccaaccuagcagggugugguguauacacaaaaauaugccuuuaauuccagcauuucugauucagagguauaagaauuugugaguuugaggggagugaggucuacauaucaaguucuaggccaguuggugauacacagacuccuaucacaaaggaggaaaaggggcuggugagauggcucaguggguaagagcaccugacuguucuuccgaagguccagaguucaaaucccagcaaccacaugguggcucacaaccauccguaacaagaucugacucccucuucuggugugucugaagacagcuacaguguauuuacauauaauaaauaaauaagucuuuaaaaaaaaaaaaaaacaaaggaggaaaaaaaaccucacucuacauuuuauucuuuguucuuucuaaagcucaagauauaauuuuaauuuacaaaaaucuauuuaaaacaauuuauuuauuguuauaaucuuguuaaucuagauugaaucagaaugucccacucccaauuaguuguuuucagauaggaacucacuauguaaucuuggcuguccugcaacuuccuguguagaccugguuagcuuugaacucaaagaucuaccuaucucugauuauuacugaguacugagauuaagguguacacuaccacauuccgcugaugucaaaaggguuaauuuuacaugcucacuuuuuaacuauuuauuuuuggcuuuuugaggaagggucucuacauaguucuggcuguccugaaacuagcucuauagaacagccuggccucaaacucagacagagacucaccugcuccugcuucacagugcuaggacuaaaggugugcgccaccacaccuggccacacuuucuaacccaauuuugaucuugggugaacaguuccuacauuguuaauauuuuauuuuauaaucucuccuaauuuucugugugcaaagagauguauaaaauauacuuaauagauacauuuuuuucccaacuagacugauuuguuauuuguucacuuacacaguguaauuuucuuugauuaaagacauuuuugagauagggugcaacuauguagccugccucugcuaugaugacuuacugggauugaaggugcggccaccaugccacagcucauccucugcuauugugaucuagucuuguaacuuuaggaaagugcuaaaucacauaacaggauaucaauaaaugauacugaccaccaaaagccacuuauuuugaccuaaaaccuuucuaauuuauuggcaagaauaaauuuuaucuuacuaauuguuuuggcucuuauuaucauacauauaaucaucaguucccagaacaauauuacuuuuacuacucaaauuagaaaaaagugugugguggcacacaucuuuaacccugaaguuugggaaacagggacaggcauaucucugaguuccagaccauucuggucuauauacccuacucgaggucagucaaagcuacauuagugaaacccugucucaaaaaaauaguacuacuacuaaaaaaaaaaacaaacauaguaauaauaaaaaauaaaagaaauuaaaagucagcaauaaugaaauauuaaaacauuuuuucagccaggcauggcaccauaugcacuugguagaagcaacuacacaguaaguucauuaucagacucagcuauaagaaucccgaucuuagaaaaacaaaagaaaaaagaauucaacuuccuuuacuacuuuaacaaaauaguaagcaagacagugguagcacaugccuuuaauccuagcacgugggggcagucuaaucucugaguuugaagucagauaggucuacagagugagcuccaggauagccaaggcuauacagagaaacccugacuugaaaaaccaaagaauauauugaaaauaucaauagauacaucauucaccuuaaaaaacuaagucagggacugauaaugcagcucaucaguugauagaguaucugcuugccaaguaugcacuaauuccugaguucuuuucccagcaugaaauaaaaccaagcaagguaucacaugccuaggauguuggcacucaggaagcagaggcagaagauaguaaaguucaagguuaugagacagcaaauaggguaaaggugcuugcugagcaaaagccuagugauuccaggaaccuacauauaaacaaaggagagaacugaaucuagaacauugucuuucaccuuccacaugaaccacacacagacacacacacacacacaagacacacccacacaauuuuuuaaaauuuuuaaaaaggccauaaguucaaagucaucauucuaagcuuaauagccaguuaaaggcuaaccaggucuacauggagaauuugccuccaaugggguacauguuggggcuaagggcuagggauauuacugagugauuaagagugacaguuucucuuccugggauuaaguucccaguacccacaugguggcucacaaccaccuauaauccaguuccaagggauuugauacccacuucuguccucuaugagcaucaggcaugccaugguucagauauacauacagcaaaaacacucauauacauaaaauaauauuuuuuaaaagaacaaagaagccgggcgugguggcgcacgccuuuaaucccagcacucggaaggcagaggcagguggauuucugaguucgaggccagccugguccaggacagccagggcuauacagagaaacccugucuugaaaaacaaaaaacaaaacaaaacaaaacaacaaacgaacaacccccucucccaaaaaaagaagaacaaagauaugaaaaagcaaagcaagugaaaccaaggcuucauuuuuauuggugagaaauuggccucaaacacuugcuugucugccaauacuggcauuggagccagggcugccauguguagcuguuucaguugcuuaaagcaucacuaaaagacaaagacaccagcucuuucacaaguuaaaagauaauggcuacaaagaugaacagauauagaugaagauguauguacuauguaugacacccagaaguauauuaaauaucuuacucaauuuuucuacacuucauuuaaaaacaaaaacaaaaacaaaacaaaaccagaaucucuagagcugaagagauggcuuggugguuaagagcacugacugcucuuccagagguccugaguucaaaucccacaaccacaugguggcucacaaucaucuguaaugggaucugaugcccucuucuggugugucugaagagagcaaugguguacucauauacauaaaauaaauacauaaaucuuaaaaaaccagucucucacugaaccugaagcaagccaauucugcuaagccucgucugguugagugucugguaggcccuggggaucuuguuucuacuccucaguauguugggauuaguggugucuaccacacuggcuuucacacggaucugaccaucauguuuuaucuacuaagccaucugccuaugacacaggucuagauucuugaaucuaaacacaaccucuucuuaccucuucaucuuuaucuuagaucaaauccaguauauaagcucuguuaggguuuaaguagcuguugacucagaguauguuuuaguaggucacuuucuauuauuauaaacccaguaagugagaaacacaacuacuucagucuuaggcgucaguauguuuccgaagcucaacaaugaacaaggaugccauuagaaauguccucagugaccucgagguaaagucaaguuuggacugguuaacaauagacugggagccaguucuucugaacaccccagaauauaagauaauuucaugucuuaugggauguugguuuauaaaaagaggaaaggguagcauacguuacuuuaagagaccgacugggagccagagagaugguucagcaggucaagaacuugccgugaaaacacaaagaccuggguuugauucccagcuccuguguaaauguguaugggcaugguguuuugccuguaaucccacacuuggggaaaaaaagaacaagcuagcuagcuagacuagccaaaucagaguucuagaucaguaagagaucccgugucuauauuuauaugguggagaacaacugaagaagauauccaacaucaaccucuagccuccacaguaugugcacacaagugcacacacucuguugccaccacuaccaccauucaacacagagaaacugaauaaaggggucugagacauugagaacucuagaacuauuugccacaaauauuguuacccauaaagaugcuaauuuauucaggcagcacuaacuaccuaaaaccaaggacuacaugauuuugcaagaaagggaauguuauaaagugugucugugugcacuauuuuaaagaugaauauugcaaaguuaccauccccaucuagguuauuaccaacaccuguaauaaugucuguauucuuuguagaucuuaaaugauggaagaaaaccugccuuaucaaucaaacaucuacuuuugaaauugguuuaaaaugacuacuuuuaauaucauuaagauucacauucuccuuuaagaacuaaggucaccagguauauuuaguuuccauuuuuaaaaagaauauuccuuuacuuccucuuucuccaguuccugcccucauucucucuugcucccuuucaguuaaaaacuucuuaaaagcauacucuauacucaccauccccauccucaccuuccaucacuccucaaaucaaugcaauauggcuucagucacuaugaacugcuccugccaaggucaacaauaaucucuaugucaguaagggggaaagauaacucagaauccuuaucuugcuugaccgauuaguaguacuugacacagcuggcuacuccuugcuccagaaguaucuucccuucacaaucuguagcccugcucugcuuucauuuuccauccuucuaauguuggccuuuucuccacugguuauuuggacuggugauucugaggcuagccacaggucuuguagccuccacucuuaucucauacaccacccccccgaagagcuuaucuauuaauaugucuuagaacauauuguauauguauguuuuauacugacaauucacaagaucuugcuucuagacucuaugucugaaucuaacuucuacauggauagcuccauuuggaauuuaugcccaaggaucucaagcuaaguauacauaaagcuuaacuccuauuuuccacagcaucccuaagccuuuucuuccuucucguccucuagguuuuguauuuuauuaagugguauuauuaaucacccaggagcccacuguugggagccgcccccacauucgccgucacaagauggcgcugacauccuguguucuaagugguaaacaaauaaucugcgcaugugccaaggguauuuuacgacuacuuguacucugccuuucccgugaacgucagcucggccaugggcugcagccaaucagggagugaugcguccuaggcgaaauauaacgcuccuaaaaaaggggacggguuuuccgccauucgcucucgcuggcaucucgcuggcucugcgcgcccugcgcucucucgcugccuaaagauguaaacaauagagcgcgcucugcacuuuggcgcgccggagcucuggcuccuaaagauguaagaagggguggcuuucgcuuuuggggcugcgguuuuugcgcuccuagcuccugaagauguaagcaauaaaguuuugccgcagaagauucuggucuguuguguucuuccuggccgggcgugagaacgcuauuaagagcccacccccaagcccaccaauccuugaugccucccuugccaugacuauccaacuggauggauucuagcaggagacaucucuucugucuuuuuaccucuuuacaucuccacuaauaccauccaugcccaaacccccaguuuucuugccuaaauuacuaacaaguauuuauccuaaaucauucuuuugcuuuuuaauuucacucuccacaccaaaagcagggcaagcuuucaaaaaugccaauccaggggcugaagaaaguuaagaggaccugcuauacuuagagaggaccuagguuugguucccagcacucacauuauagcuaacaacuguggauaacuccaguuccgaagauucugacacccacuucuggccucuauaggcaguguauacauaugguauaaaauaaaauaaaauaaaauaaaaaucaaucuuucuaacugucagagcuagagugauaacucagugguuaaaagcacuggcucugccagacaguguuagcgcacgccuuuaaucccagcacuugggaggcagaggcauggggacuucugaguuccaggccagccuggucuacagagugaguuccaggacagccaaggcuauacagagaaacccugucucaaaaacaaaacaaaaaaacaaaacaaaacaaaacaaaacgcacuggcugcuuuugcauuagacccagguuuuugguucccagcacccacgugauggcucaaaaacaucuguaacuccagguuacagcagaucuaacacccucuuagcuccacaagugauuagcauacagguagcaaacagauuuacaugcagguaaaacacccauacgcauaaaguauaaauuaauaaaaaaaaaacuaaaugcccaucuaggcugggaggagcagcgcagugguacagccuaaccugucugcgcaccacuaaagcaaucaggguaucacauuugccuucuuaaaaucccucaauggcuaacuacagucuuggaaauagucuuuaaagcuuucucuauuacauacauaccuauuauuuagaaccugugcugucagagacccuucuugaacuuguuuuuggucucucucucucaaacacacacacgguuuuccuuuucuguuauuuuuguuuuuguuuugagacagggucucauguagcccaagcuggccucaaccgcucuauauagccccggacuccugauuguugggauaaggguaugccaccaagccagcuaaauauuauuuuauaaagguggcuucuucaauuaggauacagcuccuaacaguagucaaucauuuaaaagguaucuaucuguuuuucacuuccaauguguacaaagaauugugaacaacaguguguguaugugugugugugugugaauuugugugugugugugugagaguacaugucuguaauuccaguucucaggaagagaaaacacaaggaccuggaguucagggucagccuuagcuacucaccaaguuuaauaccaaacugggcuacuagagucacugucucaaaaagccaaaauaaacaauaauaaaacuuuuuaaaccuaccuuuucuaguuucuuauauucuaguaauauuucauauuuuccaaucccauggcauccuguauuucuccucauuaaaauaaagucacugacaccaagaaccacagcuaugcugcucaccaucguauguacaguacuaagcacagugcuucaucuuaaaggacacuucugagcacuacacucaaugucaacauuuuacaugggcuauuuggagaaugaaagaaauaaaaccacaacucauugagaagacuacuauacacuuaacuggucaaccccuuaaacagaaaaacuaacucuuuagaaagaauaucccauuaaguuaucaauguuuuacucaaguaucuagagaauaaauggaaaauagugaaguauuugucccaucuuuccaguacuaacuguauucccaaucaaauagcucuaguucacaagugaauuuucucauaauuccauccacuaagucaggaagaaacugcagaaaggauuuacaaucacacuacugaaaauuccaaugaaaugauuuagucauacaaagaccaucaaugaguaagucacuagagaaauacuagaaagauacaagacugacaagagaagccaacagugagagccagacugcccccaccuaaauccauugaucaagcucagcaucagaagaacugugggacaaccaggcacucacgaugggugcaaauaaagaucuuguauaguguaacaccuauacucuauacauuugucaacaucaacuaaucuucagucuagugcuuuggaguuaaauucuaauuuauaaaaagaaaauagaagacucaacaaauaaaauggcacaauuaucaagauagaagcagagucagaaugucugauauucgaaagaaugacagauuuuucauccaauucagggcauaauguagggggaaaaaggaaacaagaaacagagauauagaucaggaguucucaaagaaggcggcucucucuucccuccagaacuuauggugguguagcucacaaugucuacaaacauuucuggcucucaaaacagggagagcacuacuggcaccauuguuagagacaucaguaaccacccugcaauguauagggaaaaaaucccauaacaagucccaaagguuuacagugcucagacucagaaacccuaaccuacacgauuaagaaucuucuauuuacgccgggcagugguggcgcacgccuuuaaucccagcacuugggaggcagaggcaggcagauuucugaguucgaggccagccuggucuacaaagugaguuccaggacagccagggcuacacagagaaacacuaucucgaaaaaaaccaaaaaaaaaaaaaaaaagaaucuucuauuuaucuuaucccauguuggaucuuaauuugaacaaaccaacaaaauauuacugagacaauuggaggauuuaauaaggaauuccucugaauucugauaacaggagacaagagggaaaucuaaagagacuaagcauuagauaauacaaagacuuaagcuuuuauaauguacucagucuaaaaaagaucuugacucagcaugguggugcaugccuuuuagguaaacagaggcagacagaucucuguaagcuggagaccaaccuaguuuacauagcaaguucuagcugccagugcuacauacugaggcugcaguuuuuuuguuuguuuguuuuuuguuuuguuuuuuguuuuuuuguuuuuucgagacaggguuucucuguguagcccuggcuguccuggaacucacuuuguagaccaggcuggccucaaacuuagaaaucugccugccucugccucccgagugcugggauuaaaggcgugcaccaccaugcccggcucugcguuuuauuuuuuaagacaugaaaggucacucccacccucguucuuuucuuucuuuuuaaaacuagguaacugaggcucuagagauggcuuagcaguuaaguuacuuguugcaaagaccaagacaucugagagagccugacaaccacaggcuguccucugacuuccauauguacacaguggcacuugcaccccacccaccccugccacucacacccaguaaaugauaaaauguaauagaaaaaaaugcuuuuaagaaaaccaacuaagaaccuaauuaagaauguagaacacuggagaggaggauguagcuuugcagacuacuuaacuagcacgcacaaggccuuguggcuugauuccaguacaaaaaaggggaaaaaccccaaaacauauaggggacuuccgggauaacauuugaaauguaaaugaagaaaauaucuaauaaaaaaaugaaaaaaaaaaaacaugagugaaggacagaagauguaagauuugcuuuaaaauauuuaaaauuauguucaugauauuuucucuacuuaaugcuuaaaucuuucaccauacauuuuuuaauacaauacccugaacaccaacuagcucccagaaguuguccucccaccuccugaccuccauaugcacacugagccaugucauguacaugugcagcaggcccacacucccaucauauauaauaauaaauuuaauaacauuuuccaaaucuaaaauaugaaugaaaacauacagaaggauauacaauguuuaucaucuaguaaagcaaguaccuuagguguaaagaaugauaacucuugaaucuuacacaacaaaucuuuauagugguucuacaacuugcaaggcacuguccuaggugcugcagagcauuaagaagacaaacaucaccaaaucacaugagugauuugcauguauggcucauggagacugaauuuugagaugugcuuugaaaguauuccauuuaaaggugagagagaaguuaaggacauugggauaaacuccauaaaguuaaaaauaaagggcaugcaaagccccauuucauuuccuccuucuguauucccagcuggcuuugaauuccaguagcaucuggauggccuugaacucccgaucuccugccucugccaccagugcuagggacugcagguguuuguaucacgaugcccaguuuaugcagugcuaggaauauaauccagggcuuuggggauacuaagcaagcacuccaccaaugagcucuauagucaugggcaaggcucuucuugaucugguguacacccagaccccaagcuucacccugcuguuacuuucuaucuuucagcaagaaucaaaagcacuacauguucaaaacacugaaagaaguucauuucagaugaggcagaaaaacaaaagcaguauuuguuccuagugaguacuuauauuaagauagucugguaugcacauucuucuuuuuaaaagccaaagcugaggguguagcugaaugauagagcacuugacuagcauacccaaggcaccaaguucaaucccaagcacaacaagucaacuauguaacucauguguuucucuacaugcccagaaaaagucagacugaggucauaguuuagcuugaaggaacugggcaacuggaggaaauaauccucaugagcugauguaacuuugguauaagacagcaaaaucacuuauucuaccguccugugagugucuccugugcagacccugcuucucuuaaauacugaacuacaauaauaaacaauuaccuuuuggaaucuuauacauuacccugagcuugaauaucauaagauucuuagugaauuuaagguagaugaggucaaauagucacaauagaugaucuauuccuacuuauuuauuuuugauacagggucucacuauguagcccaggcuggcuucaaacucucccauccucuggcuucuguugaccaaauacuggauggaggcacagguuuccaugcccaacuucuauguuccugcaacccugucauccucuuacuggucuguggaaugcaacaucuucaaaacagauugucaaaaaguuuugggauggcucucacaggagcagccaucacaaaacuuucuuuucaaaaccucagccaaauuccaaggcuauuauuuucaaguaaaugguaauaauaaugaaauguagcaaauucaccaugcggcaaaauuauccuuaggagaugguuuugaaauauaacaacagauucuccaaggaucaagucucuagaggccuauggaguccacaugaacucacaacaucaguuaggaugucaugaugagacuuccaucuuuuaugugcugagaacccacuucuggaaacagacagcuaucucuggccccugcauauuuugcugguccuaagaaauuaacuggucaauauuuacauguauuuaaacaucaguccuuuaagaauuuucuuuuauacugccuccccaugaaaaucuuaguuuaaaaaaaaauuaaaacaaagcucugugcaacaauaaauacugaaugcuggucaaagaaaacuaaggcauacauuugagaaauaaaucuagugccaaccuacuacaacuucaagugccuagucuuaucuuuacucuucuuuugguaaucuauggucaauuuaaaaccuggcuuucagggcugacucuuaggggaucuuuggaguaugaaugggcuagucguuggcuguuggaauuacgauaggcauuagcugguuaaagcccaagaccugcucacguaaagccuaaaugaaagaugugacacagugcuuaccuguggagucauuguagagggaucugguucaggagcagcuugcuucuguucagcagucuuguucuuggccccacucuccaaaggcucuugcuggauagcuguuuuauucccagaagggauggacggugguggugguagcugggguuuagaagggcccugggaggagcgggaaggagaggccugagaaggggguaaguagggcugggaauggcucaaauaugauugugaggaggacgaggaagaauaagaaggagugggcgccagauaggacugggaagguggagacugugaaggggauggcugagcaggaggcagguagggcugagcggaggaagggggauaguacgagggugguggcugagguggaggcauguacgacugggaugggggcauguaggauccuggagguacagggggagauucaggaggggacuccagcuccauuggaaccaaacccggaggcccaucucguuggugguggaucaucugguguuuguacugcugcugcuucugauaacugagggcugguccagguggcgggggcaucgguggcggaggcggcugccagucuccguagccgcccccgggcaucaccggcggggguggcagcgggggcggaggaagauggugggguuggagcacgcacugcauuugcuucuggugcaucugcugcagcugcuggagcugcgccaaguguugcucucggaagcucaugaagccugaagaggaaggggccgcgggagccgucgaacuggaguacccgggccccggcgaggccucgggaagcgccaccgguggcggcggcggcggcaccggcggcggcggauaguggcugcucccgccauaccggccccaauucggauacauauaggaaacgaaggcgcggggcucgucccggcgccguuacucgucgcaaccgaccuccaggagccgcggcggugacggcgacagccggaacucgcggugccuuacaggccgcggagcgugugaacggagcgcgccagugcgccggcgcuacggagcugggcccgcggucg

SEQ ID NO: 6753 - RNA, 77201 nt, Mus musculus
cacuuccgguugcugccgggcccuguauccgguguccgcccgcccuccaucccgcugccuccgcgaugcugucccggucacgcugcgugucccgggcguucagccgcucgcuuucugccuuccagaagguacugucuggcggggcccgggcuccgaugggugccgaacauggcugugggcggacgggcaggccgaagggcagggacgcugugugcuggccaggccggccaccaagggcaccgggacgcgguggcugccgacgcccgcggagccgcccagccgcguguacggagccccggagccccuguccucucccaggcagcccgcgccggccguuuucccgcugucccgaacccuuugcuccggggcugggagccgcgcccgcagcgacauugacuuagaguuaagagaggaggcacggcccccaaccguauuccgcggccugucucuucgcggucuccaaacuagcgccuggcaggcucaggggaggaugacagaguuuggccgacucgguguuuugcgucuacuuucggaguuaagagcacgauaaacgugucauuaccugucagcagcacgauaaacgugcccuuaaaaaaaauguuuguuuguuuuuuuccccccucuuuucauuuugggugacgucgauaaugucuucuuucucaacaggggaacugcccucuagggagacguucccugccugguaaguucugcccuugcggucaccuaaaaugcacuucucgugggcagagcagcaugggaggaaaucugauguuucuucucaugguauuuaaagacaaugaauucagagagaugcgaagcaaaagacucccuuaaguauaacugcugucauguacucacccggcgcauccuuacuggguuuuguucagcuuuuuguggugcugaggauagaagcuagggcaugggaggcaagcacuuaaccacugagcaacaccagcggcccacgguuacugaauuuacacugucagggcacugugcuagaugcucguuagaaauacaacaaugcaaaaagucuuguccuccaggagccugaggcguaagggaaaggcaugguguaaauugcugaucaucaaucaucuaaguguuuggaaacauggacagaacagguuuaaauaggugacauuaaaguuguggcuugcaggaugugacagucagugaagagaagaagaagagagagaaagaaagggguagaaugcaugaagucagugaagaaggaaacagguguggcauucuuuuggaauuggaaacaaagugacuggucagaagccauuaguuaaaggaaacaguaucucgaggaagaugaugguguagaggcuuucggaaguuuagauauuuuuucccuuaaauuuauuuuucuuuauguguacuguguacacacuuggcauucugugcccacggaggccagaagaggugugggauccccuguaauuggaguugcagguugguugggaaaugcccggugccugggucucugcaagagcaguaccgguucugaaccccuaagccuggaaguuuggauuuucauucucguagcuguguguggguuguugucuuugguagaggagaaaguuauuaacaaccuuccauagcuuacuuuuaaucaggugccuggcagauauguauuuaucccugcccaccuucacuuuuuuauuuuuggagacaaagucuugcuguuaggacugucugaccuagagcuaacuaugcauauaccaggcuggccuugaacuuccucuugccucucugccucagagagcuaggauuacagccuugugcuaccacaucuggcucuggcaaaauacuuguugaaagauucaguccuauguauguaggcuuucucgugccagucguuguucugaaugcuuccugugcaguuuuggguuaaucauaacuaagugagauuuaguagcauaguccucgauuucgaggucaaggucacucaggcaaaacuauugguuaaaugaggcucaccuaacuccuuccucagcucaaacugcuuuacugaaagaaggguuggaauuuccuugugaacucaacagaguaugucugugucugaaugauagggucugauauagcccaggcugaacucaaacuagauaaguagucugaggcugccauuuuacuuuugaacauucugccucucuuucccaagugcuaggaucacaggauugcaccaccaggccuggguuuaugcagugcuggaguucaaacccaagacuuuguaccugcugggcaagacucuuagcagucaucugaacuguguccgaacucagucaauagagugcuucuuagguuccuagguuccuagguagggauacagccggucucucucugcaagaaucucuugggcuagcuggacagacaaagcaaaugcacgguuauguacccuuagggagaaaacagcauugugguuacuaaguacaggcugagaagacaugaggguaguaugauaauaaagcccagcuugguagguuagagaguagaaggcccagagaagggacauuuaagaugagacuuaaagaauguaugaguuagccagggaaaugcuauuccaggcaaagggaauuuccugugcaaauguuuccaagcaggaagagacuugagcaguuguacaaaugguaacuagagagacaaggaggccugauacagaggagguggaggacuguaagcgccuggacuuuauccuaagccaggaggacauaaggcuucgagcacgguccauagugcauucucaguuaugaccuuucugcucagcuaggaaugcuggaagaugcaacaaguauuuucuccacuucuuaagcugugaggaaaaggaaaagccuugugcuuaggggugggcaucuugacucaaguauucugguuaggcuagucaccaaccuaguuguauaugaaauagaaauaauggcaggugacuauucuacuucagggaguugcuauugagaguggaaaaugaagaggccauuguguggaaucuccuuaugagccuacaguacuguacaaauaaaacuuguuauaggauaaauuuuguaggacuccaguuuccaaaaggcugugugggcugcuguguucuaguucaaagacaggcucugcuuagaaucugcaccucacucauuggcugcugaacacagagaugacuggcugaccugacucugggaauguuugugugggaguguauguacauaaggaccaguugucucucagucaaauggguuauuaauagacacaaauagcaaaaaaaaaaaaaaaaaaaaagaaaacauaaauaauauauuccgaagaagcagcuguggguaguagauauuggggaaaugaauuuaugauaaggccaguugguuuaguggguagggacucuccccucuuccucucccuuuucccuuaucccccucccucucuugcucaaggaucauuuuauuagaauuugagagaaaaauggcaggucaggcaaacugaaucuagucgcugccacaccgcgaggagggaaauggccaggccuuuuggauuaggguccagggaagcacccauguucagcaguggaaguugugggcuagcaguuauagaaagggcagggaagccgggcgugguggcgcaugccuuuaaucccagcacucaggaggcagaggcaggcggauuucugaguucaaggccagccuggucuacaaagugaguucuaggacagccagggcuacacagagaaacccugucucaaaaaaaaaaaaaaaaaagaaagaaagaaagaaagaaagaaagaaagaaaggaagaaaggaaggaagggcagggagucuucacagaaagaguaagaaaccccagagugaccuuuggccagugucagagaaaagggcaaguuacccuuuuugaauuggaacucccagagacucaucuuuuauuaagagugaccagguggaaagcguacaucagaggaagguagacugacagggggagaggugguuucugcucaguuguaggacaaguggaagaccuaaagccacccagucuuugccgcucggguucagucaguucgcuuucuagccucauccacuacacccagaucagcuccucugccucagguuauaagaagucacaggacaagcuaucaugugucuacuuucaagcuucaaagguaguagagacauuuuacuaugcaaacauaguaggcuaaugaaaauucgugacuuuuuaaggcagguagauuauacaagccuuaggacuguaccucuuucccuccaagugcacauccacucuuauucucccauaccuauaugcugccaauaaggcaggucgaacauuugagaagcaggauucuaaaugauaaagauucugcuauugccugaagcuggcccacucugucugggcucugugggacgaauaguucuauuuaauccuguguggguuaggagcuguugauuaagaguuguuuguuucuugcaggggucuccuuaugucggggaccagguuacccugacaacaggaagaugguguaaguaucaaugggugaugcagauauguggccaugguagauuuacuuagacacagauucuaaauuuaaacuccgaugucuucacggaucuccaguucuagacauuaagggcauuagguuggauccauagacccauccuggauggucauggucguuuuaucauaaucuaccuuugucaucagcucaguggucagguguuggaccaaaaguauacuucgaaguauacuuaauaacuaccuucgcagguaguuaaaguauaaugaguguuaacuugaaacuaucuuucuuaucuuuuucuuaaaaaugagaaugggcaucucagagaaccuaauauucuaguuggauacaagugcagcugagggcugcaggucacguuugcuucagagaauugagagaauucucucucuugguagcacuguuacucaucuuaaaaucaguaaacgcaaaagaccaguuaagcccaggacuuuugacugguuugguaagaagcuauuauugccuaaugcagaguuuggaggagggccauccacgugugguccagauuaacuuguucuuacgaguguugcuuugaguuacuuugcauuccaagcaucuuuaggguucugagaggcugcuuucuaguaccucuugaggaacuguggggcugccucguuacagggugaagccuuggcaggaacaagagcuuucuccuuacgcagcacaauacauuuugcuuucauuccaaacuguuucauuagcgugcuguuacaaguacaaaacucuugaaaucuuugugguuuguuuguuggguuuuuucaagacuggguuucuuacccuagaacucgcucuguaaaccaugcuggccuccucuggagcaaugggauuaaagguguaugcacuaugccuggcucugagaugucauugcuaagaauuuuuacugaagaauuuauauauucaaauaccuuucaaaaaggacaagcagccagcgguuaagcuguaguguuuuaacauguucccacuaugauaaguaagaaauaaaagauuuauagaauauuucaguuuuugauguguaauuacauuguaaagaguuuuuuuuucuguuucuaauacucagcaguaagcaaguaaugcuuucauaauucaaaaaaugauucagagucauaacauauuacuuguucaguuuaaauggagagugggguaaugaggaguaaucaugacuuuauguaguaaauacaacacauaacugaaguuaauuguggaaaacuaaacuuccacuugagucacccucaacuguggcaugcuaguaacacugucugugucgcaugcugucuuuucuucuacgcaugucuauuuuguuuaaaagaucuuuacacaauauucuuugauugcauuuguucguguaguagcagugaugggagcacagcaugaagaacuugugggaagcugguucucuguccacugggugggucccagggagucaagcgcaggccaccaggcuuggcagaccuuguccacugagccgucucaccugcucaaaagaccuuuuuaguguaaaacuuuuuugcuuugcuuuuuacuuaauaggcaauuucauguuucaaaagucuuaaaaaaggcuaucaguuuuguuuuuuguuuuccaaauaggguuucucaguguagcccuggcugucuuggaaaaugcucugcagacuaggcuggccucugcccccugggugcuggaacugaaagcgugagccaccacugcucagcaauacgucuuuuauccuuagcacauugagugccucuuccaagaguagccagugcaccagcuuucuaggugucugccagagcaaccccuuuuccacguuagucucugcucauggacauauguuuuuauuagauucuuauguauguauacaaacuuuauacgcaguguucuaugugcuguauuuuuguauuguuccccuugauacuacauguauacauuuuaaaguuauccuggcauaaaagagaaagggcaaaaaggcaguuaagucuacuuauguauuguaaaaauaaccuguuaagguaaugaaugccucaggccuuuaaucuccgcauugagggagcagaggcagggcagaccucuugaguuugaggccgcuuaaucuauagauugaauuccaggacagccagggauagugauacuuagucucgaaaaacaaaacaaaacaaaccuguugagaagauccccuaaauuuuuucaucaguuuaacucauucucucaaacuauauaaauagcgguugaguggcagauaaccuuaguaaccagguguaucuccacuguaucucuacuguaucuccacuccucagcuguaacuuagugaguuuguccagagggugauagcuaucaccuuccagcguguacuaccccauguucaaacggcaugguuuugagguuccuuugcagugaguccaggaagggcagaugugcugccucuguguaugggaauguuagaggaaauaccauggguuuuuuuuugggggggggguuguuuuguuuugcuuugcuuuguuuucuuuuuuguugcuguuuuuguuuuuuaauuauuuuggggggcgggguuagugguugccuaauacuuugcuuuuugcuucugaguuuacucucauuuugcugccuuauggaaaucuaauccugaggguaguaacacauuuguguuuggcauaucugcgugcugcagaggauuugguuaaagaaaccuaauugggaggaaacaucauuuugguuaguuugcaaaggacuaagauucuuuuuacuuccuagaaccagugugucucacucuuuugagaggugacauuucauuuuaguauggagcacuguuuaaggcacuuagaucaucaggcuuuggggugcuacuugcugagucagaaucuguccaggucuggccugacaugugugcuuugacaagguccccugcaggagaaucugcuuaagauccaccaguuuaaguagguaacccuugguaccuggacuggacugagauauuaguggcucacauucuaaaaagaauuaacauuuguguuucuuuuguagcauuaacagugguagcgucuucaggguucgcuucuuccaaaccacggcugugugcaguuaaguaccugauuucuugugaauggacuuuuacugggaagagaaacaacugagugagauuauuaaagacagaaugagcacuugugguuuuccuguuuuguuuuucccuagagaaugaugugauaacaguccaaaccccagcguuugcagagucugucacagagggagaugucaggugggagaaaggugagcuuuaaguuaaaaacuaaggucucuucaugaagcacagcaagugggaacuggcuccaccuuuuccucacauacgcaucuacuuccugcccagucuuguaggaaaguggucuuuucacacaguggguuaacaggggcccugaggcucccagccaacagguguccuuugucuuucagcuguuggagaugcgguugcagaagaugaaguggugugugagauugagacagacaagguggguucauccuaaggauuuauuacagauuacuuuugauuauucagucguauguaguauguacacuaguaacuugaaucaguagcuacuuuguuugcuuugugguuccugggcugcuuucagucuucuuccuuguaucacuuggaaacauaguaacuaaagcauguuuuaauguuucuaagaaaagacagaaggugaauccucaagauagcaaucacuugucuuuuucugacugaaaacauggccuuagguauuucugugugcagaggagauguaauauccagguguaacaguguuguaacucuuucuacucauccugcuugacuaaugcaauacuauacaaaugccgauaggauacaaaugccggacucugucuccauuucuuuccuuuccagacuucugugcagguuccgucgccagcaaauggcaucauugaagcucuuuugguacccgaugggggcaaaguugaaggaggaacuccucuguucacacucaggaaaacuggugguaaagaaguucuuuuuccuggugguuaaggucuccaguguuuccuggugggauugaggcugagcauacuguccuagcaacuccccugccucugacuggcauucuaguuacaccuuuaguugaaggguagaagaaauccuguugauggauggugaacuuucauugucaaguucuaagccaacaggguaauuuuaaaaacccacaauacucuguucuuuccauauuucucagauuggaucuuuuucuuaaagaacuaacaggggguuggggauuuagcucagugguagaaagcuugccuagcaagcacaaggcccuggguuugguccucggcuccaaggggguagggguggaggugacagggauggggggacggggauggacggacagacggucagacuagcagaagucagguaucugaagagaguaguuucccugcacugaccuggaucacauggagcuuuaaaaaagauacaaaugaaaaggcuuccagcuccugagauuucugauuuaccaccuugcuauaauaguuggauuguuguuaguuuuguagcauucuccuaagugauucugacauauagucaggccugagagccacuguguugacaauugaguguaguuuccuuuuuucuuuacaauuacauuuguguguguguguguguguguguguguguguguguguaucuguguggggaguguacacacaaaggcacgaguguggaggucgguggguaacuugagagucaguuuucccuuccugucacaugggcccuagcgcucgaacucagguugucagacuugguccugugugucuccaccacugaaucaccuccuuuccguguaguuucuucucacauuuuucucaggaaaaauuggcauuucucuuuggaagaaaugccaaagaaagaugccuguacuggaccuuauagucaauauugggguuagaaaaucuguuuuucugacuuguaaguaaagauuuuuguaguuagaguauuuaacuguuaagauagucaagcagaaagaugguagauuagaccauuaaaguuggucagggcaagaucaaguucaaaguaaagggaaaaaaaucugaaguagcuaggaugaauacaccugucaguauucaugcugggaccccugagacaucuuuccaggcgccaaaauaacauuuuaaucaaaugcucauuuaagauuaaagaguucagaggcuggagagauggcucagugguucagaguagauacuguucuuucagaggacccaaguucacuucccagugccuacauggcagcucacaguugucuaagacucccgcuccacggguuccaaugagccuuuauaggcaucuccauucacgugcacauauacacaguuaauaaugauaaaauaauucuuuaauuugauuuauuuauuuaaaauaaauguucuuuuuuuuuaacauucuuuuaagaauuauuuuauguauaugaguccacugucacugucuucagacacaccaaaagcgggcauuggauccuauuacagauggcugugaaccacuguuauaguugcuggaauuugaacucaggaccucuagaagaacagucagugcucuuaaccacugagcuauaucccccacccccauuccuuuuuaaaaaauuuuuaaugguuaagaguauuccuuuugccuggugguggcagugcacaccuuuguggaucuuugugaguuugaggccagccuggucuacagagaguuccaggggaggguuacacagagaaacgucuugaaaaacaagagagccgggcaugguggcgcacgccuuuaaucccagcacucgggaggcagaggcaggcgaauuucugaguucgaggccagccuggucuacagagugaguuccaggacagccagggcuacacagagaaacccuuuguuagcugucuugaaaaacaaaaacaaaaaaaccaaccaaacaaacaaaaaaacccaaaaaacccaaaaacaaaagagaaagaguauuucuuguacauguuaacucuaaaauagaagauuguuagcagcgugucacauuuaugugugcauuuaaacauuuucauuugcuuuguuguuuuugcuuaaaacagugguucugcuggucaccaaccccuuuggagguugagugacucuuucacaagggucacccaaaaaccuacgcauaucagauauuuguauuaugauucaugauaguaugaaaauuacaguuaugaaguagcaaugaaguggcuguggggggaggguuuacuaccacauaaggaacuguauuaaagggucacagcauuagaaaggcugagaaucauuggcuuaaguuuuauuuccuugggcuuaguaugugcuuugaaaguauuugcugaauuugaaagucuguagauguuaguuaauauuugugaaaucaggaaggcaucugaaucgagccagcaggacguuuagggagaccugagacuagagaguaguggcucgugucacuguguaucacuugaugcuuugccuauagcaaggaccuaggagacauuuguuugaggcuggaaauagaccuuucucucugaauccucuuuaguagcugugguuaauugccuuccauggaguggugccaauggcauucucucucucucucucucucucucucucucugugcagcugcuccugcuaaggccaaaccagcugaaacuccugcuccagcccacaaagcagagcccgcagcaccggcggccccuccuccccccgcagcaccugugcucacucagaugccaccagugcccucacccucacagccuccuucuagcaaaccagguaagacccuguaacagaauacuucacggagagcuacuuagauuuauuuuagcuuguuuugaggaugaagaguccuuuaugucagggaaggugugguuucagugcacggcagauggucacguggccauugcagccaagaaaguuugucugcugcuccauucacuuuguuagcuaaacgcuacucacuuccagaccccagcccacauuacagugcugccuguauucacaguaagucucuccacucugagagcaagaauucaguuucucuggaaaaacuguuauagacauggccaggcuuuuaucuucccagugguucuaaguccugucaaauugacagucaagauuaauccuuacagucucugacucccagggagaagggacuucgugucccucacaguuacagucugaugccauggcucugaauacaccaaguuugcugaagaacuggguuugcaaaccagccuucuauuuauuugcuaaccauaugacacuaguuuaauuacuucuaugacuagauuguucaucugcgaguuuggaaugaugcugauaaacuuuaguaucuugaggguaaaggguuaauacggugcagaaaguauugcuguccguguccgauguagcugugcacucucuucauuuucagugucugcaauaaaacccacugcugccccuccacuggcugaggcaggagcugcuaaaggucugcguucagaacaucggguaagccuccgacaacuuccagggaaguggcagagagucgcuguggagaguaauggaguguggucaccguuagaaagggcuggcaccucuuugccuuggccuugagaagggggagaaaguuacuuguucauggucucgugacugucagagggaauaacuagaacucagugucucccgaauguugggguuucuacuguauugugcuguuggugaaaugcuuccacugaguaaaaugucugcagagaauagacgcacagccccucuccccacagugacacgcaugucacagcgguagucacagcaguagucugcugagcgcucucucucucuauacuuccgggauauuucgccgcagcuggggagccaguggggccagauuguugcacuguagcaguacucugucagaggagacagaacccucaaggaaguauggucaagaguguggguucuuugccugagaaugcuuccuaaaaauaccauagcuucaaaagcuugcuuuagaguuuccguuccccaaguaguuauucucacgccagucuuuaucaagagaagucgcccuuucugaaaugacucuuaagcuggcuggaucuacaccacagucuuccuuuuguaaauugguuuugguuuuuaaaucacacuauuuccugagcuucuguucuuggucaaauuucagguauagcugagugaaaaccuuggucucugagucuguguuuuugcuggggcuacuccagaaagggaaagccucuagcuuuaacuguagugauugagcccagcacuguggcacaugccaugaaucccaguacuuuaggagguagaggcgggagggucucuggugcuugucauccaucgcugacaggcugaguccucucacugacuagggauggucucauggucaacucguuccacuucccuuucaggagaaaaugaacaggaugcggcagcgcaucgcccagcgucugaaggaagcccagaacacgugugcaaugcugacgacuuucaaugagguugacaugaggugggaucucuagucccucuaguccccacaucuguguuucuagaaguagaacgcgggaacuugcuguagcccuuaucagugcugcuuccaaaacuagcuugaccugggagagguauuuauuucucugcuuagcuccuugcugacuuauacagcaugacccacuggcuuaauuugcuaguuuacuucucuaauacuauggaaugaauuagaaagcguguaagaaaauagugagcuuuacugcaauguaaaaagcuuaguuuuuuggacuuucaugccugaacuauuauggucucugauaaauuauccuaggguaaucauuuuuguuuaggcuuuuauauuuacuuuuacuuauguauaugugugaauuuggagcaggggugccaacagagggcagaagagggaucccuuagaacuggaguuacaggucuugggggcucacugacaugaguacaagcccacauuuggguucucauaacugcuccagucccuguuugguuuuugagacagggucucaaauauauaguccuagcuggccuagaacucacuauguagaccagacuggccuugaacucacagagauuugccugcuugugccucccaaguacuaggguuaaaagugugugccauuaugcccaagcugguugguugguugguggguggguuuugagacagugucucauguugccugagcugggcuugaacucucuguagcugaggaugauggugauggugcugccauguccugcugcuaguaauggcccacuucuugcuaccccuuggaaugggaacccuucacaaugugccuaaaaggacaccacacucuccuucuuucugacagugauuguuucuuguauaguucccaagcaacucagaaucuagcaggcaaaaggacagaaaccugccaccucuuacucuacccuguuuggauuauggaauuggaacuaaauuaaguuccucugugugugugugugugugucugucugugucugugcaagcaagcacauacauauguacgugugggaguguguaggugugcauacaugcauauaaaagccaaagaucaauuucaguuguuguuccugggagucauccaccuuguuuauuaaggcagguuucuacuggccucgaguuuguuaauaggccaagcugacuagccagugagccccagggaucugcgcgucuccuacgucuauaacucugagauuucaugugugccaccaaacccaggaugguuuguuugcuugguugguuuuauauggauuuuggaguucaaacucaggucuucaugcuuaccugggaacgaggaugucuucccuagcccuaacaguuaaacucuaaaauguaaaaacccccaguucacuauacccauuccuguaauggccuaaugguugauuuccuuguuuuuuucaagauuuugauauaucuaaguaucagcauuuugggaaagagaaaauaguuuuauuuaacaaguauuuuaaguguuuaucauaugcagauuacuaaagugaaauuuaaggaguuauggagaugaguguaaaagcucuuuggaucuugccgggcgugguggcgcaugccuuuaaucccagcacucgggaggcagaggcaggcggauuucugaguuugaggccagccuggucuacaaagugaguuccaggacagccagggcuacacagagaaacccugucucgaaaaaaacaaacaagcaaaaaagcucuuuggaucuugcuaucucauuuuggugaacacuaaauaaaaucuagaagaaaaaaaagcaucaaaaagauaaaaaugaguaugaaguggagaagggaguguuguuugcuuucggaguuugaaugacaagcauguaagccagggagagugugucaucugucauccugguacuugagagguggaggcaacaggaccaacaauucaggguucaccuuagcugcauaaaguucagaaugagagccugucucaauuuaaaacaaaacaacaugaaaaugcuaaguaguguuacauagaaacucauuccaaaugguuuuagcaguuuggaucauggcacugucaagaaaaugcaagaaacagaaaagaucuggguugguuuuguuuuuguuuuuguuuuuguuuuuuuuugccaacaguucacauaggauaugaauggugaagguuggaucuguauuugaauaucaguguaagaaugaauuaagucaaagaugacgucucuaagguacccaucucccuuugcuuugaguauuaagucuuucccucugcuucucagugaggaaguuuguuuauuggaaauguauguagggaucugguuaauuuuauugggaagcccauaauguagggaaggacuuuuccuagugaaucacaaagacugcagccguguuuccugcauuagcggcaaaguguacacaaauuaaauuggacuuugaaauuuuacccauuucuuaagacgaagcauguaaauauuuauaucucuaaaagaugcaguuggcccaacauccuugauugcaaaucuguguaauagcuggaucuucuuucaguagccaaucuagugucacuuagcaguggccugagacuucccgggagccgguaaugugguuuagaucgagugcccuuugggucuuaugccuaucagcgaacccagaggagucuuucugagacuugccccuuccuccacuggcucagcguugccuccaagggcuaagcucugaaauagaaacuccuuaaugaccagaaaauggcaucuaggcaggucugagaacagagacacccaccacgccucuuucugcaguaaugccuuuagggugguaauucuagcacuaaaugagguuagacucaggaaaauaaacauuuuaaacccaaucaauccccucaggaaaauuuccuuuuuucaaaaacaaaaggucugaagugggcaguuaaaggguaccacaucuuaucuuuccugcuaauguugaauuaagccauuauagggggaaagggagacgugagcauuugggccugagauaaaguucaacucaauuuucaucauggaaugguauuccuauaaucauagaccuuccugugggaaaacaaugggagagacguuucucacuaacucugcaaugcauauguguauguggggguggggugggguggggugggggcuagcuugauagaccagaggauguucaaguugcagagucuucucagaggcaagcccagcgcugaaucugaaagacaggccacagcccacacggagccgcuuucuaaauaccaaggaaaccacagucggugaaacuaaucuuaagggcagacacuguuguguuguuguaucuuggugcccagcccagucccccucccccacacauaaugggcauuaguaacuguuucaugagcaaguagaaagaacugcuaacucagaggaaagagugagucugcugacuuugcauaagccgggaagaauauuggacuuagcuccugcguauaauuaguaccguuuggaaugguaguauucauugugaucuuuagauuaucugucacugaaaucugugacucauagaacuaaaaggaucuccuuaaaagggcucaaccaucuuaagggacaggauggcgcugauucuucuaggcugguauuuugugauagaguacuuuauuacauugacuacuagagaauguuucaaagcuugaacuuagaugcuucaggccaagggaaagcccauccauuuguauacaugggugaaaacuugugaaaguccaaacuagggcuuuagcuguucugguggguaguacaggccugccaucccagcucguugggagauugaagcagaggaagugcaaguuuaaggcuagaucaugcaauuucaguacaccuagucucuagacuuuaaaagggugggaugcaucaguagcccccagccccuuagcacuggcucagcuuuaacuguauccucagccaaucagauguugaagaccauggggguccucuuguuuaauuuguccuuguguaucuauuaaaccuugaucaggguuucuagaauggcugcaguagauuuugaaaacagacuuaccguuauugauuugggguuccccagagauccaguucacaguuguuggacucuaauacaacugaccauugaaaagcgaacaacggcuuauuguuuuguaaccgugucaggugagcccugacauuucaauugaaacaugaauugucauuauaacucaaugcaaauucaacaguuguugaauuauuuuaacaaauaacaguuggaguuaaauuauuuuaacaaaaaauuuauuuaaugaaaaaaaaaaggguaggaugcagggguggguuggggagcacggcucaggaguaaagccguugccagcguuucucagagguccucgacacuuagccuguggcaguaugugcauguauauacacaccagagcuucaccaacaguuucuuugcaucauguauuuacaguaacauacaagagaugagagcucggcacaaggaugcuuuccugaaaaaacauaaccucaaauuaggcuucaugucagcauuugugaaggccucggcguucgccuugcaggagcagccuguuguaaaugcagguaaguuuccugaggccaguguggaaaagacuacagaccugcugccacauuuaggggucaccaaagcuuuuuauucacagucuauggaaacaugaucaccuucaccaaauacuaaaaguaaugguaacaugauuacuuucucuguaccaaguaugcagaauuggcacuuacucuggcaguaggcagcucugggauagcuuggcuucccaagcugucuugucaugggcgaucucaagcucuggcugcuccucacccccacgcacccuuuacuuggaggcuugacuuucauguuuggcauaggcuccagguugaccucugaccugggguuggggccucauuacgaaggcuugggcuucguacucauugucuuuccucuucucagcgcugaaguguugaucuagcuugcauuucuuguuuuguguuguguugaggcacuucuguguuccuuagaagauaggagaggggacagugacacuuugcaguccucagccuaaaauccuuagucuguuccccauugagugcugugcauuaggcacacaggagggcuuucuuugcucuuggcaucucucagaguucucguucacuugacauguacucuaacaauccauuguagacucuggaagauucccaagccugcuuuucuuuucuuuucuuuuuuuuuccucuccuccccuccccuccccuccccuccccuccccuccccuccccucccccuccccuccccuccccuccccucuuuaaaaaaaaaagauuuauuuauuuauuuauuuauuuauguauaaaguacacuguagcugucuucagacacaccaggaaauggcaucagaucccauuagagaugguugugagccaccaugugguugcugggaauugaacuuaggacuucuggaagagcagucggugcucuuaaccacugagccaucucuuuagcccccaagccugcguuucuuguagguagguacaguuuucaguaauugguuuuauauuuuaagaugacguauuugaaagccaggccuccuccacccuccucugccuuuuccagggcacuugcuaucuagccauucucugcucagggaaggcuugcauagauaggccacuagugugcuucuacugagguuaccuccugugagcucugggagaacaugcuccaucguucagguugauucagacgcuugggaaacacugauaugaguugggaugggagccagaggaguguucguuacuuguaauguaguuauuuucaugucgauuagucagcccacacugcauuggccacugaagacuuucacucuguuaacuccuuauccuuggccaagagguuguauguaacauccguuuucucuuucauagugauugaugaugcaaccaaggaagugguguauagagauuauauugacaucaguguugcaguugcuaccccgaggguacguugggcaagacuuggaagugcuuacuuagauccugucuuggucauuucuauuucugugcuaagacgcuaggaccagggcaacuuacagaagaaagaggauugggugggcuucgguuucagaggguuaagagaaauuacaauuacauucauguuacagaaagugguagcaggcaugguacaugagagcucacauguugagacagucacaaaguagagagaacuaacuaacugggaauagcauggcuucuuuagaacuuaaagccugcccacagcgacacaccuccucccaaaaggaggccacaccuccuaaucuucccaaacacuuccaccaacuucagagcaguguaugauccuguggaggccguucucagaccaccacagagcucaccuggaagggcuuauuucuguagcuccggauugcuaggagacuguuaguaaaagugcauuuuucuuuuuuuuaaacuauaccccguuccuuuaucuuaguguaagucuuuuuaaucacagugaguuuaagguguucugguuggggaaauuguaacuauaaagaggacuguuauuugcaacuuaaaauaacuuuccacuccagggucucgugguuccugucaucaggaauguggaaacuaugaacuaugcagauauugaacggaccauuaaugaacuaggagagaagguacaguagacggaagugugugcacggccugcugggcaguugggggaucagagccugcagaggcugcgcugcucaggccucuggagucuggcucucuggggacagcauaaccuccuaggaaggcagcagcuguguucuaaggagaggcauguggcaggcagagccugcaugcuccagugacugagaucucuaagucagaaucuucuguagagucaggguuucucugaaggcggucacagucaccugagcugagccacuguccuguuugcaccugggcucucagauaagaguuuucuagauucacuguuuuggaucagagaagccugguuugacuuaauguuuguuguucuuaggcccggaagaaugaacuugccauugaagauauggauggugguaccuucaccaucagcaacggaggaguuuuuggcucacuuuuuggaacacccauuaucaaccccccucaaucugccauccugggcaugcacgccaucuuugacaggccuguggcugugggaggcaagguaggaaccauuguuucugagauuuuuaaucgcugaauggcuggcuguaagagagaaagcuaaccaaauccuuacuauaaagcauccacuguaauuuuaauuacuaagugacaguuaagacacugguucucaaacugugaucuggggcuauugacaucaucugggaacuugucaaaaaugcaagugcuggaccggcgagacgaaucagcaguuaagagcacuugcugcuagcaaaguagcuagauucaguucucagcauccacguaguggcuugccgccaucaguaauuccgguucugagguaucgggcaccauccucuguccuccuuggcugcuaggcacgcauacauguaggcgagaugcucauacacaguaaauacuaauuuauuuuuaaguaaaugcuuagacucccccucccccacucccuuccccucacacacuuagucuacugaagcagagaugcucagcucugaugcaugcugacguuugcacuggcacuuguugccgccuugucagagccucagggagucagaaaacggcacagugcacagcagucugugggcuacagaauuaugugagaaagcuuacaaguuucuuugaguguucaagguaugagggaggcccaagagcuugaguuagcuauuggaagauaaguuaguuuaaaaaaauaaaguuuucugagacuucugugucuagaauauaucugggucauugacuccuuuauaagucaaaaaacuauaggucuuuuucuuggaaaacaguuaacacacuuagcuuugcacauaacagacuuauuuuuuuaguucauggauuuuuaagacaggguuucucuguguagcuuauuugucccagaauuaucuauguaaacaaggcuggccuugaacucagaucugcuugccucuaccuugggcaaguuaggugcuugcuaagcauacacaaggccugguguuggaucugcucauugcaaaaaaaaaaaaaaaaaaaaaaaaaauaguaaugacaaagauugaacuugaaaguagcuccuacaggcagccacaacugcagaacaaaccucugugcucauugcaaauaaauaaauaaauaaauaaauaaauaaauaaauaaauaguaaugacaaagauugaacuugaaaguagcuccuacaggcagccacaacugcagaacaaaccucugugcucauugcaaauaaauaaauaaauaaauaaauaaauaaauaaauaaauaguaaugacaaagauugaacuugaaaguagcuccuacaggcagccacaacugcagaacaaaccucuguggguaacaguagcuguagagcacaguguagcuuacuugugucaaggcgguuuugaguggccuguuuccuuguuuaaacuuugguucuaaaucucagagcuuugcucaaaagaaaauaaaccuaaguuauccagaggcagcagugggaggaaagguuuugcaacuagaaccauugggugggcuuugcuuucucacauuucccucagcagggcuuugucucugaucugcuggauacagaucuguugaccucuccucucugcagguggaaguucgaccuaugauguauguagcccugaccuaugaccaccggcugauugauggcagagaggcugugacuuuccuccgaaaaaucaaggcagcaguagaagauccaagaguccuccuccuagaccuuuaggaggaagccacacauccuaccuaucgaucaugcaggaacugaaaaccacucuucucccuguacccucaucaaucccagguuagccugaugacaggcaggcacauacuauuggccucaagcacggaagccagggcacgauguaaccagcguucacaagucuguucuuaguguucccucgaggcucuuucucucucccugagacucuuaucuucugcuaucuuggaccugagagagagugagagccuuaauggaugcucauuaauguuccugccuuuauuccaguccucuacaaaggcaauuuugcuuuucuccaguaacaguaugcuauagggauaccaccagggaccaugugauuugaguuucuaucuuaggaaaguguucuccagagaugccuaggggaugcuuugccuccaucccagcugugcacacucugacuugaugccaccuguguggagguauugaacacaggcaaagaggugcugcuuugcuucuuaaaugcaccaucauucugaccugucaguggcuucaaggugcucuaccucuuccagaaagcacaggcugggguauuuggggacaggcaggauugugcagcauccccugagcuuaccuguuauagucacaggugggaguugaacccuggcuugcccucucuggcuccauuguaugcuggcacugggaagauucauuuuggcauaauuacguacaacugucgucauaccaacccuuuccagcuucuaggaaucguucuaggacacuguugucacuuaaagcagauuuuagcacaucauggcaguggggcagccugacgaagggacuguucucacaagaucaggcugaagagagcuuuuaaauuccagguggugugagcauguucugggaagaggcugugcucucccucccugggauguggccuguggggagcaaggucuuguugccucuggugcagggcacagagacaggggaggguggacugcggugggaaccagccucaggaguuaggacagcgacgagaugauggugucaucucuaagaucacccucaggugcagguacaguuguuggaauauucuugaagcaugguaaaaugcuuaagugguuuugagcgcuccuaggccucguauccugcacugagccugagccugcugacaguugccguggccauuagugcugaaugcccuuuuuucuuguaauccaagacaagcuggggggaggggaagaggucaguauugagugccugcagcaucugcuacuacaucuacaccauucagaacuuguaacuaaaauauuuaaagagacugauuuugaaugaaaauuaaagggcaaauguucucaaacagggcuccgggaucugugcuccuuuugacccucgaggcuuuacagccuccaucauuguuggcaaccacaaugucguuaucaccgaaagcuacuacuuccuccugaguuggcuaucuugguggagcuacugguggacgcaggaucuuuguauauucuuaucucugagcagcauaccaagcccccaucccauauuuuaggcauauugcuuuuaacagccagccaggagagcccacuaaugucuuagugcccuggguuccugucagggggccccaugccccugagaagccaauucuugagaaauugaggcucccaccuaugugaauccccuucaaaacaccaggggcaguuucccuuugaagggcuugcaucauuucugagauagaguggggaggcacgaacacuccuaauaccauuuggacuugguugccacaugugcaucauuauaagcacaugucugguuaugaacggugagggccaucuccuaggagcaggagugugcgaggggcaauggacaggauaggguuggucaccaacccaggaugaccccaauggauaggcaugauggaguagaggcuucaacagagccuuacuuucccacacaccucucaucugcugauccugucugcagggaggcccucccucuggugcccugucccaggaagaagcaggguccuuaagaauugcugcugguaggggaauucagugaauuauguaccaggucuaguguuugguauguugcaaguuuuaaaaauuucuacuaaacuucuggaguagcuguucuguuuuauugaaaggccguccauaaggccucucagaaucgggaccucgguguuccaaacugauggcuccacagaguuccagaugugcaguaugauggcugguuaagccagaaagcgaccugcacuccauaaagcaguggccgaagaugucuggcacuguggguuaccacagaaccuacaccugggagccagcucuagaagguccuacguuaaccucucaagaucguuuucucaggagaaucuuccaugagguagauuagauuauaugcuccucaggcacaccucaggugucugucucuucgccuuccucccuuuuucugaggcuguuccucaggcugcuuccuuccaggccacuugcacuauauuaaugaugcaaagaugccacagaaagaauaggcuuuauuagaggguagacgagccccaggcacuuggagccccagacacacgcgugcacgcgcgcgcacacacacacacacacacacacacacacacacacacacacgaacuggggauuggucaagugaaauuuguugcauguaccaugcauggcccagcaacuggguugucuugaggcaagcccucagaccuagggagggggcugucuuuggacauaccacuuacuucagagaccagaaauaccuuucugaaggcacuggguaaaauugguccauauguaucucauucuaaaagucaguaggcggugaauugaauagaagcucauaccaaaaugcagaguggaaaacaacaccugagaagaacugacugcugguccuguggagcgagcucuucugacacaggagagccagccagagaauaaagcgcuuuauucuguuuucaaacuccgucuuaagugguacaaccgcauucuuaucccgcucuuaaacacacuggcuucucuuugccuugauuuuauucuccaaagucagaaaucagaaguuaggggucaggaguggcgaguggcucacacugugucccaccucuccccacuucacccuacagacuuuccuacagacccucccagcacccggaccucuguaggaacggcaucugguuguagcagcccacugguagcaugacuaaaguggauccaggacaguccugguuugggucuacugagccagagguucaguguccugagaugucuccagagaugcccuacgugguguacagauggcaguguucccagauucaucagucggcucaauggguguugagcaguuuggaacuagagcaacagaaggcacccuuugagaugcuaggucccagcuaaagguccaagcuguguggucagcagguaucuguuggcuggugagcguagguugcucgacggggugcaccucucugcccuugcagcagcuucaccagucugaggcccaagcagguugugagcagaaaaaguggcugcugcgccacaugcuuccccugaaguccacugaggggaggggccagcccagcugguagacagucaagagaacugggccagccacacuguccauuccccgccuccuaccccauuagccggcuccacuggauaguacugaaaaagggaugggacuugagucugcuggugccaccaccuccagcuccuaggcgccgcuggggcucaaacugcagcagcuguggggagagagucaaucacugcagcccuuccccauccuagagggagauaucccccuccuggggcuacuaucaccaaaguuccuaggguguucuuuccucgcuaacccagucaguaagccccuccccaggacuuuggagguagcaagcacaggcauucaagggcauuuaugcguuccagcacuugaauuaacguguacaggcgguuccucucaccccccacccauauaccaauaagccaggggcagugagaaccucucaccucaguuagcagagaagcugcugggugacuaagccacucaggcagcuggaguugggugugggccuggaauccugaaggguggcucugggacagugccuggagagugggggacacaaagagagaccauccuggggaagcuuacccccuaguggcagccaaaacuugcacacaugugucacaguccaagaggaagaucuugauagcugccuuuugcuaggaucuacuaaugacuuggaccgagcuacaccccaaacauuaaagaagcuggcucagggaaaaggggacuuggguuagcacuggaguuggaaccugcaacuuuuuagaaccauugucuuuaugcaguagacacuauugggaacucuuaagucucuagaagcuacagaugcaauggcaggccugccaugcagccguugaggccaaggcaggaaugugaugaccagugguaguauauugagauaggaugagcuagcugcaagaagagagacaggugagccuuguggggcuuaggguucuuuuuuuuaucuuaaugaaggguucucagagacccugaguuaugaccaacaaaggcacaucaagucuggccuuuaggucacucacacugucgucuucuggugccacucaaacuguugccugcucaaauguaguuugucuucucccuugcuucccaaucagacuggucccacaugucauucugagcucaucugaguggaguacagaggcuaaaaccuggccaagugggugguguguauauguauauguguguguauguauguguauauguauauauguguauguauguguguauguuugcguguauguguguguauguguauauguguguauauguauguguaauguauauauguguauguauguauguguguauguguguguauguguauauguguguguguaugcauguguguauguauguguguauauguguauguauauauguguguguauguguguguauguauguauguauauguguauauguguguauguauguauguguauguguguguguguguguauguguauguauguguguguuuguguagggucacugaaccugacugguugaccaggaagcucugggaaugcugcugucucucccagaccccguauuaguuacagaccccguauuagucaucacacuugacuuuugcgugguugcuggggaucagacucgaguuuucaugcuugagcagcaggcacuuuaccaacugagccccugcccagcccgcaagugugcuuggccgacccagcugagaaggcaauggcugacuuguauggaggagccuucucccaucuccaucuagggacaauagccuuuaaggguaagggggacuggauaguaggaaaaagauuuagguuauaauccagagaccuuccagggaaggguugcugcuucuccagaccucaggccagacaugcucguccauaagccucuggucaugccaacucacauaguucauagaagccggcaaggcuccuuagccacuggcccuccugcgguaggaguucuauugccaguggucugauggauggaaggacauccagcccaauggucaggcacggagaaccaggcagccucuguuuugacccuggcuaagccucugcucagccuaaacccaaugguccccaccaggguucuauacacucccugcccagcuacucaccauuccugugagcaguucauacaggagugagccauagcuccaccagucacaggcuucagucagcucagaaaugcccccaaccucugcgagaacgagaacacacacaugcccaccucacaggagggcccuuucuguucucauucuagcacccacugcccaucccgucuuuaacccgugcaaaggcagccaagaucuagacgccucucccaacucccuucuugccuggagcacuguacagacaguccacggccuccuggcugcaucgcggcuccacuucugaccacuggccaaaauacgugaguuggaugugaccuucuuguccagugugcagggaggaacggugggacaaagguugaaacuagcaucaccgagcaucgggaaucuccaggcaguccaaggcuucccccaauacaaucaugucaggggccaaaggucaucccagguggaaucucccuaaggguguggccccuugcugcccagggcccagggguguuccugaagcugcccuggaccccagguucaugccuucucuaaaggaacagaugaaggaaggggagggggaggaacagcuuuauaaucuuggggcuucuguugacucugggcucccaugugcagugggguuggagaagggaggcugaggcucuuaccugccugguccaggagcagguucuguggguugaggucccggcacagcacccccugcugaugcagcgccucuaaugccagcagcaucucagcugcccacugcuucaccugucccucccucaggcuccaggcagcucuuccgcuccccaggcuggcccuguuugcugaugggggguuccgaccccugccucggccauaggcuccuagcacccggucagccccuucucguacccaguggagccucugcgugggugcuggguucgaacucuggccagcucgccuaacuugacugugcgaguggccacacggggccucuguggggucugaagagaagacagcacugggccuggaugaaggcucagcaucggccucuuucugaagcuggagggcuggggguaggcucugggaaguccguggaggcuccauugggauucuguucugccucaggguauggccuggugugagcuccgcuggggucaugaggcugaggcgggugcugaguugggcuugcgacuucuccugaaccgagccagaguuaagcccagaguauugaaaaugguccugggagaguagaugugaccaaagggugccuccugggccaaagagggaaugagagcguaggaagaaagaagagcucggacauaggcccaggccccauccugcuuucccuccauuucaucccgcccccucugccuccucagagaucugaucacccugcucugacccaccuccagggaacucagcuucacagccugcacacucgauuguuggugaacuuaaacugaguguguuugaacaccaguguucaacacguuacacuuccucuucacaaaagguaaaggccacgcauggauuuacaguggccgcaucacgacccaaggaugugccucacauuuuagaaucacuaaguaucugcugcgcggcucaguucccgucuuuacaguuuuagucaccagccgcgccauguggccauucaggaaugggcacugaccaggaaagccaagacuagaggaaaugguaacaaagacagcugaauaaaugucccccuucaccugccuagcuagggugggaacauccuuccggggaugcccccugcucccucggcaccauacagagcuccacagcagcucggccccgcccucaaccuucagaaacucuaggcucccagucuguaccccacgugugacgcaagccauaguccuccucagagcucagaguuggggagaacagugagaccccaaagcucagaggaacugaugggcccucaccuugcacaugcuccaggugcaggaagauggaguccucgcucacgaaguaucgcaacaauuuugucauguaggggacgccaugugggaugaucgucagccgcucccggcucaccaugugacaccuggggaggcucuggagaggggacaggguauguaaaugagcugauaccgcccaaugcucuggcuucagggcaccggaagaugaacugggagccaggcugaguagcaucugcuuccaccaguuccugguccagcccucaccccuguaaucccauggaauccacauccaaggaugggauacagugugugcaugucagucguggagccuugggcaacgcucggaggaauuggcagaguuggucuuuggaggaagcauggacuucauacgcacauuccggggguggggugggggugggcaggggucucaagagcucugagaaaguuccaaaagaaacgcugcacgccagcagccgggcagcaccugccuucacgaugaagguuccuccaguugccggguccugaaccaccugcaccugccaaaguccaggaggcaccggucaagcuguguuaguucccgggcguuccauggcccgaggcccugacuauucccaaacaucuaagcccuggugccucuuccuccagcaucugcaacuccuaccuaugucucgugcucucugggcucccgcucugugggucuaccccacaggucuguguagugcgagggaggauggaauggauacuccaccuaggcuggcaagaggucuaaguacccgcuguuggguuugccauaacucucaugagaacaucuccccgccccccaaccugccuacacuagcuagacccuguguggccuagaaggacaaccaaaaucaacacuucaacugcaggcuuucgccagaggucaucaucccagcagggauugaagguggcacugagucagucaauucuuuugugcacaaaugaagcuaggugugcaugccuuuaaucccagcagugauugagagaggcagaggcaggcggaccuuguugaguucaaggccagccaagugcacagugagcccuuuucucaaaacagaacaaaacaaaacaaaaaccagaaaaacaaaacccccaaaugcguuaagagccugaggcgucugagaaugugguuccagaucaggacggcugccuucagcaggcuccacacacuccaggaauuucucuucuuugcuacacuucuuuugaaauaaagugggugcaguugugcacaccagucaccuguccuuugacaguagccgucuccuucucgggguggcuucgguaaguggggagcuggguccacauugcuagacaguggugaaaaacaaagccuaggaauggaguagggggaagagcccugcagucuuuuuuaaugguacugggccuccugcucaccaggcuagagcucuguuacugacuuauauccccccagcucagggcccugguucccgagcuugggcaaauaagcugacuuuuuuaacuaccaaagagggauuagaaauguccagcuuugcuauaucgcugguuuguuaggcuguaaauaggagaguccuuaaugaagccaugaugauauuacaugcuugccaagucacgcaccuucucugaaccuugugcuuguuucugaguugugcuugcgugcgugcgugcgugcgugcgugugugugugugugcaugugugugugcgcgcgcaugggugugcgugcaugcgugugugugugcgugugcacgcacgcaugggugugcaugugugcgcgcgcgugugugugugcaugugugugugcacgcgcgcaugggugugcgugcgugcgugugugugugugugcgcaugcaugggugugcaugugugugcgcgcgcgcgugugugugugugugugcaugugugugugcacgcgcgcaugggugugcgugcgugcgugcgugcuugcgugcguguguguagagaccaggcuugaggaugcuggugucuucuuccuaagccacucuccaucuuacuuuuugaggcagucucucgcugaacuuggaacucaccucucuggcuagguuggcuggccaacaagcuccugccuaccgccucaggauuggaguuacagacaugcacccuacuaugucuagcuuuguacguaguugcugggaaucaaacucaggucuucauguuugcaugggaaguucuuugccaacugagccuuuucccuaagcugccuaaaaaugggggucucagcaguucgugcuuucugacgucauugugcuuguugguaaaagcaaagacuccaagugucaaauccuccucagcccugguaauuaccaaugucauuguagcagaaacagacacugcucauucagugcuaagggcuucgaacggcucacuucaccguguucuccuaccagcuuuccuggugaaauugagguucugaaacgugaaaccacucacuuucaagccuacugcuaaaaggcuguagcaucagaauuugaauacagacagucugaccguagagaggggugaaagugccugccaggcugggccuuauuuucuccauaaucaggaaagcaaaagcaggggcuaggcucgccccaccccuccuuccuauaccagggcaccuacaccagagcagcaguaucccuuuugaccacaagaggucgcccucuaauggcuaacucaccuaacucaggguggccuuggcucccugaccaaacuugugcaauguuugaagacagaggcagaaaacacuggguucauuuaggaaaagauucccauaaguauugccccccaguuaguuccccaccauccuuccccaagugguauuccccgcuaccaccuccuuggccaaguccucugauuuacagucugaaaacucagucaaggaucggagccagaaauuaaguaaggacccauggugucaaaaaccuguguauucaaaacauacucugcccuacuuucuuuuggaaggaauuagaccaaaacauuaacaacgacuacucugaaguuagguggggcagugaauugauuucuuuuccuuuuuccuuuuugguuauacacucuccacucucacagaauacuuccagcagagcgaacauuuucccauugauacaaccaagcaggcaagcacacacauccucucccucugauaaguggcccagaggacagaagagccaacaccugacucccuggaucuuaguuguucucucucucugaucauuguuaaggggcuggagauguagguugcucgggagagugcuugcauagcacgcaugaaacccuggguuugcuccucagcaucaacugggaacagugauacgcaccugucaccucagacucagggaugaaggcaagaaaaucaggaguucaaggucauucuuggcuacguggcaagugugaggucauccuggguuacaugagaugcugucuaaaaagugcgggcaauuaugaaaacacagcacugccaagcacagcuuucccugccuugugcacuggggaagccgucgaccccaguggugguggagcccaucaacggagacacagaaaacuagguuuuaauuaauccacaaaugggagcacagccuuauaauugggaagguggaaggcaauuguggccacuguuuguuuguuuuuuaacauuuuauuauuucaucagaucccauuacagauggcuaugagccaccacgugguugcugggaauugaacucaggaccucuggaagagcagucagugcucuuaaccacugagcaaucucuccagcucuggauuaggccuuugccuuuuuccuuuuuuuuuuuuuuuacaauuuaucccuaacaaacuuucuuuucuuuucuuuucucuucucuucucuucucuucucuucucuucucuucucuucucuucucuucucuucuuucucucucucucucucucucuuucucucucucucucucuuuccagacaggguuucucugugcagcucuggcuguccuggaacucacuuuguagaccaggcuggccucgaacucagaaauccaccugccucugccucccaagugcugggauuaaaggcaugugccaccacugcccggcuccugguuuccuuuuuuaauuaauuaauuauaagugcauugccugcauguaugccugcaagccagaagagggcaccagaucucauuacagauggcugugagccacuaugugguugcugggaauugaacucaggaccucuggaagaguagccaaugcucuuaaccucugagccaucucucuagccccugauuaggccuauuuuuaaguaggaaaucuaaauccuggguggaaccucucuugaagcaggcaagccccaaaacuucaaagauguuugagucucucuauuauaagcccugacugaccuaguagucauuauauagaccaggcuggccucgaacucacagagaucugccugcuucugccuccagagugcugggauuaaagguaucuaccauacccugccagggucaaacaggcuccuaaaggcuuagagggaaagauagaguugagcagaguuggaacggagcgugggcaagcccagugcuccagcugaagugggcagcuucuccuugccucccuagaguuacaugggaaugugagccccacaucucaagaucugaguuuuguuuuccaggagaagcuugacauguggacuuuggggacaaucccugacaaaagcccccagguguccugacugucugccuggucccucacgugcccacuucucugcucccugccaccuccgucccugcacuucugcagcccugugggccccacagccagcaccuuucuggggcccaggauuguccugagcaagcucccuuccugggccugaggguggccacucacaggcacuaacacagcucugcugccuggaucugucugggcagagcuguggagugggacugauggcccuaacaccugauuuggggaaauuucugucccuggcugggacauaaaccuagaggaggaagcaagaccccaggagggaacugggagaaucugagagagggugaaaagcaacuaccuaaacaucuuaaugcccccccccccgccucccccaccccaucccccagugcaggccucagggcauggagguuucuaugccuugcaaaugugcauguccuuggguugaacaaaucagagaguuuugucacagauuuccccuuggggacuccuccuauauaugcauguccccaaaagcucugagacugucuaaaguuaaaguaccagggguggaaacuuucauugaguguuucuccaaacguauuuagcucagagcgcgccucucuucaaaucuggcaucucacucagagauauggugucagucagucugucuaugagagcagcugugcuuggccacugugcaguucagugcgggguggggguggggggacuguagcagaugggaagcuggcuggaccuucccugagccuggcgccuguuccagggacccuggagaagcagcuggagugaggccuagcgaugggaacucagcccucccugcuccugucgcuugcacuccgagccaucaaccaugcaucaagugucuuagcaugugccaggccuuucccaaaaacuguuucauuuccuucucaaaucaccacucuggggggaggagaccaguucucaguguccacgguucacuggccaaacccagagcaugcuugcccgccuauauggcugagaggcauacacuggucccuuuuucuccaugggcucccagacccauuaaaaugcccagugcuucaaacuacacacucucgguuucaacccuagaaagucugucuccacaggcugggcauggggucccaauaucuacgaccggauggcucuuagaacugacuagggagcccugggcuagaggcagagggcaaucuaauaaaggcucaacucuuauaugaccucuuugugccucagauuucuccacuuuaagagggguugggaugcugucuucuaucuucuugucuacucuggaucaagggaaagggaaaaggugcacgauggcaggacuaccagaggagaaagggcggagcugcccaggcccuggacgauccacgccaucucaaagaaaugcauauguccacgggucaggcuggagagaaggaccuuucaguacaggaagugcucagcugugugugucgggagggagacugggggggggggggggcgcugcagcucuggcgggcagauugaguggaaggaggaggguugugggaaaugggcagagcagcaagugcuggacgguucccugggcuuagcuccucccacaggcucugggagcuuucugucugagagggccgggccgcugucugcuucuucucauucuccuauuccucuguagaaccugacagguguauuuugggagagaagaggaaccacuggaccgggcugcucucucuuccgaugcaggcagcacuauagacgccuuccauucuauccuaccuccccauccuccgccaccccuaacuguacaugucugcuucccuccccgcaccccagagcuugcucaccuucuugaugaugccaacgacccugcaucccuucagcugcuccagagcagagcucagugugcggaugggccggagccucaagcugcugaagcccuguggaggagagagacaagauguacaggguuucuggaugucgggagaguagugggggccacaguggcuaggacuugggguccaggcagacccugccucacagggucagacugaguaaagaagccccuugguuccaaguuugggggugcacggguucaaagcaccccggcuggcuuuuugcucagccccuacccagccuuauuaggacugcuucuaggggcuuuggaaucuccuucucaagagucuugucugugggaggcagaugcucucagggugugugguaggaacacgugugugugugugcgugcgugcauucgugggucucagccucaaaaugcagacaaccuacucuuuugaaaggcaagcuacaggacacagugggccuaggaggggcguggcauggagagugcaguuggccacuggguuaggaaagcgacaggaggagcguuagaugcaaaaguguguguguguguguguguguguguauacauuacaaauaccugcguuuuucccacucagcagaaacagaaucugcguacuccugugaaaaggacauggagucacacacaaacugggguggguguuuaagucacguaugccagguucucugugaggccgaaugaggcaugagggugugggagacagagggugggcaaccuugcuucacacucagacucacauccucugcugcccacuccuccuuggggcaggaggggagugaggguuguaugggggaggggcugucucuccccagaguccuccuucucuuccucagggagguucuccucaccguguugggacuggcuccacugcccaggguccgcugcagguggcaguugaagaucuccucugcccuccguagguacuugguaauuuucagcuucacagcuucacgccucuccuuguuggggucaacuguggggaaccaggggucgccaucuguggucaccaggacugugcuccacccucuauccugggcuuacugguggcugagaugccaacuccgucaacuacgucugccugucaccaccgcccauggcuccuacuucucagacagcuuuagcugguucauccccccagcucugugugugagaucaggggcugagaugagagaugcaugaggaaacggggaaccaccauggcccucagccaccuguucuuuacagcgguacccaccaccucacugacuguucucacauccugggaaggaucaagguggagauuuuuaugucucuuuccuucagaagaggagagagacgcuuccagaggacaaugcugccucuaucucugccucccauuaugaaaaaggccuggguggagaccagauuagacggaauaaggaaugcuuugggcacuccugaagcucaggcauggcaggguccccucuacagugagucuggugacucuagucaucauagccugccugccacaggcccuugagucugagaguuagcauggaaaugccuccuucugccccaucagcgcuucccucuugcccacaagccugggccucccuuccucccucccucucuguggaacacugcuaggccuuuacuggacacauauaugucagcauucacaucuggaugucccuugcuaggucccucugaccccaguucuccucuuuucucccuuugccugccccucuuuguucuucccacccaggauuauaauuucauauccaccugucagucagccccaccuccccccaccccuggagugcaauuuccagagggccacugcacagcccagcuccguggccaggcaggugcagcaggccaaguauguaagccacaggagcugaugaagccacagucccaccuuccgguguagcccucagcagcuguggagccuugagcuccaugccucaauuucugcaccuggaaagugaguuccugcuggcacuggagagaugguuuggugguuaagagcacagccugcucuucuagaggacccggguucaauucccagcacccacauggcagcucacaagugucuguaacuucaguuccaggguaucugacacccuuacacagacauacauucaggcaaaacaccagugcacauaaaacagauaaaaaaugaaucauuaaaaaaagaagggcuggagagauggcucagaggacaagagcacugacuguucuuccagagguccugaguucaauucccagcagccacaugguggcucacaacuaucuguaaugggauccaaugcccucuucuggugugucugaaaacagcuacaguguacucauauacauaauauaaauaaauuuaagaaggaggaggaggaagaagaggaggaggaggaagagaagaagaaaauuaguuuuugcccagagcacacacuuguagccugagccaucagggaacugaucuaggaagauuagccugggcaacaaugaaaggccuaucucaaaaaaugauaauaaugaucauacuaauaauuccuauauacuucuauuaaugugagacuugaaugaguuaauauagugaaaaccuaauggggucugccagguagaaaugccuuaauaaaucuaaguccucagaaauguccuucacggaagucaggcaggguuaacacaaugcccuaguauggauagagacaaaggacccuccacuggcccucuccuguccaccuucuguccacacacauucccacccauaccaugcacaccgcggaguagcacguccacaccauucugguagugguugaaggcagccucguagucuucacugacaucucgcuccagugccagguggaucuguguagcugcaucuaccagguagucacguuuggucacaucggcugucccuguagcuacccgguuacgaaucuguuccagguacaugcaggccugggaccgugcucgugaacagggcucuggcuccaggccugguccagguggacauucacaggcuaccaggcucauaguggcccugcuguugugaccuguaagaagcaaaggucuuaggggagacacguguugggagccacaccccuaccuguacuccagcuuccucuacuaaacauuggagagacagauguucacauccaaaagcuggagggacgagcgaugguaaggucccgucuuugagcuggguccuaccucaguguggcaaugauagauuaacacagcaguguguguguguggggggggggcuuucuuuucuuuuccacucaaauucagcuccacaaauaccaugcuguaugaacggagcacggaaaacuggggguaccugugacccacagcugccuuugagggguguccacagaguaaaccuagugucaagagcauaguaaacauaccaaagucacacacuggcuuaaagcuggucucaccucuccuccaccucaggucuccccuccucccugucuuccuugugaaguuccauucagcucagggguaccucuccccagacaaaaccuuuggcccagagagguccugagucagcaaguggggaacuccccccccccaauacccaggcuccaagccggaauggcgagcucaucaaagcccccugggagaugaggugauugacagauuagaugccaguucauguggaguucagcgagagugucagggugacccagcccuauggaggcuaucccagaaguccaggggccugugcgcccucccaaggaccugacaguaacuccuccccaagcaaugugugaccccaauggcccaagggauaagaguggcggcugccagaggggaaggggcaaagagaaagcagccagcagugcggucccugucccucacagcagccuagcagccaccguugcugucucggguacccuggaaaaugaccaggggguagcuuuucucccuggaucuuuuccaccucggcaaggaaagagacacaggauaaaggaagagguggggaggaaacgcacauauccaagcagccaggaggccaggagauggagaaaggcggccuuccugcucugccaggcccagcgggauagguagcuucgaggccugugcuggggcaccgacgccggcugcgcagggcugcgaguugcggguccagcuuucggagccgcgugccuaagacuauacacgucaagcaagcagcgcgugcacgaccccggcacacaaggugcaucacuauagggaacguccaaggaggucgggcugaggcagggaggggaagccuccucuccugagaggauggcucaagagcagaccaaauacuauaccuguccgcgugccagagcuccgggccuucccgccaacgcugucccuucaccuucugcaaggcuccgucugugccuaccacccuuccgcaggugccugggggcggggguggggcgucuagccgggugccugccagccauuggcuaaggaugagcucauccucaacccguuagaauaaaccuccaaucaucguucuccucggcuucugacagcccuuaaagcccuagaguuugcaaggccaggaacucaggagugggagucaguggggauggaugugggugacugaguguagcagggagagaaaaggucuauugucacccagggauguggcugccuuagaccucuaagccaaugaaacuuaaccacagcacguucaagagacuuucuucauucacuacuucaguuagucaauguuucucuguuggguguguacucugcccuagggcuuaggguagagcugccucuauggcuucacagaucaaucugcccagggcuuccugggcucuaaggucaggcgagugguucggaguugagcagcaccgaauccuaaccuggagucagaaaugcauucccaagaaaggcacaaacgaccccgacccccuuacuugucagaagccacucugcgcuuugcugugaccuugucucugguaguuuuccacaccggucuccucugacuccucuuccuccuccacaccccuuccucacccagagcuguugucgucucuggggaucacacucaggucaccaggcucaaauggcagcaccuuaugcacuaaaccacgucaccagccccagauuuaucucuuuauuaaaauaaaacaaccuuuuaauuuuugaguuauuuauuuuuaucuuauguauauugguguuucgcuugcaaauaugucugugugcgguguucgauucuugaaauuggacuuacagacaguucuaagcuaccaugugggugcaggaaauugaaccccgauccucuggacaagcagccagugcucccaaccaugaggucaucucaucaucccuaaagcaucuuaagggggagagggaggggggagggggagagacagaggagaagagagagagagagaagaaaagagagaagagaagagaagagaagagaagagaagagaagagaagagaagagaagagaagagaagagaagagaagagaagagaagagaagagaagagaaagagagagaagaagagaaguagcuugggucugguaugggcuuucaaaaccugaaaacacacuuccuccagugagaccacaccuccuaacccuucuaauccuagcaaagagugucacucccuugucacaaagcauuuaaauacaugagucuaugagguccauuuuuauucacacggacacauuuuaacaagcuaaagacaaaaaauucaaaacugagcaaaggauuuuaauaauuuccucaaagaagauauaaaaacaaccaguaaauagaugagaagauauuuaauaucauugguucuuaagggaaugcaaauuaaaaccacaacaacgcaucgcugauauccacuggauggccauaguuagacaaauuaccauagcaaggcuugacaguguucuggggaaacggggaccuuacacugcugucagggauguggaugauaagacucugcagaaaguguguuagucgaugcucacaaaguuaaauuuacaguuauguacgauccaggguuucacuccugugaaaguccacacacaaaugucauuagcagcaacaaucacaacagacaaaagugcaaugucgucacaaggcucacacuccuagggaccugccugccucugccuccccagggccgggaauaacugugugugccaccacugccuggcuuaaaacuuauucuuuauuucuguguaugugugugugugugaaugugcccaaggaggugagagaggcaucagcuuccugaagcuggggacuacuggacaguugugagcugcccaaggugggugcuaggggcugaacucagguccucugcaagaaccaucaugugcucuuaaccacugagccauuucuccagcccgauuacacauacuuuuuaagugacaugcauguguguuuguauugcacaacgccccagcaugcagugggaggucagagugcaacuugcaggagucaguucucuccuaccuuuugcguuucaggaaucaaacucaggucauuaggcaugguggcuaauguguguaucugcuuuugcugagcuauuuugacuuuguuuguuugcuucuuccuuccuuccuuccuuccuuccauuuuggucuuuuauuauuauuauuauuauuagauauuuucuuccuuccuuucuuucuuucuuucuuucuuucuuucuuucuuucuuucuuuuuguuuuugggguuuuuguuuguuuguuuguuuguuuguuuguuuuugagacaggguuucucuguauagcccuggcuguccuggaacucacuuuguagaccaggcuggccucaaacucagaaauccaccugccucugccucccaagugcugggauuaaaggccuguaccaccaccgcccagcuagauauuuuguuuauuuacauuucaaauguuuuccccuuuccuaguuuccccucugaaaauccucuacccucucucccuucccccuacuccccaacccacacacuccggcuuccuggccuuggcaguccccuauacuggggcauagaaccuucacaggaccaagggccuccccucccauugaugaccgacuaggccauccucugcuacauauucaacuagagccacgagucccaccauguguuuucuuugauuggugguuuaguuccaggaagcucugggguuacugguuaguucauauuguuguuccuucuagggggcugcaaaccccuucagcuccuuggguacuuucucuagcuccuucauuggggaccuuguguuccauccaauggaugacugugagcauccacuucuguauuagucaggcacuggcagagccucacaagagacagcuauaucaggcuccugucagcaagcucuuguuggcauccacaauagugucuggguuuggugguuguuuaugggauggauccccagguggggcaguuucuggauggucauuccuucagucucugcucugaacguugucucuguaacuccuuccguggguauuuuguucccccuucuaagaaagauugaaguguccacacuuuggucuuccuucuugaguuuccuauguuuugcaaauuguaucuuggucuuuaaaaaaaaaauguuuuuuaaugaacaugcccacaggugcucauggaggccagaagagggcaucagauucccuggagcuggagugacaggcaauugugaacugcccaaugugggugcugggaaccaaacuccaggcaucugcaagaggagccagcacucuuaauggcagagccaucucuccagcccucuaucucaauuuuuaaaagugaucauaacaaaaggcaaagacuccuugguccuuugaaacucuuuuuaucuacacggggucccaacugugugcaucgaggucaucuacugcaaggcccucacuguuggaguuaaucugacuucucuucucuuuucacacaccacugcuuuaguccguuugaacaucacaaugguuuucccuccaaauccaaacauucuuuccccauccucacugcaauguguuugaucagaacaucuguauuugcuacuccauuuacuguaagagcauuuucaacucuuuuuguuucagccuuuuuuuuaguuguguguguguacacacaugugugcuugcuugugcaagugugugugugugugugugugugugugugugugugugugcgcgcgcgcgcgcgugccauggcacacauagagcucagagaacaacuuacaggagucaauucucuccuucuaccacacagcccaggcggccagguuuggcagcaggugauguucccacccugaauuaacucauugucucuaguuuuuacuuuuaagacaggauuucccuguguccuccaaguugguuuccaacuuauugucuccggacucuugaauguugagacuacaagcauaaguuaccuugccuaguuuuauucauuuauuuuucaaaaacguaaagaaauuggagacugcagagauggaccaguggucgagagcacuugcugcucuuccagaagacucagguuugauucccaauucccagcaccuacaaggcgcuucccaaggucuguaacuccaguuccauggaaucuaaucucucuggucucuaagggcaccagacauagucgcgguacacagacauaugugcauacaaaacacccuuacacauaaaauaaauaaccauaaaaugagcacauaugaaagcccaugaaccagagccaggcugugcauacuucacucacuguagaagaccccucaccucccccucccccuccuucuucuccuguccuaaaugcaacagacacugccauccugggagccucuccaaacacucagauucugucccuccucgcucaaauggugagaguucccaucuggcuccgagauguacucgggaccuccuguggcccccaaggccucucuucccugcccuuccuaguucuuccuccuuauggaccucaaccauccaacuucagcuccucagcauaccuaccaagcauuucuuccccuagcgccccuacccuggagcugcugcuccuucuagaauagucuucuucagaaauccgccuagcucccuucccccugaaaugauucucucucucucucucucucucucucucucucucucucucucucucucucucucucucucucucucucucucccucccccuucucuccccuaaacugauagcauggccucugauuuucuacuuguuucuuucucugugccuguuucuuuccucccucuagugugagacccauaugcccagggcuuguguucacugcugugccccaaaugccaagcacagcauaugucacguaggaucacccaagaaauguugucgaggggaugagugggcucuaaagcuuaagaagaaauuaaccaggaaaugcaauggaggagagcgguggaggagaaggcucuggacagagacaagauagguaggaaugcccuguccaaacagaaggcaugaagucacugacagacauuagcaccacuucccgagagauacaaacacuucuacacaagcucuaggcgaagcucacaaauuuucuucucaacuugauaguggguuaucauccaagcacagagcaaaccccaucuguaaguaacuuagaaacguucccacaguccgucauccuggcuugaagcaggaucacacuucuccaccccuuugcaagaugggcugagucacagaacuugcuuugaagugcucagggcuggagcaugugguauuuuagggugggaacuucaaaagccaggggauaauucaucuuuccccuuccuuccaccauagcgagcuuagaaacaggcagccuagaucucugggaaaucgcagcaugucagaccucuuucccccaaccaugacguguguuggauaugaacugugagggacagagaagauuuuauugcaggaagcaaauggauggagauugugcaguaaaggggcgccuuuugauuuucguggcucuugcuguuuuuaggaagcaagagauuucugcacacaaagagcugucuauaaggcugcccaccacagcugucuuuuuuuuuuuuuuuaagauuuauuuauuuauuguaaguacacuguagcuguccucagacacuccagaagagggagucagaucucguuacggaugguugugagccacaaugugguugcugggauuugaacuccugaccuucggaagagcagucgggugcucuuacccacugagccaucucaccagcccccacagcugucuuaauaguaacugccacccaaaccuaaauguccaauagugcgccuguuaugggaauccuagaugauaaaacacaagucaggauuaaaacgguaucguaggauauagauaauauuauuggaaauaauucacaccagauggcguuuaagguuuuacuuauuuuuacuuuauguguaugaguguuuugucugcauguauuuaggaguaccacauacgugccugggagugacgaagaggccuuagcuucccuccauauggagguagagaggguugugagcaccauuugggugcugaguagccagcauuccuaaccacugagccaucucuccaguccccaaauuaaguguuaaaagcaggcugugagauaaacaguggaucucacuuacacuugggucuuaagauaagaagauuugcaaggacucuguaccucucacuucuuccuccgucuucaccuggugaugauagugguaauagcagugucuuuugacaugaaaccaccucguaaaaucuaugacaagaggcuuugaucugcuuuguccaaagagguugaaggcaauguuuguuuguccuguagaugaucuacaaggggacagaggaggaugggccacagucacucugucaggauugagcaggguucugggggagaggauagaagaagaaaaagauagacugggggaauaauuuuggucugcagccuaaaccaguuuuguuccaaagcuguaagacgaauuuucuugcuuguucuuuggauuuuagaagaauuugugguagauuguaagaaagauuuuuggaagagaauauugaaagaagauauuaccaccaauuaugugaaacaagaggcauuugcugcuugcuucagagagcgguccuggcaaggcacagcaucuagggaggguagaggguuguugcuauucaguagccuccuuuccccuaagggguagggauguguuccaagacuccccgcugaugcuggaaaaccugccuaguaccaaagcucauauaagcaccgugacaccacugcgguagaacuuuaaaacaacagcagacagcagacagcuacuaaguaacuaacggggaggguagcacauacaguguagauacacugaagaaaggggcggugcacaucugggugggguggggcgugacagccagagauuucaucacauuaccaagaacagccuacgguuuaaaaaaaaaaauuacggauuguuuauuucuggaauuuuccacuuuauauuuugcaacucugaguaacggaaauucuggaaaacaaaaauauagauaggcuacuuacucuggggcuuugggaagaggacagugcuccggagugaggcaacuuuuacuggcuguucuccgacccuaggagcacgcugcugcggagugguuauuuucagaggcaugaggcuguuacgaacugaguguggguuucuggaccaagaggccauguaaaucagguuuauaaccuguccuaagagacaccuguuaucauagccacaugaugaucagacuuucuuaaggguauuagauguucuaugcuccuggggaagcaaggggaagggcaaaaaagucuccauacauagaaacacggggucgcagugaagccuugugggucuuuggagacagagcuucccuauguuguccuggcuaucuuggaacucaccucuuguagaucaggccgagucacucacagaaauccuccugucucugccucuagugcugagauuacaggcaagagccaccacacccggucacuguaugacuugggugaagcuaaucaccacuggccgggggcuucucacucaagaaggagccaagggcacccaaugccaccuagauguucugaugugagaaggguccuuggacuuccucagcuuccuguggggugagcuugaucuaggauuuaugccguucuagccgugucucaccucauccaccacacaugaacagcccuaccggccuggcccugacgcaugggggaggggacaagacacuacaugugaaucccagcucugcuucuucacacugugucuucugcgucuauguggcagccagccguagccagcugucaguuucugacccuccaagaugcugagggaagacuuccuggaguugaccucaccccuccaggacuugucuaacaagugagaagacuccacaggcuucagggauccucggauggugcugaggggaugggauaacccuguaggggguuuaccucaucaggcuaacccucagaucccugcugggccaccaugcuaccacugugggcugggaagccugaagauuacugcaguggccuuaugguguuggguggcccuggcugaggcgugaaaggguaggaccacagaggcaggagcaggaagaaagacagagcaugggucuccugcacugaacagccucacagaggggccaauagugucucaccugccauccaggugacaucccauaauccaacucaacgaggaugccucaaccccuucccgacccgcuagcccucugauguuuuccauggcaacaggaaccagaaacacaccaucuuuuuggccuggagucuuugagguggggccucaucugccucagucgaggccaaagucaagggaggggggccuucgggcuucccucaggaaagggaggggcccagcuucuucagaaacacagcuguuaagcuuuguuacugacagacagccaucuuuccacuccaagacucagcccugucaccgcccgucuggagucuugauuucccacccgagucugugggaaggccuuuucugcagacccacccaggcacaccucacagaugguuuggccagcuccuccuguggggagcaaggcucucuccuccucuuguggaggaggugcuguuuggaggggcaggaagcaucagcuucagguuuggaucccaucccaucucuguccuuccugggaaauuugaaaauucuggcuugcucaaucuacauagcuuuugacaacaaggccuuucuuuaaggccuguguauuguuuguuguccagaauggucuugaauuuaacaauccuccugccucaucuuccuaaguguucacgccaccacaucugguccaugaugagccuguucuuuaaggaaccacucaaaugucaccaacucuuccuuccuucuaauuguaaucuuuuuuuuuuuuuuaagauuuauuuauuuauuauauguaaguacacuguagcuguccucagacacuccagaagagggcgucagaucuuguuacagaugguugugagccaccaugugguugcugggauuugaacucuggaccuucggaagagcagucgggugcucuuacccacugagccaucucaccagccccuaauuguaaucuuaauccuuugacuaacuuuuuuccccucacaaugagaauuagaccuaggacuuucugugucuuaggcaagugucccgcccuugagguaaacccucaguccuuuaaacaaauauuaauauaacuauaauauuaauguaaauauaauuuuaauaaauauauuuuauauuuaauauauauuaacacuauauacaauaaauaauacauucuuuaaauuuuuaaaaauugaacuuuuauuuuaugugugugaguguuaagccuggauacaccauacacauaccuggugcucaaggaagccagaagaaggugaugaccccuccccccccccccagaacugaagguaaggaugguugugaaccaccauguggaugcugggaaccgaaccugaguucugucaggagcagcaagugcucuuaaccacugagccagcucuccaaccccuuuauuaaagauccuaagggcagagacuaucucagcuuccucuuugugacccugcugggcucagucucucucuggucucucauugaauagacucuuaaaucccaccagcaaguaggggaucauagcaguguguucucaaagcccuucucucacaacccaagcuguucuucaucauccaaggcuccuugacaaaacucccagcauccccuucuccacucccagcaaaucccauucacuugccuucucacuuuagcucccaaguagcuccuagcuuagacucucagcucugauuucuugucagccuccuaaauucuuucagaauggaauccucuuucgccccgggggggggggggagugggaagacauuugcaugcuccuguaucuugcuccaucacaaauccaucuacuccacaacaccugguccuaggacucagcugaugcucaggaggcagcaggacagacagcacgagcaggaaggcccuacaucucuuuguacccuguccuucuuacuagaaucaccuacccuaaccgugcccagugaccucuccaucuugugucccuagagaauauuuuccaagaaacagauagagugcacuuucacagugguacccagcaauagcuggacagguagugcugcacauuuucaaucccagcacucaggagguggagccugguggaucucugugaguucaagaccagcuuggucuacagagugaguuccaggacagccaggacuguguagagaaaccuugcaucaaaaaagaaaaaaaaaaagguaugcagugucgcuuuauucuauggcuugacacccuucagugguuuccugucacauucuaucaaacuucagacucccuacccugccuucagggugaagguccagcucuugaagacuuccucucuucccccucacccaugacauuccagccaucuuggaaucuuuccuauccucaguuuggaguauccuugucucugaucuuuaugugaccaucgugucauaaaugcuguaaaugucgucuccaugaugaggcuuccugugaccuggucuacugcguuucccucgaacauugccccuuugccuucucugcauuucuguccccguuacuuacuguuacagaacaaacuacucuaaaacaaucuguuguuacagugucuccugaucccagcaauuagaaagggaagcagggcagggugggaacauuuugucuuugcucugugaggucugggaagcccucaguggagucuuacaaacacuuuucuaauuuuuauuuuauuuuauuuuuaaaaggguuuguuuaggaacuggagagauagcucaucuguuaagaacacuggcugcucuuucaaaggacccagguucaauucccagcacccacguggcagcucacaauugucuguaacuccaguuucaggggaucuggcaugagcacacagauauacuugcaggcaaaauaccagugcacguaaaaauauuuuuuuuuuaaauuaaaaagagauuuauuuguuuugucuuucauuuauagauguuuugcuuauauacaugucuuccuuccuuccuuccucccuuccuuucuuccuuccucccucccucccucccuuccuucuccuccuccuuuccuuccuucuuucuuuccuuccuuccuuuuuuccuuccuuccuuccuuccuuccuuccuuccuuccuuccuuccuuccuucuuuccuugcuuucuuauuuccuggugccugcagagaugaaaagauggaacacaccauggaucccuugcaagaucaacaagugcucuuucugcugagcgcucaauccagccccauaaccuuuauuugugauuaugugucuauguguggguuugugcacuccggugccgaugcccuggaggccagaggccuuguauacuugugggccugggauuucaggcaguugugagccacccaaaguggguucuagaguuugaacccagguccugugcaagaguggcaaccacugagcccuuuacccaguguccugagguguucguuaagaugacuauggugggugggaccagaggaacuugggguccgcugagcauuucucucugcuccccaucucuagggucagucugagcuuccuccuuacaugguggccucaagauggcuaacaccgugagagcucagaguuccaagugacagagguggacguaccaguggccuuaggaacuggcauaagagucacuggcugggccaaagcugaucagccugacucagccaaagggagggagcugaagggccaccuccaguggagcagugucagggauacugcaaaguuccacagcuacauuuuggagaggcaaaacccuucugucuuccgucuuccgucuuccgucuuccuuccuuccuuccuuccuuccuuccuuccuuccuuccuuccuucccucccucccucccucccucccuccuuccauccugucuuccuuccucccucccucucuuccucccucccucccucccucccuuccuuccuuccuuccuuccuuccuuccuuccuuccuuccuuccuucccucccucccucccucccucccucccuccuuccauccugucuuccuuccucccucccucccuuccuuccucccucccucccucccucccucccucccucccuuccuuccuuccuuccuuccuuccuuccuuccuuccuuccuuccuccuuucuguuuaauuugacagaaucuuacuguguaccucagguugacauugaacucuugauucuccuaccucgguuuccagaaugcuggaauuacagguauguacuaccagaccagcuucaacuggucuucaauuuuaaauugaaaaacuuuaaauuuaaauauuuauucuuguuguuguuauuacuauuaucaacauuagugugugcacgugcaugauguauguacauguguguggcacaugugccacagaacacaugugugaacgcuccaagacaacuuugugggauuaguuaauucucucuuucuacccuuuuguggguuccaaggauugaacucaggucaccaaguguggugguuugacuaggaguggcccccagagacucauguguuugaauauuuggcccaugggaguggcacuguuaggaaguguggccuuguuggaggaagugugucauuguggagacaggcuuugaggucuuaugugcucaagccaugcccaguggggcagucuccuuccacugccugcagaucaagaugcagaacucucagcuccuucuccagaaccauguuugccugaacaccgcuauguugauaauagacuaaacaucugacacuguaagccagccccaauuacauauuuuccuuuauaagaguugcagaggucaugucucuucacagcaauagagacccuaagacaccacguuuucaagauaagcaacuuuacuugaugagccaucuugcuaaccccucuuaagguaucucuuggccucugcuaccuaccucuaucuaucugucugucugucugucugucuauccauccaucuaacuaaugaguaugaguguuuugccuguguuuauguuuguguaccacauggguaccuggucccugaaaaagccagaauaggguguuagauuuccucgaacuggaguuacagacaguugugaguugucgaguauggugcugggacucaaacccagguccuguaggagagccuccuguggucuuaacugcugaaacaucucaccagauuccuccccaucuccuucaaguucuuaaugaaucccauaggcaaguauuucuggccccaaauuguuucuugcuuuagaaucuugggugcucaagaguccccuuuccuuagcuuugaguugagucauccauuugagugaugaaaaugaaccccuagacccucuaacacacaacgcucuguggcaugagagcccggggguuggggaagguaugcaugcuccauuccucacugcuccucagagccuauuacucgaugguauuccaccaaugagugacaagcccauucauuacauagguccccggcgacccgggugaccugaaaggaccggcaguuuggucaaacaccaucucgauguuccuucccuaacuguuccuguagugaacacccuggccaaggccaaggguuucuucuucuaacccaggaacugcucugcucucugucuagguuacugagagguugcuggccugggugggaacugauauucugggugggguugggguccucggggcccagccagaggccugagggagagagggagggguacuugccucggcaaaugcagccaagacaaugucuuugaacagcugcagcugaagagagaaguaagaaagucauuucuuuagcugagucuccuggggccagcccacacccucucugauccccagccaggagcacaugcugaucgaacgcaggacuuucuuccagggccuccacaaacagacaaguggaaggcagcugccugagcagagccccucuacccuguuccucaucacggccuccauccaaagccuauagcagugguucucagccugugggcucugaccaucagaaaacacuuaauuccugauggucuuaggaacugagacacugcucagcagcaaaauuagucaugaagucgcaauaaaaauaacuuuucaggcuggagagauggcucagcaguuaagagcacugacugcucuuccagaggucuugaguucaauucucagcaaucacaugguggcucacaaccaucuguaaugggcucuuaugcccucuucuggugugucugaaaacagcuacaguguacucgucuacauuaaauaaauauuuuuuuuuaaaaaagaacuuuucauggaaucauaaaauggaacuguauucaagagucguagcuguacucaaggaagguuaagaaccaaccacuggccuguaggcgggcucccuucugucccugagcucuuguguguuucaaugucaagagauaaaguugggagggcucuucaaaccaucacacacacacacaccauaaaaagugaggugguacucacaccaccucaugggucaggggcagcugggugucuguucgaaaaugguucggacucuuuuuucccccccuagggaggaagguaaaggaguuuagugguagaaggaagaaguuggcuacagauccagguaucuagaggcccaaguagugagaggacaacgugcuucagcaagccucagacaggguguccuagggacugaggacccuaggaaacccacuuauugccucuccagaguccgugccccaggcugaguguggguggcuuuggguuaggaaaacagggcccugcucuuguguuugauggggcuuagaggaggcucgagccagaucucuccccaacuuuuauugaugagacuguauguuuggggcaggguagacuccaggggcaucccugaaauagucucuguagggacagucccugaagaccauccagggucauugagacaauagcagggcuucuuuaacagugucaaagcggaagaggucuauccaagcgugaaugcagggaaacucaguaucauguggcaagucugggauaagacuggccugucagcccaguggccccuuaccccugcacugcccauucugcuuucucgggccuccguuuccccagcugucaaaagagaaauauaugauguuacccgcuggcauguccccucacaaccugagaagguuuucugagaagaggaaucguggcuuggaucugccucucccacauccucucucaucugccuugccuccauuuucugcucuccccacagcucuggaagacauacauccuagacauguugguuccagacuagaaugcuuuauucaagagaaucuggcuuggcaguuagucccggcagagacaaccggugggcugcaagggcccuccaggagucggcucacuucccguagcuguaccacgaagacacacaacccagacuuguaucggucaaaguccacgggcuacugcuccuccagccugcccucugcucagccccaggccacucugccuguguuccagagaggggacaaaggaccuuugcaaagggugaagcauaaacuucuaggcugaagggcaaacuccacaggcaagcucugcucuccagagccgaauguccugucccaucuccaggauacaguagacuggguccccucuacaugccuucaaugcagccggggccagagcugcucucuggguggagcugggaaucagggcagguucuaggccuccucuucucuucuccaguucccuggagagccagggccucuggggugcggcuugccccuuguaaggccauguccaugucuugcuucuucccaagccgaagcucccacagauccguggcuggcuucuuucuuucucucucguucuguuuuaaggcacugaauuccugagcgucuuguccuuccaugccccuuaucuuggagggggcacgucauucagcagggacgagucggcuaauaaauagaggguagguaccagcagggaggguucugagagggugacgguaauaaauacgugagcuggguguggggcucuccucugaguggcugguuaccuccgggaaaugacaucaccugccagaaaccaaacacagacaagucagaggacaggaugcugugaggauggcguccccuccuagagagagggucagacccagagggacaaggaacagcaccaagaaacagcaccugggcaagccugcucauacccagaccagcaagcaggugucucccuugccaagcaccagcucaggugcccaguuuugugccagguccugucucauucacccuucgccacacaccacaggaguguuaacccuuucacagauguggagcucaggcggagagaucgccauucaguggcagagacauuugaagccguucuggcaucccguaacagugucucugguuaacccaucccaagacagcagucuucggauggaacugguaggaguggcucuguuguuuguacuuuuauacuaggugguuuguggcacuggggugggggguugagcuugggucuuacacaugguaagcaagcuugcuaccgccgagcuacaucuccaguccaaaaaaaaaaaaaaaaaagguguuuuuaaagaaaucagucuccagccuucuuggauauucacuuaaacuuuguguguggaaggccuggggccugcuguccuugcuaagguugcacuuuccccucaaaggagcauuaggaccuccaaacccaacuguuugugaauaugauuuuaaaccuucaaaaagagccuggcagugguaacacaugccuuucauccagcacucaggaggcagaggcaggugaaucgcugugaguacagccuggucuacagagugagaugcaggacagccaggaccacacagaguuaauucugucuugaaaaaaaaaaccagaauaaauaaauaaaaauuuaaaaauuaauaaaaaaagaaagaaagaaagagagagagaaagaaagagagagagagagagagggagagagagagagagaaagaaagaaagaaagaaagaaagaaagaaagaaagaaagaaagaaagaaagagaaguucacagugagcacaugaggcaggauugcugugaguuuaaaaccagcuuggacuacauagcauccuauguaaaacaaaacaaaauaaaacaauccuccucuaggcauagguucaaggccaaccuaaaauuaagcgagaggcacaugaacuauuaaaauucuuuggggcgauaccugaacaagaccccugagaacccauaucugagagauggcacaguggcaccugauaucuguguggugugugcugaucauuuagcucuggcuagcuuggcugccaggugggagugucccuucccccaccccucucuuccagcuacacugugacucuguaaccugggacuccagccugcuaccccuagggugaagcaaggaugggcaaggcagggagaggggagaugaagggagggauccaaagacagagagacacacuggccugggaaccugagagcggcagacgcacugcaccugccccagagaugcccagaaguggccaacuauguaggagaaggcaugaucuggaagaacagggcaugugguugucaccuaggugccuggcacacagcagugaucccugcacaguagcacauugcuuguuguacucccaggcccaucauuuuacaaggaaagggacuuguuuaaggccacaaagagauaagggacaagaauuaaagucccuggaugcgccuuagaccuuuuuuuaaaauuuauuuauuuauuuauuuuucgagacaggguuucucuguauagcacuggcuguccuggaacucacuuuguagagcucgaacucagaaauccgccugccucugucuccugagugcugggauuaaaggcgugcgccaccaugccccgcacgccuuagaccuuaaaaguggauucccuguucucaucgcaagaccucauccccagugccccacccccucaggcucagccuuugugccaguccugggccccagcauacucacgggugggguuccucagucugugaguuucuacuccucuuccucuuccccuugguuuuccuccugcaauaaaccaagcgucaguacagaggguuccucgugcucggacagcggcuggcagguccgacaaccuccccgcgcacuaaguacacuuaccuuucugccuuugucgucuccagaauaggucuagggaaacggaaagaugcaggggagacgaguaaauggauguuuccugcuaccacccacuucccacagucccuagguccuggugaggcgguugcuccagcgccgcuagggggcagcaccgagcuggugaagaagcuguggcggggugggggccccagugcuugcgcucccagcccuacccuagguccuggcaauccccagggaggucgauguuccccucuggggcuuuucaucacauguuucugcucgucccagccucuuggcaucaagagcugggaucuuuugauucugcuuucugcuuuuuaaacuuuuucucuguucacuuuccccguuccuucuagggguacacucugggagccccucaagaaaguaaaugaugaacaagauuguggucagggcaauggugacuaccagcuaagacugccugccugggcuuaacccagccccaccguggcaacagcagggagcuugcuucgcagucuccaggcaugucccagcucugccuucuggggccauggcucuuggcccagaaguaaaaagaaaggugucccuguugccuggcuugcuggaaagagaucucuucaguaguucccaagagcaguguuccagacaggaggggccgcaugggcccugaguguaugcuguccugagccagcccacuuugcccagucacaccucugcagaugggcaagucagaaaaaagaugauauaaaagguaaaggucaccauucagccccugggggaggaggcaaggagggacuccugacugagcuauuggugucuggcuggaagugaacagguugacucaaggccucuaauacuggcagaguggagagggccuggagccagggcucagguucaaagagggcagcuagaguccuaggcagagccgggcaguguggcuaacuguggcuaugaagaacauggugacugccaagaaaggcagcaggcgugagacaggccaaguccagaucuagagccccuuuccacgcuggccaguggagcaaaucacagaacuguagugucuggcucgccuccucugugcgaugcugacaagguggccacaagcggcacaaccuugcuaucccgcucaccaccauuucccaggcacuuaggccaguguguggcaugcagugggcacugaagagacacacguggaaggugguugcucuccccuucuuccagcuccagacgaggcuccaaaccucuagucaggugccuugucugugacacagagacgcuccagaccuaucucaugucuccgggaccuagauggcaugcuaggcugcuguuccuagcagcaagugugccaagagccuggggaacagauagcaaggcugaggguuggccagagcucccagggacaguuagcagugugcagcaacucuaaagacaccacuguaccugcuuugccugucucuuuccuucuaugagguuuuccugcugucuucucaguacaguuugcccacccuacuccccacaggcaggcagccugguccugaaucaagcacaggcuugugauaccuucgucuauagacauuaguuccaaggaccugugacaguugugugacaagcgccagggcucuggaugucuaggggagacuuccuuuucuacugggacaucuuggcagcuguacuccagcugcuggggccagcuccucagagugacuuggcucauagggaauauuaaaugaaaaacaucuccccaggaccacuugcuuagggaaacaaacgcagccugcuauaggcuggcaacccccucuucugccccaggggcccggcaaggaucugcuaagugaucaggguuugucccugcugcccacccaggaccuaccugcauucacagagcacauccugagaaaaugucaucuccacauagaaauguggaucccgauuggggggaaucuucaagaucugugggaaacaaaguucauacucaguaaggaguccaugagaagcucaagguuggaaugggggcucaagggacccuggcuuggacccacuguaggccccugaccugccucugucccuaucuggguaauuucuagagguucuguggggaucugaauacagugugggcuaugggcaggcggugacaugugggggagaguuucccuaccugcauagugauguuggcugucuuuaucggcacacagugcagaccuucaucaccacagcagccacuacagcgacucagaaggacacaggacggacugaauaugugagacaccucaucaggguauucauccaagauguacaccagcuucuccaugggccgacaguagcugcgaccccacacuucguugaaaggcaccacuacgggaagacagaagggccaggucaggucagaaggggugucucagacuuggcucucggguuuaguucacaccaagugaagccccugacucuaucuugggucccucugcucugaacuauugcugccgucacccugggaugccuuagcugcuucggggcucaaauuccaacggagcagaaucucucauggucccagcuucucagucugucuuucucgcugguuccaccuccuuggagcuuugacgacuaugccaugaccacucuucaagcuucugcgucuuucuccagccuggccuagugcuuccugggccuuggggaacuugcugaaaacaguucucaaguacaccaggaagggccagccuuccccuggccucugccucaaccccacuauggcuggcuaccuugugucccaccccacucaauacaacuccucuucagcuaagagcaugccuagucauaugguccagccucaugucuacugggucccaccacccuuuaaggagccagacauauuaguaucgaucgcagcuuuggaaucuagaucugcaugguccaaggaagaccguauggcuacacacccagcccccacuccucccugaagccuucuccggccauuaucccaggagcagaacuccuuucuggagcauagcuugggucccuggcucccaucuuccaucucuggugcuucuuaucuccgccggagccaaaaugaggcucugggagagcaagagcugaccccaguaaacauaggccaagugacuccugacugaugaggugacaguuggccuaggauuaccaggaacagucccgaccccugugauggccugguggugguagugguaucuccgcagggccgaucugaaaucccuccaaaggugcugcuccuucaggggguagccuaguaccagggcuccaacacaggcucucagggagcagcugacgccaggccaucuggcuucagugccuauauugguuguaugaccuuggcgaggucacuuagccauuccagguauaucgguuuccugugcuugggagagagaagcaggccgggaauagaugguugcuaaggucacuuaugcccugacagacugucugugauucagugcgaccuugagaccaugccugggucagccuguaccacaucugaugcccauccucagcucauggaagacuuggaaccugggucaucuacaagccuuuucgucugaacagagagcgguggucuuuccuagcagacccucacuuccacgguccuuccuaagaggcagagggggccaaaguccaucucacagauccugugaggauaugugucuccggguaaucucagaagaaaaauaaacuucagacauagcagaggccccugggaaaggccaaaaauacccaagaggcggaucguccacguggagcuggcagagcagccucggaggcaauaaaccuuacuuaucuagacgucugguguuucauccuauccugcuccacuuugaagauacuugggcuagaccaggggcuggaggggcauguggggaccuucugacacuacuuuuucagacuacuggacacucucccuggacccaagugggaacauccaggcaaggaaagccugucuuugcgacaugggucagaggccaccucccuuucaccagugcugugagcugccuguuuagucugaagccuucuugagcauccaaucacuacuaacauuuaaucucugccguggaaacauaaauaagggagaagaguaguuagcuacaaaguaucacagaaaaacucagcugccagggaggggcaccagugaaggggaccuagccaccccccacccaggacccaaacaaccuccuaucccauguccaauuagguaaacauuuuagauuccaggaccccccaaauccugagaccuaugucuuagucuaaaaaggcagagaaagagcugaugucccuggaaauagggacaucccuagcagugccccgucuggguguacaggagaaaucaaggcagguagagggagcagagagaccacuuguucccucaggacaguguugugcuccaucgcuccaaggagaacuuccacuaaccccaaaccucuucuggguaggaaguggguagugagaggccugggaggcuguuccugcuaggacuggucccuccuuugagggccucuuuuggggccaaaauggauuccuuagcuaccugucgagcucugugagugagcugucaucuguccucagcggcaugcuacccagaauggaaggauacuguuuaauccugauggugagcugcuggaaaggccucugcaguggccacuggcugccagccggagccuagcugguguccuccucacaggcaaggcacccagccagccugccgcaagagacgcucuccuagugccucauuagcuccuauguagcugggaggccccgggcugaguaugcuggcucugccagauacacugaagagugcauagagcuuugacugguuucugggguucgccuccccccacacccaaccccauauacaucaucugugacacacugggaccucccuccuucacaugcucaucccuggaacugagaagaacagugguaaaaaaaagugguaccaugcugccucugccucugguguuagcaggaggggaugacaaugccagaugcuaaccacuguuguuuccuuggccacaaugcaggcccacucgcuugucaggauuauaggugagauggccuacacucugaaucuauaccuccaagcuuucucacacuggaucuuggcaaguauaauauacauucauguuucuuccaaggacucagaauuucacaaccuugggaaaagagucuuugaaaucaagcacuuagcuaagcucucccauuuaacagaugaggaaacagaggcugagaucucuuuggaagcuggugucugcucuacaaacaaaaguccccaauaacagauaugauguggggggugggagauaugacccuccucagaucaauuccagggggcucaaaaaugggcaagucccugaaguugaggcagcuaccucucuaaccuguucaguggucugggcuucagaugugagggcaggcagaggacgaggacagacaggcugcucccagggggauggggaacagacaaggggcagaccagcagaggguguucccaggccaagaaagcaauccagcuauuaucugugucuuugaggacacuacuacaagcacauccuuucucccaugcuguuggaugccucagucaugguauguggccauccuccaugucucugagaggcaagaagggagaaggagagaggaucuggcacgagccuucggcgggcgcgcuccucucuuuggcaaagguccugcugcccuuugaagauuaugucuugacacaacccagggcagagagugaaagggccagggagggugugacagagcccgccuguuuguaaucaauggaaacgccuggucagcgcugcacagcuccaccaggguuggaauggcagggaggacucuucguccugaccaagccccuugaaugcuccuuacuauauccaguucccagacuccagucuggccuccggcacucaacacagauucuguccaccaagacuccaucugcauccuuacagcuugcugggcaggggcccugagccagcuggacgaacccuagcgaucacguccugcuuuccgugugcuuggugacccuaacccaugacugcaccucucuaggcugcugggucacaaaagcuggacucuugggcuucagccuggaugucgagcuugcagacccaccccagcuugccacuggccugcucccacccuucagaccaaccgaucccuucuccuuggcugcugaggcucaugaggaaagaagagagggggcucagcuugcagagcuggccuggcuggcuuaccuuccacuucuguugaguuguucccagcagacagggcccccugcgguggacacaaagguggagcuauaaggagggggcauauucuuggggcucggcucuuugagcccaccccaagcuccucccccauccucugcuaaaaaccaccugacuuucuggccucaguuucuucacuuggaaaaggguaggaggcuucuuguguucccaagugcuuguaauccuguggggucucucuucugcccagcccccaggccaguccugcugggccuacuacagcccgccuuggcugggugccagagcccagggggagggugaucagcuggugggagcucaggggcuggagaagaggcggcgccaugagcuggugcugccugccaguaacguuacaccucgagcuaacacugcagcaagcagacggauggccuggcugcucggcaaggggacuggacaacccacccacuccugggcuggggcugagggcucccagggcagugggcagugcagcgggcagugcagcaggaagggaaugcauuggcuuugucaggauuuugcugcccaaucuggcucccugccagacucacccagcuccugggaaaagggcccugcucacuuccccaggcccugcacucaggaccuucugacacccaccaggaggaaagggcacggcaggaucccuugucauaucugaagcccacccaagagcccucugcucaauuggagcaauggugggggaagggccucaccuccccaccucaagcuucuuuagucagcuccuuccccacuaggccaggucagagguccugggggcgccugguuggucauggggccacaacccugaccacagggccagggagcugacugggauuaguggacggaugcuuuuugcaaagccacuagggcuccaggggcuagacaggaaaccucccucauucccuguggcuucccugcccccacuaagacagcccccaggaauuggggacugcccagccagaggucuccucccugagguccagcccagccccugggaaauaugugggcacccuagcagaagcugcucucuaaagugagucuguaauuaaagaccauagccccuguuucuacggcuaggaugagaaggucaagaggaagccaggccagguccuuaccugggaaugcacagccaacccagcuaggaccuguaagaagcaagugaacagcuucaugaccagcaucuucucagacauccagagccaagguccuucaaggcacaaucaccaugcucgucccccuugggggagacgcugauaccagaggagaggagaggagaggagugucccccucacugcuguccuaggcuaggucucugcagucugccugagcauccacagaaagccggggaaguccggagcucacagguagggcuguggcugaggaaacuggugaggaguguuccggcgagucggagcgaugugaaaggaucuuagggguccgaugacccuagcuccucucgugagugagcagaagucugaagaugcgguuuccuucucagacugcagcuucccuacgaacugaagcuagucggccgcugguuuucaagaccguguauggggcggggcugcagccugcccgcccacuucuaucucgaggccccaggagcagcccgggagcgcugagagccgguuggcggugagaccugagugcgcgugaccccgcagggcgcugaaggggcgcugccggcgcagaucuccuggccccucggagcuaggcguucauuagcuugccccagggucagcccgcagcgacagccaagguugcaccuggcucuucuggagccuccaggugcggacguccaacaucugccuuggagauggcuggguacuuaagugaccucugcagggagugcaguacuaagaaggcagcaucuugcuguggcccuucaugaccagugccaucccuacacaaccccgggaggagaggugacaggauuacuaaccccauuuuauagacuaacaacccgauccuaugagagggcaccaccugcagaugcugaacaauguucauauucacacuaggaaaguguaugugugcccgcgggcaucugccugcguagacagggaucuggcagagacaagacaagcuacgugccuccagaaccgucccucuauuccauguacuaucugaccugguaggcaggcacagggcagcccagcugugggcuguacacaggaaacaccucggggcaccuggcuagaccuagguccaccaccacuuccuccugucaggucaggccagccuauuagagguagggaauggacuaaccuggcaucaccucccgagcccaagcagaagaggaaguguucuagagcagcaggacaugcugaggagagguggugucugcaugggcacuuguguauaccuaugaagcuguguguauaugucacccacugaacgugcccaguuacacugugugucgcagaucugggucucuggguaucucuuuguacuugugugcagccaugcaugucuguacuuuugugguaaccuccuguguuccugaguuguucuucaucaccuaccauucuaacaaaccucugugaccagcuugugggcugguugcaaaaaccuggcagcauccagagucagaaguugguggguggcugugggggaggagaugggccugggagguggcucuuggaucacauuccauucagaggcagggaggcuagggcaguccuggcucucacccccagugaccucugugucuguggccugcugcccacccacaaggggcugccagagaugcugccucucugucugguaggcccugaggccugcagguccaggagccaggggccagucacuggccagcuaagcggggguugcaaagaacauucugacgagcuccaacaugcuggggauuguacaguagacagauugucucccuggcuccagagcaugguugcggggucauugugcauguggaugaaagugagcugacccaaggaugcuguggauagguagccaggauccacacgugcucacagcaucucguguacaccuaggcauugaagugcaucuauuccuagauggaucuguggaugugggcacaagugugugcccuuuaaacauuuuuuuaauacuaacuuuacuuuguguguugcuauggugcauguauggaugggaguggucagagaacauuaccuucugauguuggcucucuccuucuaccauguggguucccgagaucaaacucagguugucagguuuggacaagcgccccuauccauugauccauaucaccagcccagguguguauucuuaauuaucuguguaauauacaccuuggguauccugacuaucuugagcacacacggauugggcauauuugccuguaauuguaccugaagauggaugugugcauugugugcauucauuuguucauccgucauuucacgugacaucuuccuuuggcucuacugugcuguaggcucugcuccaaacgcuggggauccaaugcagaugaccccuccacauuuccauuugcacagauggcugcagaugcucacgcacuccucuucuccugcaugaacuuaaccccuuggguaacaucugggcucccuguaagcgccuugagaggucucuugucccuaaaccucagacgcauguguuuugguuugugggaugaauuugcuaaagcagguaagguagcagaaaccaggaagacuccaaaaccuccauggcacgaggauagcucaucuccuucaggacaagugaacugacaucucuguucccggguccugaggcccuacuucaggacaugcaugcaacuaacuucaagcuauggcuuucauuuucugagucugucuugccaucugcaaaguaggaagcaacucaguagggucguggaaacuauaaaggcacugugugugugugugugugugugagagagagagaaagagagagagagagagagagugagacagagagacagagagagacagagagacagagagacaaagacagagagacagagagacagagagagagacagagagacagagacagagagacagagagagacagaaagacagagacagagacagagagagagagagagacagagagagagagacagagagacagagagagaagcuaacgguaguucuugggcacggucucuaauucaauuuuggauucguauuuaaaaacuagaaauacuacaguuauagacuagaaucuuucacagcacagaacaagacaaaagcaaaauaaggacucuauccucugccaguuugggaagaaccaguggauacagggguuugugcacacuuaagcacaugcacacacacacaccaccauucuagcacgauccauuccaucggcuauccacacaauccuggccauucacugucacugagguccuuugaguagauucaccugcugaaaggauggcaugguccauagucccaguucagcccuuagcugcuuaucaauauguuugguguuguuuuaagggagaaaugguauuuauugaauaccaauaauaugccaagaaacagccuggugcuuucaacaccuuaacucauugaauucugcccacaaucccaugauguagguuuuaauuacucccacccuuucccuuguccuggugguucugccacaguuagugugugggagggggaaggcccuggucugaggagccaaccuucccagggugcugggcaaagggguguuagcauuuggggugaggcaguaugaacucccugggcuacagagcagccccuggccccuccaccacaagaguucucauccuagucuuccccccgaaugccuguccuagcuccaccuccacuucuacacaaagcuuucugauucagcuagaguugaugguguugacuuuucauuccaacccuagguacacugaggcaggaggauggcaaguugaagccaucugggcuacacggugaggcgcugcuuccaacaagcaccccucucacuuguuucuagccuuccuaaugucacgaauccaugaaccucuccccuccugcaaccucucugucccuguagugacaguucagcuccugccucugucaaugugucaugacagcccuggaaaaucaccuuguccuucuguucuuggcccccccagcccagagcuuuuccugaggcuuaucccaaacacuauuuauuguauagcuucccucauucagguuaccacagcaucugggcuaccccuccauagugauacccaacaccacugcccuguuacagaucugcuugccucaaagaccauaagauguuuaagagcaaauacugucucuuguaugucugucuccaguaccuugcccaggagucgagcacauaguagaggcuuaaucaauaugaaccaacccggccucugaggcuccuccucuccccacagggaagauggcccgagucugccaagcgaucagcuucuacacucagaaugucucacugugggcagaugucucuggagcauggacaaaugugagagagccgucucccauuacuguacaaucaugccccauguuggucaccacagacuugcuagccucuagagggcaaagcucuugacuucagcccgagcccaaagcaucgugggagguuugugguggagcugaauaggaguggggcagagaugagccuaugggugaccaaaggguucucagggugggaaggaagauggcacccaccacagggcugggaacaaggagaaccaggcgaagugcccaaggccuugucccaagccucuugggcgaugugcugucaccaaaggaaugguacccuguauuuugggaacuuggcagcuggggcuggguuuuucguguuuucuguaauuauuuuccuuuuguucuuccuugguguuuaguaaaguccuuuguggaaaugccagcuggucucagcugugcuaagagcagugacaaaaaaggacuguguacacgguuggcccugugcuuucauagagggcuuaguaaagucaagagccagccaggccaugaggaggcucuggaggugacugccaggaucguguguccagauagccucuggaugcagccuccuucuagacuauucuaggcucccccgagacagucagcuuuacugaaagcuagagaucuggcaggcuagcccacccugguugcuuugaaggaaggcauuuggaucccagccagagauguggaaagcucuggugagacccagaggccagacaccugcugaguuauaucuauccagcaguggggucggggagagagaaggggccccuccagggcuggaagcugcugucgaggaaacagggucuggaacagacgcucagaacuauuccuuuccugcuaacuccguucuggcggguuuuuuugagccugggaccucugucugucugcugugcacagguguggacccacagcugaucuguccaccugcccgggacccaccacaugcucauuuccugcgucugcccucuuucccuuucucuuccgcccucucucaucccugcacuggcucucagcgacgcaggagagaggggcccagagacaccccccccccccgaggaacaaucaccccuuucuccauguugucagagauacacgaggagggcaaggucucuguaacuaaucagcugugauguggaacggagccuaaggagaacccgaugcugucccgccuguggaugacagcuggauggcucuguaacucagucugcugauggggacagcaggucaccccuuucuucucuccccgacccccugcugggaggcccgaaggaugcuggcggaugcuggcuccccuccgccacucgcuggauuuuacacaugcaguauguagaaaccuucucccaccuuccagggaagaauuauugucuguacauuucagaaaggaaaagggagguuuagagaagugaaguaagucucgcaggcaccacagccaacaagcaguagaggugagggggaagggcaagguccagccaaggggcaagguggcaguuuuaaguaaggaugaagagucuacucuuuuugagauguauaaauuuggacaagucuuuucaucucucucucucucucucucucucucucucucccccucucucuuacucuuucucugucucucacucauucacucucuuguucucacguucucuugcucucuucuucucuccugcucucucucucacucucauucucucucucucugucuugcucacuuucugucucucuugaucucccauucuuucaagcucucucucucucucuuucucucccucuucucagaaacuggcaguguggcuuaacuaggaaagcagaagcugaucacugagcuggcacagccuagugacuucagcugucgugacuguugcuauaggaggguggaggccucuucccgccaaggucucgcagccccuugcgggugcugagcuggcauggauauccccucagacuucaggcuucugugcuagucuuccacugccaaggguggaggguaucucucucuacggagcaagggguugaggaagagugggguaaauaaggguuaccuaggucccuucucuuugacgagcagguaaggaggcaggcacagcccuggcuuauagacaauuagagucaauuaaggguuccaucuuggacagauuugguggcacauaccuggaaccccagcacucgggagaacgaagcaggagaauugugaauuugaggccacacuaaacuacagagugagcuucugucucagaaaagaaagggagaaagaaagaaagaaagaaagaaagaaagaaagaaagaaagagggagggagggagggagggaggaagaaagaaagaaagaaagaaagaaagaaagaaagagagagagagagggagggagagggagaagagggagagggggagggggagaggagaagggggagggggagggggagggggagagggagagggggagggggagaggagaagggggagggagagggggagggagagaaagaauuugagggcuggcaagagggcucauuggguaaaggugcuugcuaauaagcaugauaaacuuaguuugauccaaacgauuuacacuguagcaggagauaguugacuuuuguaaguuauccucugaucuccaaacacacacacacacacacacacacacacacacacacaccaaucaaucaauaaaauguugaucuucgagauuaugucugucaagggccuugcugccaaacuugaccaccugaauuugguccucagacgugcgugguagaaggagggaaccaacuccuacaaguugcucucugaccucugcacacacacacacacacagaugggggaaaugaaauaaacccaaaucucuccagcuuagugcuucugauuaccuuucccccagggaagaugaaucccuguguuguaagagucucugagaggcugugggaucaagggccacggcccuagccuucuccaggaaggaggucuaggcauuccagacaugucuucagguagcaaaauacucuguggggugaaaaccagaguccacaugaacaauucacccgcggagaagggagagcaggcucuugucucaagagcacugggccagaggccagucugaguggcugccccugagcgagcaaagugaagcaccugacucugaggcaaaacccacagcguuugcugaugccaagaggccuggaagucaggcagauuuaggcaaguucuugguacagccucagugagcaaauggaacaucacuccuuggauuaucagcccuggccaguugucuguccuuuaaagaaaggggggucagaaggccccuugaucuugcucugagccugugcccauuccucuggaugauccugggagauaacauccuccgcucagucccugacagauggggaugcccacguaauaauggugaccaagggucuuccaguucagagggagagacuuacuugccuucaaagauaccaagucuccagggcuucugauccacaucccugguucccgcagugaccagccccacaccuuccaaauaccugacucugaagcaauuuggugauguaaaagaauguucuagaauugggguguagcucacuugcaagagaacauguuaucaauacauaaaacagguguagugcauguuuguagucccaggacucagaagguggaggcagggagaucaaguucaaggucuuccuuagcuacauugcaaauuugaggccagcuuggguuauaugaaccccuguugaaagaaagagggagagagaagggagagaggggagaagggagggagagggagggagggaggaaggaagggagggagggaggaagggaaaggaaagaaaggaggauagaauguuccagaauguucuagaaacuuccagaagauauagaagcuccacaaagcagacaaaacagguggagacagauuuuacuauggugaagauaauguguuguuagcauucuacaggaugaaccaggaguagaaggguggauuggucaagaagaguggguugaggaggugugggcuguuuaagguauguggucaucugugcaggaacuagagaggaugcagggaagucagggagagcgagcugugcauggacaugaggcuggaagggaaagcagggccguguucugaggaacgugaagaccuugcuaagauucccugguuccugagcagaguagugugaugugaccacauguaccauucaaagaagugucugggagcagacagagagcuuagccuaaacauaggcuuagucccacugucucuuggguaaaggauuucgcggcucagcugucuuuugagccugcuguggccucguccuagcugcucccuacuuguuagguccccuuagaguuaucauuggaugugacaggguuagauuuuaaccucuugaaaguauccuuaaaguuucugccaaguuuugccugacacuugagcaugcuaguaggagcuacugcagccaucuuggaccaugagcugcagacaaaauugaauuaccccaaaauaucaugaaguugucauacuuucccuacucgauuucuguccagaguuaauuuauauaaaaagggcaauaaaccucaaugcuguuaaagcugauguuauguuguaauuuucuaugaaaacauucuguuucacgcuugcuuccccaaggugggacgaugagcgccuuuguucuauaugaguuuuacaggaaaaaggcuggauuugccucuggcuuauccuggggaaugagucauaucgcugucuccugggaggaauggggcugucccauccccucccagcuggaagcggaacggagaggccacuguuaaggauacagauaucggggcccacagcccucccagaugcaucccucccuccccagcccucaucuccacccggagagcaaaggaaggcagcuaguguaggcacuaggugcaaaggagagccagauuaguuccuuaugcuuggauucccagggguagaggagccaaaaagucuagcagagucuucagcagacagacaguggaccuccagcuggcuccucaggccccagacucuucugaaucaaggaacacuuggcugcuccuucuaagauccuuucugccuucagccuuccucaucucaaagaguggggccuggagucugcagcccaggaggccccuggggacagcucuggaccccucucugguguaaugaggaauggccaggaagccacguugguuuggagguggacaucugggauacuccucuaccauucagccuuggacucacguaaagaaugucucagagaguguuucccccaaaugaugacucgcacccugcagaugacaccucacauuccagucacuuccucgucucaucaggaaccugaggaauucccuggaauccacacguucacugugugcuacguggcaggcccugugugugucuguguguguacgugugaucucauucaagccucacaggaggcccuagagguugauaucagcucuguuucagccacaagaaaaauaugucacauacaaaauaagcaacuugccuugaguuacccagucaguaauaguucgagcuagaguccuuaucagaugacucuaaagacugggguuucuaaucuagacaucccugggacccccagggccaaagaugguggugucuaaggucccagcugguggcuucugccaggaggcccuaggcccuagacagaaugagagaaccuggcccuuuccacauuuacuaccucuucucccuccaucccucccacuuuucuuccuuccuuccuuccuuccuuccuuccuuccuuccuuccuuccucucucucucucucucucuuucuuucuuucuuucucuaagucuuccuuucuucuguucucuuucuuccuuuuauuuucuucuuucuuucuuucuuucuuuuuuucuuucuuucucuauuucuuucuucuuuucuuucaugugugugcaugcauaagugcuaacagccacgugcauauauauucuaaggcuagaaaaagauaucuauuaucuuccacuacgacucuauaucuuauucaccaccaccaucaucaccauccugugugugugcaugugcgagcgugcguguguguguguguguguguguguguguguguguguaugugcacaugccauacagauguguggcaggucagaggccaacuuuuuuuuaauaguuuuucuuacuuuauuaaaccauacuaauauucuuucaaggacaaacauacagccaaggaugcuacagcgagagaaucuuauuuuaaugaaagagacgucacaaggcgcucucuucacggaugcuucuuaucaccauucugggaauccaggaaauauucagcccccaaagcuaccacaaacgcagcaaacccccauuugaauccuuuuaauauuacgcucgggaaggugauguugccugcaaaacggcccauguaucuccaagccucauugcgagcccacggaccccucagcccucagggagcaagcuucuucugcaccguuucuaauggcgucccuucaauuucccacugucuguaaucuggaaguuccauuuuaccauggccauguccguguucaugucuguguccagcagucaugucugacagcaaucugaccucccgggacacucaauauucaaccuuccagccagagccaaccgcaaacagacgcucagaggccaacuuuuugagugucaguucuuaaccuucuaucauggguuuuguuuccagaucugaggauguagcucaggucaccaggauuuuaccugcugagcugucucgccuuuuuuuuuuuuuuuuuuuuuuugagacagg

SEQ ID NO: 6754 - RNA, 7150 nt, Mus musculus
aguugaccucucucggcccggaagugaaacagugcuuuggcaauugaggcuucuguaagugagucccgggacgguguuggaaaugccgggugccgcggcgaagggcucggaguuguccgagaggaucgaaggcuucguggagacucugaagcgagguggcgggcagcgcagcucggaggacauggcucgggagacccuggggcugcugcgccggcuuaucacggaccaccacuggaacaacgcgggugcggcaacucauccucguucuuguucuauuccugaagcugauauucacuuucaccgcgcgccugccccguucacucggucucucuuggguuucaggggaccuuauggauuugauccgcagagagggcaggaggaugacggcugcgcagcccuccgagaccaccgugggaaauauggugcggagaguccucaagaucauccgggaggaguauggcaggucaaacucacagcuugggugggcuccuggugggaccaaggggugcuggcuuuugguuguuaaaccgugccaccuaucagcuugaagccucuguuguggcugagcugcucccguugccccagugaucacucuuugggucuuguugccuccauagacugcacgggcgcagugacgagagcgaucagcaggagucccugcacaaacucuugacauccggaggccugagcgaggauuucagcuuccauuuugccccacuuaaggccaacaucauugaggcgauuaaugagcugcugguggaacuggguaagagaucugaucacuaaguggacaaguuaggucgcaggcaagugaaacaguccccuagaaauugugcauugacagggauaggcgagaucaccagucuucugguuugaacacccauuugguaggaguggauggaaaacaccaagcuuauaguaacugcaucuuucaagacagaccugcucuuuaacaguauauuaagcgagagauuucuuuuaggggaaguuauuuuauuuuauuuuauuuuauagcaaaugaacuugcuggggauguagcucaguggaagagugccuuacuugaggcucuggguuucauucccagugcugcaaaaaacagaaaacgaguuccccaaagccgcauuuggaaguuucuuuuucacuaaacuucaucuugacuucaaaaaauguuuacuauuagugguguguguaugugugugugugugugugggucacagggcaacuuuguagaauuugcgcaucccccuuuauguggguuccagggauggagggcagguuuccagguuugcccaucaagcacauuuacccacuaagccaucaugcccaccccuuugagguauuuauauacauaccgccuccauccucacuugcagauuuuuguuacagucuguucuucagagauuuaacacuggguacuggggauggagagauggacggcucagcgauuaagcugcucuuguaaaguccccagguuuaguucccagcaucuacacuguggcucauagccaccuguaaguccuguuccagaggacccgauguccuccucuuaccuccacagggaccaggcacacaugaggcaaacagauauacaugcaggcaagacauucaugcacugaaaauaaguuagacaauuuacaaacaaacuaggugccaccuguacuccagacagccacucucaagcugcugugggguuucuguauuucuuugguaugcccacugcccauggagguguuguggccaccuuuuggaugaauaguucuaucaggggaagaucuguuuuugguuagcacuucaggauuucccagauuggcugaggagugcaggcccaggaccccagagugaugcuuuuaagagcuuggacuguugcacucugagccugcuaagccugugaugccaggcuggcagugucuaagggcagcuuccccugugagccuuugcccugccugucugggguuagcaugccauuuucacguccccuugcaaaccuguucuugcagaaggcacaauggagaacauugccgcccaggcucuggagcacauccacuccaacgaggugaucaugaccauuggcuacucuaggacaguugaggccuuccuuaaagaggcggcccggaagaggaaguuccacguuauuguugcagagugcgcuccuuucugccagguaagaggggcgcuuggaguugcugagaaggggugaagggggaauaaaggagggaugagccugagccgacugugaaucaauuagcucagccuggagucauuaagaaaguaaguccuaccggauguggcagcccacacuucuaaucacagcccuggggaggcagaggcagaggcagaggcagaggcagaggcagaggcagaggcagaugggucucugugaguucuaagccagccuggucuacauaaugaguucuaggaacagccagggcuauagaaagacccuguaucaagaaagagagagagagagagagggagagggagggagagggagagagagaaaaagaaggaaggaaggagagagggaaggaaggaaggaaagaaagaaagaaagaaagaaagaaagaaagaaagaaagaaagagagaaagagaaagaaagaaagaaaagaggaggaaagcaagaaaggaagaagucaggcccgcggucagcacaggccuuuagucucgcacuggggaggcagaggcagguagaucucugugagugugacaacuugguuuggucuacauaaugaauucuaggcaagcaagggcucaguugugagaaccugccucuaaacaaacagaagacacacacacaaaccaaaacacccccaaacagaauauugguaaggauuuucaaguugcuguagauacauuuaaauaguaguuuaagaaagcuguguaaauuacagguccuaggaaaugaagucuugguucuuuccagggucaguagggcguaguaucuuggggaugacugguauuugauuugaccucccucaguccuuaaguaaauaacaggucucaagaaacauaaagaacguuguaaaaugacgaggcggaagcugucuugccagcugugcuugcguuguguaagcaguuguauuuccagucuuguagcuucccugaagucacauuuauuagcaucccuauggcuugccagacuguggaccacagagagauggguuauccuggaaaccagauaucagagucuuagauccaguccauuugucagcucuugucacuguguaauucuguccuuagcaccagccuuuccccuccuguuucagggacaugaaauggccgucaauuuguccaaagaagguaucgagacaacugucaugacugaugccgccauuuuugcuguuaugucgagagucaacaagguggguggcgcuggaguuacugguucugaaauacucguuucuuuuucuugucuugugagguccauggugauagaagaagguuucuagcaccauuugaaagcgagcacuuaggcccuauaaucugcuagcuggccguaucccccucacccacaucacccauccucuccaggaauagccuguaaaugugguuaaagcaucgaaaagagugaaguggaacggauuuaagagugcuagcuagcuguuggggauuugccgugguucccacguaugcucaaggagcggggcaagggugcaugggaagugaucaggcuuagguuuccaggaagugcugugcaugauuuccgggaaagacugggaaaaaaacccagguguugcagcuucccaugccacaacuagaacuuuccaguccugagcacuggaggcucucuugcccucugcugccugugagcccugcagaugcuaagauacaggccuggacauccagccaagggcccgguuaggucuccaccccaaggagcucaugacuuuucuccucccaaaggugaucauuggcacgaagacuauccuggccaacgguucccugagggcaguggcaggaacacacacccuggcccuggcagcgaaacaccacuccacgccucucaucgucugcgcccccauguuuaagcuguccccucaggugcgguagcggcucaagcugguaaccugcagaggagggagcggauguguagccuucagcuccgcccuccagcuuucuccagcuucuccuucugaucuguugcuugcucaguggaguugauccaccacaggcuaaaaggagccauggauguuuugagccaggaacagaaucaguaguucuaauccuucacagaucaugucagaguaacacgggacagaaaggcccuguguguucaguugccaguauucuccauugccccaacacuucuggaaaugccaaaaagggugaaacuaggaucacagaaucccuuuuuuuugggggggggggggggagccagugcgaugaggggcauuauucuagggcuugucuucuagggcuugaauaucagcaguuguuaaaugaauagucauuugacagugacagaaacuuugugggaaaaaccuaugucugcauagucacacuacaguuuaauuacccauuuauuuaggcuuuuuguuuauuuguuuguuuguuugguacaggguuuaucuguguaguccuggcuguccuggaacucucuuuguagaccaggcugaucucgaacuuacagagauccaucugcuucugccuccugcgugcugggguuaaagauaugugccacuaccaccuggcuauuuagauguuuuaaaguauauuuuauuuuguaugcacuaugugcaugcccuagugcccacggaggucagaagagggccuugcguucuauguguuauagauagauggucacguggauguuauagauagauggucacguggaugcuaggacgcgaacccaggcacucugcaagaacaaucagugcucuucaccauugugcaucucuccagccccuaacuaaccuuuaucagaggauauugaguuagugaguuaguuucacucuuuaacuccugagaacaauguugcuucaggcaguuguaacauucauuucuauccacacagcaacagcaaggcauucaacaaaauugcugaagcccuuuaaaaaaauuuuuuucuuuugucuaguuccccagugaagaagauuccuuucacaaguuuguggcuccugaagaaguccuuccuuucacagaagguguguaugugugugugugugugugugugcccuugauuuccuguguggcuguaaggagucgguuggugacuuggcugcucaaagcagcaagcucugaaacacuuguacuuggaagcucaccuguagcccagaugccccgugcuuggggagggacgggaaggagcugugcuucucuggccucaucugaaggcagaagcucaguuccaugagcccacggccuggagcaguccagcuggaugcacacaccucguaagaacagaacacugugucuguuguccugauucuucuuagaaguugacuaacuuauccuuuuauuuaaauaguuuugaagccaggugugguggcucucauaaucccagcacuuaguggggagcugaggucaucacaauucaaggccauccuaguccaucuacauagggaauuccaggccaagcagagcuacaugaugagagacacugucuuagaaaacuaaagggaaggagaaaugccuguucugccucacugcauguggugcggggaauaaaguagagaggcaauaaugcccucuuuccacagacauacgcuguagacagcaggcaggaaaguguggggucccggguguguuaggaagaaagggagguggugacgggacuuaccuaagacuugugauagguccugaucggacagcaucgcuggaguccuaagugagugggcucugugugaggauuugggaaaguuuuccagggacugcagggcaugaaaugugugugguaugccagcuggggaaagccggucacguggcugggcuguuccgagcacggggagagugggucacaguagaccuagugugcuugcuggaggagugggugcacuucuaagauugcaaucuugaauuggaauauaaaaagccaaacuuuuuuuuuuuuuuaaacuauguauggcuguuaaaccugcaugucugucuguguaccacaugcaaggcugguuucuucagaacuugaaaggggcauuggauccguuggaucuagaguuacagcugguugugagcugcuauguggugguagaaaucaaaaccagguccucuggaagagcggcuaguuaguaccuuggccagugagucacugcuccagucccagguuugaauuuuaugugcuaugaaaagacaugagagagguugguuuaacugguauaguuuguucuaguuugaggcagugucucuggcugucuucucacuggccgucuaccugacucagccacuggaaagcguuagcgugagaaucacaaguugaagccacaucucccgguuugaacucugccacaacugucuagcauuauugaacucacacucugugacgauagagcuggauccucaguuuaccccuagcaugugauugucuugcaggagacauucuggagaaggucagcguccacuguccuguguuugacuacgugccccccgaccucauuacccucuuuaucuccaacauuggcgggaacgcaccauccuacaucuaccgccugaugagcgagcucuaucauccugaugaccacguccucugacacggccugcccuaugcggacccagaguggaguggagacacagcauugcugcuacaguggggaggggaggccagccugagcccucagugucuccugccuuccugcucaucuccagugaugagugcguccaggacugcuccugccuuccaggcuuagcugagcagcagggcucgcuuaccuggggauuuuggagccacucaggcuguguuugcuucaggaacuucaaccuucuagcucaguagugugcuagacaugccaugacuacuuugcuggguugguguuugcucagaaaugccuuccagaccuuuugccaauaaaagcuacuggaaacuccucaaguucguuuauuguucugagcucugaauggacugaagcgucagaguggccccuucucugucugcauagaggcuguggucagagagggaagccuaaaacaaguacaaauaaaagcaguuucuccguacaacua

SEQ ID NO: 6755 - RNA, 2518 nt, Mus musculus
auuacaguuacacgcauaggcuacuguuuauucuuggguguuguaguaucugcuuucugagacauguaccccaggcuggcuuggaacucacuauacagucccagcuggcuuccaucucaaggccauccucuucccucggucuuccaaacccugcgauuacaggcaugauauauugagcaugguucuugguauauuuuuuuuagcuccauaacacuuguuauaguugcaacauaaagaugcuaaacuuuuguuuuguuuuuguuuuguuuuguuacagacucacuauguaguucuggcuguccuggaacccaauauguagacuaggcuggccuccauucaaggagcuacaugugucucuguuucccaagugcugggacuaaagguuugugccacugugccaggcacuaaauauuucuuuaaaucgauaaauacuauauaggaauuauuuucuuaaggaauauuuaguuugauuacuuuaucccugauuuaacauaagauugcuaagucuguugacuuauuuuauggacaugaauuuuaccuguguguuugcuuuuuggauuuucaagacagaguuucucuguguagcccuggugggacuaaagguguguauucccauuguuuggugcucaguuuauugagcagaaaggauguaccucaauaaacacauuagacauaaugauuguagucucucuagcacguaguagguaaucaagacuuacuaacggauggaugaacaauuccuauacaaaucaguuuacuacaaaagagcagggcaguggugcaugccuuuaaaaccagcacucagaaggcagaggcaggugaaucucuguguguucgaggccagcuuggucucuagaguucuaggagagccagggcuacacaaagaacccugucucaaaaaaccaaaccaccggggcagugguggcacacgccuuuaaccccaauacuugagaggcagaggcagguggauuucugaguuuaaggccagccucgucuacagagugagcuccagggcagccagggcuauacagagaaacccuaucucgaaaaacagaaacaaauaaaacaaaacacacacaaaagaaagaaagaaaagaaacaaacaaacaaacaaaaaaaauccaaagaaacaaaccaaaccaacaacaaaaccaaaaagaccuaucggagguacagaacaugcuuucgaaacacgccguuucuuccccuugacaacacucaucugguaaaauaauauuuuaugcucaucacugacuggaccaaaacaaaaauuuaaauguugguuugagugcaguuuaucgcagaagacuauugaugugucuuaaauaaauaagugcguugggaacacccaacuugcauuaacuggauaccugccaauccacauucacccgcugaccucuacgcacucuccucugaguuagcaacccacacucacuaaaagccaaauuaaaauuuucucuuauguuuucccucuucagugcuccacugucccaacacccuuuggaguaagcguuaggacaccgaaauuccucuggugccuuagccccgagucuacgcagcuggugggcgggcucagagaaggccuuguggcuguuucuuauugggggcugguugcuauggugucgucgauuuuaaaaacucgcaugaaccgcuuccgggggcuuaaaacaauuacuuccgaggcugcccauacuuacuauggcucacucggaaguauuucaccaccauuaaaaaauaaaacguguacgaaaaacuccuggggacuucucuauagacccuuaaacucguaguuaugacauacuaccaaaucuuugcuuccucuuagaaguuauuugcuuuacauuccuuuucuguuuagccaaucuccaaaauggcgcggacggccucgccagggcagaggcgcgucacgugggugcucccgguuccggcgcgcuagaggccccggguggugaacgaggcuccggcaccaugucugguuuguuuggcccacucucccggccuggcccucucccguccgccuggcucuuucuguugcugcucggccccagcucgguccucggcaucuccuuccaucugcccgugaacucucgcaagugucuccgagaggagauccacaaggaccugcuggugacgggcgccuacgagaucaccgaccagucugggggcgcuggcggccugcgcacccaccucaaggugcggcggcggggcgcggcggugggcggcaggaaggcaggcguaguccggggaaggccgagguagggggaggccggcgggccggcgagcgggcggaggcuggggcauggccuggccuccccccaaccucaucccugaacgcuaagucugcgcgguggggaccgccccuucaccccgcgcguugggguucgcggggcggggccgcgcgccaaagucggggcccuuggaagggcagaguucugccuuggcggaccuagaguccggagaccuagggcuguuuccacuucgggcugucaucgggguucugugucuugugaagucucag

SEQ ID NO: 6756 - RNA, 9233 nt, Mus musculus
ccagcaugaugggcaagugucguggucucugaacugcccggaagcucugcagucaccgacaggaccagaaguagcaugauaagcaguacaagaaagcccacuugggcacagcccugaaggccaauccguuugggggugccucucaugcaaagggaauugugcuggaaaaaguagggguugaggccaaacagccaaauucugccaucaggaagugugucagggugcagcucauuaagaacggcaagaagaucacaacguucauacccaaugauggaacuucauugaggaaaaugacgaaguucugguugcuagauuuggucgaaaaggucaugcuguaggugauauuccuggaguccucuuuaaggugguuaaaguagccaauauuucccaauguuuuggcucuauacaaaggcaagaaagaaaggccaagaucauaaaguuuaacaauggaaacacgguaauaaauuuucauauucugaaaaaaaaaucaagaucagauugcucagugugggggcacagaccuuuaaaaucccagagucugagguaggaggaucaguaauucaaggccauuguuggauacauagcaaauuugaagacaacuaccugagauucucuccccccaaccccacaaaccaaaauaaacacacaaauuaaaaagaaagucuuuaaaugacaacacaggauccuauccugguuuuugcccauugugccccgaaaagccaguuaacugcugaucuugaaauagcacacagguugagcacaggagcuauuguuuuaacuugcucucaucccuggaugguguuccaauucauuauuaguuucuuggcaguugaaguacaugccuuucugggugaugguaacacggccuaaaacacauaauccuuuaauacccacccucucugugucccuucucuuuaauacccacccucucugucuuccgaucuucucucuuuccccuaaguggcccagcgucaucucauuuaaagugaacuauuccagccccugcagcuguuguaaagccauggacuaggguaucagcccucuuccaaccucuuuccugcaggcucccgaucacauggcugcucuuuucuccucucugucaaagcaggagagcugucgagaugcauaagccucaaaaggaacuguuuaaaauuuugaaaauuucucccagaugccaauucuaugcccacguucccacagccaguuuacuccugggauacuaccacccugguucuaccuucaggaggcaucucugagugugagagcaaaggguuuaggguaauauuuauguguaugugcaugcacacauugaugauaugccaucacaaaauuauucccaucacguguaucagagguuaaauuaaguaaccuaaauuaaauaaugcauuuacaaacccaauuuguaguuggggguuuccucuggucuucccuuggcuuuuuuagauguauacaucucagaugucccuagaauugaugaauuccuugacccugguuugguguaauugggucaagcacugggugcuccacacuuucuccugugccucagucccugaggccagcaucguuagggugugaccugggcagagauggcagccagcccagugauggagcuaugacguccucaccaccaucaucuacccacguccugggacuuaaacccaaccucacucgugcuaggcaaguucuacugcugaguuucagcccuggcacucccucguuuauuuuuuauuuugggagaguccugcuaagccacucagguaggccuucagcuugcaaugguccuguuucggcuucccgaaucccugggaucacugauaugcagcaccgggucgcacuggcuggaaguucugaugcucaugguagagucaugacugguuggguagauccgugguggaacugaaguauggcauggugggagcauggcgcucucuggaaaggacugugagauccauaugcacguuguacacucuacuccaugaauuaguugggacggggcacagaaaaggcagaugcugauuggucacaugggccaucucgcgcagcauagcacccguguaacacagugauugacuaucucuguuguugucccuccccuuaggguuuggaggcagauaacucaggacguccuauauucuuugucagauuucucaagacaaagcacacugacacugcccgcaagcucagucucuagcuccugugacacagaggaaacuuuacugcggaaauguggcuucugcucaaugcagucauucauucaacagauacuugcugggcagccugagugguagacuaagugagaacuaaucuagaugcccauggucccggugggcugcagaguacucaacuaaguacucaggcaaaaggcaaacaaacaugccagcggagagcuccugacccagggcaggaagaguuaaaacaacuuauuugagucagcaucagaaggaaaaaaaaugggaauuuuccaggaaaaaaaaaaaaacaugauagcacaccuuaacucuaauaucugggaggcugagucagaggauaacaaguuugaagcuagccuuggcuacauugcacgggcgcacucacacagauacuacuaacaacaacaauaggaagggcauuccagacagauggaacagucuauacucacacacacagaagacaagagaguugagaacgaucaguguaaggugguaaggagcgaccuggagacuuucacagggaugaguuacucgggaaggugacuauaaaaguuaagccagagccaagaaugauggaaugcacgcuuuaaucuuagcaugcaggaggcagaggcaggcagaacucugugaguuuggagcuaauuuaguucgacauugcaagcuccaggcuagccaaggauacaaagagcaagacauugucucaaaacaaacaaacaaacaaacaacucagagacuuaggcugcaggccucagaacuccaugucugauggcaguguauucaggccugcuccugaggggaauggaguaaugaggaacggaggcaggaguauaaguucgaggcuaguuuggguuguauaauaaggggcucaggggagauaggcacggagacacagacagagagacagaggcacaggacacagagagacagacauagagacagagacaaagacacagaaaaagagacacacagagacaaacagacacagagagauacugauacugacucauuaaugggcagggguagaugaaaggcauuaaguaguucaccaaggugaggggccaccucccagccuggaagaaggggaaaggagggcacacguguccaaauuccacccaaguccauuauuaauaagccacagagugauucaucuguaccuuccccauuccuggcuucauuuccccauccggccccugcgaacccugucuuugauucugguccacuucccuuuccuccuucucuuagcugcucccggcacuagaacucucuggggccccgcuccuuucugccuuuuggcgcuaauugccagacuccccuggcuuucuuuguggaaagcuuuagguuauucuuuccagaaauccucagaagcgcuucggccagugggaaaggaggaucaacuccuuucaaagggcagcugagaaauaaggcagccgucaaguuacgacuuaugggaacuccauggccacagcugcugccaaugacgggaaccaaaccaacagcaggagcccuggcccugggccucccauucuggcagcucccaaagccaagauuugaaccugccaagucugugugccccugggcaauaccuuaugggucccgucaugucacucagagcaugcccauggagauuaagaacgggaaacguguggcucacugagaacggucgucgucugcucacccugcugguuaugggaagcaggacagacugggagaagcucucugagcccugucacucuagcuuugugugaaugacacacaguuugagaacacccuaguacuuucaaggguguccuagugagauucuguuauauguucaucuaucaaaauguauauaucuaaaaagaaaagauuuaaucucagaggaaguccaaagacaguuugucuauagagcugauugaaucaagcgagcgggaaucuuuaagaagguggacaaauucccagcaaugugagggauguuuugaccuauaaggaaaaacuuuccaagcgagauuauccccauuggugugggcaaggcaaucuucugucacggcccaucuccaaaagagaccaucucguuuguucaugcagcagcagcugcuaaugucagauaaaaaaaaaaaauccuaccauuccaaagcaaaaccguuuguguauaauucacgagccccuuagguuccuuuaaaaugaaaagaguuaccaaaauagaaauuguuaucaccaugccaacagcagaccuacaacaucagcucacaaaacauucuguccuaaagcucaaagccagacccucauguuucuccaucagaaagagcuuucuauuuccuuccagaacaagccucuuucccuuacaaugcccuuaccggauaguauagucaagcuggcaggaacacacacacacacacacacacacacacacacacacacacacuccuccucagcacacaccucuccucauuccccaagagcucugugugugugugugugugugucugagcugaugacauauuaugacagcaugcucaagagugagacucagccucaaagcaaugcaggucacggcaauaggcuuuauauaacccagagcugcagagagacccaaaauagcaucuucccugcugcucaguuagucuccuccaucagccagggauaaaauuagagcaggcgcugacgugcaccugcgugugcagagggacuccagggagacagaacagacucaacacucugccaucagcugagaaggcugccagauuuuucagaccccaaucugucaccagacggagccguguguguaugugugugcguguggguguucguugguguaaauguaugccauguagagaccugcucugaggacagcgugugaaaagacuggccugggagcugauagcaaggagcuuggcugugugggacuaugcaggagauguuucaggcuauuuggaaggaaguugguucccguaccggucucaaguuuaccuugcaguuucuuuucucggacccacacacuucucucugacccaaggagugggaaggcuggccccuuugaaaccucuuucugcaaacagauaagccugacuguguuuuguuuugcuuucagcugaaccaaacacauggaaucuggagguuaaaagacugccaagaagucaaggggagagagaaaugaggauggaaaaggaaacucugcuguucuguggccuuuggggcuuugaccucgucuggaagccauaaacacugcucucagguguggugggcagagauauccagcuuuuugcucugucugagaggaggcuggguagaaccuuuugacauauauauaugguuuguuacugcaucagugaauaccaaccagguacuaccuccaggcugaccccagagaccagaaaaauaguacaggcuauacgggaugagucgaugguuguuuauuugugguuguuuugcucugucuugacugcuagggauugaaacccaggcuuuguucaagccaagcaugcucccggucuauagacacucaaagucugcuauuacacguucauuuggggggacuuucugucuuugggccuccuuuaaacauauuuaaccauuggacaugguuuacugaucccugacuaaagccaaaauaaauucuagguaaauguuuguggggcccaagaacagauuaauaucagcuuucagaaucaaagcaauacacauaugauuaauaauauauacuauauuuuuaggcauggucucauuauguaucucuugcugguuuaaacuuacuauguagaccagaauggccuagaacucagagcuaugccugccccugcuuccugagugcugggauuaagggcgugucaccaccacaucugguugucauuuuugauuuuccaagguggcaaacuuacuauauaacaucaaccaauauccacgaucccccugccucugacugcacugcugggauuacaggugugcaccacuccaucuagcuuaaacagcuuuuuauaagaacccccuccaaguuuuuccuuacaguuagugugugugugugugugugugugugugugugugugugugugugcguguguguguguguaggucagaggacaacugugggaguuggcucuguucuuucaccguaugggaucugagaaucaaaugcagaucaucaggcuugguggcgagugccuaugcacugagucaugagccaacccagaucucccauuuuuaauuaguaauuuagcaauaaaaaugaccugauuaagcuacauaaugacuuccaggccauucuggccugggauguagaauuagagucuguauccaaagagagaucacgggugaggagggaaaccggggaggaaaagugaaaggaagagaguggaagaggggauagaaaagggggcugggaggagagagaucugaccacccccccaauuccucacuuuuggcaccccaaaucuuauagcuaccaagaccccucucagauacacuguccacccguucccucuagcucuuuauuguuacauagauugagaggcaucucugguuucuucugcuccucucugaucugcugugcucuggcuucuccacgcuuccccgaaacugacucaguaggcaaagcucugcucgccuuuguaaggcagggugugaugugagugagcauggauacuuaguagaccaacagagcugugaugagccggccugaugccugagcucagcagacccccacuugggaggaaggaacgucucucaggagcugggcuguagacaggauagagcaauggagugugggaagcuucaaaguggagcuccugcuguugggcagcuucagucuuucagccuaccuuguguggucaucgugaauagagacaaagaacuaauugagagugcaggggauuugccuacccuuucuguggccccuugcuucccagcugggcaccagccccucucauagccccuuugcugcugaauauaucauguauccugcauccuguuccuuuaucccccuuugcucaagaacaacucuggcuaaucagcccuaccuccccacccccacagcccugacuccccuucuuugcuaacccagggaacuuaaacucauucuuccguguuggacagauggcucagugguuaagagcccuggcaacucuagcaaggcagccugguuagcuccccggcauccuuaggaugguccacaaucaucuguaacucuaguuccaguuccaaggcccucggacuucacagggcaucaggcacaccuguggcacauauagauacaugcaggcuaauacucuuacacaugaaauaaacauaagcuucaaauuuauuuuaaaaaauguauucuaagccgggcgugguggcacaugccuuuaaucccagcacucaggaggcagaggcaggcagauuucugaguucgaggccagccuggucuacagagugaguuccaggacagccagggcuauacagagaaaaccugucucgaagaaccaaaaaaccaaaaaaaaaaaaaaaaauguauucuaugaugcacagugaaaugugacuuucccugacgccuguccuucccucccugguccuaggggacaggacacucagguggcccuuuagauuucugccucugguaugcaucauguuuaaucucuuucccuugaguaugguuugaaagcacaucucacucuggauuguggcaagggagcuuugcugguguagugaaggcccuugcucaugugauuuggaguucauugaaagauuaucugggucucagcuaaucaggugagguaaugggccucuuccuggagucagaaagaauuuccugguggccuugaggaagucaacuaccaggcugugaggggacauguagaggagccacaggacaaggacaaggcacguguaggugcuaagagucguccccacugacaucgaguaaagcaaggaucuaaccguggaaggcagcgccagagagacugaaucaggaggaucaugaaauggaaggcagccggcgucucagggugagauccugucucaguaaccaaaacaagaggaaaaagcaaacaaaacaucacagaagcuaggaguguuggcgcaugccuguucuccuaggauugggagcgagaggcagagaaucagacaugauugcuguucaucaauaucuuugguuauauaguuugagacccgccuaggcuauauuacacucugucuuagaaggaaaaaaaaaaaaaaagcuaacugaacaaaugaaugaaugaaugaaugaaugaaaucagggauuuaaugauuuauaugaaagaaacugaauucucccaacuaucacaggagucuggaagagagcucugacuccagagaugaauucaguccacaggcacuuagugagacccugagcagagauagaugccaauuagacucaggcuagacaccuggccuguggaaaccaagaauguuauuguucucuuaaggggcuaaacuaggcuacguuguucuauagucauagaaaaguaaagccaggccccacaauuaaucauccucuggaccccacaucuugaguaacccuccuuacuuugugucgacugcacacuuggggccgguccuuggcacugccuccuccugcccgguccagccuccucuccuccaccucaguccugacgagagaaucugggaucuggugaaguggaagaaauggugcugaauuaaugucacuuaaacccaaagucucuuugauucccacccagcgagcauuaagaagaaguagucuuuuuuuacuuggcugggagcaggaggcagucaguaccuggaaucaaacccagcuucuuagacgacugaacugcaucccuaacugguucaacuauuacguaauacacuucacacaguagccccugaaacaagauauuauuucagggcucuccccaccccucuaagaguguuauguguagcacagacuggcccuugagucucauuuuuccugccucaaccuccugaguuugggggacaauaugccugcaucggcaugacugacguaggcuccaccuuacuucugucugauacggcagggauaccagaucacccaugagaacagauuuaagauuuagugugauggcguucauc

SEQ ID NO: 6757 - RNA, 3390 nt, Mus musculus
ccaaccgcgacugcagcgagcaacugagaagacuggauagagccggcgguuccgcgaacgagcagugaccgcgcucccacccagcucugcucugcagcucccaccagugucuaccccuggaccccuugccgggcuuuccccaaacuucgaccaugauguucucggguuucaacgccgacuacgaggcgucauccucccgcugcaguagcgccuccccggccggggacagccuuuccuacuaccauuccccagccgacuccuucuccagcaugggcucuccugucaacacacaggugaguuuggcuuuguguagccgccagguccgcgcugagggucgccguggaggagacacuggggugugacucgcaggggcgggggggucuuccuuuuucgcucuggagggagacuggcgcggucagagcagccuuagccugggaacccaggacuugucugagcgcgugcacacuugucauaguaagacuuagugaccccuucccgcgcggcagguuuauucugaguggccugccugcauucuucucucggccgacuuguuucugagaucagccggggccaacaagucucgagcaaagagucgcuaacuagaguuugggaggcggcaaaccgcggcaauccccccucccggggcagccuggagcagggaggagggaggagggaggagggugcugcgggcggguguguaaggcaguuucauugauaaaaagcgaguucauucuggagacuccggagcagcgccugcgucagcgcagacgucagggauauuuauaacaaacccccuuucgagcgagugaugccgaagggauaacgggaacgcagcaguaggauggaggagaaaggcugcgcugcggaauucaagggaggauauugggagagcuuuuaucuccgaugaggugcauacaggaagacauaagcagucucugaccggaaugcuucucucucccugcuucaugcgacacuagggccacuugcuccaccugugucuggaaccuccucgcucaccuccgcuuuccucuuuuuguuuuguuucaggacuuuugcgcagaucuguccgucucuagugccaacuuuauccccacggugacagccaucuccaccagcccagaccugcaguggcuggugcagcccacucuggucuccuccguggccccaucgcagaccagagcgccccauccuuacggacuccccacccagucugcuggggcuuacgccagagcgggaauggugaagaccgugucaggaggcagagcgcagagcaucggcagaaggggcaaaguagagcaggugagcagcgauucuggaccuuugugggcugggggggggggggggggcggagacugacgcacagaccacacaacagagaagggacgcuacugacugcacuuccugaccaggagcuguggcugcuagcccuuucccucccuugucagauuuugacaguuggacccaagacaaacucuagacaguuucccugacagcuuccuacuucauucucuagccggggagcuucuuuguuccccugcuaaagaucucacuuuaaaugcaaaucacacucugccugccaacugcagguuagaaaaacugcuucaccgagaggugcgggugcuguaggagccaguuucacuggggugacugaauggaggugacacuagacaaccuuaacugaauguugguccuuuucuucuauagcuaucuccugaagaggaagagaaacggagaauccgaagggaacggaauaagauggcugcagccaagugccggaaucggaggagggagcugacagauacacuccaagcgguagguugaaccagcugcugcuccugaaacuuuauuaaaguuggagcuugggacuaugggcgcaggguccuugagcaugcccgugucuuaugcuuucuuauaucucucccuaugcaggagacagaucaacuugaagaugagaagucugcguugcagacugagauugccaaucugcugaaagagaaggaaaaacuggaguuuauuuuggcagcccaccgaccugccugcaagauccccgaugaccuuggcuucccagaggagaugucuguggccucccuggauuugacuggaggucugccugaggcuuccaccccagagucugaggaggccuucacccugccccuucucaacgacccugagcccaagccauccuuggagccagucaagagcaucagcaacguggagcugaaggcagaacccuuugaugacuucuuguuuccggcaucaucuaggcccaguggcucagagaccucccgcucugugccagauguggaccuguccgguuccuucuaugcagcagacugggagccucugcacagcaauuccuuggggauggggcccauggucacagagcuggagccccuguguacucccguggucaccuguacuccgggcugcacuacuuacacgucuuccuuugucuucaccuacccugaagcugacuccuucccaagcugugccgcugcccaccgaaagggcagcagcagcaacgagcccuccuccgacucccugagcucacccacgcugcuggcccugugagcagucagagaaggcaaggcagccggcauccagacgugccacugcccgagcuggugcauuacagagaggagaaacacgucuucccucgaagguucccgucgaccuagggaggaccuuaccuguucgugaaacacaccaggcugugggccucaaggacuugcaagcauccacaucuggccuccaguccucaccucuuccagagauguagcaaaaacaaaacaaaacaaaacaaaaaaccgcauggaguguguuguuccuagugacaccugagagcugguaguuaguagagcaugugagucaaggccuggucugugucucuuuucucuuucuccuuaguuuucucauagcacuaacuaaucuguuggguucauuauuggaauuaaccuggugcuggauuguaucuagugcagcugauuuuaacaauaccuacuguguuccuggcaauagcguguuccaauuagaaacgaccaauauuaaacuaagaaaagauaggacuuuauuuuccaguagauagaaaucaauagcuauauccauguacuguaguccuucagcgucaauguucauugucauguuacugaucaugcauugucgagguggucugaauguucugacauuaacaguuuuccaugaaaacguuuuuauuguguuuucaauuuauuuauuaagauggauucucagauauuuauauuuuuauuuuauuuuuuucuacccugaggucuuucgacauguggaaagugaauuugaaugaaaaauuuuaagcauuguuugcuuauuguuccaagacauugucaauaaaagcauuuaaguugaaugcgacca

SEQ ID NO: 6758 - RNA, 2260 nt, Mus musculus
cggagaggaagagaaggaggggacggggaggaggggguguggaucgcccgcuucacacccacugaccuucaccucccccgccgccggcgcccuccucccgccgaugcucgcgcuccuccgccugcggggccggcccgggccccgccgcgcuggucccggcagcauugcgguccggcggcgcgccccgcccgcggcucccgagagcgcgaggcagcaggacacggcgagcgguuauguaagcgcauccccugcucggccuugcggccgccacccccaaaaugcuacacagcccgggaggcagcgacgcgaaggcggcggccggaugagcagagaaccccuuccagcucagcccacgccgaaccauccuccuccguccggugcgcucucccccaaauccagagcgaggguuccgcgcaguggugucuucggacgcugcaggaucucgcaagcuuguuuuguuuuuccgcggaggagcaugggcggggguuuaaggcguuuggaagccuuaaucccuacccacuguccaccaaagcguccugacguccugaagccaugcggugaaugaacgagcuccugaaguggaacugcacccugaggccaccguuguugucaguggcuggcccaguuugagccagggcucuuugcccaacuccagcaggcuuuugccucccuuugacaggacgcagcagugagccuaccugacuucugccaaaccuccaaaggccuucuuccucaaggacuccagggccagcuuccgugcucucuucccacccugcuacagaaguagauaguaaagaacacucuagauaaaauaugacagucccucaaaggcggauugucucaggcagaaaugcguguggcaucugagaacuauuugcacacacacauagacacacacaggucuccauacccuugggggggggggcagacccccgcccucuuuccucuuaaaucagaaaggaguggcaauguugacacucagugaccuucggccuccuucucagagagacagcaggucaucacccauagaagaaaggaagugaaagaaaaaguucaagucuucauagaguacaaaugcugagaucgaaagaccaacagggagggaaggaaguccacgcgccaagccggacaagcaggucuccacgugcgugccugccugcagggaggaaucggucuccauuuuacccguaagucuuccugcaggggggaacaggugaauggaaagaaacagaccaagcccuaaugacaucacuguccaucuuccccgccaccaucagcccacuucccucacaacacugaugaaaggaaaaaaaagaaagacuccaaaggaacacacgccacaaacuccgugguaaugugaaucacuccuguaggacaugauucuccaucccagaaaagccagcagcaccuuuacaacacacagagaucaaagcuggagacuggggaacuggcucacaugaugcuucuccccuaagaugaggaucugauguuuaugggaaagaaaacagggaacagguggagcauuaaaccucuguguguccucuggugggacuuugaaaacgcuaaacucaucucugugcagggccuaauaauugaaaauguguccuuaaagcugcucuucuccaaggccuacuuuggaucauggcuaggugacagguguccuucugggucacuacuuccuccacaaaauaaauaugcuacaggaaaggcauuggcgugggggcacuaaggggucuuuauucccuuucaucuccccaauaucuauuaggcucccccauuuugauauaguuguuacccaguuuuauauuggauacuauacaaauacagcucagaccucccuccuagccacaccguuuccuaccagaccucucuguguagucauuguuucugggcaaggcuggagggaaggccacaacuggcuccuuugggcgaacaugcaaucuccugaugcaacugaucuaccuuaggcuuuuagggaaacaguggucuaggcuaaggcagucugaauuaggugucuugucucuugcaacuaaauaaaacaaacaaacaaacaaguuuccaauaagaugcacauccaugggccaucgggcugauucagagauaaccacagaccccagauaaaguggaggaaacuaggaguucucuggauuggccagggagagaggcuaccagaagcugaccugaaacuggaagaugccaccugagcaaagauguuuacugauaauaauauuaaugcaaauaaaaauagagagaaaucaag

SEQ ID NO: 6759 - RNA, 9620 nt, Mus musculus
aucagaauagaagguuucccuauuuauuauaaaaugcauuacacaaauacaauugaccaaaaggucuaaaaacagcccagacucuuccaaccuucauccaccuguagauaaaagaggagccugguccugcucaugagggcaguccuucucagaagaacugccuguccccugggcccagcaauagaaaggagcccagucuaugugcucaggaccuugaagcagcccuugcccgcggcugcucugggcaggcagcagcugcggcuucacaguuauguucccaccacaacagaucaaggaaugcagagaaaagcaaaagacuggaaaaggagcuagagggguuauagcuaggggaggacacauuagggggcuucucagaauuccuugacuuugaaggacuaacaagaguauuuucuuuaaaugacuccuaaauuauacauacauguuaaguaauuuuucuuaugaauaccuuaaaaaauuuaaaaacauaaaaaaaccccaaaaaccaaaauuuaagaucaaaaaacaaaaaacccucucgaaagcuuaagaugcugaaccuagaugaaggaguuaaggaugcagccaaacagaaaugguuuaaggauagagggugaaugaagaagacaguggagguggaagacgauguuucagagcuggcaaggcuggccucaauuucuuuucuucugucuggauacugguucugccucuagguaccggagcccgaccagcaugcccaggauugagaaaccuuagacagacagagaaggcuaaguaaggguggacagacauagcaccuuacuggcccaguacucucuccucucuaccagccccgccacugaaggaaggggacuaggguggcccggugcuuacuugcuaccaucaggggugccagcacaccaacugugggagcugcuguuccaaauacaaacaacucugagaggaagugucccagggcgaggaggaauguccacagugugaugugauagagucugcaagggaacagacagaaacgggaaaggacauuacugcagagugugacacaauggugguugaaaggauccacgucccucagauacacccggcuacuuaaucacuucaagcucuucucuucuaggacaaaucucaaguuugguuuuuuuuuuuuuucuuuuuugguuuuucaagacaggguuucucugcauagcuccggcuguccuggaacuuacuuuguagaccaggccgcagugggccucuaggacuuagugagguagagaacuccgcagagagucuggaucgcaguccggggcagugcaaccaucacacacaccaucacacacuagccuuacuuaugcgcucagugcaaacugucagauggggcagucuaaggcuccccuagcaggugcccggccguaggccagccugugcuguaugacggaaccauaaaugaacguacuggauggggacuaggcagcaugaggcuuucagacgcucuugcaguacagucggcuucuuuaugucuuggccuaaaaucuggucugaggaggaggacaucuaagagccccagaggagaagaacuucuucaucaguuuugauaacaaggugcuggcugaccauuugaauuuagauuuuuuuuuuuuuuucaagacaggguuucucuguguagccuuggcuguccuggaacucacucuguagaucaggcuggccucaaacucagaaauccgccugccacugcuaggauuaaaguaaaggugugcgccaccauaccuggcuuucucucccccuuuuuuuguaaauuaugaaaaaaaauuaggacacacucccaagaagcuagugaacuguaggaagcacagcgggacggacucagcccucuugguucuaacacuuguacauuuguuuuagauuccuuuuuucugguuuuggggaucaaauccagggccucacgaaugccaggaaagcacuugccucugagcuaggucccccaaauggacacuuuuauauuaaagaacuaaaaauugaaaacauucgugcuguauccuguccugucuucucuccugccuccccauuucuaaaagaaccaguaucuuaaauuugguuuuuaucaugcugguacauguuggugugugugugucugugugugguguaggauguugguguggugugugugugaugguauguggugugugugugugauggcauguggugugugauguugguguguguggugaugguauguggugugugauguuggggugugugugugugugguguaggauguugguguggugugugaugguguguguguguguaauggcauguggugugugauguugguguguguguguaugugguguaggauguugguguggucugugugugugugaugguauguggugugugauucugaauucccagcugagggcugauaagcugaggaaguaugucagaggucuguggaucaaaguccuaagcgagagaggacuggaaacggcaggucagcauuugccgcugcucugggucagaagauggaacaccgaaugggcggaagaggugaggggauaacuuguuuguucacuggaacacacaucaaacaaaggccacaucccaaguacuugucagcaauucauccuggugguaaaagguccucaaaaugauuaucugagccuccagacuuucauucacccugagagguagaacagcuagcuauccucauuuuacagaugcagagugaaaaaauaaaccugauuaccaacaccacggcgagcagacuccgucuuccugaccccaggcagcuuccacuaagccacccugcuucuaaaaauauggguccuaucuaggacauguaguuuaguuucaagguuaaaaaaaaauuaaaaauaaagauggagagaucaaagggcuaauagucuugcuucacaacccucuugagucaggcuccuucuacuuaaauuaauuggauuuuuaaaaauauuuagacugcaaaaucaguaaugaaaaucacuaccccuuuucccccaagggauugcuaagaggugaaacauagguaaaagcuccuggcaaaaucagagaggagccauaaauauuguuuccucucuuccccagauacugcagggagggacaagauaaaaagauuucagcgugaggucaccguuugacagcuucacccagugagcugaccaaugacuguuuauaccaagccagaggugguuacugcaggcaagaaaccuugagcccccucuagcggccagaacuggguauggcaucaucuagacaagaugucucauuccugugugugugugugugugugcgcgcgcgagcgugcauuuuuaaaugcaggcuuauuguaaagcugcuaagcugcucuuggucaaguuugcuggccccgaggacugaggccaggggaguugcuaugggaaaggaaggggaggacaggggagcgaaagcacacacacacacacucgaauucucauauucucucucucucucucucucucucucucacacacacacgcacacacacacacacacaaacagaggcguuggggggagggagagaguguuuucuuuuuuuuucauggauuucugauuaaggaggaaugugcaggcagacacacacagacacagacacacacagagggagugugaggagagaguguuaguuuucuuucuuuccguggauuucugauuaaggaggaaggugcagaagguguuuacaggacuagcagugcagccgggcgccugagcauuugucagcaaugcucaagguccuucuaaaggacaccaaaccaaacccugaggcugaacugagcaggcacgcuaguucuucauaggggaaaggugugcucuaaucacgggcgugucgccaaccaaggacagugccgugcuauuugcuauggauguuaggccuguauguauuucaggccuggaaggacucucauuuucucugcgcuaugcuaaugcaguaaagugacucaacagguaccaacaguagccgggcacgugagcggagcgucacugccaacacacggacaccagaggccuucuuucccugacguacguuuuguuguggaugucaauggcacagaggcagcgaaucacugaugagagcagcguccagaucccaaagguccgggcuuggaggccauucacugugcaguuaaaaagaagcaagagcagugagaaggagggcugaggugagccuuguccuaugcuagucugcuucccuggugaugccuggaaggcagcagagccugaccucuccgugugggccccccggggaauggaaggaauucugagugcugcucaguccucuucagaugucuauaguuggaagggaaugcagcagagcugcguaggaacauacaagaugccuagcagaaccaguagccuuugaagacugcuaggagagaccagauaccagcaccaauggagaagucuucaagacaugguuuuaagaggucuaauaucugcucuacugggacagaauucaagcuagguuggcuucuuauauacauggaaguggaaacaggcacuauuucucugggguuugcugggaccaccuguucuuggugguuucauugugauacuguuguguuaaauaucuugcucugaaaauuugagucaauucaccgcaacaguggcucuugacccugacugcuuucuguaucaccugagggaacuuuauacaauuaccagggucuggacaccugaccaguacacgguacucuccagaagugaguucugacacgaguauuuuuuagaaguacccuguaugggugacuuaaguguauagccaaugagcugaaguaccuaccuuguggauuacaaacguucaagcacuaaagcauagcuaguucuuuugcuuagaugucucuugcacaauaaaaacagucuagaaauaguucaguuguaagcaccuacuuagcauacaagauaagaugugcaggguuugauucuuagcaccugaguguguguguacaaucaauggacacaaauaacaacgaaaaggcucuuggacuuuaaaaagucuuuagucuuuggaaacacaaacagcucuacuaaauucacaccaaagaacuuuuagguggcaaugagaauauauucaaaugucagccauuuggggauauacuccuuuuuuuuguuuguuuguuucuuucuucuuuugguuuuuugagacaggguuucucuguguugcccuggcuguucugaaacucacuuuguagaccaggcuguccuugaacucagaaauccaccugccucugccucccaagugcugggauuaaaggcaugugccaccacugcccggcgggggauauacucuuuagaaaccaaguugauggcuuuucuaaugaaaagacugaaguaaucugucuagugugagauacuuaaaaccagacuaaggucaaggggaaguuuacauguuuacuuucucuagagcccugcuccauccaucuacacagguuccaugacuaccugugagcagcaacuaagaguaaaaaaaaaauaaccuucacuucuccagguucuugacucccauuauauuucaauuuuguucaaaauaaggcucagccuacuuaauuacuuaauuuucuuucuaccuagauguugcagagaaaagaguaggucagagccuggaucuggguuaucuauaaaugugacaagagcugucagcugcugucaaucagugauguagcuccagguaccccugucaacggggugaaaguguugcugcaucagacagacacagacaugcgguaagaguuugaggagucgggagaggccccugugagcuggagguguggcuuugagagaggaacuuggagggaucuggggauccacucaggggccacaccucaguuugggaagaccuuggaugcgugacugucuaccuguuacauagacuagaaccucgugugccacacacucugacuccuaaugaggacacugagcuaccgcaaaaggcuucuaaccuuucucuuuauggccuuuuagaaucaacaugucauccuauuucuuugcuugccuuccugggagcuucuuuuaacacacaaauugucugggcaggcaaaugaauggagagguauccagagaagcuugggaaaaaggccaagugcuuccugcauguucuaauauucuacugcagugguucucaaccuuccuaaagcugcgaccguguaauacaguuccucauguguggugaccccccaaccacagaauuauuucauugcuacugcuacaacuaaaaaucauaauguaagucucuuaauaugcaggauaucugauauucgaccccugugaaaggguuguuugacucccaaaggguuauggcccacagguugagaacugcuguacaaguggcuaccaagacuggauuaggcaccagaaccaccuggauauuucuggaacuggauuccuagccaaacuuauugaggagccugggguggucagauacauggcugacuuuggaaucagcagcuaggucauugcuacagaaaauauacuucuuuacauucuuuucuuuucauuaguuuaauuaguucaguuuuggacauaggagcucaccaaguugcucagucugcuuugaacucucaaccuucuugcccuauccuccugugugcuaagauuauaggcaugugcucugaugcccauacaguuuugacgucuuaccaagguuuggcuugccaguguagagcuucucguagagaaaaguguggucucggaagcucuggaguguguuccccauggcuauaauggacaccauaaccagccagcuucguaacacauucaggaagcggcucaugacuccccuccaagagagggcgcucugccuugggaacaaagaaggcugaaaguuacuucuacaucagucacaagcugucaccuaaccuguacgagggcugucuggagugaugucggcagagcacuucacacauaccucugcuaguccuucggccccacccuauuucuugcuacaccacuuuuauuucacaaaauaucuaggaauauuuacccuaaacagagcuaugcugaucuuugucacggagguuuaaaaaaaaaaugcaguggguggaaaugucaaaucuagcacaaaagacauagugagaaggacagaagaaaugggggugcggacauuucuauaaguaaucaaauggauuucugggcaagcuuguguuccugccaaugcucggucacucuaaagagggugaacgaccaguacaccuugcagcaaguggcaccacauuuaccuuugcucaacuaauccuccaaagcacagcauugcuguaagucagaauucccuccacuugccuggaaucaguauuacgccuucaucucuucaugccaucccuuugcaauacaaauagcucagggugauucaaaaucuacucagauaccuggacacauccuaucaaauguacagaaguugcaucauacacuugaauggaaaccauaguguaacugucugacuagucuucuuaguuucccucugcauggcucccagacacaucauguuucauaaacuaaaacaaucgaaaagacuuggaaaagaccugucauagcuugauguuggguuucaagaaaaguacauuagcuauaguuacggaacacuuguguccuacacuuauaugugccccaaguauauaacaucuuauuucacucacucccuacaucaggauaggcaggcacuauuaguauuuccacuuuacagauggggaucagaaccaagagcuaagugauuugcuuagguaacauagcuaauauguggcugagugccagggucuguggacucuguugcaauacucccucauagaauguuuugauaaaguucucaucuuuuaaaaaauauuuacuuauuuauuuauuuagagacagggucuuacuauguggcuagucuggaacucuacauagaucaggcuggccuggaacucacagagauccaucugccucuuccuccugagugcugggauuaaaggugggugcggccaggugcagcaaaguucccauuuuuugaggaagcugguaggagagagagcuagguucgguacuuuuuguuuagcucaagccucgcugaguagugauuuccaucagcucuaaagggaucccacagagacaauuugucauagccaccaucauauuggcccuucauuuaccuauugucaggcuaacugcuuuggccugaaagcuguaagaaacuaucaggcuucccuuaucacugugguaauguuucaguaugauucccuacuacccaguguauauagacaucaagugaagugaugacgaaaaaccaacuauaaagggcuccaggagagaaaggguggacccagaggaaagaggucucaaacggggacugucccagucuagagaugcuggggugugcugaucuucacagacacuuacagcauaugccaaucuacuucuuuuuacuuucuccucucaacaccagcuuggguuauuuaaaaauccccccagcccgcccccgcacacacucccuuucaguagaacguagaacuuacacccuccauuuauuucacagaucuuagaaaucccagagcugaugaaaacacaccagagcauuucuguaugacucuaccaauucuuuaaacccauucccuuggaguuaugagguggagagagaggugggguacacccuugcccaggucagcauggaugcgauacuaauuaacaaucaauagaggcagacuccuauccuagcuacaccacucauaucugagggguucagacaagccagugagacucuagagacucgguuuucucauccguaaaauggggauauaagccucuaucucgaggguuacccgauaauacaugaggaaaagugaaagcucguugcagagcuagguucauaacgacugcccguucacucacccauccccagaauugaccaaaucuccauuuuccuagcaccuccucuuggacaucguuucuagacuccuccaccaccaccuccgguugcuuuccaggcaacccccacuuuccuaaauuuugcagauaguuuuacucgggugcuacaucccacuccaaauucuccuaccugacgauccaguacuacugcagcaguaucagcagcauccgcaaaccagcucucccuaggccagcuccggucccaaguccaccugggccacuuguucccgcccccucccucagcccagcuccaggauuggguuguuuuugucaguccucguucugauuggcuacgcuggcucaguucgagcaggcgauagggagugaacuccuuugcugccaaucagcaguugccgccgccugagccucuuccugcuacgccgcucacgcgguaaacccuucugucgagcguggcggaacucugaguuuggagucagucuuuuagggguggggaaaacgcagagagaaaaaggagccaagaaaccuucuggugacagccuggguuggcucuggugucugagcgcgccguggugacgccauccgucagcgcccgcagccgagcguuguucgcgccgcuggcgggcgccugcgcaguggcucuuagcgggcgguugcuuguugguuguuguaguaacgggggaagcagccuucggcggcugcguugauucgggcuggggaaggaggagggaggugaagcagagcgugguccccgccugccggccccg

SEQ ID NO: 6760 - RNA, 1151 nt, Mus musculus
auccacacacacguuuuauucaucccaggaccccagcucacggaaugguaccauggacaguuaagcugggucuucccaccagcaaugcucacucucaucuagccuauccuucccaagccugcugagacgucugucuccuaggugaccaaauggacagugcuaaccaucagggccugcguucccccacaggauccuggagauuggauugcaaaacaccuaccacccauccuguucagcugcucagcuguaggccuuggcuuugaucugcccaacaccugagggaaguggcuccagagaagggucuagaagcagaggggaggagaauggaagaaauuuucuaugaauagcauuugccccaguuagaguggggguaauuaucccagcauuaggguaucccaucuaagcugcauguuguagagaacggucugcacuaggugcugaccucuuccuucacuucaccuguaaaguucuucuaugguggaggcuggggugcaagugagcauggugcuggagccucuggaagaaucugaggucaucccuguuucccaccucauucccagaacugugggauccacagccugcagaggaacaaagggcagcaggacacuguguauaugcugggugaccccugaacacgcaagcauccugcucauguacccugccuccuagacaagaacuuccaacaggccugcagaggcagacugugcucgcauccugggaagugcugguccccagcacaaaggacagggcuuuagacaggacccauuuuugcucagaucuuggcuacaaccuucucuagcacucacacacggauugcugggagaugccaagggcauccagaaggggacuuggaucguuuuaaugccugcucacccaggcaacucagagcuaccccugaauucugacuccagcugagugcuccugacaguccuccaugcucuucccaacccugcucugggcucacaggucaccauacugccuuuuacccagcaucuccuugcucccacaaggccaggucucaccuuguuuuggccuuaccuacucuggguuucugaggcagggcugcugucugcuuucucagggaguccauuaaaagaugucauucuuccucuagaagauagaaaugagccuggcuaccucuuccuaugaua

SEQ ID NO: 6761 - RNA, 16991 nt, Mus musculus
cgcggcgcggcgcggaccggugucgagccgggugggcggcgggagggcuggggacccggcaggcggcagcgguggcuucugcuucgccgagccgggacgcagcgaucggccgaugggcugcaccuucucaggcuguugcucuccccagggauccacgcaccgacgcccgcccucgcuuugucaguggauuccagccgccgccacgggcggagccugaggaccugcgcucgcgccccgcacgcccagcuucgcucagcuuggccgcgggaacccuagcgcagcauccuuuugcccgcucaugcugcagcugcuggccagcggcgaagcugcggcuggagccugccgcucagugaccucagcccgguccccgagcgucgcccgagccgcucuccacgauggcugagcuuggggcuccgcgccccucuuuagcucagcugggaccguuuagcgccaggugcacccggugcccccgcugagccgcgccaguccaggguucccagggccugggcuccccuagcccucgccuucccgccgcgcccuuccccucccgcccucuccgcugcugcuccccggggcuaggggcuaggagacccagacaaagccccacuuugugagggaggcaggcuuggaaugugcggagcggcgcgcgcccccuccccgccccaccagcugcgagucuugguucccaggagggucgugaccgagaagucaccccggacaucgcccucuacccuugcauccccggcccccgagguccagacucggagcucacgcggguccccucugcucgcuccagugugagugagcaaggauuucguagaggaauuuguucuguccaaaacugagagugggcaccggugacuuggccugccuuuuugguguagcugcaggucugagcugucuggccucagucuccccaccccgaccccccacuuuucuccucucagccaucguagaucgcugugggucauuguucucgcugccaaauggaggugauuuauacaggcugccaaguugggguguguucucuuuauccuguuuuccaaacaaaacaaggccucuaaggucgacccugggcaacccaccuggccaucacuccugguugaugcucugaguuaccaaaugguauuuuauuguacaggagccacgcccugguuucuuaaaggcgccaggcacuguuugaccauguguuaucuuuauagcgggugugugggaggccuucugugaggcacuuauuccccccccccccaccuccugaucaucgucccacccccguugaggauuuagggaugccagggggaaagaagguggucccaaguggcagcagcagugccuccccgaacgcagccgccaccaccacugcugcugcugcugcugccgcugcugccccccacucuggcacuaaacguuuggagaccaccgaaggggccucagcacagagagaugaggaacccgaagaggaaggggaagaggaccuacgagauggaggugucccuuuuuucaucaaccgagguggacugccaguggaugaggccaccugggaaaggauguggaagcauguggccaagauccacccagauggagagaagguggcccugcgcauccguggggccaccgaccugcccaagguaagacauggaggggccaggcacagugaagauggguuuuauugaccuugaagcuaagaaaguaaccuacacuauuuuguugcugaugaaugaaguagagggaccauuguuguggugagauuuuuaaaguauagguaggugccaucuguccagaaguuucuucccagugcuuuuggagucauuugaugggggaagcucaguccccuaucuccaggaggcccucccucauggcauccugagcaggaucacaaaugaacuggagaacugguguagccuggccucucuuuggcucaggauacuugagaagccagaaaacuaugaggcuauuggugacugacugggagagugcagggcuugcuguguaugagaaaauguuuuccgguauuaucuaccaaguucgaccagcagcauucccaaggaagugccguuuggguuccucguggaagaugagaaacucaaaagauacgugagaauuagcagaguggagauucccacgccaggguuugggguuccuucugcucagcucugguggguacuggauucagucacaugagcggugacccuguggggaagagauaaguuagauauucuccugcggugacuggaauucauccgccacaacagugccucuaucgggcugugcugagcaaggagagccucugucucauucaucuuugucuucuugaggucuccugugugcuuggcacaggguggacacuuauguguguuugcuaaaugcaagggcauuugggaugugccgugcugggcagugcugugcuaaaaaugugcagacaugugguguguguguguguguguguguguguguguguguguguguuuaauguuuaugguccaauccaagaaagcacugcuccaaguaccaaggccacuggucagaagucagaggcuaaggguuagguccugaaggaagagagagagauaauuaccgauacacaaaaauuaggccugaggguaugggggacuuuugggauagcauuggaaauguaaaugaggaaaauaccuaauuaaaaaaaaagaauaaaaaaaaaagaaauuaggccuguuuuccucuugcugguuuauugguagaaccgucaccaaaaaaaaaaaaaaaaaaaaaaaaagaaaguuuuggagaaaagauaaucugaggucgaagguugagcugcuacguaauguuucccaggggaauaagcuagauuugauuuugaacaguuacaucaucaucuucucauuuauuuagcuaaucugaaauuggacauuguuuccacugucuuauccuuaaaaugaacacuaugcagaccacucuaaagcaugcauucggggauccagcuuugauuuuuaaauaucugaacaagaaaguaugacaucguggcauaguguuuuggaucaccuaccugcccgugugagcucaaggcaauccccacccacccagccagccuguuugagucacagcuggcuuaucuguaaaauggguugguaguggagagggugaaaugagaaacuacguuaaucauccaaccgcggaggaggacugauucgaggagagagaugagaugccacacagagcgccugacugacgaggccagagucacacacaugcuccacagugucuggcccucuugguucuguuugaauugggccauaggaaggugggagaauggcuaccaucaguacuuuggaggacucuggccaucagugucuucgauagugauuagucacuaaugccaucuucuggccucggguucggaaagggcacguuugaacaaaugcaacuguuugucagggaagaaaguauggagaccagaguaugggggggugggguuaugagggguuucggacacuuugaaacgucgucuuuaagccuuugggaaagcgucucagugaggaaguaaggaagcauggugaagcuugguguuacgucaggucagggaacccuuggggugcagaggauguggaggagcccuggaagcuuuggcgaagagcagcaauauugggugucauacugggagcugcagaaaggccugucccugaccugucccauguggccugcugcagaggucacacuguccuaugaugggcccuggaaggguuucuuaggauacacaguguuguaacagacugcuugagcuaaccguuaacguuagauuucucacacagugauccguaaucuggcaucuuuacaggaaaggaagagaaaugggaacagcauaucuauagcagcugccaggagggacugggauguguccccacucucucauuuugcuacagcuucccauaaccccacccaucuucccugaguuuuacaggcuaagcuggagccacagcagcagggcaguucaaagcccuggaggggaagccaucauggucucucacccuuucgaucucauaacuacuuauaagaggaggcuguguccuugccccucagcaugcccagccguccacggaucagcggcaaugacccuuucauuggggauauugagaugaacugaugguggaaagcguguagcaccucauuaggugagcaucuaauagguccccaguggugcagagugggcacgcagcaagccacagguacuugcagccucugugagagcgaugucaaacauaacaguuucuaccaggauccagaagccagcagcaggcuaaacuccugcauaagaauaucuccuugcuguucccagccacuguccccugugaaagcccagaaacaaguugccuaaaccugguugcuguaggccuagcugugucuuuggccacugagcaccugcagaugggaauccaggcaucucuagagggccagauagcucagggcagcgugugccgaaccggcuuugguacauaucuguagccagguguuggacaguguuccgaagcauugcuugcagcaggucagugaugcccgccaaggcggguucuguuacuccccuuucaugagugagguacauuccccugugagacaucuggggcaccacuguucaggaguuccccugaaaucauagagcugguuccauaacauggccaguucugucugcugugcucaucgcuaagucuuccuguaggauuguccuagaacccuggacugucugguucuuggaccaggcuuugcuccugggaagguagucuccaaggccacacauagaauccuaggucauuucugacucuccuuccacaguggccuucuugccaggcccuuuguguggcagguacccaugaugcuuuuguggguacucccguuccuggcuugagucuggucccaagucuuucugccugagcuuuggcaagugcuucugcuauggcuccuucccuguccagaguggcucaccaacagguggguucaguuacacagcuccaguugcugggaccuauuuaucaaggggggggggguuacucugcuacacugagaaugccccccgagguccagcaacucggguggauguguauacccuugacuaggauggcugggcagccccuuggacaguugugugcagcuggcacagagugaucagggaagugaaggcagggcccguccugagcuugccuccugcuguaagugacagugccgguuugaagacaggagugaugugaaaggggaaauaacuucuccaggcugugguaucugcugcuacagacugccuagacaggaaacaaagggcccuggcgagaggagagggaagaaagucauguuagacagcuucccugagccaggacccuuccuuccuacaucuccgcccugcagagugaggcaguaucuccuaccauucggagcaccccagagacaaguguaugaugauaacugugugugacgucccuuccugaucaagcccagccacaacuaugguuguuguuuuuaaaaacugauuuaaaaaucaauuguuugauuuaaaaaaaaaaauccucugugggcccagccuaccaaggaugaauccuuccuccuccauauagccccacccugagcguaccuaggacacgagauaccccuucugucuacuccuacccuuacauuugcagcuaggugggcaugggcaagcucuggguggccuuggacgguccaauggcaaccuaacccaugggaaaggguggacaugugcugcucagggauggagugggucaggaaauggcguuugaaguaagaccugacccauaauucccuugucccacugccacacuccuugaccauucaggcuggugcuuuggaagcccuggcacaccugccaugccagugaaguggaugacaccccuugcugagguuauagccaccuauccaggacagacccccuagcuuaggguaucaucugguagaauggaacacugagaaaaacaguuuuagucuaguccucgagccagaguguauuggucugguuuucguugcuauaacaaaauaccugaggcaggacacuugugaaaaaaugagguuuauuuagcuugcagccuuggggacugaaggggccccuguugguucggacuggggaaaggucuaauggcgacggaugggaucaugacagggucauggagaaacagaucacaguggaagcaagaagucagaagaagggggagcuguguauugcuccuuugaugacaacccugagaacugccuuccuccucuccaagggcacaccuccaguacccuaauaccuucaucuagagcccacucaacauuaccaacccaggaacaaaaaucucaacaccuuugccacauccaagcuauagaccagagugaaccccaaacccaaacaaauuaaucccaauccagacuuucucauuaaguauuaauucauguguauuuuaaauuuagucaguggauccuucuguguuuucuaaaauuauuuaauagaauggaauuccaaggccaacauaagcuccccaggugucaggugucagggaugcugagcuggggcccugggaggaggcuugggagggaggcauugccagggaaaauggcucagaguaggagccuccccaggcuccccagaguguugcugcugggggaggggggugcuggaagcuccagggugugccucuccaugugacagagauuuuucucuaucugucccuagauucccauaccaagugugccuacuuuccagccgacgacgcccgucccugagcgccuggaagccgugcagcgcuacaucagggagcugcaguauccucuuggcuccagagcugugaccaccacuuagugacagccccaaagaucaaguggagucuagugagggauccgcagggccagcucccucccagcuucagagcugcucuucacuggcaucgcuguucccugaagcugcugaggcugugucugagugcuggacucuauccagcuucuccagcacuagaucccuaugcucugugucugugugucugugugugugugucugugugugugugugugucuguauaugugugugugugucugugugugucuguguguguuugugugugucugugugugugugucuguauguuugugucugugugugcguuuguguaucugugugugcaucuguguguguguaucugugugugcguuugugucugugugugucucugugugugugucuguaugugcauuuaugucuguuauguaugugcauuugugucuaugucugugugugagugugucugugugugcguuuguguguguguaucugugugucuguguauguguguguaucugugggggggauuuguguguguguaucuguggggggggucuguguguuuguguguguguuugucuguguguggggggguugugugugcaggaagaagggggcuccuaagcaccuugcugaggaaagggggugucagcuguaauucgucuugcccuagucaagggacagaagcagcucuuuggggucacuacagugcucaauuggggggggaugggaaaagggacuagguucuucugcacuaagauauaacauccacauccuaaaguuuucuccuaauucuugacauuucucuuccaugucuggaagcgaguuaccuucugucucugcccuaggccccuggagcuucugcccaagagcugugucuguguccuggguucugugcuccuuauuugcuugcuccuugugcuuuccuagacacccaggaccacgcagcccaggggugacacaacacacaaugggaugggagccccucccggcaucaaucaggaauuaagaaacuucaccacaggccagucgggugcaggcauuuucugaauugagguccccuguucccaauugacucuaacggguaucacauugacauaaaaguagcuggcacaggggaaguagugguggccccucagccuucuuaguuguuggcaaagcccagcacugccaggaacuguccccagcuaaggcugcuuucucagcacugcugggcuggcugcccgcucaguguccucccugagacagcaggccaagagagaacaagaggcauugccaaagagcgggggaagagggucuaugagaguguggugaaccccacgcccuacccucccccucuuccucaagaucaaguccuaaguguccuggaggguguuccguggggcuucuguagccguccuagggucugggauagcagccgagggaacaguaccuacagccuuccagaucgagccaggaaguccuuaaccacuguccccagguacaaucacacagggacacaauucuuugaaauuaagaagagcagaccucugacgggguaaguacaaaaccacuggguuggcuccccuagggaaccucugugguuugccuucuagugacaacuuaagggguuggcaggggacuuuucugagaaaagccagccaugggaugggggaagggugcuacccuagggcccuaaggaaggaaaucccaaugagauagccacccaaggcugaugaaaggaggcacaguugagcuccuaguguaaccccuagccccgcccccaccuagccccgcccccaccuagccccgcccccaccuagccccgcccccuguuugugggggaugugggagggggcagggaagaccauuucccuuuuucuuucauugaagccccccuguacucugcauuaugugguaccuacaagaaagaaaacugcuucucuuacccgcaagccccaucaugacucagcaugcagacuugaacuaaaucucuuguucuagauaguuuaaguugcuuauuuacuuaaucaugggaaaauauccugaguugcuuaucuauuuaaucaauugcccccucuugaagcccuuggguggagccacauucucucaucuccgggcucugcuccugcccuuccguugcugcuuuguguugcauccucugguaggaugcaggugacccagacaaagcagaggcuaggcugagucccuagaccuggaggacaggauguuuugaaauagccuaaauuccaaggucagggcugggccuacaagccaagcgacagcugucugcuugagaugcugcauccaggcugcugagagucuuuuccaucaguuagcagguucuuugggcagcuguggcuagaugaggaguaucugcugugcucagggagggacccaaucaaugccaagcuuucuccccucccaagcccuuauugccaugggagaaggcuugagcuccucagaucccggcuccagucaugcuccccucccccagucuuugaguagcagcccaggccaggaaagaggaaaugaagggaaagaaggacagacaguaggccuacuuccugauccccaguguuugccuccuuacccaagacuuuagacuugggagagaaggaaacaccaggccugggggaggacauccuggaggcaagccucugccccagucuuucuggcucuucagcaaauagggccugagaggguuggagccggucuccacacagccccgccucccuuucucauaggcugauggaccuggccaaggaaaugaccaaagaggcucugccaaucaaaugccuggaagcugugauccugggaauguauccuuccuugggccugggagaggcuggcucagacuggcccagccuuggcugcaggcuguggaaugggaggguccuaagggcuuccugugcuaacaauugacccccagcaugaagcaccucccaagauggaggagucucuguaaaagaaaggauucuuggggaggucuucgucucagugcccucucuugcuaucuuccaggccggcuggauagcuuauuuuugagucccauggucaaggugacccuguuuuuuggaauuccaucccugccuggguacaggucuggcuguugugccauuucuaagaaacgcucuggaagcugcaaagaagccccguguuggcacgcccagguagugcugauuuauagacgugacagaugagcuuuuggaaucagaacuaaccuaaaaagaugcacacgguuucucagccagccgcgcaagggcaaaggggcaccuaggaagacugaccagcccccaggagaagcagcccucuguaggaccccagucagggcaggggagugaguggguaaacauggccagauugucuucagaaggccucuuuggcacacgugaccacccagaccuaacccuuuccuuagcacucggauucaccaguuaccucaccaacaguaugcccacccuggaacgcuuucccaucagcuucaagaccuauuucucagggaacuacuuccgccacauugugcugggggugaacuucgggggccgcuauggcgcccuggguaugagccgaagggaggaccugauguacaaaccgcccgccuuccgcacgcucagugagcucgugcuggacuacgaagcggccuacggccgcugcuggcacgugcugaagaaggugaagcugggucagugugugucccacgacccgcacaguguggaacagauugaauggaagcacucggugcuggauguggagaggcuggggcgggaagacuuccgcaaggagcuggagcgucaugcccgagacaugcggcucaagguuagcaucggcaauggguccacgagaccggugcuuucagcugcagcuuucucaugggauucccuccgugccuuuagcagguugucccgaccaguugggccugaaaaugaaguaucuauuugggcucaggauggggcauuacucaaaaaaacaaaaaaaaaacaaaacaaacaaacaaacaaaaaaaaccguucaguuguugucccuguugucccuucaaggugggcagacggaggacuaauguaaaaguaggaaaggagugagcugggagugagucauaggccugugcaguuggacacgugaagggcggggacaugguacuccaggccugggugcuuagaauggaagaagcagacaccugaccugucugacaaugggcaggaugggguaguaagcagccacaaccucuccuguccaucucgacuccugagucccuaagcucccugccuguaauaaaggaccaagaggagaucagcagaaaacggaagguccaccucuagggaagacacuaagaggguggugagcccuccccuucucucccaccacugggcaggagcuggagaguuggagaagucucauggaccaacaacaguaggcaaagaucccgaggaguuggcuuccauagggcuuucuaucuuccuggacuggagagagcuuuccuagggccugccagggcucuccccagcguggucagcccucugcauuacucagcccuacugcacuguagccugcuccccacaaccgcuacaguuaacagugucuuuccccuaagguaggagcugucauaggccuauauuacagaggggcuuuucugugccugggccacucccuucccccagcuugguaagccugcacuccacccacccucccccacuguugggagcauggucguguuuuccggguagcagcaagucacauagauagacauggagcuucuagauuccucuuuugagugcuguugauucccagacggcucagcgcuggacuccuugaguugcuuuguuuucagcuuuguuugagcugaggaaauucaaagcaggcugaccauccuacacaagggauguuuuggguuuggguucauuuuguuguuguuguugaugaugaugaugguuuuugguugguggguuugguuuuguucuuuuuccguaucagcgauccagcucccagugugacaucugaugagccugagacagucagugucacugucaggcugguaggaccugacucagagcucaguauuugccagauccccaauuggcacauuuaccuugccuggcuaaaaaggucuuucuuucuugaaagguguuuuccaguccuaggacagcccaguggugccuccugcacuauguuugggacccuuguggaguagacggcccuaccaaggaucugcugcccgccucccccccccccccauggcuuuagugccagggaugacccagagaugggguaaaggccaccugaggcuuggagcucagaccgcauagggauggcuuccagggacugugacuccuagcaggacagaguaggccaugcggcagcucagaacauccuuuucucucuuccucccuauccagauuggcaaggggacaggcccuccuucucccaccaaggaccggaagaaggauguuuccuccccacagagggcccaguccagcccccaucgcaggaacagccgcagugagagacggugaggaaggagaccccacagucuuucccuuuucucucuuccucacucuuccuuucuccuuccuauccuuugcucugucagaagucacuugggacaaaggauccaggggucuaaguguuggcaggcuaacggcaguuuggugccauuucccuaaagaaaaggccccucgacuguguccagauaagcugugccagaaggucugaggcaggcagcagaauggauugaggaggaaggaaagacccaauggggcccccacaaggcccugagcucuccucaaguuugcugcaagggcucugcguaugaccagaggcugagcagccaggaccggagacuuggagcacaacuuuuguccccuaggguguggguuugugucuguguccaaauggcaagacuugcuauuuaaauaucaggccucucacucugacucccucccucucccacacauuauuauggcucucgcuuuaauuauaauuguggagccgccucucugcugugaaagugagggguugcugagcaggccucuagugcugaaaugcccauugcuccuaccuuugaucuaggaggcuuuuguaaggagccaauuccggguugugcuugaagcuguuaccccacaagcuauguaagucaucagaaagccagaggcuguguaaccaaccgaccgcaggggaucgauccucuaggagcuucaggcuggccacacugguuccacaaacacugcccacacucucugcugcagcuguagaagccccuuagaggagggaagucuuagaggaggggauagcucucccuccuuccccccucccugucucuauuucccuaguaaccacucgcuccucuucugcacccucugcuuuucuuccugcaggccuucaggggagaagaagcccgcagagcccaaagccaugccagaccucaguggguaccagauccgggugugaggcagaugccagcauccccagaucuccucugcgucuggaggcccaggaaagaaacuacuucauccaggcaggggcuagugaugggguggacuuggggugggaggccagaaggaggccuugccauucagccccaagugacuugcccucccaugaagccaagccccuaacuuugggccaagaagcaguuaguguuuuauuuggaguuuuagcucuacaacugaaguauaagguauuugaacagaaagacaaauggauauguugguagcugucagggucuguucucucucucugagcacugcguggcuuggggaggagggcugccucguucuguggugcuccuucucucaacagugaucagguuuaugagccuccccagccuguggggugaggguggggcaguguaggaauggagguguuuucuccaacugggccuguccuggcagaaucaugacccagggaaaggaaagcagggugggagguucuccugagaaaggucuauuuguuuuucaaaucaggaacuuggcagaagccacaucugccuaagguccaggagagcccuuuagauaguacugugcaccccccccaccucccccuacaucuucaccauggccaguuuaggacuaggcuauaggaggaccaggagaggacuauagugggaagaguucuggcucuuagcacaucugcuggcuccgucuaguucugacuauugcugcagcccaggggcucccugaagaagggcugggcuuuguagagagcccagccuuguacuggggacaccaugaccuuaugaaacuuggcugggcacgggguaguugagaagaacuaccuacucuagcugugugggagugggcucuucucuccccaucuaauaaucucagcacuugguggggaaacaagaccagagcaggcugccuaaccuccagggugccuucccaggccuagcugccuguuuaggcuuggaguaguggccaguuuuagcagcucuuugggacacuggcaggagggggugggaguugucugcccccuggcccuggagcacaagaucccagguagaaaagugagguguggagaggggcugucugggcuggggaggagaaccagcccuugaguugggaauguaagugagaagggcugagagaggcaguucaggauggggaugcgguggggacuguguggggaccgaguucccugcagcacagguggcacucuucaaguugcuggagacuucaagugacagagggcagcuggaugagguggugaccguuaagggacuuuacugagagguggagucagcuugggcagcugccaauaagacugcagagggcugagggcuggcugggauaagagcuagagaccuagggacucaaaugccuacagggccagcaagaggcaaagaagagggcuggauggggacugugucccaccaaagagaacauaucccauuaaaguaggaugcugccauuguacugucccacagugcaagcccuaagggguguaagcccuuuuuuuuuuuuuuuuuuuuuuuuuuaggccaaggcucugaacuaauauaugaauuguaauuuuuuaaaaguuaccaguucaagaagugaucaccauagcugagggaguaucaguccacaaugucugggguagagagcaugggcugguuguggggagacuguggguggaaaaugugacaguuuaaaguuucccaaaggcagcaggagccacuuccuguaucucucuccuuagccccauccugcaggcagaggcugaguuugugcuugcuggguagaguaggauagaaggguggaauucuuccugccuggaaauggaugguggcuggaaugaggaggaggaggaggaggaggaggaggaggaggaggaggaggaggaggaggaggaggaggaggaggaggaagaagaggaggaggaggaggaggaggaagagggaugccccugcuggugacacaccaacagcuccugggcccagcacaggcaccaugggggggggcugaguguuuagucccuugucuugccugguuccuccuggggucaggggggcccuuggaaagugcauagccuaggcuacacccucuagccagacccaugaaaagacaugacacuauuugauccaucucagaguucagggaguagggauggcaguagcucccaugccuucuuugagagguauaagacuggacaagaucuuuuuuggaucucaguguggcugcuuaucccugggacagcagcccuaugugucucuggaaacuucaagauaugacaaaauaugggagaaggagguguggggagagcuagagucagguguauuuggagaacagcaccaggucccagagccuuaggacaggagcgcugagcuccaguuccucugaggcccaggaaagaaggaagcagggggagccccgacuuguucaggauuugagggagcagcugauggcuagggguacacacaccccugcuguucaccucucccaggcuaagggcguccggccuguggagacugucauaggcugucaugggccacaguggugcuuuuuuuauuauuauuuuauuuuuuacucuuucucauauguagcaagccacgcuucccucuguggccauuuacacaggcugugcucuugggggcuggccuggcugucugguuucuggggaggcagaggcaaggacuuugaggccuuagucaccauccaugacaucaccucaucucacuuccuauaagagccagggaucuggcagaugucugcagaccuccugacucaggccugcccuuucagcucuucuaccccacccuuggggacugcuggcugaagagggucaaggugaggucagaggaggcugguugguggagguggcaugggcagagagguuccuuguguuugguguugggucaaaacacugggaagcuagcuccagagaaccuuccuucuccauccagcuaccugccaguccuuucccccuccauaaccucauauuuccuuguucccccgaacugucaugcuagccacccauccuuagugggcauggccaagcggguagaacagcagcccgcuggccccagacuugaugaugaagccuagagacuggguacugaggaacagauucaggagacugaccauggcugaugucugguccagucagaucaugcccugaccccuuuccagcugggaagacauccuggcucaggggaggaguaggucuaaugauagcugugcaggcuuugugcucugaggucugugcccguguaccaccccagcuuuccuaccugggaugaguuugggcuuaacacaucagcgcccacccugacaugcugucagugguguuaaagugcaaggaugcacagguggggaccaauaagccagaggugugaagggcaaggguauucucugaaggaguggaggugggagcuagggauucucccuacggguaccacagccucucccagcagcaucuccagccagguggggcugucacuguacuagcugugaguccugugcuaggacccccucacuccaguucgaugcacuggggucccaagcuuccuuguuaagucuggaaagaaaucuggguacacuugaccccugggccagugaugacggaccgcccauccccugugcuuuguuaggcucuuguguugucccugaugccauuauugugcccuuguaucaguauuaccccugccuuucagugcacacuuugucucauuccuuucucaccuuccccugaaaugaauaaagucucccagcucccaucguaugggcuggcagaaaucacgugaaac

SEQ ID NO: 6762 - RNA, 4436 nt, Mus musculus
uuuuuuuuuuuuuuuugcagcuggguccuguaugggggguuggguaaagaugcuuaagaguaaacagaaaucgcuuagucagcaacuguagauuacaggggagguaaauguaaacagucugguacccaggggguggggcagccugcucaagagccuuccaaggaaccaggaugccagguuccauccaaguaggagguaaacaguuguccccccuuaauuggaguagcauagcuucaacccuagaaagacaaauuugcugacucagggcagaauuaauaucaauugaauuuauuacaaguuacuaagcugcaaggcacauuacaguguucuguuaacuacagaaauguagaaaggacaaacagagcaaguucuccaugucuagcauuucgcucuacuguucaaaagcauccgugcaucaauaaagccaaaacaaaacgacacgugaagauccaacacauucaggucaguagaaacaaaucaaaacauuuucccccuucacaaacuugcaacaaaaaaaaaaaaaccaaacaaaccacccauccccucccaacaccccccuuaccauuuugcaaacaaaacaggaaaacaaaacagaacagaacaaaauuaaguauagacuucaacacuggggcuguuuagaaagaagacgcuuuuuaccauuuuauaguaucaauguuuuuuuguauuuuuguauuuuauuuuauuuuuuuuuuuaggcagcaacacuggccuuggcaaaacaaaaaacgacaaaaucucuucuuuuguguguuuuccuuucagagugcauaacauuuacaaaaauacacaccagcagcagucguugcuaagggcuauuaauucuguaccuaggcaaacauucugccaccaaauaaaugcuaacgaauaugaugcgaaagacccaaucaauauuauacugcuuaacacaaaccagcuuauccuucaaaugaagaaguuacauaccuguuucaaaauauagaaacauacgacgaaaauaaugucuauacauaagacuaacuuuuugcaguuauauucacaauucuacaucuugguggauaggggagguggaggcaggugggggaagggcccucuagauugaagaggagguggucuagggcaaaggaggucgcugcccugcgguucaagggucucucucuuuuuucacuuuaacauccccagcuaagauaguugcaauuucgcccugcaugaaggcccaagguacauuagacccgacuagggggcauuucucuccgcuggggcaauacaccucaccuguggcccccugggccuugauacucucucuagaacaagggaaacaaaauuuguggcuagggacagacggacacugaacgaaaugcguguccuccaaacguucguggcaaaugguacagcagagggguccgcuguuggccauaggggaauccggaauguuuuggggguguacuugguccaugcccgggugggcgcuaggcggcgggggcgccaccuguaaauucagguccccauugcgugaugccaggcgacgcuggcccggcacggaggcgggugacaccgggcugcugcuguuucgccuagcagaugcaguggucgagugcacugaacugccguccuugggcgaaugagcugugcccaaagugucugcuaccgacaugagggcagccaugggggacggaccguucuggggggcugacuccggcggggugguccgauuggaaugaggucccagagguggagggggcggagguggucccccugcugagugucccggcgccgcaaagccccccgcggacaucgugagcuucagcgccucgcucugguuugccauccacugcugccucugcuguuccucaccgagcuucagugcgcuuucagcugagucuggaggcuccggggaugccuuccuuuugcgcaggcuggacgcugcaccccggcccgugggcgccgcggguggcaaggcuccaguuccuggaggugcgcugggggcgcggcugagacucaccagcgccguggguagcaugggacagcuagcaucuagguagggcuggggcagcauguccgcgccgggcacgcccuccuugaagaagcgcacagccucaggcaguagguccccaaguaggcgccagucgccagagccgugcuucuucucguacuccagguacuugaagccagaggacagaccccggccaaaguccuucaugcaauccugguacaucuguuuggccaccccagacgcgcuggaguacacauugccggagcccgugggauacucaaugaacagcuucagcucauaguccaugcccggcuuagagaccgcgucgaaggcaaagacgcgacccaaaagcgagugguccuucuugaagcgcaccucguagggcgugcagccagccagcgugagcagcgugucgcggaccaucuugggcuuguuggcccacuccuccgcgcgguugcgcaggcucucgcucagcucugccaaggccucagcguugcgcugcuucuccuuuagcucacgcuccugguccgugcucgacaccgauccaggccucuugccagcagcacccacgcccaccucugccaccgucgacgaagucgaugauggagcggaggauacaguggcugacacacccgggggacccccgagacaugcggggcccccgggagcacccggaggugcuggagucgggggcccucggcuuccccccaacccguggggcggaggcagcaccgcggcgcuggccgggccguuaagcagcgucugcggcaauagguuggggggcacgguuagcugaggucccccgccaccacccggguugggcagcccggucaccaacccacuaugcgucccacgccgagaagccaccgauguugcugcugaggaugaguuggggcucuggcgguucagcuccggggggccuuccucuggugccggcuuggggaagccguuaggaccucccaggccguugggcagccgggcggcguggcugcugcuccccagacucaccggaggaggcggauacucgaaccggcugcguuguuccaccgcagcggcggcggcagccgcggcggccgcugcgcucaggccauaacgcuccagaccggacggggcggccaacacugcagguuugguggaaccaucgacgugguugagcugcugcuguugcugcuguuguugcugcugcuguugcugugcggcggcagcugcugcugccgcuuccuuggcggacaaggccaccgucuugaccccgacuggcggcggcggccccggggagcgaccgucuuggaagcaaccgugagcccgcuucagcuggcgugcugucucgaucacgaauucuaugcggucggcgccuucguaauugacgcaaccacggcauacggguucggagaagucccagaucauggcccagggcaugcgaggcaggucgcacagguagcaagacugucuucgggacgaggacaccugcgccgccgacaugaugccagccucggggaagguaggcccccgcccgggcuguuuccgaggcgccuucuccuacgggaggacuagcuggcuggggaagaaguccagcugcgggggaggggggcggaggggagcgagaaaguucugccccuggggcaggagagagcgcgagucuccacagccggcgcagcagugccucucucucggcgggggcuccaccacccaggcggccgacggguuccgcacgcuccucgcccccaccuccuacugcggcugucugguccagagaagagcaccgggagccuucuuccuggugcggcggaucagggcugcgagcuccgggucuggggggagggggcuacgguguccggggccggcugccaguggccucuuggcccccuccccggagugauugaagcguggaagcgcggaggggucccccuacgaucugaguccucucuacgccaggcgccccggggagaggguuagaagguugugccacccggugcccagguccaaucuugcugaagccgcugauuccccgggagggccgggggaggaggugguggcugccaagagaggagcguuuccccuccgcagcgacggccguugcgcuggcggcgucuggguuugcacgccggagggagccggccgccgcggccaccguuuccaagacacacgagagcagaggagaggagcgcacgcacgcaggcucccaccgcccccuggccugagcaccucuccggccacagaggcuggcggcgcucacguuggcugcagggcgcucgcucggcgccuccacccgggucgcaucccuucccgcucucgcucgccuggaaugugggguugugauuguuacucuacguuccggaggcgcgucucagcgcuccugcucgggcugcggcucgcgcuguccccggcuuggccgcgcgggaugccgcccgggcggagcgcugacgucaccgccaugcucugcaccagu

SEQ ID NO: 6763 - RNA, 4436 nt, Mus musculus
acuggugcagagcauggcggugacgucagcgcuccgcccgggcggcaucccgcgcggccaagccggggacagcgcgagccgcagcccgagcaggagcgcugagacgcgccuccggaacguagaguaacaaucacaaccccacauuccaggcgagcgagagcgggaagggaugcgacccggguggaggcgccgagcgagcgcccugcagccaacgugagcgccgccagccucuguggccggagaggugcucaggccagggggcggugggagccugcgugcgugcgcuccucuccucugcucucgugugucuuggaaacgguggccgcggcggccggcucccuccggcgugcaaacccagacgccgccagcgcaacggccgucgcugcggaggggaaacgcuccucucuuggcagccaccaccuccucccccggcccucccggggaaucagcggcuucagcaagauuggaccugggcaccggguggcacaaccuucuaacccucuccccggggcgccuggcguagagaggacucagaucguagggggaccccuccgcgcuuccacgcuucaaucacuccggggagggggccaagaggccacuggcagccggccccggacaccguagcccccuccccccagacccggagcucgcagcccugauccgccgcaccaggaagaaggcucccggugcucuucucuggaccagacagccgcaguaggaggugggggcgaggagcgugcggaacccgucggccgccugggugguggagcccccgccgagagagaggcacugcugcgccggcuguggagacucgcgcucucuccugccccaggggcagaacuuucucgcuccccuccgccccccucccccgcagcuggacuucuuccccagccagcuaguccucccguaggagaaggcgccucggaaacagcccgggcgggggccuaccuuccccgaggcuggcaucaugucggcggcgcagguguccucgucccgaagacagucuugcuaccugugcgaccugccucgcaugcccugggccaugaucugggacuucuccgaacccguaugccgugguugcgucaauuacgaaggcgccgaccgcauagaauucgugaucgagacagcacgccagcugaagcgggcucacgguugcuuccaagacggucgcuccccggggccgccgccgccagucggggucaagacgguggccuuguccgccaaggaagcggcagcagcagcugccgccgcacagcaacagcagcagcaacaacagcagcaacagcagcagcucaaccacgucgaugguuccaccaaaccugcaguguuggccgccccguccggucuggagcguuauggccugagcgcagcggccgccgcggcugccgccgccgcugcgguggaacaacgcagccgguucgaguauccgccuccuccggugagucuggggagcagcagccacgccgcccggcugcccaacggccugggagguccuaacggcuuccccaagccggcaccagaggaaggccccccggagcugaaccgccagagccccaacucauccucagcagcaacaucgguggcuucucggcgugggacgcauaguggguuggugaccgggcugcccaacccgggugguggcgggggaccucagcuaaccgugccccccaaccuauugccgcagacgcugcuuaacggcccggccagcgccgcggugcugccuccgccccacggguuggggggaagccgagggcccccgacuccagcaccuccgggugcucccgggggccccgcaugucucgggggucccccgggugugucagccacuguauccuccgcuccaucaucgacuucgucgacgguggcagaggugggcgugggugcugcuggcaagaggccuggaucggugucgagcacggaccaggagcgugagcuaaaggagaagcagcgcaacgcugaggccuuggcagagcugagcgagagccugcgcaaccgcgcggaggagugggccaacaagcccaagaugguccgcgacacgcugcucacgcuggcuggcugcacgcccuacgaggugcgcuucaagaaggaccacucgcuuuugggucgcgucuuugccuucgacgcggucucuaagccgggcauggacuaugagcugaagcuguucauugaguaucccacgggcuccggcaauguguacuccagcgcgucugggguggccaaacagauguaccaggauugcaugaaggacuuuggccggggucuguccucuggcuucaaguaccuggaguacgagaagaagcacggcucuggcgacuggcgccuacuuggggaccuacugccugaggcugugcgcuucuucaaggagggcgugcccggcgcggacaugcugccccagcccuaccuagaugcuagcugucccaugcuacccacggcgcuggugagucucagccgcgcccccagcgcaccuccaggaacuggagccuugccacccgcggcgcccacgggccggggugcagcguccagccugcgcaaaaggaaggcauccccggagccuccagacucagcugaaagcgcacugaagcucggugaggaacagcagaggcagcaguggauggcaaaccagagcgaggcgcugaagcucacgauguccgcggggggcuuugcggcgccgggacacucagcagggggaccaccuccgcccccuccaccucugggaccucauuccaaucggaccaccccgccggagucagccccccagaacgguccgucccccauggcugcccucaugucgguagcagacacuuugggcacagcucauucgcccaaggacggcaguucagugcacucgaccacugcaucugcuaggcgaaacagcagcagcccggugucacccgccuccgugccgggccagcgucgccuggcaucacgcaauggggaccugaauuuacagguggcgcccccgccgccuagcgcccacccgggcauggaccaaguacacccccaaaacauuccggauuccccuauggccaacagcggaccccucugcuguaccauuugccacgaacguuuggaggacacgcauuucguucaguguccgucugucccuagccacaaauuuuguuucccuuguucuagagagaguaucaaggcccagggggccacaggugagguguauugccccagcggagagaaaugcccccuagucgggucuaauguaccuugggccuucaugcagggcgaaauugcaacuaucuuagcuggggauguuaaagugaaaaaagagagagacccuugaaccgcagggcagcgaccuccuuugcccuagaccaccuccucuucaaucuagagggcccuucccccaccugccuccaccuccccuauccaccaagauguagaauugugaauauaacugcaaaaaguuagucuuauguauagacauuauuuucgucguauguuucuauauuuugaaacagguauguaacuucuucauuugaaggauaagcugguuuguguuaagcaguauaauauugauugggucuuucgcaucauauucguuagcauuuauuugguggcagaauguuugccuagguacagaauuaauagcccuuagcaacgacugcugcugguguguauuuuuguaaauguuaugcacucugaaaggaaaacacacaaaagaagagauuuugucguuuuuuguuuugccaaggccaguguugcugccuaaaaaaaaaaauaaaauaaaauacaaaaauacaaaaaaacauugauacuauaaaaugguaaaaagcgucuucuuucuaaacagccccaguguugaagucuauacuuaauuuuguucuguucuguuuuguuuuccuguuuuguuugcaaaaugguaagggggguguugggaggggaugggugguuuguuugguuuuuuuuuuuuuguugcaaguuugugaagggggaaaauguuuugauuuguuucuacugaccugaauguguuggaucuucacgugucguuuuguuuuggcuuuauugaugcacggaugcuuuugaacaguagagcgaaaugcuagacauggagaacuugcucuguuuguccuuucuacauuucuguaguuaacagaacacuguaaugugccuugcagcuuaguaacuuguaauaaauucaauugauauuaauucugcccugagucagcaaauuugucuuucuaggguugaagcuaugcuacuccaauuaaggggggacaacuguuuaccuccuacuuggauggaaccuggcauccugguuccuuggaaggcucuugagcaggcugccccacccccuggguaccagacuguuuacauuuaccuccccuguaaucuacaguugcugacuaagcgauuucuguuuacucuuaagcaucuuuacccaaccccccauacaggacccagcugcaaaaaaaaaaaaaaaa

SEQ ID NO: 6764 - RNA, 1166 nt, Mus musculus
uaaucuuuggcagaggccagaaacaggaguaggcuucuuggcugccuguccugauaaacaaucuguucuugggaagaguaggugaaggggcugcgggagguaaucugcgggcaugggagagaggguaggaaugggggggggggggcaccgcaaagccugcccucagggagaaaugcaagugccccuccucccgcaccggugguuuagggguaggucagguuuccugcccuuaauagaguggguagacaguggaucuuuucuuccugccaguuccuaauguccagggcgcgccacugggccacggaaggcuuaaaggagaagaagagagcaaaaccggugcgcgccacacgguuucggaccaucuacaaagcugugcucuaggcgcgacagcccaucccccagcgcgugggcgcagaaccugcucucgaucaagggaaaccaaggcaguagcagagaaugccgaguuggggcggccgcuguagagcuuauuauaaagcauaacgggggaagccagacugugggcaaaacaaaaggagagacuauuuggcggagucggaggucgcugggaucgaaacucccgaggcaagaaagcuggcuguggauuuugcagcggggauauugugugagcaaccaggcagaaauuggcaauauguaaaagugggaggggggagagagugggcggaaaggcaaaucagugccuagaaggcugcgcacggcugggaaaugucaccaaggagagcgcaguggcaccgaauaaaagaugaaugauagacuaccuuuuggaaaacgaauauaaaaauaguauugaaggugagaaguccgccucuucgcugaaaagcggauccauuccgcacugcuugccuucaagccccgacauccaggcagcucuaaucucccuuguauccaagaagucagggccaggcucgcuuuccuucggguuuaauuacacgaaaaugcugaacaaaaacccuguaauuacacccuuaguccccgccacucaggcccugcgcacuuccugccuaguuuuguuuuuuugauuuuuguuuuguuuugguuuuuuguucucucuuuuuuuaauuuuuuuaaaaagaggggucauugccucuuucuuugcaaauuggccaaaacaaaaaaaccuaaaggcacuaaauaaaucuuuaacacuu

SEQ ID NO: 6765 - RNA, 31086 nt, Mus musculus
uccgccacuuaccagaugugagcaggcugguccagccggugaaagcggguggcaaaggacagcagcgucaccacagccaacguggcccaccacccugccgccuggaagcgccgcgagcuccaagcaggccguuuaaguuuccgugcugcagccugggggaccacgucucggcucacggcucuggcagccugcggcacacagcggccccuacggggacgcagcucggagcccgcuaggccaccgccuauggccggcggcauccuccccuuccgaaggaucacccuccgggccggaggcacgccgggucuuguccgcugccccgucaaggggucauaagaaggcgucucgaggugccaugggauuuguaguucccuccguuugccgcggagcgccgggccccgggcucugggcggggcggaaagugugguggccgcccgggcagcuaagaggcggccugaggcguagagcauugcgggaggcggagggaaaccaaggacugacaaacucgagucggcucaugaacuacaacucccagcagcucagggggcgggggcggggccagcccgaaggagggaggccaucuaguccaaccuucgcucucuggaccccgcuaggccucagucaucuucuagucccgagagcugacuuucuuggccggccgaccgggcgagaugcaagccgggaaggucugugccccacguccggggaugagggucucuccugagaaacgcggagaagagcugugggggggggcggggcugagagcucgcuucuucgcguggcgccacaacgacucccggcgugcaccucggcgcccgcucacucuacaccugcgcgcuggccgcugaaccuuaugguggugguagauugggccgggaaggcuaaacuuggaagcuuuugaggggcguccaaucgcgcuuuucccugcuucggguagacagaccucuucuagggcuuucaaacaugguucccuacuuugcaguuucgcggcgcccuucguaugucucucaggggaccuggugguccaggcaugcaccaaaggcaagggggaaagaugugacucuuuaacgacguuaauaaucacuuguaguaucugcucagguuucuaguuuugucgguuuggcucuaagaaacgaucuugcugugcagcccaaccugacuuugaacuuugacucucccgcccccgccuuccaagugcugggauuccaggcuguggcauauggagcguccaggguuuaagucgaacuucuuuaguccacccuagagccauuuguauuuaagccauugcuggaauggagcugcgaguguguuuuauaagagacuuaaaauugagucucuuaggagggccgauauguaggaaggcggcacauuagaugcaaaggacauugcauccgguuaauauagauuuuccacauacagaugugauuuuucaggauuuuaaucauguaagaaaugguauaaaaacagcuagggauguacgcaacucugacguagcuccuagcaugggccgagucucccacaacagaaaaacugcaaauuuaaagucgccagaaugcauguuugaguuggaaacaugauccuucccggugcuaauuaaacggacauucuacuugauauuaaaaaguagcuguucaagugcaaaaaucgccaggugguuugcuguuagugcuuagcugugauuucucucccuguuuaucuaaaagcacauaggagacaagccuccagaugcucugcagagaggguuaggauugucuuuaucagguuaacugaugugggagagugacaccauucccuggguugggucuggcugggcccauaauaagggggaagucagccaagcaccaacacacagcauuguucuguuucaugcuguggaugcauagguuacuuaccagcuguuucaggcugcucuucccccaaaccccaccccacccccaccccaggugacuuacuacaucuugaauuauaagccaaaauaaaccacucuucuuuagacugccuuuguuggggcauuuuaucauagcagcaggaaaagaaacuaaaaugauauauaagaaaaaaaaauaauaauagauguaggguaagauuccagcugggugauggugaugcaugccuuuaaucccagcacucgggagguagaggcaagcggauuucugaguucgaggccagccugaucuacaaagugaguuccaggacagccggggcuauacagagaaacccugucucgaaaaagccaaaaaaaaaaaaauucuguuuccugcugaagggccauggggugucgcgcccaccucagccagcaaggaagacacgacauggucagauucuucucaacagccuuuauugcaggaacaccucgaugcugcuaccgggacagggcacccagggagggcugcuuauauacacccuagcacaggagaaggcuccauggccccccaggauuggucagucugccugcaucuaauuugcauguaccugcucaggaggggucaggcuagcaccugcgcaaugguguuguuuaccacaaaggcacacagaaagccugcgccaucuuagaguuggcuuccuacaucucccucuuuuuucuuuaaugaaaugaggcuggucuaggccugggcaaaucuguccauggccagggcuccugucuuaggucgauccucuaguaucacagccuuacccaucauaggguuauccuaugauggccuccaggccccuucucuuagguuggucugugcaugaggaaaguugcccgucucuggauaccauggaucugugugacuacaacugccaaaugaccuagggcggacucuuaauuuuuuaaagaggccagccaaauauugggagaugcaccaucuucaauugccaacaaagcuugguagaccacugcuuuauguugagcauacucucuuuuuaguugacacaauagccagaugcagaagacacaccccaggaggaccacugucccccaggccaacauuccugcccacuccuuuaaaaaggagaaggcauuggugauccaggaggugaagucucccagggugacagggucgggucgagugcuguugaguuuggcaaucuggaggagcaacuuucugcucugcuuuggcugaccaauuuccuuuaagauaagcaauuuucaugucagccuuucugguacccaaauuggauguucuuuauccuguggaaaaacacaaacagcuccccuagaucucgaaauaacgggaucugggccauaccauuuaccaguuaagacaucuucccauuuuacaucauguugaauuacaggcgaggucauggcaugccugucugcagccgagcgaccaugaucauccaaaauuuaaaaauuuaagguaaauaaagcuaaagauaauuguucuuugggugcucguccguaggcaauucccucuuuuuguuuuuguaacaguucuuucaaggugcgaugugcccuuuccacaauaccuuggccuugugggcuauagggaaggcuggugguaugacuaacuugcauaguuucgcagaagacuuggaaggauguugauguauaugcagguccauuaucaguuuuuaaauuagcuggguuuucccaagcugcccaugagucuaagcaauggcuaauaacauuguggguuuuuucaccagacauaggggaggcauacaugauaccugaacaggugucaauagaaacauggacauauuuuaguuuuccaaaagcuggaacauguguaacaucuauuugccauacuuuuagagggaucaauccacgaggguuaaucccaacauggggagggugaugaaacugcacgcauugagggcauugcaauacaacaguucuuacugaggcccgggaaauauuaaauuuuuacugcaauguggcagcggggacaugauacaauugaugaaaaccuuuugcaagcucuaauggaguaacaugaaaaaugaauuccauacgaguacuugcaucuaccagggcauuccuuucagucauagggccuggcagaguagaaugagcccgaauaugcugaauaaaaaauuuacuuuuccuauuccaaaucaaguuuuguaauucugacaaaauagcacauacagggcugguagauuugauggguccugcaacuuccaaugcuuuuacugcauucacuacauaugcugaaucagacacuaaauuaaaggaaauuucaaaccucuuaaauacuucuaauacgauuuuacauucaacuaguugcggguuaccaggaucauauugaaauaaaacaggguuuugagaauuaaccacauaagugccaacaccugcuuuagaaccaucuguauaaauauccagugcaccugguauggguuuagaugucauaaccuuuggaaaaaaucacuggauguucaguaaaaaauuguaauaaagaaucuuuaggauaaugauuaucuaauuccccaucauaacuacaacgcaacagagcccauucaucaacuaaagagcucagggucuguauuugguuagcauuauaugguguaauaauuuuuugaggggggucuccaaaauguugaaugcaugacuuaaugcccaagauugcuaaaugggcuacaguggugagauaauauuuaagaguuuuauuaggagacaccugaggauaaauccacaauaguggaccugauugccacaauacuccggucgguuggcgaaacgucuucaggacacacaaauguauguucucuccuucuuuccaucuacauaauuuagcuuuuucuaugcaccucucuaccuuuccuaaggcaacucgggccucaggagugagggcacaggggggcgggaggacaauugagggucaccuuucagcauaucaaagaguggaguuaauucagaauuggguagccucauauaugggcgaauccaauuuauaucaccuagcaauuucuggaaaucauuuaauguuuuuaaaugaucuuuguacaauucuaucuuuugagguacuacauaaugugaaguaacucggguacccaaaaacucuccuaaauuucccaucugaacuuugucaggugcuacaaacaauuguuucuuuucuaauucuuuuacuaauucuauauaagcuuuaucuaaacuuuauuauuagaagcaaggaggauaucauccauauaaugcacuauccucaauuuuggaaaugcgucacggacagguuguaaugcuucuccuacaaaaaguugacacaaguaggacuauuggccaugucuugagguaaaacgacccauugauaccguuuaucaggcccuucauuauuuacagaagggagaguaaaagcaaagcgcuugcuaucacacaaugcaaguggaauagaaaaaacaauccuuaauaucaauuauuauuauaggccaaucagcaggcaggcuagagagcaggggcaggccucuuuguguugggcccauaauuugcauuugauuauuaauagcucuaagaucauguaaaagccuccauuuaccugauuuuuucuugauuacaaauauagguguauuccauggugacugggaggauuuaauauguccuaauuccaauuguucccuuacuaauucccuggcugcugccaauuuuucagaggaaagaggccauugaggaacccauacagguucuucuguuuuccaaguaauggguauacagcccucaacggccccuaggaaaaacccaguccuuuuuuaucuaguuuaaacuugguugguacuggcauaguacugccuuguaaugacuuuccuaauccuuuaccuggaguauagcccauguuagacauuaucuccuuagcuuguggggaauauucauuaaucuaagauccaucuuggucaggacaucccugccccacagagucacaggaauauccacaauauaagggauaaauuuuccugacuuaccuucgucauuucuccagguuaauuccuuaguacugacaagaggagcagucucguaacccagaucacgcaggcuuugagaugaugucugcaagggccacuuugacagccaaucaugaguggagauaauacugcaaucugcaccagugucuaauaauccuaaaaaggauuaaaaaguuagcaugggguggucuccuaauuccauagauaagaaagcaaaucaagaaccuguagaaccuagucuguucucucuuauuuuauuauuugcugggaaauauuuauguaaacuggguaauagcaacaauugagcaauucuaucucccguggagauagcugagaugccagcaggggaggcuaccaaaaccuuuacaacuccaguauagucaggaucaaucacuccagggguuaucuguaauccuuuuaaagcagaagaugagcggccaagcaauaguccuacaguaucuuugggaagggggccuuuaaaaucuguaucuaccuaauaaaaaauggaaaaggaaaaaaaauaaaaucuguaucuaugggcuguaccgccaucugugggguuaauacgagucuggugguggaguggagguccaauccugcagagccaguaguggcucuccguggucucucggaugacagagagacggccaaaguuucuucuggucuuucugaagagccccauauauuugagggcccuggggacgugggccccacuguccguuuuuuggccuggugccaccauaucucagugggcguggcagaacgaaugagcaggaagcuccaccccgagcaagcagguuucaggcugggagaggagagacuacaauauccugcuuguaauggucggccuucuauauccuuuguagaucugcauucauuagcccaauguuuccccuuccuacauuuauggcauaagccuggcugucuagguuuaucuaauacggccuguuuuucauuuucagggcaguuucuucuaaaauguccucuuuggccacacuuauaacaaguaucauuauuagaucuauccaauuguauuacagcugccgccaggccugcauugguuaaugggcccccuaguucucugcaaaccuucauccauacuucuaaaccuuuaugguuauaggguguaauggcugcuuugcauuccuuagugcauugcucauauacuagcuguuugacuaaaggcauagcuguaucagggucuccaaagauucuaguagcugccucaacaaggcgugcuacaaagucugagaaugguucuguggggcccugcaaaauuuucauaagauugccugagacugcgccuuuguucggcaacgcuuuccaggcuuugguggcuacuucaauuauuugggcauagacuguuucaggauaauuuguuugaucuaaagcaaaacguccuaaacccagaagcaugucugcaucccaaugucucugaggaucuuguccuauggcuaaauuggcugcugccugacuauuugcauauucauaagucaaggacuuccgaucuaaauauugccuggacgacaagcaagcccgagccacauuauuccaguacccaggggugaggcaauaucuggcaagcaccucaauuugugcaaccacaaaagcugcacccaccccauaaguacagacugauucugccaguugcuuaauaguuuugaaauccacuggcucaugauaccauugcccuuggccaucagcaaaaccagggaaacuuagaccaacuucuuuccaaaccuccagacagagagagguaccugguuuagcagcccuggcgggcucccagcacuuucaguuuuauucuuuauuucgccgauacucccuuuuucaauggguuggcucuauauggccaauccggaucauaccuaucccucucauacagagcugccucuucuucuaggucagcuucaucauccucacuaagcuccgagccacuggaaucagaacuugauagacuuagcgauaagucuuuuaaagagggauauauuuuugcuauuuccuuuucuuuaucacuguuuccuuuuccuuuuguauuuaucuuuucucccuucucuuuuccuuuucgccccuuuuccuuccuuugcucauacauuccuuaucuuccucugacaugcuuucuuguuguuccguaagaauuuucugaccugccuuaacugcuucuauuaaacaaaagcagaggacagaaauuacaaaaaacaaaacaacaacgauaagagcuacccacacugggucuacgagcgagaaaaacauauccccccuuuuaaccgggaaucaauuugggagacuuaccuguaccgccauuccccagcugaagaguucugaauccacgagauccucggguccccauaggggccaccaauuuguugugcccaccucggcugacaaggaagacacaacacggucggauuuuucucaacagccuuuauugcaggaacgccucgaugcugcuacagggaucccggguacccagggaggacugcuuauauacacccuagcacaggagaaggcuccguggccccccgggauuggucagucugccggcaucuaauuugcaugcaccugcuccggaggggucggcgccagauucgggcuagcuagcgccuaugcagugguguuguuuaccacaaaggcacaccggaaaccagugccaucuuagaguuggcuuccuacgaugggguggguaggaguaguuagcaugacucuaggcacccuuaguacagccagguuugugacacauacuacauaaggcauccucuccagcaguucucauuuuugccacucccucguggucagugucucuaagcucuguugggcccagugcuccccuggccuucccagauaaagaaggagauaccucuccagauagaaugcacuguggucucccacguccuccgaggacacuggcugcaucgccugugcucuagccaugcccaucuucccuuuccccacagaaggugcugaggaggcacaggcccugggcuugggggccgcccugagagaaccugggccuacuuguugccuugcucuugugggcuucuguguugguggcccuugggacagggaaacugcuucacauaguaucuuggucugaggagacagcagaaggaggggaacuuaggugaaaugacugugguccgaggaguuguaggugaucugaguguugauuucugucgcaucuuuguggauauugucugcaggaaggugcaugggugcuuauugucuguuccugaguccugcuaugaaauggcuacccagaaaacaccagagaaauuaacuuccauucccuuuaaucuuagaucacacauucuaggggcccaaauguaacaaaauucauggcaaaucagggggcaugcucauccuaaaaggggccauugaucuguuccaauaaguuguuacgauuuaagaggcuaaugccacagacuccugaaguuuuaaaggggaaaaagacaagguuugugugugaaauauccugguuuaaaacauccagauaaauaaaucauacauuuauuggggggcuaaagagauggcucagccguuaaaagcacugucugcccuuccagaggaccuggauucaauucccagcacccacaaggcaacucacaaccaucuacaauuaauuuuuuucuagugaugaaacuauuuucaaagcucuggcuuuguuauuuuaauuauguguauuauugugucugcauguaacuaugugaaggugagugccagcgcccauggagaccaggcauugaaucucuuggagcugggauuacaggcaguugugagcugccugcccgaugugggugcugggaaccaagcuccacuccuggaagggcagccagcacucuuaaccaucgagccaucucucuagcuccccauaaaaauaaaccuaaaaaaaaaaaaaaaaaacacucacagcagggucggguuuucccccaguuucuucaguccaguaucaccaagcuguaacuaacugccauggcccagccugggaaaggaccaaaauucaaaauuugaaguacaguuuuuaaaccaaaugcauaucacuuucucuucauuauaaaguugaaaaguuguuaauuagaacacugguaaaucagggaccauuggcauuacaaaauucagacaggacccuuggggaccuccagcuggcaaccucuccuuuguggcaaaugggcauaccugccauuuauuucuaugaggccucugagaauggggagcuuccaggugagaaacacgaaagcaugaaaauaaauaagaagccccaucucucugccagcauuuuagagcagcguuuguuuuaugaacaaaggagcugaagaccaggagaaggcaggaguuugucucuggucacaaaaggcagcugcuuccugucucaggucuggacccugagccugccugcgcugagccauuucaccacauacuuuaccuccaagccaggcuacacucuuugccccagugccacaaguugaaaaagauucccuuucugaccagaguccaggauccucuggugccugucuagccgcuuucccauuggcuccugagacccaccccugguuuccgcccccugccucccagcucugugagagaaaaaaaguuccuuaggaagcuacugcacuauggcugacaagguaaggcuaacacuugaaagcugcuuccucuugagaggcccgugauccucaggaacucagcaguccaacuaggacccaagacccuggaggaaggagggccggugccaugggaagaaacuggugcuuagagucuuuugccugugagcuggucggugccugcuuccaacaagacgggcccuacagcuggaaaccugcuaaauuaauauccacccucauccuccucucuccacagccuauccucuacuccuauuuccgaagcuccuguucauggagaguucgaauugguaagagcucagcuuccggaugaggggaugggggggugggguggggcaaaggaccucauaucccucuccugucccguugcgcccuccagcaaccaccgccccuguuuugaagccuccaucucugaaugucacuuccagcuagaaaguccaacaagaggacagugggagugggaggaagagggguuguuuuucaccucggggcugcuacuucugucacacugcacuugagaagccuuuagcaaccaugccuagaacagguucacaaaauccagaggucccugguaaccggcaggggagcagcuggccucgaucuguucuuaucuuauuugaucuggcuaaucaaacacaacuguuuggaguugaccacagagauuucaggagcguagacacuagagcucucugcuugaguccaggucugacucucgcuucuccagugagcacagcuguuggcaaaggcuacccucauagcagugcguaccaaagaagucuaugccuagugcuuuugugugugugacccucuuuccaccccagcgaucauaggaggggggacuguuaguguucccauuguacaaacuaaggcacaggaagguuaaguaaauugcccuugaucaugcaacuacuaagaagaaaaccugcaguuugaaccauguagucuggcucaagucuauaaucauuugauuuaauacugacaacacagccuugaaagugcuaagcucauguccucccacuaagcuacaccccuagccaauucccacacuuucaacuacugcacggugcugcuugucagauuugggaaacugaggcacagaaacucauuaaguuacaugaaccaaggccguacaccuaccaauugaauacgguaggcuuuuaauccaaguagcuugucuccagucaccuaccucacaguccuuuccugggucccaaaggcucucccuuaacugagcucaaagucaaaacacuauggauacugucucuguagugcauacaugcuuuggccucucucagccuaaauuuuacuccacaguagagcugaccagcagaggggaggcuccuggcaucacccugggagggcugccuuugagagcagagucuagccagaaggcauucccuaacuccucucuggucucuccuagcucuggcguuaaaaggcauugacuaugagauagugcccaucaaccucauaaaggauggcgggcaacagguaaggaggcugucccaggcucacaacaugaggauuggaccuugaagggguaccagauggaggacuagcugucgccuagaaggaaaacuguauuucaugguuccugugacugggaggcugcagauggcucuccugagcagcaauaguaggaugggaagggcucagugccugauuuuuuuuuuaggguaggugguaauggggccuuuucuguauugggcccucaauggaugagugagugagguaggagcugaccuggugaccacaguaaagaguacagggaaaaccauaaagccggaccauugagguaaagcuugcaucuuaugagccuaggauacugccuggauucccuagaaguuaucuugguuuuaggaaccaaguccuccaaggacaagaacuauggaucaguacuaggucuacaguuuuccuacuugcuugguucuguguuaagcuacucaagcaaggccacccuguucaccacagccuuguccccacaguucacugaggaauuucagacccugaaccccaugaagcaagugccagcgcugaaaauugauggaaucaccauuguccagucagugaguagaggacuuggggguggcagaguucugaaugaggggcccugacaucucuuccuaacuaaccuacaagugaccaagcauaauagggaucauuaaguguaugguagagggaaggagagaggaagguuaagcauguggggacccaaguccagcaagguccccaaaggaccuuuauagugcuccaguugaggaagguguaggggagaguugugguaccauucauugcaaaaaaaaaaaaaaaaaaaaaaaaaaaggaguuugcugccucuccccucugguccagggauuccaagcccucucccugccucaauguucccucugaacagcuggccaucauggaguaccuggaagagacucggccuaucccacggcuccugccucaggacccacagaaaagagccaucgugcgcaugauuucugaccucaucgcuaguggcauccagccccuucagguuaggcacuguuacaccugcacccugugcaccucucaggcagcccuucauacccaaagugacgagccacagggagguguucugcuguggauggggaaggagggcaagaaagaaaaacucccaggggccuugacauagaccacauggcagaagggggcagggaucccagaagucuuccaucagcauugucccuaacucugcuucuaagccugggagcauaaagauguugagacaggaaaagggguaggguagcagguguagguccaccuccagccugggcagcuccuggucaucugcucuguagcacacaugcagguaggccuugcauuaccauacuucccuucucugugcuucacagauaacuguguuagguuucuguuuagucuguuacagacugaacgaguauggcagcccucauuaggcaggucuauugguggcuucuuucuagugauuuuucaucauaguauauuuuaguaauaaauuauuuuaaaguuaaguuacauacauuuucagacauagugacucaguacaccaucauaguguaaacagaacguuuguuucauaacacugagaagaaaagaaaguaaauugcuuuauuaccaaaucugcuaauuucccuagucuagacuuaacccccaucuccacaauaugccaaugcuaggauucuuguaaaguuuuuuugguuuuauaaaguaaguuuucaucugugaaauagaaaggcaaguauuaaaaucacucaccugugcuaacuucuaauuugcaagguaauggcucuaaaagggagcagugacuuugcagggugacacagcgaaauaguaucggagcaaggaccaagcucacccugcgucaccguucuguuuuuaacaaugggggcugcaccuuagucauuaucucuagaagccaguccaacacgccuggcuugcccccccccccccauaucauacagcuucucuuuucaagacaccaaguaggaagaaguauugagagaaagaagccuuggucugugccuaucucugucagucauaccagcauccuauagaccuauucuugcauauugcuacuaagcucacauggcuuucagaauacuugggaucacuggggaagccccaaaagguggcuaccgccaccuucagagcccucauggaaggaagggaccauauaguccaaaagggagcagaacagguaaacaucuagggcagagggaacacugagcagggaaccucccugcagaggcuuggcagaggagcaaacucaggcuggcuuccagugcaaugacuuuuucucucuugagcugugcagaaccugucuguccugaagcaagugggacaggagaaccagaugcaaugggcccaaaagguuauuacuuccggcuuuaacggugagucauuacucuuacgagcugccccagugugaccucuuaggggacugacccucacacagagcucugagcaucuugccaggcugcuuugaccuugacaguagaauggagcagaggccuguggacgggcagguggugggcuaggcaggcgcuuaagcauguucgagcuccagaacgccuaggaaccccacaccuggaggcucguggucccacagaguugguugacagccauugaguacuccaaucacggugccagucuucagaacauuaggcugucugugagagcuguugccuuggccaacugcauggcuugucuauucugagacuagacagggaagccauggggagcauucuucucaguccuggcugccauagucccuacacuagacucugcccaaugccccagccuagcucuucauugucugccuauggaggccagacccuggagaagcugauguaacuguuauccacauggccuucccacagcucuggagaagauucugcagagcacagcagggaaguacugcguaggagaugagguaaguggccccagcccugcccacuguggccuucaugcugaccccaggccaucauuucucccagguagacccagucaacuccuuacccuaaggagauccugggccagccuccuguguaaaccucugcucugagcagucaguuuguggaaaugccucagcucauuccuacaccgccucuagagcagcaguucucaaccuguggguugugaccccuuuggggcucacacaacccuuuaacagccaucacauauccaauaucuugcacaucagauuuacauuacaauucaaaacaguagcaaaauuacaguaauggauuagugaugaaauacuauuauuauaguuggggucaccacaacaugagacgcuguauuaaaggagcgcagcacuaggaagguugaacuagugcaguagagguagugugagguguccaggccagaacacacuucugacucagugaagugguccaggcaucagcugaaggguuagacuaucccuuccuucacagcccagagauucuaggauuacggagcccuugaugccuauagaauaaggccuugggccugugguagucugguuccaugguuccuuaucugcuaggaguccucauuaagugccuagucgugguggcuucaacaagcacagugauagccacuaaggcaguuaggccuucucugguugguugucagggaaacuugacaugggagaaaugcuacagcacugagugacaggaacaggcaguuccagaggagacagugagagagugcuagggauuguguaaagugaagcaaaaggaaguuggauuggcagcccugguacagucaacagcggguacagccagccuugccagugagucuaggugauaauccuugugcaaacucccuugaccuuccuuuagguauccauggcugaugugugcuuaguaccccaaguggcaaaugcugaaagguaagaaaaaguucugccauucuccuucaccuuaccccuccaccagggccuccacauguacuacugagauaaugucucaugugaacccuucuuuagcugccaaggagccacuacaccaggccauuaucaacugcccuggcuuagcagagauguggcagaagaaaucauugaaauaccccuaccauucccacuauagccugggugacccuguauagacagccauugugccuuagaggaggcuuaucuaaaggaaccacuuccaagaacacugcuguacccaaauguggagugucugcuuagaagugagcucugugaccucccuccaucagcccaccagaaggcaucaugcuugcucuuuagaauaugggcauguauggugcauucucuccccuaagaagcuaguaaugugggugaugggucagucuauacaaaugccugacaccagaauucagagccgucauuucuuaaagagagguauaugauguuagaugauagcacuccagaccuacccagagcaucccagccaaugcgguuccccauguggcaggacugauuucaguccuuguacuacagccccugaaccucauccagcccugccucuacuuuccacacugcccacagcagugucccugacagccuuggcuuacaaauguuucucugccacagguucaagguggaucuaagccccuacccuaccaucagucacaucaacaaggagcugcuagccuuagagguuuuccaagugucucacccccgucgacagccagauaccccugccgagcugaggacuuagcucccaaaccaugcccauugguacagggaagggaguaggcccagaugcuggguguucuacugcugugaagagacaccaugaccauggcaacucugacaaagaaagacguucaauuagcuuacaguuucagagauucaguccauuaucaugaugguagaaagcaaggcacauguaaggcagucauggugcuggagagguagcagagaauucacaucuggauccaaaggcagcaagaagagugacacugggccugcugugagcaaucugaaaccucaaagcccacccccagagacacaacguccuccaagaaggccacaccuccuauuagugcaacucccuauaugccuuuuuauucaaaccagaacaggcccagaaaugaaugcauuauagcagaggauuugaacuugagcucuuuccucaggaagcagcagauucauggaguccaggcuauuucuuccagguccccguauuaaaguuuucucuagcaacaugaagccaguucgauauaucuuccuucugcuugcacuauagucacuacagucugcauuaauucucuuaucugucacguguuaggaggggguaggcagagacaugaccagcucucaccggcuaauguuaauugucaacuugaaauaaagcuagaaucaccagggagaagggccuuuauaaaugucuguuggggguuauauugguaccauugaggugggauggcacccagcauggauggcaccauucccuaggcagaggauccuggggcccagaagaguagagaaggaguggagcaaccaccacacgugcauuaugaucagcugcucacgcugaugucuugacuucccugccauuauggacuauacccugaaaccaugggcuaaaauaaaccuucucuccuuuaaguugcuuuugucauggacaauuugucacagcagcagagaagagaccaugagggcagccaagaagauugcaugaggaugcaaguuuaaaaugccuggcaaagccagguggucauggcucguaucuuuaauaccagcacuugggaugcugagacaggcagaucucucugaguuugaggccagccuggucuacagagugaguuccagaacaggcaaaguuacauauaaagaaacccuaccucaaaaaaacaaaaaacaaaacaaauugggcaaauuuaccaaaguucaauagggaagucugaauucuuucauuucuuauugaaccugacuccagaaaacauuuacauugagucauuaguugaaggcaggccucagaagaugaacauuuacacuggcuggaaaucaugucuagacauagcagaauaacucguuagccuuuuucucccacaaggguuaggaagagaaauaagcacagagccuaucugagagaacaagauccaggaugaaaagauuuaagaagcaggaaagcaucuaguggccagcugggcucccagagcuaggaguugcacugcuguucuauguccacaccaguacagagacaucugcugguguucucgacccaguuacucauccuaaggagaagccauacuccugaacuaguuccaggacuaagcacauugaggaaguccacucaugaaugaugcugggaauggaacuagcccccuuccugugcaguguagacagcuugaccaucuccagcuuggacuaacuaggugacagcacuccccauacagaguacucuguacagaguauguauagcacucugaucaacagcaguacaguucuguuugcaauaaacccaucauugcuauaaaucuaauuuucccuuagcucccaucuuguaauguucugccacagauuuauuuuuauguuuuaaaauguuuaugaguguuuugccugcauauguguaugcccacuaugugccugccuggugccugaagaggucagaggaagacaggugauccuaacuuagaacaggaauaacauagcuugggagccacugugugguacuggaugccagacccaggugcucugcaagaacaccagugcuugcaaccacugggacaucucuccaaccccaaagauuuuacaauuuaauucuguguggguguuuugauuguauauaugucuguguaccgcgagugugcaaugccaccggaggccagaagagaguauaucauguucucuggaacuggaguuagagaugguugugagccacugugugggugcugggagcugaaccuggaucguuuacgagagcagcaagugcucuugauggcugagcuaucguucuauacccuuugauaggauuuuacauacaagcagacauucaucuuaggcucaguuuuucuuaauuuuuauaaucuuagauuaugaaagauucacaaguguucacugaauacucuuccucuuaagcugaagagaaaaaaaggcuuauuaagaaagaacucaaauauuuuaggugcacagugaaaaaguuuauucaugacagauuucaaaacuuggaaaagaagacaaaaaaaugcacaaaagcaucucacaaaacugucacauaauauaaaaacaccagaacugagcuguuaaaaccauggcucaggauucauccguguaucacagcaacacauucagugcuuugaggugagaaaauauagucugacagaagaaaaaccacucaguagaacagaaaaacuaaguaacaauugguaccgaguucuuaguguggaaaccauacauguggacagcauuucucaugacagggagacauggaaaacaaguugacucaaauggauuaguuuggauuuguuuauauuuugaagaaaaaagacaagacuaugugauaguucuccuucaaggccuuuggugaccuugguuggcaucagcauacgauacgaaacaguaaggaaagcaugucucaugguugucagcugcuuaaacauuuagcaaggaaacacaaucacuuuuaaccacugauggaucaggcaauggcuccagaguagcccuuuggauauauaagcaaauggcauagcgugguuuaggaaaucuccaagcaccuccccgccuucccauuauccuuaucuacucugcucucuagaaucuaucacucugauuacaaagcauuugcaaaugcuuuugguuuuuauuacaaagcaucaaacauuucuucuguggguuucaaaauacuucccauuauuaaaauagagaacauggauauaccaacgucaugcaucacgggauugcuuuuuccagacuggcuuguucuuuaacaaggcuaaauggaaauaacucagacugauuagaugaaagcuaauucacuuauggaacaauaaucucaaaacaggacacagauguauuuucaacaugucuuaauaaaauguacuauuaaggcuaugagggaaggaauuaagauaauguuuucuggaugagcccuggccugaaccuaagaaugaacaauaaccauaacaaagagccacuaaaaaccaggcauuucaacccugaguggggaggagccgaggaggaccccuuaaacugacaguggguuaggggcucuucuguaagacuauacauuauucaacuccaaacuucagaaccuuuuaugaucuugucagaacuucagaaaauauacugucacauacacaauuuuacuuccagauaagcaaaaaagcuuccaauuaaaugacaggaaacugaaauuucauaaagcaggguguauuucuaggucucuggggugccauuuuuauuguaucuaagaaugaagagccaugccaguagucuacaugcuaagaauccgaucauggguucaaaccagggaccagcccuacaacuucacagccaggguguacuaucuuugcacuuaguucaugaggaaugacgauuuguaaaggagccagucuaucaaucgauacccuaucaggcuuuaugucauugauuguguuuucuuagcuuugagacagugguucagagucucugguuagccuucuugguucaagggggcaacauuacaucucagcaggaacagugacugcaaauuuggccacaaagugcuuacaguguuucucugcacacuggaucacaagucccucuaaucacaucaccuagauaaauggaucuucuuugggaaugcccacagguguuacagaaguuacacaaagggcaagucugucagugaccagcaucagauacacagagauccagaaguucuugccugagagucacccaaaaugcuaccaggacuaaagagugcuugcucgggucauugggaacuggguacccaacacgugccuggguucugauccucauuuucuacuccccaaagaaggagugugcagcucccugaccucaggcacacaaugggcacaaggacuugcuuuuuacagaacccacacccuuuaaccaacuacccguauaacaggacccugguucccuuccuucagaugaaaacuugccuuuucaaacagcaaagggucugaagggaacauguaauuccccuuucccaaaguguagacauucuacacuucuggucaugggaaaaaaauaggggcaggaguuaauguggauguuuagccucaggagaaacucuaaauagaagcccugacagagaaaacgcuguguggugugcucugugugguuuaacaugucaaugcugucaggcuaucgaggccugcuuguuaccuaagcacucacgugacugcaggguuugugcuguuagacaaaugcaucuuaacuaugccuuugaggacacauucacaacuguagcgucugcaccacaaguggaacugacugacucucucuucagccccaaaggauggagacaggaaaccaauccuccggucaggguuaccuguagcagagaagaccuacccaaaaaugcaucuagcugauccugcuaacagauggcacaaagggcuggagaguucuccacugagcacaagaagaacaaguaaggcucuggcuuacaaaacaguuccaaugaacaaaguagcacuaaugcagugaaugaauuccaggacauacgugaugguuuguucacuuuuccagccucuguucuauccuguuuuaaauggacacccuucacuguccauuuaaaagacaguucugaagcagcacaaacuuaauuugcaccuucucucuguccacuaaaaacgucuucacauaauuacuagggucacucaaucccacaccuuagaaccauggacucugacauuaaaggcaacuuuucgcagaguggucuuuaaacauaaauauacaaucacagacuuuaggguuuggauuuugcccauuccucauaaagaaggaacugaguacagcucgucaaaaucaaaauguauauauuauaaacuccacaauaauauuuaaucccaugaauauaugacaguuacagauuaacuugucuguaaucauauaaugggacaauauauacuucuuuaaaaguccauuuuuccuaaauaccaaauaaaauauuuuuaaagugcaugaauccauucauaggaaaauaccuaagaauagucuacuuucaagcuacuaccuauguccaugcguuaucugaggaguguguuugcauaugagcguccugaggaugugucagagagccacagauggggaaggaaggcuuuccaacacagcuacacaauuaccuugacaccgauaggcaguuagagaggcuacagccggaagggacauacagcuagcuuucugaaagauggaggccaauggccaguuuugugaagaccucuuaggcagcccauguugaaaaagagaucugcauaagcagagcuccuaacagagaacugacacaguacaggggacauccuccaaggggguacuugucagacaaaacuaaaugcuagaaucuugguuuagaaacuggcaguuuguaauuuaaaaauauaugugggaugaaaguguaugcuuuuuauuugcugaaaguuuccauaauaagauguuggaaaaauaguacuuuagauaugucuuuuuaaaaagccugucucuuaacaaaguagcaaaauuagacaaauugaaaaaauuuaagaacucagccacucuuaggaagagaauccuaaucucugcucucuuagaaaucccuucuuuaacugcauaguauuuacuugugcucuagagagcagggcaaggauaaaagcagauaacuuauuucauuguuuaauucuuuaaacuugaaaacagagggaucaaggaagugacacuucuuagacccuucaagguauguguucuguggucuccacaauuaccuggguuuuaguaaauaauacuuugucucucaaguucucuuacugcaaaacuuuagugcgugaguagugaaugcaucauacuauggacgugccgucccuuaggcauuuuauguucaugagacaaacaacccacccacccugugaggaaaaggucagcaagcaauaacugcagcauagccagcaagugacagguacagagggagaugagacgccccucaacucuccugcugugcacuacaagaaaacaagccuaaggaaagauggagcauucugggcgcugagugcagggcaagcccaggggccuugcucccaggcugagagcaggucagggguccacaacaaacaggagaaguauggagacugccacugacuuggaaauagcuccgaaggaggugcuucuuugcuucuuuuguuuucucaaacagagaguacccucagucaguaaaagcaugauucaacuucagcucagcaucugaguccaaggugagcagcaaggcucuucacugcccacaguuuacucauuucucagagggcacagagacuuuugccaguaccccuacaaagcacaucugcaaugacgagagaacggcgguguggugcugacuggucacugagaggcuauggcgggccauacagcccacacuuugcuuccagguugacagcuacagggugcguccuuuguuccugaccacaccuacuggcaagauccugcucuuugggugaucacuucuguaggacagagaggccuggugugaggcaaccacaugauaaaggaaggugccaacggaaacauuaugaagagggugucagaggaggaaaaggacuuuggcgucccauaaucauggugcucaguuaucucugacuccccagucaguuugaucugcguccaucacaccuuagaaucccgcagugggagcacugagauguaccuaacacagacuagguuggaguccuccaucucugaaaggccagacuucccaagcaucgcaggaugacauguuagaauaaacacacaugaucauuuucuaagcccuaaaaucaucuuuagcgccauaaaagagguggccuucguggcucagagcagaugggaagccuuaugagaaacagaugggagcuguuucaaaggcaaucugaaaugugcuuuaaaaaacauaaauaaaguaauaaauaaaccuaauuauucaaaauucagaagaaugacagacaacacagacugggaaacagagguauggauggcugcagagacccaugccacugugugcccacuccaccagaggccuuagcaccugccgcucuguggccacccacuacaauacauucugccgcuccagaaccucagaaggaaccggcugugagaggcugucugucgccugcaggcuuuggucaaguaagaugcacacacagucagcagcaacagcaaaaucccaugauugcuuucccuaaggaccauggacaccaaaagcuuucuguccucaguguaaaaaacauaaacccagaaucacggcaaacaugucuggguuucacuguauuugguaccaaagcaaauuuucuacauaacacacauggccuaagauggggugcggggacuaauaccugauuuccaaaagggcagggucugagauaacucagugguuaccuuccacccuuucuucaucaacuaccagcacccuuaguaagggcgauaacucuggagacagauaagaggccgacgcuuuucuucucuuaggacacugaccacagcuugcaacugcuuggaaguucuugcuauguggcagaaacacagacuugguaaagagaaaggaggaaaggucuaaccaucaggaauaauaauauccauucaaggcagugaggucucccagccugagcuagagacuaagaagacccagcaggcaggcaggaauauggcaguggugagaggcuggauagagaaagcauucuccauccaaaagauugggcucuuucauacagugugcuuucccucuucuggcaccucaaaauguaaagaaggcaggcgcuacuacuaaguccacuggcaucacaggcucuggagaagagugagcgguaaccugaaugaugggcuuuaccagagugaguccauuucuuaagacauccuucuacuucacuuuaggcuuuugccucauaggggccuucugagaggguuuuugcuggagucggaaacaagagugugagucagggaccacagaacaggagcacuacaccaccaccugcagaagccaagaaaggagaaaagcuacauggggucaauagucaggcagggcacaaggcuucaaagccccacacagaacuucaggcucuugcuuacacacaagaggcaccagcuggcagccugcuucagccagcaaacacagcccgcccuagcccagcauccuucagcuaguauaguagauauggaaguagagagucuuguugcggagcaaggaguaggaguuaucaaacuugagcaaguagaugcccuccccaggguaaucauggcugccagcuugcacaucucgguggcugucccgccgguacacaggcaugaccuccccauagcggccccguagagaacuccuggagccucucucuacaucucccaccgggacggguucuguaggagcaaaaggacagaguuuagauaggaguuuauagacggaauacaucccgcaugaaggugagagagugguucucccauggggacucuacugucuucccacauguacuaggaaaagugcacagaucuuggucaguaacaugacuguggaaugaaacuggcauccaguagcccagagcccaagagucucaauaaacaguaaugcauccuuugagaaaccaugauccagccagauaaccuuagaagugucugguuuccaauggggaaaagcuacuuaaaagugcaaaaccuggaaauccaugguuuccaggaaguacauggaaggaguagcuaacagaaaggaaauacagguaaaccaauuguauaauguggcccuaaaacuuccacuugauguccugaagaguagcaaguaagacagaaggacccccucgucccuaaauacauaugcaucuccugggagacuugaaagagcgagucaagagagugauucacgggcauacaucaaagccaaggacuacaacggaagcucagacauuacuucuagauuccucuccauuugucacgucuccaguagacaccacaaauaacaagaauggagaagagaggggcuugagcaaaggcucagugcuuuaagagcacuggcucaagucccagcacccacguggugguucacaaccaucugugacuucagguccaauggaucugaugcccuuuucuggcuuccauaggcaccaggcacauaugugguacacagaauacaaguaggcauaauaugcacauaaaauacaauauuuaaaaaaaauuucuaaagaauuaaagaaugaagcugggcauggugggacucuccuuuaaucccagcacucgggaggcagaggcagguggauuucugaguucgaggccagccuggucuacaaagugagcuccaggacagccaggcuauauaaagaaacccugucucgaaaaaacaaacaaacaaacaaacaaagaauuaaagaauggaggagagaccacuacuguuaacaugaagcaaagaauuuguauucugccagcaguggcaguuuagaagaaagaggaaagaggggagagagguacuuuuagcuuaagccagagaguguggcugaaaaaucaagaauaaauauuccaaaacaaagagagaaaaaacauaaucuuguguuccagugugagcuggaaaacccugcugcccauccacacacauggagaaaggggaaauaacuaggaaauacuuguuaaagagggagggauaaaggggagggggcaaaggggcgaggcccaccaaagcauuaauaccccaucaguuugcaaugcugccuugcauucugagugggcagagaaugcuacaauccaugaagcagccacuagcaacuagguugagcaaaugaaaauuagauuuaccuucaaucuccuccucuucauccucuuccuccuccucauccucacuggagucacugaccugcacgguuauaucagugcugguuacugggguccagucaaaauaaacuccaaaaccaauaucauagucaucaguugcaaauucccagcacacgcgcuuucccucgggguggguagggacccggauggugaccacuucuccccgcuucacuaccagacggcuguucuucuccuugcccagcuugcuuuugaacuccuucacuuuggcaaagguccagacgcacggaggagccaucagaggcggagagacugaaaggacagacaguuuacugagaagcuugggagacgccccuggcccagcauuuugcuagguuaacacacaacauucuuucuaagggccuccaccaacuuguuuucuuuccuuccuucuggcuugaauccuucaagcaucuacuggccaucaagaaacuauuuucucugcuuccaaaggccucaccuuuccuguggucccccagaagaucugcagauuccaaguccgcugaaagaacaucuauagccccagugugcucagacuggaucauaacuguguccucaggucgcuguggagcuugguacuuggccaucuacacaacagaauucugguuagaggacguaugauaucagacuccaauuagcaccuuuccaaaugcaggcugccccaccucuucccugauaccacauccagaaaguuagugugcuaaucaacguuguuucuuucugccaagugcaaguuaaccgcaaauucuacuuuuuaacaucaccaaagcgucuccuaaugauucuuuucuucccugugucuguaacuuuagaaaaguguuguugucuuuccuuucagacccucugcaaaaucuuccccacaaauauccucacagcuuacuacaggccuacaucaguaggguuuccaacacauucccagcagcaaggcuacuccacucaacaauuacuucuguaucacuaucagccaccauauuuaucaaaagcaucacaaaguaucugguuucaaauuuuccucucuuccuuccauuccucuguaucuuuuuccuauuucucccucacucaccccucaugcuacaaguugucucccccuguacuucacuagcaauguucuucgagugugugugugugugugugugugugugugugcauugucacauaugugagugccugcagaggacagaagaggacguuagauauucuacuggagcuagaguuaaggcagucgugaaccaccugauaugaaugcugagaagcaagcggaggcccucuggagaagcagcaacugcucuuaaguacugaaucagggagccaucucucuagcuccacaguguucucuuacuaauuacaguuucacuuuaagccagccauaggacuguucccuuugaacaguauauuugcugccagagucccaaccugcauaaaaggauacaaauggcauuugaugcaaaaagcccuggcuacccacacugaagucugcagucccucuagagggauuucucucugaaucucuuacaguguguuccuuguuucauguuauuaugccuuaauuuccuguuccuuuccccagcugguaggcaacucaacaagaaaucuauaccuacccccauggggaagagcacaccagugagucagcaaugcaguuagaggggcuggaauuguacuugugcaaggaaaucaaguuguaauccucccaggcuguguccucacagaucuguuucagaggccgagcccuccccuucucaaccacacagcuaaguaaugugaaccagaccuugccuaccaaguuuaaaggaacccuuccuuuuacaguguggauguaauuugcaacuuaauuagcagcagagucuuaguaaagcuuuuagccuuauuuccacaauugcuaaauggggacacagugguauuugucucacuagagugagaucaacaguaaaugaaguuuaaacuaccaagcauuaugcaaaagguauaaugcuugaugucuuuauugauacaaauucuaauuacaucaucacuaucaauacaaauauaaacacaaaccaucgccaccugcccugcccaggucaaaggaaucacuaguuauaacgcacuccuauggacucgacauagauagaguagaccgccguaguccagcuaacagucaaugacucagguugucaaggucuuagaggacaugagaugccuguucugacacuucauuguuugugugacagucugugugggagagacaaacaauuauucuccaaacaauuaaaacugagcugccucacaggggugucuaacccauguccccugggcugcaugaagccuagaguuacuuaaaacacugagguuuuuuucaaaggacauuuuuuuucuauaacccaacaaugcaguucuuaggugugagcuuuguagauuauggcaugucacaacguccaaagguuggacgugccugcuuggagcgaauucugagagccacugucucggaagagauacuucuauccaccauugugugccuacguguggguaccagaaguucgccuuucccaagagccagccugagggugccccuaccucacugagaaccugggucuggccugcuggcagcgccgccugcucccccggagccugacccucugaggcaccagccacguucuguagaucuuccgugguauccuuacucgcuggagauaccaucuguggccucucagagcaagaaaacaggucaguucaaggggucuuggaagaggcauaaucguucuggaggaacucugaaauacaacgacauucaagagacaccccacccccugaguucugcacucagguccgugucacuuuagcucaccacugacuguucacaguuagggcacagggacugaaaacgccagccccaggcuccagagccaccacaaacacacagcucagucauaagauggacucagggucugcggcacauguuuguggcauacgguaugaugcugugcuagauguagguucugugaaauauuaaaugggucaacauauucauuacuccaauacucaguuuuuguuuuauaaguacauucuuaauuuacucuuuguaauuuugaguauaaaucuaacgaccaugcuagcagagaccucuugaucuuauuuauucugccaacguaacacccacugugugccaacuccugguaaucaucacucugcucucugugugugugugugugugugugugugugcgcgcgcgcauguguguaaacguacacaggggcucccguguucauacagaggccagaagagggcaucagaccccugagauuaaguugaagcaucugcaggaugccuggcuuguuaaagcagcgcuggggaccaaauucuggucuccaugacugagaguggcacuguuccccacccagccaucccugcagccuggcugcucuccgcgucuuuggggauggcuuuauuccucacucacuacuagcuccaaccagaaucuuuauacgcuguugggacucccaguuguuucuacacaaaagucauggagaugaggcuuccugaggcagagacuggccacugaacagaaaguguccgcugauuaaucgcaaggauagaugggaaauuaaccagagcugggaaaacugagaucuuuucugcccugaggcagcccuccguaggcugcccaucuccaugcuccaguuaaagucagaggcucaccaagcuacccuuggguugaacugcuuguauccuuggugcuggcccuggggugagcagauggguguguucaugucucccuaggaaaaggucauggaacgggaugaguuaugcugccuuccauucccacugguuucacagagaccagaaaugaguagacagucagggcaguagcacaauccccagaccuucugaaaaucuacugccaguaagagguaaugugaguuuuauucuuaaagcaggagucauaaaggauggucuggggacccuuguaguacuuaggacccuuaugggaggaguaugacaccuuaaaacguuucagaauacuacuaaaauaccauuuuauuuucugcauuuucugcaguaggcaguggaauuuuccagagaccacaagacaugcaacaggacagccaagugaaucaagaugcagaggugaaaauucaauugucuuuuauuaaaccagacauuaaaggaaucugugcugucuuacug

SEQ ID NO: 6766 - RNA, 31086 nt, Mus musculus
caguaagacagcacagauuccuuuaaugucugguuuaauaaaagacaauugaauuuucaccucugcaucuugauucacuuggcuguccuguugcaugucuuguggucucuggaaaauuccacugccuacugcagaaaaugcagaaaauaaaaugguauuuuaguaguauucugaaacguuuuaaggugucauacuccucccauaaggguccuaaguacuacaaggguccccagaccauccuuuaugacuccugcuuuaagaauaaaacucacauuaccucuuacuggcaguagauuuucagaaggucuggggauugugcuacugcccugacugucuacucauuucuggucucugugaaaccagugggaauggaaggcagcauaacucaucccguuccaugaccuuuuccuagggagacaugaacacacccaucugcucaccccagggccagcaccaaggauacaagcaguucaacccaaggguagcuuggugagccucugacuuuaacuggagcauggagaugggcagccuacggagggcugccucagggcagaaaagaucucaguuuucccagcucugguuaauuucccaucuauccuugcgauuaaucagcggacacuuucuguucaguggccagucucugccucaggaagccucaucuccaugacuuuuguguagaaacaacugggagucccaacagcguauaaagauucugguuggagcuaguagugagugaggaauaaagccauccccaaagacgcggagagcagccaggcugcagggauggcuggguggggaacagugccacucucagucauggagaccagaauuugguccccagcgcugcuuuaacaagccaggcauccugcagaugcuucaacuuaaucucaggggucugaugcccucuucuggccucuguaugaacacgggagccccuguguacguuuacacacaugcgcgcgcgcacacacacacacacacacacacacacagagagcagagugaugauuaccaggaguuggcacacaguggguguuacguuggcagaauaaauaagaucaagaggucucugcuagcauggucguuagauuuauacucaaaauuacaaagaguaaauuaagaauguacuuauaaaacaaaaacugaguauuggaguaaugaauauguugacccauuuaauauuucacagaaccuacaucuagcacagcaucauaccguaugccacaaacaugugccgcagacccugaguccaucuuaugacugagcuguguguuugugguggcucuggagccuggggcuggcguuuucagucccugugcccuaacugugaacagucaguggugagcuaaagugacacggaccugagugcagaacucaggggguggggugucucuugaaugucguuguauuucagaguuccuccagaacgauuaugccucuuccaagaccccuugaacugaccuguuuucuugcucugagaggccacagaugguaucuccagcgaguaaggauaccacggaagaucuacagaacguggcuggugccucagagggucaggcuccgggggagcaggcggcgcugccagcaggccagacccagguucucagugagguaggggcacccucaggcuggcucuugggaaaggcgaacuucugguacccacacguaggcacacaaugguggauagaaguaucucuuccgagacaguggcucucagaauucgcuccaagcaggcacguccaaccuuuggacguugugacaugccauaaucuacaaagcucacaccuaagaacugcauuguuggguuauagaaaaaaaauguccuuugaaaaaaaccucaguguuuuaaguaacucuaggcuucaugcagcccaggggacauggguuagacaccccugugaggcagcucaguuuuaauuguuuggagaauaauuguuugucucucccacacagacugucacacaaacaaugaagugucagaacaggcaucucauguccucuaagaccuugacaaccugagucauugacuguuagcuggacuacggcggucuacucuaucuaugucgaguccauaggagugcguuauaacuagugauuccuuugaccugggcagggcagguggcgaugguuuguguuuauauuuguauugauagugaugauguaauuagaauuuguaucaauaaagacaucaagcauuauaccuuuugcauaaugcuugguaguuuaaacuucauuuacuguugaucucacucuagugagacaaauaccacuguguccccauuuagcaauuguggaaauaaggcuaaaagcuuuacuaagacucugcugcuaauuaaguugcaaauuacauccacacuguaaaaggaaggguuccuuuaaacuugguaggcaaggucugguucacauuacuuagcugugugguugagaaggggagggcucggccucugaaacagaucugugaggacacagccugggaggauuacaacuugauuuccuugcacaaguacaauuccagccccucuaacugcauugcugacucacuggugugcucuuccccauggggguagguauagauuucuuguugaguugccuaccagcuggggaaaggaacaggaaauuaaggcauaauaacaugaaacaaggaacacacuguaagagauucagagagaaaucccucuagagggacugcagacuucaguguggguagccagggcuuuuugcaucaaaugccauuuguauccuuuuaugcagguugggacucuggcagcaaauauacuguucaaagggaacaguccuauggcuggcuuaaagugaaacuguaauuaguaagagaacacuguggagcuagagagauggcucccugauucaguacuuaagagcaguugcugcuucuccagagggccuccgcuugcuucucagcauucauaucaggugguucacgacugccuuaacucuagcuccaguagaauaucuaacguccucuucuguccucugcaggcacucacauaugugacaaugcacacacacacacacacacacacacacacacucgaagaacauugcuagugaaguacagggggagacaacuuguagcaugaggggugagugagggagaaauaggaaaaagauacagaggaauggaaggaagagaggaaaauuugaaaccagauacuuugugaugcuuuugauaaauaugguggcugauagugauacagaaguaauuguugaguggaguagccuugcugcugggaauguguuggaaacccuacugauguaggccuguaguaagcugugaggauauuuguggggaagauuuugcagagggucugaaaggaaagacaacaacacuuuucuaaaguuacagacacagggaagaaaagaaucauuaggagacgcuuuggugauguuaaaaaguagaauuugcgguuaacuugcacuuggcagaaagaaacaacguugauuagcacacuaacuuucuggaugugguaucagggaagagguggggcagccugcauuuggaaaggugcuaauuggagucugauaucauacguccucuaaccagaauucuguuguguagauggccaaguaccaagcuccacagcgaccugaggacacaguuaugauccagucugagcacacuggggcuauagauguucuuucagcggacuuggaaucugcagaucuucugggggaccacaggaaaggugaggccuuuggaagcagagaaaauaguuucuugauggccaguagaugcuugaaggauucaagccagaaggaaggaaagaaaacaaguugguggaggcccuuagaaagaauguuguguguuaaccuagcaaaaugcugggccaggggcgucucccaagcuucucaguaaacugucuguccuuucagucucuccgccucugauggcuccuccgugcgucuggaccuuugccaaagugaaggaguucaaaagcaagcugggcaaggagaagaacagccgucugguagugaagcggggagaaguggucaccauccgggucccuacccaccccgagggaaagcgcgugugcugggaauuugcaacugaugacuaugauauugguuuuggaguuuauuuugacuggaccccaguaaccagcacugauauaaccgugcaggucagugacuccagugaggaugaggaggaggaagaggaugaagaggaggagauugaagguaaaucuaauuuucauuugcucaaccuaguugcuaguggcugcuucauggauuguagcauucucugcccacucagaaugcaaggcagcauugcaaacugaugggguauuaaugcuuuggugggccucgccccuuugcccccuccccuuuaucccucccucuuuaacaaguauuuccuaguuauuuccccuuucuccauguguguggaugggcagcaggguuuuccagcucacacuggaacacaagauuauguuuuuucucucuuuguuuuggaauauuuauucuugauuuuucagccacacucucuggcuuaagcuaaaaguaccucucuccccucuuuccucuuucuucuaaacugccacugcuggcagaauacaaauucuuugcuucauguuaacaguaguggucucuccuccauucuuuaauucuuuguuuguuuguuuguuuguuuuuucgagacaggguuucuuuauauagccuggcuguccuggagcucacuuuguagaccaggcuggccucgaacucagaaauccaccugccucugccucccgagugcugggauuaaaggagagucccaccaugcccagcuucauucuuuaauucuuuagaaauuuuuuuuaaauauuguauuuuaugugcauauuaugccuacuuguauucuguguaccacauaugugccuggugccuauggaagccagaaaagggcaucagauccauuggaccugaagucacagaugguugugaaccaccacgugggugcugggacuugagccagugcucuuaaagcacugagccuuugcucaagccccucucuucuccauucuuguuauuuguggugucuacuggagacgugacaaauggagaggaaucuagaaguaaugucugagcuuccguuguaguccuuggcuuugauguaugcccgugaaucacucucuugacucgcucuuucaagucucccaggagaugcauauguauuuagggacgaggggguccuucugucuuacuugcuacucuucaggacaucaaguggaaguuuuagggccacauuauacaauugguuuaccuguauuuccuuucuguuagcuacuccuuccauguacuuccuggaaaccauggauuuccagguuuugcacuuuuaaguagcuuuuccccauuggaaaccagacacuucuaagguuaucuggcuggaucaugguuucucaaaggaugcauuacuguuuauugagacucuugggcucugggcuacuggaugccaguuucauuccacagucauguuacugaccaagaucugugcacuuuuccuaguacaugugggaagacaguagaguccccaugggagaaccacucucucaccuucaugcgggauguauuccgucuauaaacuccuaucuaaacucuguccuuuugcuccuacagaacccgucccggugggagauguagagagaggcuccaggaguucucuacggggccgcuauggggaggucaugccuguguaccggcgggacagccaccgagaugugcaagcuggcagccaugauuacccuggggagggcaucuacuugcucaaguuugauaacuccuacuccuugcuccgcaacaagacucucuacuuccauaucuacuauacuagcugaaggaugcugggcuagggcgggcuguguuugcuggcugaagcaggcugccagcuggugccucuuguguguaagcaagagccugaaguucuguguggggcuuugaagccuugugcccugccugacuauugaccccauguagcuuuucuccuuucuuggcuucugcagguggugguguagugcuccuguucuguggucccugacucacacucuuguuuccgacuccagcaaaaacccucucagaaggccccuaugaggcaaaagccuaaagugaaguagaaggaugucuuaagaaauggacucacucugguaaagcccaucauucagguuaccgcucacucuucuccagagccugugaugccaguggacuuaguaguagcgccugccuucuuuacauuuugaggugccagaagagggaaagcacacuguaugaaagagcccaaucuuuuggauggagaaugcuuucucuauccagccucucaccacugccauauuccugccugccugcugggucuucuuagucucuagcucaggcugggagaccucacugccuugaauggauauuauuauuccugaugguuagaccuuuccuccuuucucuuuaccaagucuguguuucugccacauagcaagaacuuccaagcaguugcaagcuguggucaguguccuaagagaagaaaagcgucggccucuuaucugucuccagaguuaucgcccuuacuaagggugcugguaguugaugaagaaaggguggaagguaaccacugaguuaucucagacccugcccuuuuggaaaucagguauuaguccccgcaccccaucuuaggccauguguguuauguagaaaauuugcuuugguaccaaauacagugaaacccagacauguuugccgugauucuggguuuauguuuuuuacacugaggacagaaagcuuuugguguccaugguccuuagggaaagcaaucaugggauuuugcuguugcugcugacugugugugcaucuuacuugaccaaagccugcaggcgacagacagccucucacagccgguuccuucugagguucuggagcggcagaauguauuguaguggguggccacagagcggcaggugcuaaggccucugguggagugggcacacaguggcaugggucucugcagccauccauaccucuguuucccagucuguguugucugucauucuucugaauuuugaauaauuagguuuauuuauuacuuuauuuauguuuuuuaaagcacauuucagauugccuuugaaacagcucccaucuguuucucauaaggcuucccaucugcucugagccacgaaggccaccucuuuuauggcgcuaaagaugauuuuagggcuuagaaaaugaucauguguguuuauucuaacaugucauccugcgaugcuugggaagucuggccuuucagagauggaggacuccaaccuagucuguguuagguacaucucagugcucccacugcgggauucuaaggugugauggacgcagaucaaacugacuggggagucagagauaacugagcaccaugauuaugggacgccaaaguccuuuuccuccucugacacccucuucauaauguuuccguuggcaccuuccuuuaucaugugguugccucacaccaggccucucuguccuacagaagugaucacccaaagagcaggaucuugccaguagguguggucaggaacaaaggacgcacccuguagcugucaaccuggaagcaaagugugggcuguauggcccgccauagccucucagugaccagucagcaccacaccgccguucucucgucauugcagaugugcuuuguagggguacuggcaaaagucucugugcccucugagaaaugaguaaacugugggcagugaagagccuugcugcucaccuuggacucagaugcugagcugaaguugaaucaugcuuuuacugacugaggguacucucuguuugagaaaacaaaagaagcaaagaagcaccuccuucggagcuauuuccaagucaguggcagucuccauacuucuccuguuuguuguggaccccugaccugcucucagccugggagcaaggccccugggcuugcccugcacucagcgcccagaaugcuccaucuuuccuuaggcuuguuuucuuguagugcacagcaggagaguugaggggcgucucaucucccucuguaccugucacuugcuggcuaugcugcaguuauugcuugcugaccuuuuccucacaggguggguggguuguuugucucaugaacauaaaaugccuaagggacggcacguccauaguaugaugcauucacuacucacgcacuaaaguuuugcaguaagagaacuugagagacaaaguauuauuuacuaaaacccagguaauuguggagaccacagaacacauaccuugaagggucuaagaagugucacuuccuugaucccucuguuuucaaguuuaaagaauuaaacaaugaaauaaguuaucugcuuuuauccuugcccugcucucuagagcacaaguaaauacuaugcaguuaaagaagggauuucuaagagagcagagauuaggauucucuuccuaagaguggcugaguucuuaaauuuuuucaauuugucuaauuuugcuacuuuguuaagagacaggcuuuuuaaaaagacauaucuaaaguacuauuuuuccaacaucuuauuauggaaacuuucagcaaauaaaaagcauacacuuucaucccacauauauuuuuaaauuacaaacugccaguuucuaaaccaagauucuagcauuuaguuuugucugacaaguacccccuuggaggauguccccuguacugugucaguucucuguuaggagcucugcuuaugcagaucucuuuuucaacaugggcugccuaagaggucuucacaaaacuggccauuggccuccaucuuucagaaagcuagcuguaugucccuuccggcuguagccucucuaacugccuaucggugucaagguaauuguguagcuguguuggaaagccuuccuuccccaucuguggcucucugacacauccucaggacgcucauaugcaaacacacuccucagauaacgcauggacauagguaguagcuugaaaguagacuauucuuagguauuuuccuaugaauggauucaugcacuuuaaaaauauuuuauuugguauuuaggaaaaauggacuuuuaaagaaguauauauugucccauuauaugauuacagacaaguuaaucuguaacugucauauauucaugggauuaaauauuauuguggaguuuauaauauauacauuuugauuuugacgagcuguacucaguuccuucuuuaugaggaaugggcaaaauccaaacccuaaagucugugauuguauauuuauguuuaaagaccacucugcgaaaaguugccuuuaaugucagaguccaugguucuaaggugugggauugagugacccuaguaauuaugugaagacguuuuuaguggacagagagaaggugcaaauuaaguuugugcugcuucagaacugucuuuuaaauggacagugaaggguguccauuuaaaacaggauagaacagaggcuggaaaagugaacaaaccaucacguauguccuggaauucauucacugcauuagugcuacuuuguucauuggaacuguuuuguaagccagagccuuacuuguucuucuugugcucaguggagaacucuccagcccuuugugccaucuguuagcaggaucagcuagaugcauuuuuggguaggucuucucugcuacagguaacccugaccggaggauugguuuccugucuccauccuuuggggcugaagagagagucagucaguuccacuuguggugcagacgcuacaguugugaauguguccucaaaggcauaguuaagaugcauuugucuaacagcacaaacccugcagucacgugagugcuuagguaacaagcaggccucgauagccugacagcauugacauguuaaaccacacagagcacaccacacagcguuuucucugucagggcuucuauuuagaguuucuccugaggcuaaacauccacauuaacuccugccccuauuuuuuucccaugaccagaaguguagaaugucuacacuuugggaaaggggaauuacauguucccuucagacccuuugcuguuugaaaaggcaaguuuucaucugaaggaagggaaccaggguccuguuauacggguaguugguuaaaggguguggguucuguaaaaagcaaguccuugugcccauugugugccugaggucagggagcugcacacuccuucuuuggggaguagaaaaugaggaucagaacccaggcacguguuggguacccaguucccaaugacccgagcaagcacucuuuaguccugguagcauuuugggugacucucaggcaagaacuucuggaucucuguguaucugaugcuggucacugacagacuugcccuuuguguaacuucuguaacaccugugggcauucccaaagaagauccauuuaucuaggugaugugauuagagggacuugugauccagugugcagagaaacacuguaagcacuuuguggccaaauuugcagucacuguuccugcugagauguaauguugcccccuugaaccaagaaggcuaaccagagacucugaaccacugucucaaagcuaagaaaacacaaucaaugacauaaagccugauaggguaucgauugauagacuggcuccuuuacaaaucgucauuccucaugaacuaagugcaaagauaguacacccuggcugugaaguuguagggcuggucccugguuugaacccaugaucggauucuuagcauguagacuacuggcauggcucuucauucuuagauacaauaaaaauggcaccccagagaccuagaaauacacccugcuuuaugaaauuucaguuuccugucauuuaauuggaagcuuuuuugcuuaucuggaaguaaaauuguguaugugacaguauauuuucugaaguucugacaagaucauaaaagguucugaaguuuggaguugaauaauguauagucuuacagaagagccccuaacccacugucaguuuaagggguccuccucggcuccuccccacucaggguugaaaugccugguuuuuaguggcucuuuguuaugguuauuguucauucuuagguucaggccagggcucauccagaaaacauuaucuuaauuccuucccucauagccuuaauaguacauuuuauuaagacauguugaaaauacaucuguguccuguuuugagauuauuguuccauaagugaauuagcuuucaucuaaucagucugaguuauuuccauuuagccuuguuaaagaacaagccagucuggaaaaagcaaucccgugaugcaugacguugguauauccauguucucuauuuuaauaaugggaaguauuuugaaacccacagaagaaauguuugaugcuuuguaauaaaaaccaaaagcauuugcaaaugcuuuguaaucagagugauagauucuagagagcagaguagauaaggauaaugggaaggcggggaggugcuuggagauuuccuaaaccacgcuaugccauuugcuuauauauccaaagggcuacucuggagccauugccugauccaucagugguuaaaagugauuguguuuccuugcuaaauguuuaagcagcugacaaccaugagacaugcuuuccuuacuguuucguaucguaugcugaugccaaccaaggucaccaaaggccuugaaggagaacuaucacauagucuugucuuuuuucuucaaaauauaaacaaauccaaacuaauccauuugagucaacuuguuuuccaugucucccugucaugagaaaugcuguccacauguaugguuuccacacuaagaacucgguaccaauuguuacuuaguuuuucuguucuacugagugguuuuucuucugucagacuauauuuucucaccucaaagcacugaauguguugcugugauacacggaugaauccugagccaugguuuuaacagcucaguucugguguuuuuauauuaugugacaguuuugugagaugcuuuugugcauuuuuuugucuucuuuuccaaguuuugaaaucugucaugaauaaacuuuuucacugugcaccuaaaauauuugaguucuuucuuaauaagccuuuuuuucucuucagcuuaagaggaagaguauucagugaacacuugugaaucuuucauaaucuaagauuauaaaaauuaagaaaaacugagccuaagaugaaugucugcuuguauguaaaauccuaucaaaggguauagaacgauagcucagccaucaagagcacuugcugcucucguaaacgauccagguucagcucccagcacccacacaguggcucacaaccaucucuaacuccaguuccagagaacaugauauacucucuucuggccuccgguggcauugcacacucgcgguacacagacauauauacaaucaaaacacccacacagaauuaaauuguaaaaucuuugggguuggagagaugucccagugguugcaagcacugguguucuugcagagcaccugggucuggcauccaguaccacacaguggcucccaagcuauguuauuccuguucuaaguuaggaucaccugucuuccucugaccucuucaggcaccaggcaggcacauagugggcauacacauaugcaggcaaaacacucauaaacauuuuaaaacauaaaaauaaaucuguggcagaacauuacaagaugggagcuaagggaaaauuagauuuauagcaaugauggguuuauugcaaacagaacuguacugcuguugaucagagugcuauacauacucuguacagaguacucuguauggggagugcugucaccuaguuaguccaagcuggagauggucaagcugucuacacugcacaggaagggggcuaguuccauucccagcaucauucaugaguggacuuccucaaugugcuuaguccuggaacuaguucaggaguauggcuucuccuuaggaugaguaacugggucgagaacaccagcagaugucucuguacugguguggacauagaacagcagugcaacuccuagcucugggagcccagcuggccacuagaugcuuuccugcuucuuaaaucuuuucauccuggaucuuguucucucagauaggcucugugcuuauuucucuuccuaacccuugugggagaaaaaggcuaacgaguuauucugcuaugucuagacaugauuuccagccaguguaaauguucaucuucugaggccugccuucaacuaaugacucaauguaaauguuuucuggagucagguucaauaagaaaugaaagaauucagacuucccuauugaacuuugguaaauuugcccaauuuguuuuguuuuuuguuuuuuugagguaggguuucuuuauauguaacuuugccuguucuggaacucacucuguagaccaggcuggccucaaacucagagagaucugccugucucagcaucccaagugcugguauuaaagauacgagccaugaccaccuggcuuugccaggcauuuuaaacuugcauccucaugcaaucuucuuggcugcccucauggucucuucucugcugcugugacaaauuguccaugacaaaagcaacuuaaaggagagaagguuuauuuuagcccaugguuucaggguauaguccauaauggcagggaagucaagacaucagcgugagcagcugaucauaaugcacguguggugguugcuccacuccuucucuacucuucugggccccaggauccucugccuagggaauggugccauccaugcugggugccaucccaccucaaugguaccaauauaacccccaacagacauuuauaaaggcccuucucccuggugauucuagcuuuauuucaaguugacaauuaacauuagccggugagagcuggucaugucucugccuacccccuccuaacacgugacagauaagagaauuaaugcagacuguagugacuauagugcaagcagaaggaagauauaucgaacuggcuucauguugcuagagaaaacuuuaauacggggaccuggaagaaauagccuggacuccaugaaucugcugcuuccugaggaaagagcucaaguucaaauccucugcuauaaugcauucauuucugggccuguucugguuugaauaaaaaggcauauagggaguugcacuaauaggagguguggccuucuuggaggacguugugucucugggggugggcuuugagguuucagauugcucacagcaggcccagugucacucuucuugcugccuuuggauccagaugugaauucucugcuaccucuccagcaccaugacugccuuacaugugccuugcuuucuaccaucaugauaauggacugaaucucugaaacuguaagcuaauugaacgucuuucuuugucagaguugccauggucauggugucucuucacagcaguagaacacccagcaucugggccuacucccuucccuguaccaaugggcaugguuugggagcuaaguccucagcucggcagggguaucuggcugucgacgggggugagacacuuggaaaaccucuaaggcuagcagcuccuuguugaugugacugaugguaggguaggggcuuagauccaccuugaaccuguggcagagaaacauuuguaagccaaggcugucagggacacugcugugggcaguguggaaaguagaggcagggcuggaugagguucaggggcuguaguacaaggacugaaaucaguccugccacauggggaaccgcauuggcugggaugcucuggguaggucuggagugcuaucaucuaacaucauauaccucucuuuaagaaaugacggcucugaauucuggugucaggcauuuguauagacugacccaucacccacauuacuagcuucuuaggggagagaaugcaccauacaugcccauauucuaaagagcaagcaugaugccuucuggugggcugauggagggaggucacagagcucacuucuaagcagacacuccacauuuggguacagcaguguucuuggaagugguuccuuuagauaagccuccucuaaggcacaauggcugucuauacagggucacccaggcuauagugggaaugguagggguauuucaaugauuucuucugccacaucucugcuaagccagggcaguugauaauggccugguguaguggcuccuuggcagcuaaagaaggguucacaugagacauuaucucaguaguacauguggaggcccugguggagggguaaggugaaggagaauggcagaacuuuuucuuaccuuucagcauuugccacuugggguacuaagcacacaucagccauggauaccuaaaggaaggucaagggaguuugcacaaggauuaucaccuagacucacuggcaaggcuggcuguacccgcuguugacuguaccagggcugccaauccaacuuccuuuugcuucacuuuacacaaucccuagcacucucucacugucuccucuggaacugccuguuccugucacucagugcuguagcauuucucccaugucaaguuucccugacaaccaaccagagaaggccuaacugccuuaguggcuaucacugugcuuguugaagccaccacgacuaggcacuuaaugaggacuccuagcagauaaggaaccauggaaccagacuaccacaggcccaaggccuuauucuauaggcaucaagggcuccguaauccuagaaucucugggcugugaaggaagggauagucuaacccuucagcugaugccuggaccacuucacugagucagaaguguguucuggccuggacaccucacacuaccucuacugcacuaguucaaccuuccuagugcugcgcuccuuuaauacagcgucucauguuguggugaccccaacuauaauaauaguauuucaucacuaauccauuacuguaauuuugcuacuguuuugaauuguaauguaaaucugaugugcaagauauuggauaugugauggcuguuaaaggguugugugagccccaaaggggucacaacccacagguugagaacugcugcucuagaggcgguguaggaaugagcugaggcauuuccacaaacugacugcucagagcagagguuuacacaggaggcuggcccaggaucuccuuaggguaaggaguugacugggucuaccugggagaaaugauggccuggggucagcaugaaggccacagugggcagggcuggggccacuuaccucaucuccuacgcaguacuucccugcugugcucugcagaaucuucuccagagcugugggaaggccauguggauaacaguuacaucagcuucuccagggucuggccuccauaggcagacaaugaagagcuaggcuggggcauugggcagagucuaguguagggacuauggcagccaggacugagaagaaugcuccccauggcuucccugucuagucucagaauagacaagccaugcaguuggccaaggcaacagcucucacagacagccuaauguucugaagacuggcaccgugauuggaguacucaauggcugucaaccaacucugugggaccacgagccuccaggugugggguuccuaggcguucuggagcucgaacaugcuuaagcgccugccuagcccaccaccugcccguccacaggccucugcuccauucuacugucaaggucaaagcagccuggcaagaugcucagagcucugugugagggucaguccccuaagaggucacacuggggcagcucguaagaguaaugacucaccguuaaagccggaaguaauaaccuuuugggcccauugcaucugguucuccugucccacuugcuucaggacagacagguucugcacagcucaagagagaaaaagucauugcacuggaagccagccugaguuugcuccucugccaagccucugcagggagguucccugcucaguguucccucugcccuagauguuuaccuguucugcucccuuuuggacuauauggucccuuccuuccaugagggcucugaagguggcgguagccaccuuuuggggcuuccccagugaucccaaguauucugaaagccaugugagcuuaguagcaauaugcaagaauaggucuauaggaugcugguaugacugacagagauaggcacagaccaaggcuucuuucucucaauacuucuuccuacuuggugucuugaaaagagaagcuguaugauaugggggggggggggcaagccaggcguguuggacuggcuucuagagauaaugacuaaggugcagcccccauuguuaaaaacagaacggugacgcagggugagcuugguccuugcuccgauacuauuucgcugugucacccugcaaagucacugcucccuuuuagagccauuaccuugcaaauuagaaguuagcacaggugagugauuuuaauacuugccuuucuauuucacagaugaaaacuuacuuuauaaaaccaaaaaaacuuuacaagaauccuagcauuggcauauuguggagauggggguuaagucuagacuagggaaauuagcagauuugguaauaaagcaauuuacuuucuuuucuucucaguguuaugaaacaaacguucuguuuacacuaugaugguguacugagucacuaugucugaaaauguauguaacuuaacuuuaaaauaauuuauuacuaaaauauacuaugaugaaaaaucacuagaaagaagccaccaauagaccugccuaaugagggcugccauacucguucagucuguaacagacuaaacagaaaccuaacacaguuaucugugaagcacagagaagggaaguaugguaaugcaaggccuaccugcaugugugcuacagagcagaugaccaggagcugcccaggcuggagguggaccuacaccugcuacccuaccccuuuuccugucucaacaucuuuaugcucccaggcuuagaagcagaguuagggacaaugcugauggaagacuucugggaucccugcccccuucugccauguggucuaugucaaggccccugggaguuuuucuuucuugcccuccuuccccauccacagcagaacaccucccuguggcucgucacuuuggguaugaagggcugccugagaggugcacagggugcagguguaacagugccuaaccugaaggggcuggaugccacuagcgaugaggucagaaaucaugcgcacgauggcucuuuucuguggguccugaggcaggagccgugggauaggccgagucucuuccagguacuccaugauggccagcuguucagagggaacauugaggcagggagagggcuuggaaucccuggaccagaggggagaggcagcaaacuccuuuuuuuuuuuuuuuuuuuuuuuuuuugcaaugaaugguaccacaacucuccccuacaccuuccucaacuggagcacuauaaagguccuuuggggaccuugcuggacuuggguccccacaugcuuaaccuuccucucuccuucccucuaccauacacuuaaugaucccuauuaugcuuggucacuuguagguuaguuaggaagagaugucagggccccucauucagaacucugccacccccaaguccucuacucacugacuggacaauggugauuccaucaauuuucagcgcuggcacuugcuucaugggguucagggucugaaauuccucagugaacuguggggacaaggcuguggugaacaggguggccuugcuugaguagcuuaacacagaaccaagcaaguaggaaaacuguagaccuaguacugauccauaguucuuguccuuggaggacuugguuccuaaaaccaagauaacuucuagggaauccaggcaguauccuaggcucauaagaugcaagcuuuaccucaaugguccggcuuuaugguuuucccuguacucuuuacuguggucaccaggucagcuccuaccucacucacucauccauugagggcccaauacagaaaaggccccauuaccaccuacccuaaaaaaaaaaucaggcacugagcccuucccauccuacuauugcugcucaggagagccaucugcagccucccagucacaggaaccaugaaauacaguuuuccuucuaggcgacagcuaguccuccaucugguaccccuucaagguccaauccucauguugugagccugggacagccuccuuaccuguugcccgccauccuuuaugagguugaugggcacuaucucauagucaaugccuuuuaacgccagagcuaggagagaccagagaggaguuagggaaugccuucuggcuagacucugcucucaaaggcagcccucccagggugaugccaggagccuccccucugcuggucagcucuacuguggaguaaaauuuaggcugagagaggccaaagcauguaugcacuacagagacaguauccauaguguuuugacuuugagcucaguuaagggagagccuuugggacccaggaaaggacugugagguaggugacuggagacaagcuacuuggauuaaaagccuaccguauucaauugguagguguacggccuugguucauguaacuuaaugaguuucugugccucaguuucccaaaucugacaagcagcaccgugcaguaguugaaagugugggaauuggcuagggguguagcuuagugggaggacaugagcuuagcacuuucaaggcuguguugucaguauuaaaucaaaugauuauagacuugagccagacuacaugguucaaacugcagguuuucuucuuaguaguugcaugaucaagggcaauuuacuuaaccuuccugugccuuaguuuguacaaugggaacacuaacaguccccccuccuaugaucgcugggguggaaagagggucacacacacaaaagcacuaggcauagacuucuuugguacgcacugcuaugaggguagccuuugccaacagcugugcucacuggagaagcgagagucagaccuggacucaagcagagagcucuagugucuacgcuccugaaaucucuguggucaacuccaaacaguuguguuugauuagccagaucaaauaagauaagaacagaucgaggccagcugcuccccugccgguuaccagggaccucuggauuuugugaaccuguucuaggcaugguugcuaaaggcuucucaagugcagugugacagaaguagcagccccgaggugaaaaacaaccccucuuccucccacucccacuguccucuuguuggacuuucuagcuggaagugacauucagagauggaggcuucaaaacaggggcggugguugcuggagggcgcaacgggacaggagagggauaugagguccuuugccccaccccacccccccauccccucauccggaagcugagcucuuaccaauucgaacucuccaugaacaggagcuucggaaauaggaguagaggauaggcuguggagagaggaggaugaggguggauauuaauuuagcagguuuccagcuguagggcccgucuuguuggaagcaggcaccgaccagcucacaggcaaaagacucuaagcaccaguuucuucccauggcaccggcccuccuuccuccagggucuuggguccuaguuggacugcugaguuccugaggaucacgggccucucaagaggaagcagcuuucaaguguuagccuuaccuugucagccauagugcaguagcuuccuaaggaacuuuuuuucucucacagagcugggaggcagggggcggaaaccaggggugggucucaggagccaaugggaaagcggcuagacaggcaccagaggauccuggacucuggucagaaagggaaucuuuuucaacuuguggcacuggggcaaagaguguagccuggcuuggagguaaaguauguggugaaauggcucagcgcaggcaggcucaggguccagaccugagacaggaagcagcugccuuuugugaccagagacaaacuccugccuucuccuggucuucagcuccuuuguucauaaaacaaacgcugcucuaaaaugcuggcagagagauggggcuucuuauuuauuuucaugcuuucguguuucucaccuggaagcuccccauucucagaggccucauagaaauaaauggcagguaugcccauuugccacaaaggagagguugccagcuggagguccccaaggguccugucugaauuuuguaaugccaauggucccugauuuaccaguguucuaauuaacaacuuuucaacuuuauaaugaagagaaagugauaugcauuugguuuaaaaacuguacuucaaauuuugaauuuugguccuuucccaggcugggccauggcaguuaguuacagcuuggugauacuggacugaagaaacugggggaaaacccgacccugcugugaguguuuuuuuuuuuuuuuuuuagguuuauuuuuauggggagcuagagagauggcucgaugguuaagagugcuggcugcccuuccaggaguggagcuugguucccagcacccacaucgggcaggcagcucacaacugccuguaaucccagcuccaagagauucaaugccuggucuccaugggcgcuggcacucaccuucacauaguuacaugcagacacaauaauacacauaauuaaaauaacaaagccagagcuuugaaaauaguuucaucacuagaaaaaaauuaauuguagaugguugugaguugccuugugggugcugggaauugaauccagguccucuggaagggcagacagugcuuuuaacggcugagccaucucuuuagccccccaauaaauguaugauuuauuuaucuggauguuuuaaaccaggauauuucacacacaaaccuugucuuuuuccccuuuaaaacuucaggagucuguggcauuagccucuuaaaucguaacaacuuauuggaacagaucaauggccccuuuuaggaugagcaugcccccugauuugccaugaauuuuguuacauuugggccccuagaaugugugaucuaagauuaaagggaauggaaguuaauuucucugguguuuucuggguagccauuucauagcaggacucaggaacagacaauaagcacccaugcaccuuccugcagacaauauccacaaagaugcgacagaaaucaacacucagaucaccuacaacuccucggaccacagucauuucaccuaaguuccccuccuucugcugucuccucagaccaagauacuaugugaagcaguuucccugucccaagggccaccaacacagaagcccacaagagcaaggcaacaaguaggcccagguucucucagggcggcccccaagcccagggccugugccuccucagcaccuucuguggggaaagggaagaugggcauggcuagagcacaggcgaugcagccaguguccucggaggacgugggagaccacagugcauucuaucuggagagguaucuccuucuuuaucugggaaggccaggggagcacugggcccaacagagcuuagagacacugaccacgagggaguggcaaaaaugagaacugcuggagaggaugccuuauguaguaugugucacaaaccuggcuguacuaagggugccuagagucaugcuaacuacuccuacccaccccaucguaggaagccaacucuaagauggcacugguuuccggugugccuuugugguaaacaacaccacugcauaggcgcuagcuagcccgaaucuggcgccgaccccuccggagcaggugcaugcaaauuagaugccggcagacugaccaaucccggggggccacggagccuucuccugugcuaggguguauauaagcaguccucccuggguacccgggaucccuguagcagcaucgaggcguuccugcaauaaaggcuguugagaaaaauccgaccguguugugucuuccuugucagccgaggugggcacaacaaauugguggccccuauggggacccgaggaucucguggauucagaacucuucagcuggggaauggcgguacagguaagucucccaaauugauucccgguuaaaaggggggauauguuuuucucgcucguagacccaguguggguagcucuuaucguuguuguuuuguuuuuuguaauuucuguccucugcuuuuguuuaauagaagcaguuaaggcaggucagaaaauucuuacggaacaacaagaaagcaugucagaggaagauaaggaauguaugagcaaaggaaggaaaaggggcgaaaaggaaaagagaagggagaaaagauaaauacaaaaggaaaaggaaacagugauaaagaaaaggaaauagcaaaaauauaucccucuuuaaaagacuuaucgcuaagucuaucaaguucugauuccaguggcucggagcuuagugaggaugaugaagcugaccuagaagaagaggcagcucuguaugagagggauagguaugauccggauuggccauauagagccaacccauugaaaaagggaguaucggcgaaauaaagaauaaaacugaaagugcugggagcccgccagggcugcuaaaccagguaccucucucugucuggagguuuggaaagaaguuggucuaaguuucccugguuuugcugauggccaagggcaaugguaucaugagccaguggauuucaaaacuauuaagcaacuggcagaaucagucuguacuuauggggugggugcagcuuuugugguugcacaaauugaggugcuugccagauauugccucaccccuggguacuggaauaauguggcucgggcuugcuugucguccaggcaauauuuagaucggaaguccuugacuuaugaauaugcaaauagucaggcagcagccaauuuagccauaggacaagauccucagagacauugggaugcagacaugcuucuggguuuaggacguuuugcuuuagaucaaacaaauuauccugaaacagucuaugcccaaauaauugaaguagccaccaaagccuggaaagcguugccgaacaaaggcgcagucucaggcaaucuuaugaaaauuuugcagggccccacagaaccauucucagacuuuguagcacgccuuguugaggcagcuacuagaaucuuuggagacccugauacagcuaugccuuuagucaaacagcuaguauaugagcaaugcacuaaggaaugcaaagcagccauuacacccuauaaccauaaagguuuagaaguauggaugaagguuugcagagaacuagggggcccauuaaccaaugcaggccuggcggcagcuguaauacaauuggauagaucuaauaaugauacuuguuauaaguguggccaaagaggacauuuuagaagaaacugcccugaaaaugaaaaacaggccguauuagauaaaccuagacagccaggcuuaugccauaaauguaggaaggggaaacauugggcuaaugaaugcagaucuacaaaggauauagaaggccgaccauuacaagcaggauauuguagucucuccucucccagccugaaaccugcuugcucgggguggagcuuccugcucauucguucugccacgcccacugagauaugguggcaccaggccaaaaaacggacaguggggcccacguccccagggcccucaaauauauggggcucuucagaaagaccagaagaaacuuuggccgucucucugucauccgagagaccacggagagccacuacuggcucugcaggauuggaccuccacuccaccaccagacucguauuaaccccacagauggcgguacagcccauagauacagauuuuauuuuuuuuccuuuuccauuuuuuauuagguagauacagauuuuaaaggcccccuucccaaagauacuguaggacuauugcuuggccgcucaucuucugcuuuaaaaggauuacagauaaccccuggagugauugauccugacuauacuggaguuguaaagguuuugguagccuccccugcuggcaucucagcuaucuccacgggagauagaauugcucaauuguugcuauuacccaguuuacauaaauauuucccagcaaauaauaaaauaagagagaacagacuagguucuacagguucuugauuugcuuucuuaucuauggaauuaggagaccaccccaugcuaacuuuuuaauccuuuuuaggauuauuagacacuggugcagauugcaguauuaucuccacucaugauuggcugucaaaguggcccuugcagacaucaucucaaagccugcgugaucuggguuacgagacugcuccucuugucaguacuaaggaauuaaccuggagaaaugacgaagguaagucaggaaaauuuaucccuuauauuguggauauuccugugacucuguggggcagggauguccugaccaagauggaucuuagauuaaugaauauuccccacaagcuaaggagauaaugucuaacaugggcuauacuccagguaaaggauuaggaaagucauuacaaggcaguacuaugccaguaccaaccaaguuuaaacuagauaaaaaaggacuggguuuuuccuaggggccguugagggcuguauacccauuacuuggaaaacagaagaaccuguauggguuccucaauggccucuuuccucugaaaaauuggcagcagccagggaauuaguaagggaacaauuggaauuaggacauauuaaauccucccagucaccauggaauacaccuauauuuguaaucaagaaaaaaucagguaaauggaggcuuuuacaugaucuuagagcuauuaauaaucaaaugcaaauuaugggcccaacacaaagaggccugccccugcucucuagccugccugcugauuggccuauaauaauaauugauauuaaggauuguuuuuucuauuccacuugcauugugugauagcaagcgcuuugcuuuuacucucccuucuguaaauaaugaagggccugauaaacgguaucaaugggucguuuuaccucaagacauggccaauaguccuacuugugucaacuuuuuguaggagaagcauuacaaccuguccgugacgcauuuccaaaauugaggauagugcauuauauggaugauauccuccuugcuucuaauaauaaaguuuagauaaagcuuauauagaauuaguaaaagaauuagaaaagaaacaauuguuuguagcaccugacaaaguucagaugggaaauuuaggagaguuuuuggguacccgaguuacuucacauuauguaguaccucaaaagauagaauuguacaaagaucauuuaaaaacauuaaaugauuuccagaaauugcuaggugauauaaauuggauucgcccauauaugaggcuacccaauucugaauuaacuccacucuuugauaugcugaaaggugacccucaauuguccucccgccccccugugcccucacuccugaggcccgaguugccuuaggaaagguagagaggugcauagaaaaagcuaaauuauguagauggaaagaaggagagaacauacauuuguguguccugaagacguuucgccaaccgaccggaguauuguggcaaucagguccacuauuguggauuuauccucaggugucuccuaauaaaacucuuaaauauuaucucaccacuguagcccauuuagcaaucuugggcauuaagucaugcauucaacauuuuggagaccccccucaaaaaauuauuacaccauauaaugcuaaccaaauacagacccugagcucuuuaguugaugaaugggcucuguugcguuguaguuaugauggggaauuagauaaucauuauccuaaagauucuuuauuacaauuuuuuacugaacauccagugauuuuuuccaaagguuaugacaucuaaacccauaccaggugcacuggauauuuauacagaugguucuaaagcagguguuggcacuuaugugguuaauucucaaaacccuguuuuauuucaauaugauccugguaacccgcaacuaguugaauguaaaaucguauuagaaguauuuaagagguuugaaauuuccuuuaauuuagugucugauucagcauauguagugaaugcaguaaaagcauuggaaguugcaggacccaucaaaucuaccagcccuguaugugcuauuuugucagaauuacaaaacuugauuuggaauaggaaaaguaaauuuuuuauucagcauauucgggcucauucuacucugccaggcccuaugacugaaaggaaugcccugguagaugcaaguacucguauggaauucauuuuucauguuacuccauuagagcuugcaaaagguuuucaucaauuguaucauguccccgcugccacauugcaguaaaaauuuaauauuucccgggccucaguaagaacuguuguauugcaaugcccucaaugcgugcaguuucaucacccuccccauguugggauuaacccucguggauugaucccucuaaaaguauggcaaauagauguuacacauguuccagcuuuuggaaaacuaaaauauguccauguuucuauugacaccuguucagguaucauguaugccuccccuaugucuggugaaaaaacccacaauguuauuagccauugcuuagacucaugggcagcuugggaaaacccagcuaauuuaaaaacugauaauggaccugcauauacaucaacauccuuccaagucuucugcgaaacuaugcaaguuagucauaccaccagccuucccuauagcccacaaggccaagguauuguggaaagggcacaucgcaccuugaaagaacuguuacaaaaacaaaaagagggaauugccuacggacgagcacccaaagaacaauuaucuuuagcuuuauuuaccuuaaauuuuuaaauuuuggaugaucauggucgcucggcugcagacaggcaugccaugaccucgccuguaauucaacaugauguaaaaugggaagaugucuuaacugguaaaugguauggcccagaucccguuauuucgagaucuaggggagcuguuuguguuuuuccacaggauaaagaacauccaauuuggguaccagaaaggcugacaugaaaauugcuuaucuuaaaggaaauuggucagccaaagcagagcagaaaguugcuccuccagauugccaaacucaacagcacucgacccgacccugucacccugggagacuucaccuccuggaucaccaaugccuucuccuuuuuaaaggagugggcaggaauguuggccugggggacagugguccuccuggggugugucuucugcaucuggcuauugugucaacuaaaaagagaguaugcucaacauaaagcaguggucuaccaagcuuuguuggcaauugaagauggugcaucucccaauauuuggcuggccucuuuaaaaaauuaagaguccgcccuaggucauuuggcaguuguagucacacagauccaugguauccagagacgggcaacuuuccucaugcacagaccaaccuaagagaaggggccuggaggccaucauaggauaacccuaugauggguaaggcugugauacuagaggaucgaccuaagacaggagcccuggccauggacagauuugcccaggccuagaccagccucauuucauuaaagaaaaaagagggagauguaggaagccaacucuaagauggcgcaggcuuucugugugccuuugugguaaacaacaccauugcgcaggugcuagccugaccccuccugagcagguacaugcaaauuagaugcaggcagacugaccaauccuggggggccauggagccuucuccugugcuaggguguauauaagcagcccucccugggugcccugucccgguagcagcaucgagguguuccugcaauaaaggcuguugagaagaaucugaccaugucgugucuuccuugcuggcugaggugggcgcgacaccccauggcccuucagcaggaaacagaauuuuuuuuuuuuuggcuuuuucgagacaggguuucucuguauagccccggcuguccuggaacucacuuuguagaucaggcuggccucgaacucagaaauccgcuugccucuaccucccgagugcugggauuaaaggcaugcaucaccaucacccagcuggaaucuuacccuacaucuauuauuauuuuuuuuucuuauauaucauuuuaguuucuuuuccugcugcuaugauaaaaugccccaacaaaggcagucuaaagaagagugguuuauuuuggcuuauaauucaagauguaguaagucaccugggguggggguggggugggguuugggggaagagcagccugaaacagcugguaaguaaccuaugcauccacagcaugaaacagaacaaugcuguguguuggugcuuggcugacuucccccuuauuaugggcccagccagacccaacccagggaauggugucacucucccacaucaguuaaccugauaaagacaauccuaacccucucugcagagcaucuggaggcuugucuccuaugugcuuuuagauaaacagggagagaaaucacagcuaagcacuaacagcaaaccaccuggcgauuuuugcacuugaacagcuacuuuuuaauaucaaguagaauguccguuuaauuagcaccgggaaggaucauguuuccaacucaaacaugcauucuggcgacuuuaaauuugcaguuuuucuguugugggagacucggcccaugcuaggagcuacgucagaguugcguacaucccuagcuguuuuuauaccauuucuuacaugauuaaaauccugaaaaaucacaucuguauguggaaaaucuauauuaaccggaugcaauguccuuugcaucuaaugugccgccuuccuacauaucggcccuccuaagagacucaauuuuaagucucuuauaaaacacacucgcagcuccauuccagcaauggcuuaaauacaaauggcucuaggguggacuaaagaaguucgacuuaaacccuggacgcuccauaugccacagccuggaaucccagcacuuggaaggcgggggcgggagagucaaaguucaaagucagguugggcugcacagcaagaucguuucuuagagccaaaccgacaaaacuagaaaccugagcagauacuacaagugauuauuaacgucguuaaagagucacaucuuucccccuugccuuuggugcaugccuggaccaccagguccccugagagacauacgaagggcgccgcgaaacugcaaaguagggaaccauguuugaaagcccuagaagaggucugucuacccgaagcagggaaaagcgcgauuggacgccccucaaaagcuuccaaguuuagccuucccggcccaaucuaccaccaccauaagguucagcggccagcgcgcagguguagagugagcgggcgccgaggugcacgccgggagucguuguggcgccacgcgaagaagcgagcucucagccccgcccccccccacagcucuucuccgcguuucucaggagagacccucauccccggacguggggcacagaccuucccggcuugcaucucgcccggucggccggccaagaaagucagcucucgggacuagaagaugacugaggccuagcgggguccagagagcgaagguuggacuagauggccucccuccuucgggcuggccccgcccccgcccccugagcugcugggaguuguaguucaugagccgacucgaguuugucaguccuugguuucccuccgccucccgcaaugcucuacgccucaggccgccucuuagcugcccgggcggccaccacacuuuccgccccgcccagagcccggggcccggcgcuccgcggcaaacggagggaacuacaaaucccauggcaccucgagacgccuucuuaugaccccuugacggggcagcggacaagacccggcgugccuccggcccggagggugauccuucggaaggggaggaugccgccggccauaggcgguggccuagcgggcuccgagcugcguccccguaggggccgcugugugccgcaggcugccagagccgugagccgagacguggucccccaggcugcagcacggaaacuuaaacggccugcuuggagcucgcggcgcuuccaggcggcaggguggugggccacguuggcuguggugacgcugcuguccuuugccacccgcuuucaccggcuggaccagccugcucacaucugguaaguggcgga

SEQ ID NO: 6767 - RNA, 6118 nt, Mus musculus
agcaucgaggcguuccugcaauaaaggcuguugagaaaaauccgaccguguugugucuuccuugucagccgaggugggcacaacaaauugguggccccuauggggacccgaggaucucguggauucagaacucuucagcuggggaauggcgguacagguaagucucccaaauugauucccgguuaaaaggggggauauguuuuucucgcucguagacccaguguggguagcucuuaucguuguuguuuuguuuuuuguaauuucuguccucugcuuuuguuuaauagaagcaguuaaggcaggucagaaaauucuuacggaacaacaagaaagcaugucagaggaagauaaggaauguaugagcaaaggaaggaaaaggggcgaaaaggaaaagagaagggagaaaagauaaauacaaaaggaaaaggaaacagugauaaagaaaaggaaauagcaaaaauauaucccucuuuaaaagacuuaucgcuaagucuaucaaguucugauuccaguggcucggagcuuagugaggaugaugaagcugaccuagaagaagaggcagcucuguaugagagggauagguaugauccggauuggccauauagagccaacccauugaaaaagggaguaucggcgaaauaaagaauaaaacugaaagugcugggagcccgccagggcugcuaaaccagguaccucucucugucuggagguuuggaaagaaguuggucuaaguuucccugguuuugcugauggccaagggcaaugguaucaugagccaguggauuucaaaacuauuaagcaacuggcagaaucagucuguacuuauggggugggugcagcuuuugugguugcacaaauugaggugcuugccagauauugccucaccccuggguacuggaauaauguggcucgggcuugcuugucguccaggcaauauuuagaucggaaguccuugacuuaugaauaugcaaauagucaggcagcagccaauuuagccauaggacaagauccucagagacauugggaugcagacaugcuucuggguuuaggacguuuugcuuuagaucaaacaaauuauccugaaacagucuaugcccaaauaauugaaguagccaccaaagccuggaaagcguugccgaacaaaggcgcagucucaggcaaucuuaugaaaauuuugcagggccccacagaaccauucucagacuuuguagcacgccuuguugaggcagcuacuagaaucuuuggagacccugauacagcuaugccuuuagucaaacagcuaguauaugagcaaugcacuaaggaaugcaaagcagccauuacacccuauaaccauaaagguuuagaaguauggaugaagguuugcagagaacuagggggcccauuaaccaaugcaggccuggcggcagcuguaauacaauuggauagaucuaauaaugauacuuguuauaaguguggccaaagaggacauuuuagaagaaacugcccugaaaaugaaaaacaggccguauuagauaaaccuagacagccaggcuuaugccauaaauguaggaaggggaaacauugggcuaaugaaugcagaucuacaaaggauauagaaggccgaccauuacaagcaggauauuguagucucuccucucccagccugaaaccugcuugcucgggguggagcuuccugcucauucguucugccacgcccacugagauaugguggcaccaggccaaaaaacggacaguggggcccacguccccagggcccucaaauauauggggcucuucagaaagaccagaagaaacuuuggccgucucucugucauccgagagaccacggagagccacuacuggcucugcaggauuggaccuccacuccaccaccagacucguauuaaccccacagauggcgguacagcccauagauacagauuuuauuuuuuuuccuuuuccauuuuuuauuagguagauacagauuuuaaaggcccccuucccaaagauacuguaggacuauugcuuggccgcucaucuucugcuuuaaaaggauuacagauaaccccuggagugauugauccugacuauacuggaguuguaaagguuuugguagccuccccugcuggcaucucagcuaucuccacgggagauagaauugcucaauuguugcuauuacccaguuuacauaaauauuucccagcaaauaauaaaauaagagagaacagacuagguucuacagguucuugauuugcuuucuuaucuauggaauuaggagaccaccccaugcuaacuuuuuaauccuuuuuaggauuauuagacacuggugcagauugcaguauuaucuccacucaugauuggcugucaaaguggcccuugcagacaucaucucaaagccugcgugaucuggguuacgagacugcuccucuugucaguacuaaggaauuaaccuggagaaaugacgaagguaagucaggaaaauuuaucccuuauauuguggauauuccugugacucuguggggcagggauguccugaccaagauggaucuuagauuaaugaauauuccccacaagcuaaggagauaaugucuaacaugggcuauacuccagguaaaggauuaggaaagucauuacaaggcaguacuaugccaguaccaaccaaguuuaaacuagauaaaaaaggacuggguuuuuccuaggggccguugagggcuguauacccauuacuuggaaaacagaagaaccuguauggguuccucaauggccucuuuccucugaaaaauuggcagcagccagggaauuaguaagggaacaauuggaauuaggacauauuaaauccucccagucaccauggaauacaccuauauuuguaaucaagaaaaaaucagguaaauggaggcuuuuacaugaucuuagagcuauuaauaaucaaaugcaaauuaugggcccaacacaaagaggccugccccugcucucuagccugccugcugauuggccuauaauaauaauugauauuaaggauuguuuuuucuauuccacuugcauugugugauagcaagcgcuuugcuuuuacucucccuucuguaaauaaugaagggccugauaaacgguaucaaugggucguuuuaccucaagacauggccaauaguccuacuugugucaacuuuuuguaggagaagcauuacaaccuguccgugacgcauuuccaaaauugaggauagugcauuauauggaugauauccuccuugcuucuaauaauaaaguuuagauaaagcuuauauagaauuaguaaaagaauuagaaaagaaacaauuguuuguagcaccugacaaaguucagaugggaaauuuaggagaguuuuuggguacccgaguuacuucacauuauguaguaccucaaaagauagaauuguacaaagaucauuuaaaaacauuaaaugauuuccagaaauugcuaggugauauaaauuggauucgcccauauaugaggcuacccaauucugaauuaacuccacucuuugauaugcugaaaggugacccucaauuguccucccgccccccugugcccucacuccugaggcccgaguugccuuaggaaagguagagaggugcauagaaaaagcuaaauuauguagauggaaagaaggagagaacauacauuuguguguccugaagacguuucgccaaccgaccggaguauuguggcaaucagguccacuauuguggauuuauccucaggugucuccuaauaaaacucuuaaauauuaucucaccacuguagcccauuuagcaaucuugggcauuaagucaugcauucaacauuuuggagaccccccucaaaaaauuauuacaccauauaaugcuaaccaaauacagacccugagcucuuuaguugaugaaugggcucuguugcguuguaguuaugauggggaauuagauaaucauuauccuaaagauucuuuauuacaauuuuuuacugaacauccagugauuuuuuccaaagguuaugacaucuaaacccauaccaggugcacuggauauuuauacagaugguucuaaagcagguguuggcacuuaugugguuaauucucaaaacccuguuuuauuucaauaugauccugguaacccgcaacuaguugaauguaaaaucguauuagaaguauuuaagagguuugaaauuuccuuuaauuuagugucugauucagcauauguagugaaugcaguaaaagcauuggaaguugcaggacccaucaaaucuaccagcccuguaugugcuauuuugucagaauuacaaaacuugauuuggaauaggaaaaguaaauuuuuuauucagcauauucgggcucauucuacucugccaggcccuaugacugaaaggaaugcccugguagaugcaaguacucguauggaauucauuuuucauguuacuccauuagagcuugcaaaagguuuucaucaauuguaucauguccccgcugccacauugcaguaaaaauuuaauauuucccgggccucaguaagaacuguuguauugcaaugcccucaaugcgugcaguuucaucacccuccccauguugggauuaacccucguggauugaucccucuaaaaguauggcaaauagauguuacacauguuccagcuuuuggaaaacuaaaauauguccauguuucuauugacaccuguucagguaucauguaugccuccccuaugucuggugaaaaaacccacaauguuauuagccauugcuuagacucaugggcagcuugggaaaacccagcuaauuuaaaaacugauaauggaccugcauauacaucaacauccuuccaagucuucugcgaaacuaugcaaguuagucauaccaccagccuucccuauagcccacaaggccaagguauuguggaaagggcacaucgcaccuugaaagaacuguuacaaaaacaaaaagagggaauugccuacggacgagcacccaaagaacaauuaucuuuagcuuuauuuaccuuaaauuuuuaaauuuuggaugaucauggucgcucggcugcagacaggcaugccaugaccucgccuguaauucaacaugauguaaaaugggaagaugucuuaacugguaaaugguauggcccagaucccguuauuucgagaucuaggggagcuguuuguguuuuuccacaggauaaagaacauccaauuuggguaccagaaaggcugacaugaaaauugcuuaucuuaaaggaaauuggucagccaaagcagagcagaaaguugcuccuccagauugccaaacucaacagcacucgacccgacccugucacccugggagacuucaccuccuggaucaccaaugccuucuccuuuuuaaaggagugggcaggaauguuggccugggggacagugguccuccuggggugugucuucugcaucuggcuauugugucaacuaaaaagagaguaugcucaacauaaagcaguggucuaccaagcuuuguuggcaauugaagauggugcaucucccaauauuuggcuggccucuuuaaaaaauuaagaguccgcccuaggucauuuggcaguuguagucacacagauccaugguauccagagacgggcaacuuuccucaugcacagaccaaccuaagagaaggggccuggaggccaucauaggauaacccuaugauggguaaggcugugauacuagaggaucgaccuaagacaggagcccuggccauggacagauuugcccaggccuagaccagccucauuucauuaaagaaaaaagagggagauguaggaagccaacucuaagauggcgcaggcuuucugugugccuuugugguaaacaacaccauugcgcaggugcuagccugaccccuccugagcagguacaugcaaauuagaugcaggcagacugaccaauccuggggggccauggagccuucuccugugcuaggguguauauaagcagcccucccugggugcccugucccgguagcagcaucgagguguuccugcaauaaaggcuguugagaagaaucugaccaugucgugucuuccuugcuggcugaggugggcgcgacaccccauggcccuucagcaggaaacagaauuuuuuuuuuuuuggcuuuuucgagacaggguuucuc

SEQ ID NO: 6768 - RNA, 2070 nt, Mus musculus
aggcagcccucccagggugaugccaggagccuccccucugcuggucagcucuacuguggaguaaaauuuaggcugagagaggccaaagcauguaugcacuacagagacaguauccauaguguuuugacuuugagcucaguuaagggagagccuuugggacccaggaaaggacugugagguaggugacuggagacaagcuacuuggauuaaaagccuaccguauucaauugguagguguacggccuugguucauguaacuuaaugaguuucugugccucaguuucccaaaucugacaagcagcaccgugcaguaguugaaagugugggaauuggcuagggguguagcuuagugggaggacaugagcuuagcacuuucaaggcuguguugucaguauuaaaucaaaugauuauagacuugagccagacuacaugguucaaacugcagguuuucuucuuaguaguugcaugaucaagggcaauuuacuuaaccuuccugugccuuaguuuguacaaugggaacacuaacaguccccccuccuaugaucgcugggguggaaagagggucacacacacaaaagcacuaggcauagacuucuuugguacgcacugcuaugaggguagccuuugccaacagcugugcucacuggagaagcgagagucagaccuggacucaagcagagagcucuagugucuacgcuccugaaaucucuguggucaacuccaaacaguuguguuugauuagccagaucaaauaagauaagaacagaucgaggccagcugcuccccugccgguuaccagggaccucuggauuuugugaaccuguucuaggcaugguugcuaaaggcuucucaagugcagugugacagaaguagcagccccgaggugaaaaacaaccccucuuccucccacucccacuguccucuuguuggacuuucuagcuggaagugacauucagagauggaggcuucaaaacaggggcggugguugcuggagggcgcaacgggacaggagagggauaugagguccuuugccccaccccacccccccauccccucauccggaagcugagcucuuaccaauucgaacucuccaugaacaggagcuucggaaauaggaguagaggauaggcuguggagagaggaggaugaggguggauauuaauuuagcagguuuccagcuguagggcccgucuuguuggaagcaggcaccgaccagcucacaggcaaaagacucuaagcaccaguuucuucccauggcaccggcccuccuuccuccagggucuuggguccuaguuggacugcugaguuccugaggaucacgggccucucaagaggaagcagcuuucaaguguuagccuuaccuugucagccauagugcaguagcuuccuaaggaacuuuuuuucucucacagagcugggaggcagggggcggaaaccaggggugggucucaggagccaaugggaaagcggcuagacaggcaccagaggauccuggacucuggucagaaagggaaucuuuuucaacuuguggcacuggggcaaagaguguagccuggcuuggagguaaaguauguggugaaauggcucagcgcaggcaggcucaggguccagaccugagacaggaagcagcugccuuuugugaccagagacaaacuccugccuucuccuggucuucagcuccuuuguucauaaaacaaacgcugcucuaaaaugcuggcagagagauggggcuucuuauuuauuuucaugcuuucguguuucucaccuggaagcuccccauucucagaggccucauagaaauaaauggcagguaugcccauuugccacaaaggagagguugccagcuggagguccccaaggguccugucugaauuuuguaaugccaauggucccugauuuaccaguguucuaauuaacaacuuuucaacuuuauaaugaagagaaagugauaugcauuugguuuaaaaacuguacuucaaauuuugaauuuugguccuuucccaggcugggccauggcaguuaguuacagcuuggugauacuggacugaagaaacugggggaaaacccgac

SEQ ID NO: 6769 - RNA, 34719 nt, Mus musculus
ccgauuuggucaucuuggauggagguagagcuuccucuucaacugauuuucuuaguuuuucacuucgaauaucuggugucuucugcucuggaucuauuuuuguugguagcuguguaccuguucuuguaggugguccuuugaacacaccuacugaaacguccugucguuguaggucuggcaccucaugauuuuuaccuacgggcaccaaaucccccuugcguguccugguuggcucuaguggcacauuuccuacauuuccugggucucggucaguauuuggggacagcuuagagcuuaccucaaacaaggugucugcguuagcauuauguaauuuaccagauuugguucuuuuaggcugcagacucagacucucaucggagucagaauuauaaucuccugagacuucagacaugucagucgaugcgcccaaggccuccuagcaaccucaacuuccgacagcgucucuauggauaccacgauuuccggcgggguuuuccagacucuucccgagauuuugucgauccuuccaagugcggacuguaaaaaccggcgaccgaaaaagcacgcccccccccccccccgccccucucacgugucaggccagcgcuacccucugccgcccagccgcuccuuccggcccguggcucgcuucggcuccgcucggcucuccucugccgcgcucgcuucgccuucggcuguuuccggagccgcaagccgcuggcugcggagccgcucccggcgcgggcugcagaugucggaccggcaggcagcugaggggccggccuucuggagccccgcagcucgccgagggucggcgggcggcgucggggaccgacggggaguggaggagagccaggcggccgccucagguacgcaaggccccgggcgcugcaagggugggugccucugggcucggggccgcgcaccucgggcgaccgggguccccaccgucacggggcccgcggcugcgcucgaggucguuuucuacgcgguuuggaaaugcccugguuccagucccgcucccuuucucggagcacccggcuuggcaguccggcuccuuccgccgcgccucuuuggcuucagucgggguccgcaucccaccuccauucccgccgcucucaccccugccccugucuuuggcucuccgcgcgaccccaccugccuuuccgcgcgcuccugccggcgucugcuggggcgcccgccuuccucucagaaccccgcuuugcccuagcguaggcccccgcgcccaaccuccgucccuugcauccuugagagugggagagauggaaagcagccagaauaaggaggcuuugaggucucgaaggagccugauagugaaagcaaaggcaggaacuagaggcugcaguagaaauuuuggugaugucucucguucuccgagauccaccccuccucuugcuugggccggugucuccauuucagaccacacaaguuccuucgugugauuuuacuuaaguguccaaaagcuauaggcacagucuaucgcgcuguuaccuuucagccuugugaccaucacaggggcgugcgacuaaaaggauacuuuagaggggagagaucuggucacacuaagugcaagugauugguuuuaucgagaucucaaaguagcugucacagugacugagguacugcuguggauuccugaugcuuaguuggaaugugaauccucacuuuuagugcccuuggacaauugguuaaacuucucuaaacaugucugaguuuccucuuguauaagauguggguucuaaaaguaccugugccuuacagcaucggugggaggaucgugagccacugugacuaaaguacuugaugugcaacccaagaugcccgcuguacaaagcaauuggaggagauuaaagucugauuuaguacaacuaaauuacuagaaaagguauuccugguugcuaucuuucaacauaguggcuuuucuccaugccccugguguguggugcugcacgagcaccccuccccccccagcugugaaucacggacaauauuuuuauugaaaacauccuaauacauuuugucuuuucuauuuuuaaggguuuuuuuuuugugcucugugguaaacaaugcuaacauauauuugauauuaugguaauaaaaauucuaauuagggugggauguaguuaagcgguagaguucauuuucgaggcccuggguuagucccuagugcuaccaagaaagaaaaggggaaaaaaauuaaguguacuuucugaaagauuauaaagauuaaacauauaagcccuuauacagguauauguuuuauaagcaccugucccuuauaugugccaauaauuauaaauuacauacacauuaacuugucuuucauuuucucacuuuguggugaacauacccgagugucuuugcuuuauaucagaucuauuuucuaacauauuccuggagugcucuuaacaccuuguguuucaaauguuuguugggugggaaguucugcaaauaucuggcugaaucuggaggugaagguaacagugcaaagauuugacugaacauccaguaauaaccaaggaugcuccuugggguagagugguggaucuuaaccaggagcaauuugacaccccaggagacaucuggcaacaucuggcaacauuuuugguuauuggagcuauaagcagcuauuacagccaaacuauaagccauaggcuauuaaaagguccuuggccugcaggucuaccucacguguuagaaaugcugcauucgaaagaaacucaggccuggacuuaagcuucgucucugaagcucgggggcaaugcuacuuuagugggguuuuauagacuccggagugaaacuuuaaaacugcucaaaauugggagugugcugccacuucccaguagaaaaugagcugaguuaacguagagacacuaaaaagggaggagacagaaagacgcuuuuuguuaucuuagaaaacagcaggggaaaaugaguggauauucauuuguuauugaacugaggguuugagucuuucaguguacuuuauuccuucaggaguuugucaguaugcagaauaacaagaaagaauguguuuuuaccaugcagcaccgguauuuguugcugagguuuugguaaaaggaaggauguauguuuguguaagccaaagucucuaguggucaugguguuccuagagucuuaggaacugugauuguuuuuuaauuuuuuuuuuuuuuugguguuuuuuguuuuuuauuugggggcaccuggguucuucuuuuccccagaggagaaucauuccuuauaucaugaaacucucugaggaauacguauuacaucacuuaaaggcagguuuuuuuugaagucuacagagcccugggguacuggggugggggugguuuugugcacuguguauucagaugccgauugcugugcccagagaucugguugcaguuuggacauugacaaugucaugauauuuggagcaacuccugucucggugaugugugauaauucuuuuccaucuccccugauugauuaacagugagcugauucagccuauagcugggcagaagaggguagggcgggacuucugauuccaguccggagucgcaauugaaagggaagaaugagagaggaagaagggagaaggaccaggaggauucgcacacagucaggggagucaccaugaggacacacauggaacagagggaagcaggcaucuguagagaguuagaacagugccugcagcuuguucguaaguuuauuaggcucccgugccauuuuuuucgggagcuaaaaauggacuagagcgggcgaguacgcccuguaguuaaccugggagcaaaaggggugaagaauagcucagagaacuacauuuacacuggggaagauaaagggcaguguuugugaugaccucagcaaggacucaguuugcuguguaugaccaagcgucugauguucaggccuggagaugggcaggugaacuuggugaugguucuaguguaagacugagcagugcagucuguccuuuugcaagggauggagugguucauguccgugaccguuucuuguuaaguuagcuaggacuggaaauggagcggcucucugccggaugggacagagugcuggcuggaagcuuaugccaagacgucuuuuuguuuuuauuucuuaauuucuauucugauuuuuaaauugacaugcuaauaauuugcuuuuaaaaagaauaguuauugcauuuuuacagugucgauggcugguuaccauguuuuacuucaguucaugagguauaguacaaccaguguuaccugaaugaacacugaggucugucauaccccagccuugggcacugaagagaaauugggcuauauggucacuggguucuguugaagcaucacccaguugaugugcuuuccuguaagccucccaguucuaaccacaucaccugcuuuugggccucugcucugaaaaaaaaaaaaaaaaaaaaaaaaaagguaggcuaauuauuucugcagcugucuagugaaggggaagucuuaggaaaugaauucuaaagaaaccuugaccuaauauucagacacuuuggggaaaaccugcccuuuuuuuagcuucccaguaaagagaauagacaguaagcucagaccuguaacaugagacugagccacucuuagccuggaaagaaaaucauaguuugaaaaagguccagagcugggugcuggugccgugcauacuucuagucccagcauuuagcaucagaaguaggugggucucugugaauuucaggccagccuggucuacaaagcaagcuccaggacagccagugcuauaacaaagaaacucugucucaaaacaaaaaacaaacaaauaaacaaacaaaauaaccagacaacaacacccccaaacaaaaacaagacaaaacaacaacaaaaaccaaaagggaaaggaagcggucccauguagagagagucuuugaagcaggcuuugaggaggcuuugguuugguugagcccaucaguuacgaacuguuaccguccagcuccuguuucuccuccacucauugguuccaagauuuuggccaguuacgaacccuaacacugaucuugucacaguaaagaguaccauagucaaauauuauuugguuacuauuuuaaauuuucauuucagucuuaauguuauacgugauaguacuagcuugagaaauuaaacuuuuauaaucauacuaagauuaacaaauacauacucauuaaaaagaauaauaaaagccuuucucugcuguccuccaauuuguaaaacuuguccuguuuucucuagaaauauacagagaauuagcuuucauuuggcugcccuauuaaaaucuguacuacugaaaaauuggcuuuuccuuguuccuagugguuuagauuucagaaaccccaaaggauguguuuauauuuguuuuuuuuccugucucucucacacaacaguccaucuucccacauuguauacuccaggaaauaaacuuauguuuuucuuuucuccuuacacuuccugccuauucaaauacagcuacaguuguuuuugccagcaguucuugaguaaguuagggcauuccuuuaaacuuaaacuuucuuucuuuuucuguauacauuaagcuguuuggaaaaaaagaugcucugggaagcgacucuugauauaugaacuuuguguagccugacugauaaggagaaauggaaaugacucacuguugguacaggugcacaaaacauaguuguaccuuucuccaggggaccuaaauuacacuguuacuauccaucacaauuagaacauaguuuccauugaccuguuucuuugcagugucuauuuuauauggguuuauuccuguuuaagaauguggauacaagguuauuacagcaucauuuguagugguaaaagauuuuggaaaaaaguuuauccauagaaaacucauaaauugaugacuuguuuuucaucaaaugaaauauuugcuguagaaaagaaugagaaagcuucauaagguaucugaggugcagcuagaaaaaaagaaaauuugcaguagugugucuaaugucccaguaguguagaaaaucugaaacucauguguauauguauguuauauccuucccuuuauucacacaaacaugcacauuaccuuuacgugcauaaagucucucuggaagacuacauaaaacccaauaguguugaucgccuuuggagaugggggagcuaacauagaaggaagcuuucaugguagaguuuugacacuuuggaauuuugaauaacaagaaucuaccuauucagaaaagaaauacaggggcuggagagauggcucagcgguuaagagcacugacugcucuucugaauguccugaguucaaaucccagcaaccacauggugccuuacaacuaccuguaaugagaucugaugcccucucgugguucugaagacaguaacaguguacuuacauauaauaauaaauaaauauuuugaaaaaaaaaagaaauacauauacaaauacucaugugcuagaacauucuucacugguuuuuuccccuaaaauuggagucuuucugcauuuaggaacagauauuuuuuaauuaauuaauuuauuauuauuauuauuauuuugguuuuucaagacaggguuucucuguguagcccuggcuguccuggagcucacucuguagaccaggcuggccuuaaacucagaaauccgccugcuucugcuucccaagugcugggauuacaggugugugccaccaugcccggccagaucuuuuuuuaaaaguccgauuuuuuuuuuucaugaacuagaguuuagcaauaucuuugaguacuaacuuuauguucuaguauauauuuuauugucuuaaacugguucauuauuaauuuaaaacuauuuuucauuaaaaaaagacuauauuaagauuucauuaaaaaaaaccaguuaccuacuuucauaauguaccauugccaacaaaaucacucaguaguaauuauuuugauauauacuuaaagauuucauuucuuuaauuuaauuuaauuuaauuuaauuuugagauaagagucuguguaguccuggcugguguggaacuugcuauguagacugggcugacuucuuccaagugcuaggaucaaaggcaugggcaaccaugccgagcaaagcuuuuuuuuacuuuuaacuauguguauguuugggucugggcuuguacaugugcaugccuguagaggugaagaguguguggaacagccuagaacuggaguuacaggcaauugugagucucucaccccaacaugggaacuccguaagaguagugcgcucucuuaacugcuacacuagcuccuuagcaccuuauuuguucuuaauuuuuauuucuuuguuuauuauuauuguuuaagguacauaugugagugccuacauguaugucuuugcaccgcaugggugccuggugcccacagaaaccagaagaagguguucgauucuccuagaacuuggguuacagaugguugugagccacuuuaugagugcugagacccaacaacauggagccuaacugcugaguccucucugcagccucauguguauuuuaauuaauuuuagagcacucacuuguaaauagcuccauauucucccucacugcuccugucccuuccuugcugcucuuucucccagaggagucucuauuacagaggagucucuguacaggugcagacuccauguaugagagaaaauguacucuuuugucuuuucuacccucccccuuucugagcuccuuccucuucgcacauaguuccucuuucauguuauaugugucuguauaugcauacauauauguacaccagacacauacaaaauaacaaaagcucucugccaggugcauggccgguuugucuguccauuacacucguagaucuuuaucuuuccuaugguguuuguggugggccuguacuacauaaaugucuugaugucugugauagcucacuucacuugagccuuacuuucuuggcgcacgggucccuugcuggucccucuuagcuuuguggcuuauggaacagucagguucucucccccugcgagaauccccucuugauguucuaggcagguguuuuucucccauguguguuaggaauugggggaagcacacacaguuuguagaucuuuauagaaggacuggucucccugcuuucuaaaugagcuaagcuuuaauaacauguugugguauuauuaugguauguggcugucaauuucucauaguccacuggagacccagaauucuuauugcuacagcagcaaaucucauagcaaauguuugaaagcagaguuugacacucccacccacaagcucaggcucaagguuauccagcuccaaagucauuuucuuuuucuuuuuuaaagauuuauuuauuauuauaucuaaguacacuguagcugacuguagcugucuccagaugcaccagaagaggucgucagaucucauuauggaugguugugagccaugguugggauuugaacucagaaccuucggaagagcaguuggugcucuuaaccacugagccauuucuccagccccgcaaagucauuuucuuuuuuuuuuuuuuuuggguuuuucgagacaggguuucucuguauagcccuggcuguccuggaacucacuuuguagaccaggcuggccucgaacucagaaauucgccugucucugccucccaagugcugggauuaaaggcaugcgccaccaccgccaggcacaaagucauuuucugaugaugagguuagcccuagccauugccugcagaggcugccauccccccaggccccaaucuccaacuaaacuuccugguugguggcagccuccugcuuguucuuuucuacuugcuugcugagugucucccccuccccaggacugccucccuccccaguugucucucagucuacagcuucuugaauggguauuguucccuguaccccaggguagcugaguuuuaaacaauagguuuccuuucugaucacacucagcucagguggcacauuaagugacaaaaagaaaguccuuucuacugcugaccugucccacuagagucaccacuuggucaccaagacacacagcuugauuugaggauugugugugagagagagagagcugggggcuuuuucugugggugggacagccugccuucaccgggacagacagggacugccucacuuaucuuugggaugaaugaggcuucgucagaacgaagcugugagaccugagcucuguucgccuuauuuccuuuugcugucuuucuuucacuuuucaacagaagcuguccccaugugauugugggaaagaaaagaaaaaaaaagaaaaaccaaagcauauaccuccccaaaucuaggaccgucccacucagccccaccucugaaacguccccucaccuuccaaggccuucauucugcggugcaaguuccuuaagcaugaaccuguacacagacauaaccauauccagaccauggcaguuaccacagugccuagcucagauacaaaaccuuauccagguuguauauguuauugagaagacauaaaggcuaucuauauaucuauaugaaucuauaaaggccuuggcuauguagcgaguuggagaccagccuggcuagagucagucucuuuuugucauauaucaacaaauaaauggaaacauacuucuuauuuguagaguggaaaacuaagauuauaaagauuagugguuaguccccagguugcauauguaugaaaugcagcaucaggagucaucccagaagaguuuugguguuuccuucagggguggaaauugacagacguacauauaagugaaagguugcaaaggcuucaaaaucauguccagcagggaaaggcuugcuuggcagaauagccagauccuaagcaggaugagaaggcuuaccuuauuuuauuauaucccacuucuuuacaguucacagauaauggcagccuuuacaaguagaaauccgggaccauccuagacugagcaaguaugccagcaccauuucuccaguccugugugcucacaucuuaucgcaguuacacucugauaauucucacaguagaccaagaguucauuguuguuaguggugaucugugaucaguggucauugauguuaauauggaacguguucuggggcaucacaaauggcucucauguaaccuggcagccuuauaugaacagaugucguaaaugaggcugguguauggaaaugacucagaaagcaguuaucaaguuaucagcaaguugucgagucuuugcuggaacaauaaggaugaucagaaugaggccaggaugccacgcaugcucuuaaguuuaaaugccgagugcagacaaauccuaucuguggguuuuuuguuagauuucuuguuucaaccaacagaagcuaauucugauugccuuaggcagagagaggauucauuagaagguaaggaagacucacuaaaucacuguaaagagggggugagaggccagaggccagacaagacccgugcggccagggcucuagaugcugcuagaauucugcucacaugccaaacuguuucaggucccagguaggggauauuagguuaugugucuaucuccugacuuucuggugcugggaauuguagcucuuucauuacaucuuuacaguguaugaaacagccagucuccuucagagagaugguuggauauuuaaaagcuaaaaggcugacaaaugacuccuguaucugccauccugagggaccugcagauaguuuauaucagcacugaggccuguugaggucagccguagauguaucugccaguuauuccacagaggaagauggaacuucagaucugcaccaugaaauuagagauaaguccucagcaaggcucgagggcaugucacacagauaguuuuucagccccuagaaaagaaaauaaauggugcuuagaggcuaguaucugugguguaccaaaacaaauuuggccaccuaguuauugucuaauuguggccuccaaagucuguuucagcuaccuuuauuaguuagguucucugucuucugugggcuaccacagaaaccuucugucugaucugguauccaucccuacugaaggcuuccacaaaucugacuauucuaaguacucaggaagagggcuggagagauggcuuagugaguuguuaagagcacuuacugcucuuccaaagguccugaguuuaguucccagcaccuaccuacauggcaucucacaacugucugaugccaucuucugaugugcagauauacauaggggaaaagaucccauauacauaaaauacauaaauaaauaaaucuaaaaauaaauaaagaaauaacuauuuuuaaaauuuuucaggaagaacugaaugcaauuaauucaaucuguuuucucaagguccuucaagggauggauagguggauguugagcccaaggccugauacaugccagguagaugaccugccacugaguuacaugcccaacucugucucaguuuccuuuuguaccuuuacuauggcuucuagcacacacacacacacacacacacacacacacacacacacacacacacauuggcuucuucuguuuccuuuugacuuggcugagcccuacuugcucauuaagacaguuuaauuaucauccguuucaggaagcuuuaauacuuguucccuuuguuaaguguuuccgugauaaucuaguuaauuauucuaucuagauaauaucauguauuuacuauuaccugcuugcuaguuuucuuuaccuaguagacugagucuuugaagguacauauucagcucugcucacggcauggaacauaguaucuggcacgcagcaagggccuaguaaaguucuguugaauggagguagucauuaacucaaguucuuuuuuuuuuuuuaauucaaauuuuuauguauuauacaaauguuugccaaagugaugucugaaggauagacucugugcucuauuguaaguggaugaaagagcagggcuggggaggucacuuaguaaagcgcuugcuguguaaucaggagggccugaguucagaucucuaauaccaugguguuaauaccagguaugacaacauacaauugugcugaggaagcagagacaggagguuugccuuccagccagccaguccggccaaauuguuaaacucugguaagagccuaucucaaaaaguaagguagaagccagagagauggcucauggguaaaagcacuugccucauaagccugaugacagaauuccccagaacccaaguuaaaagcuggauguggcugcggucgucugauaucccagcgccucugugccgagguccguggcagagaugggaggauugcccagaagcucaggugccagccaagcuggaguacacacacagcaggaagucacagcaggagacaccucaccucaaaacaaggugagggcaagaacugacuccugagagauuuccucugaccuccacacuuagucuguagcauacauacauguacucacaugucacauacacacacacacacacacacacacacacacacauaaauuaaaaaacauagguagaagacugaguguggugguggauaucuuuaauccgagcacuugggagguagaggcagguagaccucugugaguucaaagccagccugguuuacauagugaguuccaggccauccaguagugcuuagggagacccuaucucaaaaaauaaaaggugagugauugaagacccuugagguugacuucuguucacacacacacacacacacacacacacacacacacacauacaccugcacacaucuaccuauacacauaucuggcacacauacacaaaagggucacuaucauuacugagugaaaagguagacuaaugcuauaaaugguaugagcuuuuuuuuuuaaucaaauuauuuuauauguauaaacgguuuguuuugauguaacuuaucaaaagauuguaaguuaaaauaguguaccaucaugguaaagauuauaugcacauuaugauauggaaaaugaucgcauuuauuuccugcuagcagaagugaaacuuggagagaaacugaauaguggggaugaaagucuugaugggcaagccuuaugacaaggaauucuauuucugaggauugcuuagaaggaaguaaaguaaaagauagauaugugcauccgugugcucuaacuuaauaaaauaaacacaaaugaaaaguaauauaugaguuacuuaucuuguugcuaugauaaaagacccuuccuuuuaugagaaaggauuuauuuuuucuuacaauucaaggguacagccuaucauggugaguuucuuaguuacuuuccuauugcugugaagagacaccaugaccaaggcaacuuauaaaaauaaaaaacauuuaauugggggacuugcuuacacuuuuagaggguaaguccacaggugucauguuguggagcauggcagcaggcaggcacugagagcuuacaucuggcccacaggacagagacagagaaagcaggguguguguggguaacugggagugacauaaaucuuuugaaacaucaaagcccacucccagugacacauuuccuccaacaaggugacaccccuaauccuucccaaacaauuccaccaacuguggacuaaugaguggaugggacauucuccuuccugucaccauagggaggaaguugugguggcaggagcauggggugcuggucaaguggucagguugcauccagagccaggaaacagggcaacgagugcucaacuagcuccucuuuuuuuaugcaguccaugacucaaaccuaggggacugggccaccuguuuuuagagugggucuucucacuccaguuaacacaaccaagauaaucuuuccuaggcuuaaccuagucuagauaauuccucauuggcauucacagaugcuugucucacagguaagucuagauaaguuuuuaucggauacaaauauaucagccuaccacguugacaaucaguaauaacugucacagauaccaaguuagguugaugguaaacaaaugcagucccagcaauucuggaagccagggucagaugaauacuugagcccaggaguucaagaccagccuagguaacauagugagacccugucucacagaaaggaaaauaaggaaacugucaucacguuuugaauucuaucaguuuccuaaaugguuuguaaauuggacucugauguugcauugugggaaaacagguauucucuuguuguugccaggaaagcaaaaugaugaaugaucccugccaaagauggcagccugccaaaaugugaaguguacauacggcacuauagaacagcuuguaguauuaauggugaaaaacuggaaguaacacugaugggccuaguuagggaugagaguauggcauguaugcccauugucuuagaguuuccauugcugugaagagacaccgugaccaaggcaacucucauagaggacaacauuuaauggggcuggcucacagguucagagguccauuaccaucauggcgggaagcauggcagcaggcaggcagacaaggugcuggaggagccaagaacccuacaucuugauccuaaggaagccaggaggagacucuuaauuccacucuggauggagccugaguauaggagccucaaagcccacccccuagugacauacuucuuucagcaaggccacacccacuccaacaaggccacaccuccuuauagugccacucccugggccaagcauauucagacuaccacauuaaucaauuauuucauuuuaagacacacgugaaauaauauuuugcucuugagauacuguugcuuguuuuguuuuuguggcuuuuugagucagggucacccugugaccucaguccagcuucaaauucuugauuuuccugccucagccuucuaaguuaguauguucucaugaaugacugaccacuuuaucauugaguaauagccuuuguuguuccuuguggcaccuuuuggcuugagguguguauacauauguguguguguuugaucaguugauucuugguuuuauaggguuuuguggguuuuugaggcaagagcuuguuguugugacccagguugguguugaauuuacagcguccucaccuucucaaauaggaguuaaccaccguguccagcuugaguccaugucaucucauacaggucuagccaccugcacucucucgguucccauuugcauggaauauccuuccccacccuuuuuuaccuucugccuaugcaguucauacauuuggggugcagugcucagaaacaucaugaugucuucauguaugucucaguccauuuuuugcugcuguaacaaggcugauaauuuacacucucacuuuuucaguauugaaaauuuaaccgaguucaggcauaagaggcagggucucugucuuugagcuguauuguuaagcuucauuauauuauugagaaucuccugucugccuugccaugccagauugaauccagggucuuauucacucuaggcaagcauucuacccuccucagcccaagguuggagaguuuauagugaacaaagcuuuauuucuugcaguucuagaggaaaugcaaggucgcauccagcaagggccuuuuugcucauagccacaggcggugauggagaagugggggagggaaagugaacucagucuucgaacucuccccagcgaugggcccagugggcacacgggagcugcuaucaccgagcaaggcgagggagaugugaacagagcauggccuuaaugauaccuaguagucauuguucaccuauuuuuccaauuauuuugccaaucgauacagaauuaaccuuuugucuuccccucuuuuucucucccuuugcuuauuuuguuguuguuuucucaauaauauuguugucucacuguguagcauagcccuggcuggccuugaguucaagauccucacgaagucuccuguaagcaucaagcacaaguucugccuuucuuuucugagucucccauggaauuuaugagaagccauauaaugcacgaggggaaucuuuucugguagaauucacacugaugcacguucaaagugcuagucuagggaaaaagcauuuucugguuucuaauggaauuagacaauuuuagacacugaucauggauauuugccagucauuagaugaaauuuugagcauugguaugucccuuuucuuaaucaaccacaaaacaaaugcucacuaacauuugaugcgugucuuuuaggaauagacacuguaaggccucuagcaggccugagcauggcaaaugugcacauacacauguugcauacaaaccuguuuauuugaauacauuuauaugaauacauuucugaaaugcuacgcaccaaauaguuaacaguaguuggcuggguuuagauuuaugcuugauuucucuugcuuugugguuauuuugcucaucuguauguuuugauuuucuaaagcgaaugauagauauguuaaaauguuuuauagaaaauaaauuguauagaggugaauggauuuuuaaucuguauuuuauuuauucuacaauaaacaguuaugaauaauaauaacauggguauauaaagucuaaauuuaaguuuaaaauuccacuauuuuccaaaaguuuaucucaaaaauaagagggaguagauugagagagaauuuauguuuagaagcuaagggaaaccugauugauguauuuagaacaaauuugcaguuaaaaaaaccaaacuagugucuggauaguguuauucucagaaauguacaguuaaugaacuccacaagguuuaggagacucuggggguguggcaggggcagcuguguguuuuauuccuuccuuugagugaaacagugggacagcagaccccucugagguggagaaggcagccuggggagaggggcugagugggcaguguaaagauuuaauccgguccugagggaggaguagaacacauucugaagcagcuuuccaagucugcacggggaggcacgugcgagucugauacugugugagccugguaccuaggugggaaugagcugcagguggagcaucggugagcucuagcaucgccugagcucuagcaucagugagcucuagcaucagugagcucuugcugucugucagcgucuuauugggaggagcucggggugacaggagcugagcaguuuuucuggggaugagauugccagucagcauaaagaacaaugagauccugucauggacaagugagacuggccaagguuagaucauaaauacuugcccugucugcacuuguauguuucuacaaacucucaguguuugagacauauuuuguuacacuguauuuuguauuaggaaguagauuuggggcucaguuucuuugaccuuaagaagaggggcuuagaauagggaauauauaaauucacugaccuggguauaccaggaaagucucaaggaguagggcagcaagaugauuaagaauccucaauaguggagagcaaucuaggaagaugccugauguuaacuuaagauguccacacucaugcauacacaugcauguguccacacaugugaaugcagauucauccaugcacggacacuauacacacauacacaugaaaaaaaggagaaaaaucaaugguaugugucuuuguguaucaugguuucuuuaucagaugggcaucgcauccaguucuagaacuuggcuaguuuugcaguagaugugugugcagguaucccgagaauguguugacuuagauuccugugggucaguuacccaggagugguauaucuagagcauaugguaguucugcuuuuaauuaauuaauugauuaaugugucugaguauguauguguucauaugugugugaagggaggccagaagaggguucuuuguuucgcuuugucucucccugaaucuggagcucuuauuuucuuugcuaggaugaagccagcaagucccaacaacgcuccuaucuccaucuuccuuggagccagaguuagagggguacauaggaugccuggcuuguuaggugggagcugagguccaggcucugguucuccuccuccugaguuugcagcucuuaaccccuccagcccuucugucucccauuguuugaagacucagacuggucucucuccauagugcuuuuacuaccuucuguucucaccagcaauacauaaacaagccgcuggccuccucacaagcuuuugucauuuuguggguuuuuugauggucgcaauuccaaccuagaagaaaucaaaucucauuguacuuuugauuuguauuuuguugauggcuaaugguguuguacauuuuuuucuuuuuuaaaauuuauuuuauuuauaugaguacacugucgcugucuucagacacaccagaagagggcagcagaucccauuacagauagaugguugugagccaccaugugguugcugggauuugaacucaggaccucugaacugcugaaccaucucuccagcccccuuucuuucuuucuuucuuuuucuuuuucuuuuucuuucuuuuuuuuuuuuuuuuuuugccuacuaguuagcuauguguaccucuuguuuuguaucuguucauuugcccauguacuauuuagauuauuuguguguguguguguguuuauauguucuagacauuaauccccucuugguaggcugucucuuuacaaugacaguugcuucuuugcugugucaaagccuuuucuuuuuuuuuuuuuuuccauuuuuuauuagguauuuagcucauuuacauuuccaaugcuauaccaaaaguccccccuacccacccaccccccaaagccuuuucauuccugcaacucuguuaauucuugagugucuuugggcuauguggcugccaugccugcgucuugaacuguuuacccugugcuuccuguagcaauuucaaauauuucauucauagacgaagaucuuugaacuauuucuaauugauuuuuaaaaaauauuuuguuguuauuuuguguguaccaguuaaugccagugugcauggaagugcaccacauguaugcagggcccuuggaggcaaggaggaggcacugaauguccuagcgcuggaguuacagacauuugugaccugccaugugggugcugggaaccaaacccaggugcucuggaagaacaaccagugcuuuuaaccccugagccaucgcuccagccccuugaacugauuuuuauguagggugagauacagauaugcuuuaaaugacuguuuuagacagugucucaggcaucccaggcuggccucaaacucuuuauguagcuaaggcugguuugaacuccugaucuuccagccucccaagaacugaauuauagccgggcggugguggcgcacgccuuuaaucccagcacuugggaggcagaggcagguggauuucugaguuggaggccagccuggucuacagagugcguuccaggacagccaggacuauacagagaaacucugucucagaaaaaaacaaaaaaaaaaaaaagaacugaauuauaggugugugcuaguguuuccucucacauaucgaauucuuccuaugauuuuuccagagaaggaagaucuggaaagcaccaacgucagcucuccacuggcuucugcuucugauccagcagccgaguccucaccauacagguagggacaugcaacugcuugggauaacguguuucugcaagguuuguccugagacugaaggaacugcuaaggaaagcagcaguagcuguaaggggugaggcacuuguagcuuuuuaaaugucauuuuucagguuaaacaugaucaccuuaggugaccguuccuuuuuauacuguguauuuuuauuuuauguguauauaugagugccuucauguauguauguguaucaugugcauaucuagugccuacaggagccagaagagggaguuacauucccuggaacuaggguucuggguagcugugagcugccugagcugggacugggaaccaaauggaguuccuauaaaaguacacagugcucuuaccugacucucuccagccacugcagugacgggcuuaaauuucuucucuguccaucgcauccacccacggcugcugagaugcauguaguagaaaagaaggguuauacugagccguagcaugugaggaagccaugaaucacgaguggaacacacaagucugccuucagcagcuaccugauccagcugcucagucccuaugcagcgcugccugguagagccuguggucuccaggccaagcgcaaauacggccggggagaaaagggggugcagagguaguuuuaaacugaucucuuucccaaaauaaccuuuugcuaauucuuuagaccauaaaauucuaaugugaauauuaaauucacauggauauuacaagucuucuuuaaaguauuuuuaaauugguauuagauggcuuggugguuaagagcacuugcuugcucuauagucaugaggucugggguugagaucccagcacccacaucacacuuugggcaugccugccaaucaggggaacggagagaagaggaucugcugggcuugcuggcuuccagccuaccugaaaugugagccacagccacagccacagggagagagucugccucaaggaacaggcagagggugagaaggccacacgucacaucugacacucucuuccggccucugcgcgcacauaaguauguguaccugcacagcacauacauaugaacuuaccuagcacacacaaguagauauacauauguacauaaaacaaaagcuuaaacauguuuuauaaguaaaacuguguuuguccaagguagcacacacaggcagagaggaggcuuuaguuucagaugcagcaacuguaacauuagguuagugaugcugcagaacucugagugucgguuuucccgauacuucagaugauagugugauccaagaugacuuacuuuuguucccaaacaggaacuaacacauccuuucauucuucacaacagucaggagacggcuacuguuuguucacugcauagacacuguuguauaccugagauucuucuagguuccagaaacugaggauggacugaagaguccagggcacuguuguaauggagcuuacaccugaugaggguggcagacagaaaucaagaguauagcuuguuucaucaccugugaaauuugcaauuuuauaugugugcgcgcgcgcgcgcgcguguguguguguguguguguguguguguguguauuccagcuagagucuaauaggguccccaacacuaggauaucaaaagccuguaccaucaaugagaagauaaacaaagccagaauuauccccccagaaaaaaacaacugcaagaaaacaugaacugucucuaauuugcacugaaaaacaaacaaacaaacaaacaaacaaacaaacccugagaauaggaaccucaccccauagguaucuguuuucuguccaguguggucuagacagaacacuugaacaguuuccuccaguugauaguauuccaagcaccggcugaagcccccacagaccagugagaaagcuugguacaagcuuugacguuauaccuuuaauauacccuuuguuucagcuguggcaaauuuuaagacaaauguguaucuugcaaucacaaaauguggugcauauuaugucagugcauaguaagugcagugaaggaugcugggaagucauccguccagggaccucgaggaacccucccagaaagcgauacucaagagcugagggaagcaugcaguaagcuaaccagaggcagcuuguuguuguuguuguuguuguuguuauuauuguuguuguuguuguuguguuugagacuauagugagugcaaggcucccaacagcagugugcuggaagugcugaggucuguuaaagauccaaguggucacuguuggugagugaguccaggagauaaggucagaguucagagagccugagaguuccauacucagaguugguuugagacaccaggcacacacaggguguaaggcccaguucccagcauacgucuugccuucuaguaaaggaacaacaaggaacaaaaaaacggauugagguuucugggcuucuaagaauuaagaugguucacccauuucccauguacacgagaugauuuaagcaaaugacucugagucaucaucuuucuugguuugcucugagguggacuuggguauucuaaaagauggcuaucuuuauuugaagaagauauaaucuauacauugaaaaugauuuucuuauuuauacuaccaaggaaaacaacgguacugauagucuaaaagccaggggcucuuggaaauauauauauuuguuuuguuuuuguuuuuugagacaggguuuccucuguguagcccuggcuguccugaaacucacucuguagaucaggcuggccucgaacugagaaauccaccugccucagcuucccaaguccugggauuaaaggugugcgccaccacugcccagcacucuugaauguuuacacuuugaauaauuagugaagaccugcagaauuuauuuuucacucuauuagaguugagugugguagcucacaccugccaugauagcauucaggaggcugaggcaggaggaucauuacaaguuuggggucaguguagacuacagaauaaaacauugucuuaaaaggccuccaaaguuuuaaaaaucauauaagaaauuaagaccuaaaauuauguuguuauuuuacucauuugaaaacaaaaauuaacucacuccauaguacuauaaauaguaugucuuuaaggaaaaauaaucaacuucgaaagcaaauauaguucaguaagacagcacagauuccuuuaaugucugguuuaauaaaagacaauugaauuuucaccucugcaucuugauucacuuggcuguccuguugcaugucuuguggucucuggaaaauuccacugccuacugcagaaaaugcagaaaauaaaaugguauuuuaguaguauucugaaacguuuuaaggugucauacuccucccauaaggguccuaaguacuacaaggguccccagaccauccuuuaugacuccugcuuuaagaauaaaacucacauuaccucuuacuggcaguagauuuucagaaggucuggggauugugcuacugcccugacugucuacucauuucuggucucugugaaaccagugggaauggaaggcagcauaacucaucccguuccaugaccuuuuccuagggagacaugaacacacccaucugcucaccccagggccagcaccaaggauacaagcaguucaacccaaggguagcuuggugagccucugacuuuaacuggagcauggagaugggcagccuacggagggcugccucagggcagaaaagaucucaguuuucccagcucugguuaauuucccaucuauccuugcgauuaaucagcggacacuuucuguucaguggccagucucugccucaggaagccucaucuccaugacuuuuguguagaaacaacugggagucccaacagcguauaaagauucugguuggagcuaguagugagugaggaauaaagccauccccaaagacgcggagagcagccaggcugcagggauggcuggguggggaacagugccacucucagucauggagaccagaauuugguccccagcgcugcuuuaacaagccaggcauccugcagaugcuucaacuuaaucucaggggucugaugcccucuucuggccucuguaugaacacgggagccccuguguacguuuacacacaugcgcgcgcgcacacacacacacacacacacacacacagagagcagagugaugauuaccaggaguuggcacacaguggguguuacguuggcagaauaaauaagaucaagaggucucugcuagcauggucguuagauuuauacucaaaauuacaaagaguaaauuaagaauguacuuauaaaacaaaaacugaguauuggaguaaugaauauguugacccauuuaauauuucacagaaccuacaucuagcacagcaucauaccguaugccacaaacaugugccgcagacccugaguccaucuuaugacugagcuguguguuugugguggcucuggagccuggggcuggcguuuucagucccugugcccuaacugugaacagucaguggugagcuaaagugacacggaccugagugcagaacucaggggguggggugucucuugaaugucguuguauuucagaguuccuccagaacgauuaugccucuuccaagaccccuugaacugaccuguuuucuugcucugagaggccacagaugguaucuccagcgaguaaggauaccacggaagaucuacagaacguggcuggugccucagagggucaggcuccgggggagcaggcggcgcugccagcaggccagacccagguucucagugagguaggggcacccucaggcuggcucuugggaaaggcgaacuucugguacccacacguaggcacacaaugguggauagaaguaucucuuccgagacaguggcucucagaauucgcuccaagcaggcacguccaaccuuuggacguugugacaugccauaaucuacaaagcucacaccuaagaacugcauuguuggguuauagaaaaaaaauguccuuugaaaaaaaccucaguguuuuaaguaacucuaggcuucaugcagcccaggggacauggguuagacaccccugugaggcagcucaguuuuaauuguuuggagaauaauuguuugucucucccacacagacugucacacaaacaaugaagugucagaacaggcaucucauguccucuaagaccuugacaaccugagucauugacuguuagcuggacuacggcggucuacucuaucuaugucgaguccauaggagugcguuauaacuagugauuccuuugaccugggcagggcagguggcgaugguuuguguuuauauuuguauugauagugaugauguaauuagaauuuguaucaauaaagacaucaagcauuauaccuuuugcauaaugcuugguaguuuaaacuucauuuacuguugaucucacucuagugagacaaauaccacuguguccccauuuagcaauuguggaaauaaggcuaaaagcuuuacuaagacucugcugcuaauuaaguugcaaauuacauccacacuguaaaaggaaggguuccuuuaaacuugguaggcaaggucugguucacauuacuuagcugugugguugagaaggggagggcucggccucugaaacagaucugugaggacacagccugggaggauuacaacuugauuuccuugcacaaguacaauuccagccccucuaacugcauugcugacucacuggugugcucuuccccauggggguagguauagauuucuuguugaguugccuaccagcuggggaaaggaacaggaaauuaaggcauaauaacaugaaacaaggaacacacuguaagagauucagagagaaaucccucuagagggacugcagacuucaguguggguagccagggcuuuuugcaucaaaugccauuuguauccuuuuaugcagguugggacucuggcagcaaauauacuguucaaagggaacaguccuauggcuggcuuaaagugaaacuguaauuaguaagagaacacuguggagcuagagagauggcucccugauucaguacuuaagagcaguugcugcuucuccagagggccuccgcuugcuucucagcauucauaucaggugguucacgacugccuuaacucuagcuccaguagaauaucuaacguccucuucuguccucugcaggcacucacauaugugacaaugcacacacacacacacacacacacacacacacucgaagaacauugcuagugaaguacagggggagacaacuuguagcaugaggggugagugagggagaaauaggaaaaagauacagaggaauggaaggaagagaggaaaauuugaaaccagauacuuugugaugcuuuugauaaauaugguggcugauagugauacagaaguaauuguugaguggaguagccuugcugcugggaauguguuggaaacccuacugauguaggccuguaguaagcugugaggauauuuguggggaagauuuugcagagggucugaaaggaaagacaacaacacuuuucuaaaguuacagacacagggaagaaaagaaucauuaggagacgcuuuggugauguuaaaaaguagaauuugcgguuaacuugcacuuggcagaaagaaacaacguugauuagcacacuaacuuucuggaugugguaucagggaagagguggggcagccugcauuuggaaaggugcuaauuggagucugauaucauacguccucuaaccagaauucuguuguguagauggccaaguaccaagcuccacagcgaccugaggacacaguuaugauccagucugagcacacuggggcuauagauguucuuucagcggacuuggaaucugcagaucuucugggggaccacaggaaaggugaggccuuuggaagcagagaaaauaguuucuugauggccaguagaugcuugaaggauucaagccagaaggaaggaaagaaaacaaguugguggaggcccuuagaaagaauguuguguguuaaccuagcaaaaugcugggccaggggcgucucccaagcuucucaguaaacugucuguccuuucagucucuccgccucugauggcuccuccgugcgucuggaccuuugccaaagugaaggaguucaaaagcaagcugggcaaggagaagaacagccgucugguagugaagcggggagaaguggucaccauccgggucccuacccaccccgagggaaagcgcgugugcugggaauuugcaacugaugacuaugauauugguuuuggaguuuauuuugacuggaccccaguaaccagcacugauauaaccgugcaggucagugacuccagugaggaugaggaggaggaagaggaugaagaggaggagauugaagguaaaucuaauuuucauuugcucaaccuaguugcuaguggcugcuucauggauuguagcauucucugcccacucagaaugcaaggcagcauugcaaacugaugggguauuaaugcuuuggugggccucgccccuuugcccccuccccuuuaucccucccucuuuaacaaguauuuccuaguuauuuccccuuucuccauguguguggaugggcagcaggguuuuccagcucacacuggaacacaagauuauguuuuuucucucuuuguuuuggaauauuuauucuugauuuuucagccacacucucuggcuuaagcuaaaaguaccucucuccccucuuuccucuuucuucuaaacugccacugcuggcagaauacaaauucuuugcuucauguuaacaguaguggucucuccuccauucuuuaauucuuuguuuguuuguuuguuuguuuuuucgagacaggguuucuuuauauagccuggcuguccuggagcucacuuuguagaccaggcuggccucgaacucagaaauccaccugccucugccucccgagugcugggauuaaaggagagucccaccaugcccagcuucauucuuuaauucuuuagaaauuuuuuuuaaauauuguauuuuaugugcauauuaugccuacuuguauucuguguaccacauaugugccuggugccuauggaagccagaaaagggcaucagauccauuggaccugaagucacagaugguugugaaccaccacgugggugcugggacuugagccagugcucuuaaagcacugagccuuugcucaagccccucucuucuccauucuuguuauuuguggugucuacuggagacgugacaaauggagaggaaucuagaaguaaugucugagcuuccguuguaguccuuggcuuugauguaugcccgugaaucacucucuugacucgcucuuucaagucucccaggagaugcauauguauuuagggacgaggggguccuucugucuuacuugcuacucuucaggacaucaaguggaaguuuuagggccacauuauacaauugguuuaccuguauuuccuuucuguuagcuacuccuuccauguacuuccuggaaaccauggauuuccagguuuugcacuuuuaaguagcuuuuccccauuggaaaccagacacuucuaagguuaucuggcuggaucaugguuucucaaaggaugcauuacuguuuauugagacucuugggcucugggcuacuggaugccaguuucauuccacagucauguuacugaccaagaucugugcacuuuuccuaguacaugugggaagacaguagaguccccaugggagaaccacucucucaccuucaugcgggauguauuccgucuauaaacuccuaucuaaacucuguccuuuugcuccuacagaacccgucccggugggagauguagagagaggcuccaggaguucucuacggggccgcuauggggaggucaugccuguguaccggcgggacagccaccgagaugugcaagcuggcagccaugauuacccuggggagggcaucuacuugcucaaguuugauaacuccuacuccuugcuccgcaacaagacucucuacuuccauaucuacuauacuagcugaaggaugcugggcuagggcgggcuguguuugcuggcugaagcaggcugccagcuggugccucuuguguguaagcaagagccugaaguucuguguggggcuuugaagccuugugcccugccugacuauugaccccauguagcuuuucuccuuucuuggcuucugcagguggugguguagugcuccuguucuguggucccugacucacacucuuguuuccgacuccagcaaaaacccucucagaaggccccuaugaggcaaaagccuaaagugaaguagaaggaugucuuaagaaauggacucacucugguaaagcccaucauucagguuaccgcucacucuucuccagagccugugaugccaguggacuuaguaguagcgccugccuucuuuacauuuugaggugccagaagagggaaagcacacuguaugaaagagcccaaucuuuuggauggagaaugcuuucucuauccagccucucaccacugccauauuccugccugccugcugggucuucuuagucucuagcucaggcugggagaccucacugccuugaauggauauuauuauuccugaugguuagaccuuuccuccuuucucuuuaccaagucuguguuucugccacauagcaagaacuuccaagcaguugcaagcuguggucaguguccuaagagaagaaaagcgucggccucuuaucugucuccagaguuaucgcccuuacuaagggugcugguaguugaugaagaaaggguggaagguaaccacugaguuaucucagacccugcccuuuuggaaaucagguauuaguccccgcaccccaucuuaggccauguguguuauguagaaaauuugcuuugguaccaaauacagugaaacccagacauguuugccgugauucuggguuuauguuuuuuacacugaggacagaaagcuuuugguguccaugguccuuagggaaagcaaucaugggauuuugcuguugcugcugacugugugugcaucuuacuugaccaaagccugcaggcgacagacagccucucacagccgguuccuucugagguucuggagcggcagaauguauuguaguggguggccacagagcggcaggugcuaaggccucugguggagugggcacacaguggcaugggucucugcagccauccauaccucuguuucccagucuguguugucugucauucuucugaauuuugaauaauuagguuuauuuauuacuuuauuuauguuuuuuaaagcacauuucagauugccuuugaaacagcucccaucuguuucucauaaggcuucccaucugcucugagccacgaaggccaccucuuuuauggcgcuaaagaugauuuuagggcuuagaaaaugaucauguguguuuauucuaacaugucauccugcgaugcuugggaagucuggccuuucagagauggaggacuccaaccuagucuguguuagguacaucucagugcucccacugcgggauucuaaggugugauggacgcagaucaaacugacuggggagucagagauaacugagcaccaugauuaugggacgccaaaguccuuuuccuccucugacacccucuucauaauguuuccguuggcaccuuccuuuaucaugugguugccucacaccaggccucucuguccuacagaagugaucacccaaagagcaggaucuugccaguagguguggucaggaacaaaggacgcacccuguagcugucaaccuggaagcaaagugugggcuguauggcccgccauagccucucagugaccagucagcaccacaccgccguucucucgucauugcagaugugcuuuguagggguacuggcaaaagucucugugcccucugagaaaugaguaaacugugggcagugaagagccuugcugcucaccuuggacucagaugcugagcugaaguugaaucaugcuuuuacugacugaggguacucucuguuugagaaaacaaaagaagcaaagaagcaccuccuucggagcuauuuccaagucaguggcagucuccauacuucuccuguuuguuguggaccccugaccugcucucagccugggagcaaggccccugggcuugcccugcacucagcgcccagaaugcuccaucuuuccuuaggcuuguuuucuuguagugcacagcaggagaguugaggggcgucucaucucccucuguaccugucacuugcuggcuaugcugcaguuauugcuugcugaccuuuuccucacaggguggguggguuguuugucucaugaacauaaaaugccuaagggacggcacguccauaguaugaugcauucacuacucacgcacuaaaguuuugcaguaagagaacuugagagacaaaguauuauuuacuaaaacccagguaauuguggagaccacagaacacauaccuugaagggucuaagaagugucacuuccuugaucccucuguuuucaaguuuaaagaauuaaacaaugaaauaaguuaucugcuuuuauccuugcccugcucucuagagcacaaguaaauacuaugcaguuaaagaagggauuucuaagagagcagagauuaggauucucuuccuaagaguggcugaguucuuaaauuuuuucaauuugucuaauuuugcuacuuuguuaagagacaggcuuuuuaaaaagacauaucuaaaguacuauuuuuccaacaucuuauuauggaaacuuucagcaaauaaaaagcauacacuuucaucccacauauauuuuuaaauuacaaacugccaguuucuaaaccaagauucuagcauuuaguuuugucugacaaguacccccuuggaggauguccccuguacugugucaguucucuguuaggagcucugcuuaugcagaucucuuuuucaacaugggcugccuaagaggucuucacaaaacuggccauuggccuccaucuuucagaaagcuagcuguaugucccuuccggcuguagccucucuaacugccuaucggugucaagguaauuguguagcuguguuggaaagccuuccuuccccaucuguggcucucugacacauccucaggacgcucauaugcaaacacacuccucagauaacgcauggacauagguaguagcuugaaaguagacuauucuuagguauuuuccuaugaauggauucaugcacuuuaaaaauauuuuauuugguauuuaggaaaaauggacuuuuaaagaaguauauauugucccauuauaugauuacagacaaguuaaucuguaacugucauauauucaugggauuaaauauuauuguggaguuuauaauauauacauuuugauuuugacgagcuguacucaguuccuucuuuaugaggaaugggcaaaauccaaacccuaaagucugugauuguauauuuauguuuaaagaccacucugcgaaaaguugccuuuaaugucagaguccaugguucuaaggugugggauugagugacccuaguaauuaugugaagacguuuuuaguggacagagagaaggugcaaauuaaguuugugcugcuucagaacugucuuuuaaauggacagugaaggguguccauuuaaaacaggauagaacagaggcuggaaaagugaacaaaccaucacguauguccuggaauucauucacugcauuagugcuacuuuguucauuggaacuguuuuguaagccagagccuuacuuguucuucuugugcucaguggagaacucuccagcccuuugugccaucuguuagcaggaucagcuagaugcauuuuuggguaggucuucucugcuacagguaacccugaccggaggauugguuuccugucuccauccuuuggggcugaagagagagucagucaguuccacuuguggugcagacgcuacaguugugaauguguccucaaaggcauaguuaagaugcauuugucuaacagcacaaacccugcagucacgugagugcuuagguaacaagcaggccucgauagccugacagcauugacauguuaaaccacacagagcacaccacacagcguuuucucugucagggcuucuauuuagaguuucuccugaggcuaaacauccacauuaacuccugccccuauuuuuuucccaugaccagaaguguagaaugucuacacuuugggaaaggggaauuacauguucccuucagacccuuugcuguuugaaaaggcaaguuuucaucugaaggaagggaaccaggguccuguuauacggguaguugguuaaaggguguggguucuguaaaaagcaaguccuugugcccauugugugccugaggucagggagcugcacacuccuucuuuggggaguagaaaaugaggaucagaacccaggcacguguuggguacccaguucccaaugacccgagcaagcacucuuuaguccugguagcauuuugggugacucucaggcaagaacuucuggaucucuguguaucugaugcuggucacugacagacuugcccuuuguguaacuucuguaacaccugugggcauucccaaagaagauccauuuaucuaggugaugugauuagagggacuugugauccagugugcagagaaacacuguaagcacuuuguggccaaauuugcagucacuguuccugcugagauguaauguugcccccuugaaccaagaaggcuaaccagagacucugaaccacugucucaaagcuaagaaaacacaaucaaugacauaaagccugauaggguaucgauugauagacuggcuccuuuacaaaucgucauuccucaugaacuaagugcaaagauaguacacccuggcugugaaguuguagggcuggucccugguuugaacccaugaucggauucuuagcauguagacuacuggcauggcucuucauucuuagauacaauaaaaauggcaccccagagaccuagaaauacacccugcuuuaugaaauuucaguuuccugucauuuaauuggaagcuuuuuugcuuaucuggaaguaaaauuguguaugugacaguauauuuucugaaguucugacaagaucauaaaagguucugaaguuuggaguugaauaauguauagucuuacagaagagccccuaacccacugucaguuuaagggguccuccucggcuccuccccacucaggguugaaaugccugguuuuuaguggcucuuuguuaugguuauuguucauucuuagguucaggccagggcucauccagaaaacauuaucuuaauuccuucccucauagccuuaauaguacauuuuauuaagacauguugaaaauacaucuguguccuguuuugagauuauuguuccauaagugaauuagcuuucaucuaaucagucugaguuauuuccauuuagccuuguuaaagaacaagccagucuggaaaaagcaaucccgugaugcaugacguugguauauccauguucucuauuuuaauaaugggaaguauuuugaaacccacagaagaaauguuugaugcuuuguaauaaaaaccaaaagcauuugcaaaugcuuuguaaucagagugauagauucuagagagcagaguagauaaggauaaugggaaggcggggaggugcuuggagauuuccuaaaccacgcuaugccauuugcuuauauauccaaagggcuacucuggagccauugccugauccaucagugguuaaaagugauuguguuuccuugcuaaauguuuaagcagcugacaaccaugagacaugcuuuccuuacuguuucguaucguaugcugaugccaaccaaggucaccaaaggccuugaaggagaacuaucacauagucuugucuuuuuucuucaaaauauaaacaaauccaaacuaauccauuugagucaacuuguuuuccaugucucccugucaugagaaaugcuguccacauguaugguuuccacacuaagaacucgguaccaauuguuacuuaguuuuucuguucuacugagugguuuuucuucugucagacuauauuuucucaccucaaagcacugaauguguugcugugauacacggaugaauccugagccaugguuuuaacagcucaguucugguguuuuuauauuaugugacaguuuugugagaugcuuuugugcauuuuuuugucuucuuuuccaaguuuugaaaucugucaugaauaaacuuuuucacugugcaccuaaaau

SEQ ID NO: 6770 - RNA, 482 nt, Mus musculus
gcaaaaaucuuuguuucgggagagagagaguagcaggagaaaaugagaagcacaaaacauacaagcggcuggaaagccucccacgagacgggcgagcuuugcuuagcgggguuaaauaagccgcggcuucgcagugcaaccaucucagcccgcaguccacaaggcgcucgucaaucuaccgcgccgcuuacgcgaagcacaugugagguccucgcggcgaggccaugucagggcucucggaacaggggggggcgaacucaacccgggaagccccgaaggaaagaccccggcuucggcgcggccuagucgcggaggaagcccgagagagguuccagccacgguuuugacuaaguuacuucugcgccucaggccaggucacagcccgaacaguacgggcagaaaggaaaagauguguacuccagacccuuccguaucgaggacccaaaucaacaacccaccuggugagcgccaucuucuuccgc

SEQ ID NO: 6771 - RNA, 482 nt, Mus musculus
gcggaagaagauggcgcucaccagguggguuguugauuuggguccucgauacggaagggucuggaguacacaucuuuuccuuucugcccguacuguucgggcugugaccuggccugaggcgcagaaguaacuuagucaaaaccguggcuggaaccucucucgggcuuccuccgcgacuaggccgcgccgaagccggggucuuuccuucggggcuucccggguugaguucgccccccccuguuccgagagcccugacauggccucgccgcgaggaccucacaugugcuucgcguaagcggcgcgguagauugacgagcgccuuguggacugcgggcugagaugguugcacugcgaagccgcggcuuauuuaaccccgcuaagcaaagcucgcccgucucgugggaggcuuuccagccgcuuguauguuuugugcuucucauuuucuccugcuacucucucucucccgaaacaaagauuuuugc

SEQ ID NO: 6772 - RNA, 4093 nt, Mus musculus
uuucaggagucauguaaucauuuauuuucauuauacaccagagauauaaugaacauauuaaaaagaaaaaaauguguauauaccaacacguuuuuaaugugucucuguuucuggacuccuccauucagaaaacaguaacaucauuuucauuaagcucuggcuccuuuuccauuaacuuaagcuuagguuaaggaaaacuaagcuuuuacaauuauguaacuaauuuuacucaauacacaguaauucauuuuccaaagccucaauacagaagcuaacuucuugaaaauggcuuaacacaaaggauguacuuuacaaaguaaacacuacucuauguguucuuaacaacuaccugcuuugaaaauuucucuaugcaagaaucagaagagauuuacuucucuuuuuuauuuucauucuuuuuuuugaguaugccuuacaagauucuaucuaaacauugucaaguauuauaucuuuaaacacaagaaaaugaucaucuccucuaagcauuuaauuucugcugugccuaauucuuaaaacucacaauugcuacccaucuaacuuaaaaacugcacuguaagaugcaacaacuuauggguggaaacaacuuagaggaucaagggaguguauacaacaagggcuagaaaugaaaggucacaaauggaaaggcagucccuuaacaguguacacugcugugcccuaaguucaauuauacccauaagcacaaaguguuaacuugucacuuaagauaaauaacucaacaucuuagauuugcaaagauauauaauacuucaaaacauaaaauacaucaguuugcauuaacaagacacacggaggccaaaugaaguuuuacuuaacaguugaaugucaagaugccaauuguguugaguaaucuucagagaacuuggaauauagcaugcuuaguuuauguuagaugucaucaaugucuucaucauccucuccaauaucaucaaacacgauuucuucaucauccccagcaccaaauguguccauuucauugauuuuggcauguucuggaaguucuccauaggccuucagacuucuugcuucaucuagauuguacuuuaagauuauaucagcccuguuaucuugauagucucguagaccaaucaauauaaugucugagguauuuauccaaaccuuuuuucucaacuuuccucuuauguggcacagccuccuuacaccaucaaaacacauugcuuccaaccauccacaucccagcauuuuggucaccugagcauacucuugcccauauucuuuaaacaccaacucucuuuucucagauucauuuucauuuuuaccucugcgccuguuuuugccuccuuugccuuuauucuuuggcaugauggaaaagguaaccacaggagucaagugagggacuccuggcagacaguggcugagaguggcugugacucaguuccaagagcuacuacagucuuaggaugggugccaggaaguaucuaacagugguagaucugaaagcaacuaaguauagaagauccacaagccacaaaaugucccagaguacuggcuucugauaguuaaaaaauaguacuucagcuucuggccuggugcucaggaaguuguagucuccccaguagugacaaaaugaagcaggacuccuuuaccuuugcaguuaaugcauugaccuuaaaaaaaauuaaauaaguuuucguuugaaaucuauuugggaaauaauuuuuaucaaaauuucugcacacaaugaugaauuguauagcuuuuaaaaaauuagauauucucuuuauuuacauuucaaauguuauccccuuuccuaguuuccccuccaaaaauccccuauucucuacccuccugcugcucccuaagcaacccacuccugcuuacuggcaaaugcauuccccucuacuggagcauagaaccuucacaggacaaagggccucuccuccaauugaugacugacucaguuauccucuacuacauaugcagcuagagccacgaguccuuccauguuuuuucuuuaauuuguaauuuagucccagggagcucugggguuacugguuaguucauauuucuguuccuccagguggcugaauuguauagcuuaauaaaaaaauugaaacuaucauucugagguaugugguucucuauuuuaaaaaagcguucuagggggcuagugagauggcucaguggguaagagcacccgagugcucuuccaaaggucaggaguucaauuccagcaaccacaugguggcucacaaccauccauaacgagaucugaagcccucuucuggagugucugaagacagcuacaguguacuuacauauaauaaaugaauaaaucuuuaaaaaaaauaaaaaauaaaaauaaaaaagcauucuaaaacuuaauagaacacuuaguagauucagauaccauuuuaauacauuuuuuaacaaguuuagaguacccaaaauuacaaguucauugguguucaggccuuuaauauaucacaagaacacucaaaauguguaccauugcacuuuaaauggacaugcuugagcauaauaaaaacaauuucaggucuggacagauugcucagugcauucucuucccaaaaaccaaacagugguucacaaccauuuguaauggguaccugacacccgcuuuugguucuugcgucuaggacagguacaguauggucauaaauauaaauuacucuuaaaaauuuuuucaguucacagaagaaugaaaaauugaagaaagucacagguuguguuacuuagauccacuuugggacacaaaauaacacaugaaagcaguugacacaggcacauaugacaacuauaugaaguccuggugcauccagugaaaacagaaaagcaaaggccaaccagaaaauucaucuccauuuccuaagaugugagaaaggcuuaguaacaagccaaccagccagaauacuacaaaacaaauuaacaacaacaacaacaucuccagaaacacuguugaguucauuuucuguuggccaucuccuucuggguauggggcuuucccuuaagagugguuuuggacauagugagacccccuuggagaaaaccaacuuuuccuuugggagcaguuacuagagauagugucaggaaccaaaccagguccucugcaagaacagccaaugcucugaacaacugaacuauuucuccagucccuauuugcuaguuuauacaaaugacauuuaaaaacauacaaaugaaagcuaacugaaagcuuuguguucuccacgcccagccuuuuugagacuuuauuuuuggccauugcuauggugagcacaagacacacucuacaccccugguauuuuucuucugugcauccauuucaaauucuaccuucccccuuauaguccuauuaaucuauaucacagugccugaagaagacuccaauauuggcuaccucuaacacuuagcauaacucacucuuacuuuucuggacaaaggcuaggaccacacuaguaaauaucaucuguugguuccaguuucauuucuguggcugcugcuaaaauacuccagcaaagcacaauuuccaggaggaggggcuuuucuggcuuacaauuccagguuacaacccaccaagggaugucaaggcagauagugaaaucccaaaagcaagagggacgugcuuucuugcagagaaggaaggaaggaaggaaggaaggaaggaaggaaggaaggaaggaaggaaggaggcuggcagggaaggcaacucaugaaagaccccagcuucugagcagcauaaucaacaugaagcgcacaagagguucuagacaugguuguggccagguuaccucugcuccgcagcuuauaucaauccgcaaagaaaaauggaaaauauauguucucccagaacuuccuauaaccagaacccaaauccaugaccuaccuggugaguaccaucuucuuugaaggaagacuaagagccguuagaacgaugauucuuucuuucugggauaggguuuuucuguguacucgaggcuguccuggaucguuuucuacagaacagauuggccuaggucggauguccucuugccuaugucucccaagguaaaggcagcgagaugagacuacugugucu

SEQ ID NO: 6773 - RNA, 4105 nt, Mus musculus
uuucaggagucauguaaucauuuauuuucauuauacaccagagauauaaugaacauauuaaaaagaaaaaaauguguauauaccaacacguuuuuaaugugucucuguuucuggacuccuccauucagaaaacaguaacaucauuuucauuaagcucuggcuccuuuuccauuaacuuaagcuuagguuaaggaaaacuaagcuuuuacaauuauguaacuaauuuuacucaauacacaguaauucauuuuccaaagccucaauacagaagcuaacuucuugaaaauggcuuaacacaaaggauguacuuuacaaaguaaacacuacucuauguguucuuaacaacuaccugcuuugaaaauuucucuaugcaagaaucagaagagauuuacuucucuuuuuuauuuucauucuuuuuuuugaguaugccuuacaagauucuaucuaaacauugucaaguauuauaucuuuaaacacaagaaaaugaucaucuccucuaagcauuuaauuucugcugugccuaauucuuaaaacucacaauugcuacccaucuaacuuaaaaacugcacuguaagaugcaacaacuuauggguggaaacaacuuagaggaucaagggaguguauacaacaagggcuagaaaugaaaggucacaaauggaaaggcagucccuuaacaguguacacugcugugcccuaaguucaauuauacccauaagcacaaaguguuaacuugucacuuaagauaaauaacucaacaucuuagauuugcaaagauauauaauacuucaaaacauaaaauacaucaguuugcauuaacaagacacacggaggccaaaugaaguuuuacuuaacagcugaaugucaagaugccaauuguguugaggaaucuucagagaacuuggaauauagcaugcuuaguuuauguuagaugucaucaaugucuucaucauccucuccaauaucaucaaacacgauuucuucaucauccccagcaccaaauguguccauuucauugauuuuggcauguucuggaaguucuccauaggccuucagacuucuugcuucaucuagauuguacuuuaagauuauaucagcccuguuaucuugauagucucguagaccaaucaauauaaugucugagguauuuauccaaaccuuuuuucucaacuuuccucuuauguggcacagccuccuuacaccaucaaaacacauugcuuccaaccauccacaucccagcauuuuggucaccugagcauacucuugcccauauucuuuaaacaccaacucucuuuucucagauucauuuucauuuuuaccucugcgccuguuuuugccuccuuugccuuuauucuuuggcaugauggaaaagguaaccacaggagucaagugagggacuccuggcagacaguggcugagaguggcugugacucaguuccaagagcuacuacagucuuaggaugggugccaggaaguaucuaacagugguagaucugaaagcaacuaaguauagaagauccacaagccacaaaaugucccagaguacuggcuucugauaguuaaaaaauaguacuucagcuucuggccuggugcucaggaaguuguagucuccccaguagugacaaaaugaagcaggacuccuuuaccuuugcaguuaaugcauugaccuuaaaaaaaauuaaauaaguuuucguuugaaaucuauuugggaaauaauuuuuaucaaaauuucugcacacaacgaugaauuguauagcuuuuaaaaaauuagauauucucuuuauuuacauuucaaauguuauccccuuuccuaguuuccccuccaaaaauccccuauucucuacccuccugcugcucccuaagcaacccacuccugcuuacuggcaaaugcauuccccucuacuggagcauagaaccuucacaggacaaagggccucuccuccaauugaugacugacucaguuauccucuacuacauaugcagcuagagccacgaguccuuccauguuuuuucuuuaauuuguaauuuagucccagggagcucugggguuacugguuaguucauauuucuguuccuccagguggcugaauuguauagcuuaauaaaaaaauugaaacuaucauucugagguaugugguucucuauuuuaaaaaagcguucuagggggcuagugagauggcucaguggguaagagcacccgagugcucuuccaaaggucaggaguucaaaucccagcaaccacaugguggcucacaaccauccauaacgagaucugaagcccucuucuggagugucugaagacagcuacaguguacuuacauauaauaaaugaauaaaucuuuaaaaaaaauaaaaaauaaaaauaaaaaagcauucuaaaacuuaauagaacacuuaguagauucagauaccauuuuaauacauuuuuuaacaaguuuagaguacccaaaauuacaaguucauugguguucaggccuuuaauauaucacaagaacacucaaaauguguaccauugcacuuuaaauggacaugcuugagcauaauaaaaacaauuucaggucuggacagauugcucagugcauucucuucccaaaaaccaaacagugguucacaaccauuuguaauggguaccugacacccgcuuuugguucuugcaucuaggacagguacaguauggucauaaauauaaauuacucuuaaaaauuuuuucaguucacagaagaaugaaaaauugaagaaagucacagguuguguuacuuagauccacuuugggacacaaaauaacacaugaaagcaguugacacaggcacauaugacaacuauaugaaguccuggugcauccagugaaaacagaaaagcaaaggccaaccagaaaauucaucuccauuuccuaagaugugagaaaggcuuaguaacaagccaaccagccagaauacuacaaaacaaauuaacaacaacaacaacaucuccagaaacacuguugaguucauuuucuguuggccaucuccuucuggguauggggcuuucccuuaagagugguuuuggacauagugagacccccuuggagaaaaccaacuuuuccuuugggagcaguuacuagagauagugucaggaaccaaaccagguccucugcaagaacagccaaugcucugaacaacugaacuauuucuccagucccuauuugcuaguuuauacaaaugacauuuaaaaacauacaaaugacagcuaacugaaagcuuuguguucuccacgcccagccuuuuugagacuuuauuuuuggccauugcuauggugagcacaagacacacucuacaccccugguauuuuucuucugugcauccauuucaaauucuaccuucccccuuauaguccuauuaaucuauaucacagugccugaagaagacuccaauauuggcuaccucuaacacuuagcauaacucacucuuacuuuucuggacaaaggcuaggaccacacuaguaaauaucaucuguugguuccaguuucauuucuguggcugcugcuaaaauacuccagcaaagcacaauuuccaggaggaggggcuuuucuggcuuacaauuccagguuacaacccaccaagggaugucaaggcagauagugaaaucccaaaagcaagagggacgugcuuucuugcagagaaggaaggaaggaaggaaggaaggaaggaaggaaggaaggaaggaaggaaggaaggaaggaaggaagcuggcagggaaggcaacucaugaaagacccagcuucugagcagcauaaucaacaugaagcgcacaagagguucuagacaugguuguggccagguuaccucugcuccgcagcuuauaucaauccacaaagaaaaauggaaaauauauguucucccagaacuuccuauaaccagaacccaaauccaugaccuaccuggugaguaccaucuucuuugaaggaagacuaagagccguuagaacgaugauucuuucuuucugggauaggguuuuucuguguacucgaggcuguccuggaucguuuucuacagaacagauuggccuaggucggauguccucuugccuaugucucccaagguaaagacagcgagaugagacuacugugucu

SEQ ID NO: 6774 - RNA, 1247 nt, Mus musculus
augcuggcuuuguugcuaagcugugacauccucccccaauuccggucuuacccgacuuucucuuggaagggcgaucccugagcagaucccaucagcccuuuggaacaaagaauuugggaaacuuagggcuaaagucgcuuuuuccuccucuuuaagccguaccugaacaucucacaccauggccaccaugccaguuccugagacccguuuaaaccacacuauuuauaucaacaaucucaaugagaagaucaagaaggaugagcucaagaagucccuguaugccuucuucucccaguuuggccagauccuggauauccuggugucucggagccugaagaugaggagccaggccuucgucaucuucaaggaggucaccagcgccaccaaugcccugcgcuccaugcagggcuucccuuucuaugauaagcccaugcgcauccaguacgcaaagacugacucggacaucauugccaagaugacgggcaccuuuguggagagagaucgcaaaggagagaagaggaagcccaagagucaggagacaccugcugccaaaaaggcuguucaggguggggcagcugccccuguggugggugcuguccagccuguaccgggcaugccaccaaugccucaggcaccccgcaucaugcaccgcaugccaggacagccucccuacaugccauaccuggcaugaucccgccaacaauccucgcuccuggccagauccccccuggggccaugcccccacagcagcucaugccugggcagaugccgccugcccagccucucuccgagaauccacgcaaucauccuguucuucaccaaccagccugaggagaccaacgagcucaugcucuccauguuuuuuacccaguucccugucuucaaggaggugcaucuggucccugggcgccaugacaucgccuucguggaguuugacaaugaagugcaagcuggggcagcaauagaugcccugcaaggcuuuaagaucacacaaaacaaugcuaugaagaucucuuuugccaagaaguagcgccuuucccuauggaguaccccagucccuuccccccuuccuuggcucagucccugaagguaagucccccuaaggggccuucucagagccaugugagugugugguugccacacagcauuguacccagagucuguccccagacauugcaccuggugcuguuagauugugauuaaagugaguuuuugaaguuugguuuuucaccaaaaaaaaaaaaaaa

SEQ ID NO: 6775 - RNA, 998 nt, Mus musculus
caaaucaggaucugagaacugagcccacuuaaaauugucuuuugcuucacuguucaauugcuacuauuguguuucuuccaagccuuagggugauugccagaauggucuaccugccuugcccugucaccaaaaaauggcucuuuaauuuuucuuaucucuuucuuuucaaaacacauaucagacucaguucuccuuugggaggaucaaagaaaagaaagaugugguuucacaugugauucuuuuuuucuugaucuuuggagaauguacagccacuucuugccaccuggucccucaagccaccuaucagaugguuuggccauaagggagauagcaucagaucaaguaaccguccagggcugaaagacauuguuuagcaguugcagguggccaguugauggcauccugaaugaauaaguaugcuuuucugauagaaguguuuuccacagcaugagccaaguuguggacuccauaaauuccgagaugguguugguuuuguagaaagcagaaauuacuguauaaugaaggugagggucaggugaguucuucagaguuauguaaggaucaauaaugaaggcugucuguucccauagcugggugagggaagcagauacucucaccgagugagugugaugacaggcuugauauagacauaguauuuggacaguuugagaaacagaagccuuuuccuuugaaguaagaagagcagaguuccaugaaucgccagaguuuaaugguccaaacuugaugacaagugacaccauaaaagcagggcauccauccugaugacaaaacuuccuccuguguucuccagccuucugcuccugguuucucuuugugaggucucccagcauuucaagugcccccaaacacuacacuuaucauauugcuaguaucacagggcaggaggagggcuaaauuaagaugugaucuuaauuuagcuuauuucagacacacaaaugaauagaauagaauagaauagaauagaauagaauagaaua

SEQ ID NO: 6776 - RNA, 1912 nt, Mus musculus
ucauauaaacuuuuuaauguaaauuucaauuuucagauaaguaaaucuccucuguugccuaaacuagggcauuauucuuuguuucaguaccaaugacauauuuaaugugacuauaaaaaaaaaagucccacacacucuccuaaccagcacuccucucaaccuuuaaaaauaucuuuuguauguguuuauaugugugugaauaaggcaugcucaugccauggcaugugugugaaugugaaagaauaaucuuagguuuuugucuuuaacauccaccuaguuugagacucagccucauguuuguuuacauacauggcagaugacccaauucauggaauucagcguuucuccugacucugcuucuguccugccauagaagcaccaggauugcagaaacacacaaucguguucagcuuuauguggguucuagugauucaaauuugggucuuuaaagugugguaaucacuuuucccagugagccaucucuucagccccagucaaucauucuuuaagguaauauauccacaugguucuguauaauaaaacaaaacaagagggcauuguaaaacuguaagucucccaguccugaauaugaauuccauaaguccacacuucugacaauuucacagcucauaauucuucccaaaagguacuuuaugcuuauacacaccuauguauuuaugacuccacauuuuuauacaaugguaauacaauuaucacuuuguccugcuccuaacucuacuuaacaaaaugacuuggagggacgcauaaaaaccuaaggcaaugcucaauguuaaaagguggcauugcaugccuguacagaggugugccaucuauuacugauggccauuaaggguguuuguggccuuuuaccaaggaugcuuuacuaaauaucuguguauauuuuacaccuguacaacucagucucucuugaauuuuguugguaaauucauacugauaacuuucugacgucuagaaacuggcuacaaggagaaagacaaaaggcccgcaguggcaauauagaggcucauucagaaaauaugcauaccccagccgucucuuggaaugcuuuuuuuucuuugugaugagucuuuuguuucacauguuguuucagcccauuauuuccugaagcuucuucagauccuuuuccuggaugcccagugagugauggauugauaccauuugcaagacugauucauauggcacuuuuguuuggcuuuugacagguuguuuauaagaauaaugacauccgucuagagcugucucgcuuggcccggauuggagacaccaagaugaaaaucuauggugaaguuguguucaagugugagaacguggccacacuggaucccaucaacuuugagaccccagaggcuuacaucagcuugcccaaguggaacaccaaacguaugggcuccauuuccuuugacuuucgcaccacugagcccaacggccugauucucuucacucacgggaagccucaagaaaggaaagauguccggagccaaaagaacacaaaaguugacuucuuugcuguggaacuucuugauggcaaccuguauuugcugcuugacaugggcucuggcaccaucaaagugaaggccacucagaagaaggccaaugauggggaaugguaccacguggauauucagcgugauggcagaucagguaaaaagggcuuagcauugagaccagaaaacugcaguagcugauacauccuugccuucccuaacccccagcuagcuuucaggcuuuauguauuuaugaugacacuaacuugcaugcucaccugucccccugcuauuauuucuaauggcuacuguaaaaaugauauuuaucaacaagaugccugucuuguggauggcuaguauucuuagcuucucuaucauucugcacaauguucucagcgauaguucua

SEQ ID NO: 6777 - RNA, 1563 nt, Mus musculus
ugguuugucuugcugcauuagcuaagacuuacaguaugauuuugaaaagcaguggugaagaagaaaauccuucucugguccccagucucagcuggaaagcuucaagugucucaucacuaaagacagcuguuggaaucuuguugcugugcuuuaacaagauaagaacauuccuuuauaauuuuuuuucugagaaauuuaaucuuuuucauucauucuuugacaggcucauacauguagagaauuuuuagucauuuucacaucucacauaccuuuugcucuucugcuaaagccaucugcuacgcaagaaaugucucuccuucuuucaugcaaauuuuugcgugaccaacagaguuuaauuaggguugcuugcaugaacaagggugggagauuauuuacuggagcauagauaauuuucaguggcuauccuucugaagaacauggcauucccuccuccaauaaccauuaucugcuaguagucccuccuuggggagaguagccuccucccuucccugacuacauguugucaggcccagaauuguggaggucagcuuuagugcagggaaucagaauuguacugcaaugagaucauuugcgcuuaaaucaugagugguuuuuaaauuuucucaauuucccauuucugaaucuauagacgugaucuuguggcuuuucuacuuuagcuuauuaugacuaaacaguucucauacuagauguugagcuagccuuguauuuaaagauaacuuuuaauacaauuauacuucauucaccaaccugggggucaggauuguauauuuaugacuaugauaaauagcauuuugcaguuuuguuuuuaauaucuuuauaugggcuugguguuaagagaguaaugaauuaggaaguguuuaccuggauucuaaaaacuggaaagaauucaaaugauucugaaauucuuaacugcuuuagaauuacugagugaaucauauggucuagcuuuggaagguuauucauuacugauuuagcuucucagauagauguuguucuauuuaacuguauaguucuucuuguggaaguuuaaaaaauacuuuucuucugcuuuuuguugagaauuuuaaauggucuuauugcuuuuuuucuccuuuguauauccauuauacuuucaaauaaaguuccaauaugcaacuacaagauuuacaauucuguuuucaaauagcacuuuacugcauuauagauuguugugucugauacuuuuugguaauaagauaaaacaagucugauuccucucuucauucuuaauaugauugcugcauauauuucacaaguacaagagcauuucauauauauauauauauauacauauauauauauauaauuucacaauguauuguuaauauuuuuaaauaacuuuaauuaaauaauaauaaaaauagucauuuuuaaaaucuuacuugaucuuucagugaugauuuuucucuuauuucuguugacucuaaugucugaccugucuuuuaacaauuccaacaaacuauguauauuggcaauacauuucaugaauuguuucaauuuauguaagcaaguguuucccucuuu

SEQ ID NO: 6778 - RNA, 1779 nt, Mus musculus
uggguuuuuugagacauaguaaguguuuuaauggguuugauugucuuaguguucuauuguuaggaagagacaccaugaucaccgugacucuuauaaaggaaaacauuuaguugggguugcuuguagguucugagguuucguccauuaugucaugguaggaaguauggcagugugcaggcagacaugcugcuggagaaggagccaccaaguucugcaucuagauuggaaggcagcaggaagagagagaaaccuugggucuggcaugaucauuucaaaucccgaagcuccagauguacuuccuccaacgagaccuuauuccacuuaccccaguucuuucaaacagugccacucacugagccuaugcaagccacuuccauucaaaccacugcaucaacagacaguuuccaaaagaagaaacaaaaugaucaauaaguauuugaaaccggugcucaaugaccuuagccaucaaggagauccaaauuaaaugcaggugaggauguauaaauauauacugcuggugggaauggggauuggugcagagcuccgauagagauuuguguggaggggccucacaacaucaacaaagacaacaacgaaaccuaaaauggaacuauuauauaacuuaaccuauaccucuccugggaaucuacccaaaggacucuaagucuacaccccauagagauaauauuggggaucaauaacaccccacagagauaacaucauaauauuggggauugauaacacccaacagaagucaaucaaggaagcugaagugguaagcuacaguucccaguggaguucacagugagcgccuggcacuuggacccugggcaggcauuauuauacuaugggguaaagaaugguaacaucuguuagaaauaguuuacauucuagcgguucucaaggccccaguguuuuuaacuggcauaucugucaguuguuuuccuuucucuguguucugacuuaaguggccagucugccccaggacagggacuuugggagggcaauugugacaagcaugccuggaucugaagugggggguggaaggacaaccccaccaccagagcccaacuucuuggugacuucaaagagcacauggaaauuuaccuguauaguuuacauuuaugaucaguaugaugcuccugagagccaguuagagcaaggucaggacucagauaggaaagugggugauccagcacucuaguaguccauuauggucuagaaaaauuuuaaaaaaagaaaaagaagaaggaaauguuuucuuaaaguuuggguugguuucuuagguaguuuucagugaacacaguuguggaaaguccccaaggauggugucauucaucagacucucccaaaacuucaggaagcuuguguuucugaaggugcugagcccugguuuaccaccaaaagggacugaccugaugacuaugaaggugugugauagauuaagcuacugacuccagucuauuacccuuucacgugugcacguucuuugccuaugacuuuguaguucacuaaggaaggaagggagggaaggaagaagggagaaagggaggaaggaaagaaagaaggaagggagggaaaaaagaaaagaaggaagaaggcaggcaggcaggcaggcaggcaggcaggcugguuguuuuuaaagcuagucuuaggucuacuaucacuguaaugaaauacuaugaccaaagcaaguuggggaggaaaggguuuauuuggcuuacacuuucacacaguaguccaucacugaaggaagucaggacaggaacucaaaugagg

SEQ ID NO: 6779 - RNA, 478 nt, Mus musculus
auucgagccaggaacaucuuuuauuugcauuugagguuuuuuguuuuuuuuuuaugacuagcaccaguugagcaaucucaaguugcucagccuuucaggaguuugcuucuucagcgguugggagagagauggaagagggagugacaucauggagucaucauuauaauccagcucaguaauguaugccaaguaccuugguguucagucagcgguggagaugucucuuagcggacagagccauucuccguucauucuucccugcgcacucaucuaccucagauuuaccucagauuuaccucagugacgcaguggacacaauaaaggcugugcagggaacgacacaaacaaagacuuauuauaauaucaaugcuguuauggaucaugauggaaauauccgaguuuucugaugggcuuaggugaccccugggaaaaggguuguuugaucccuacccuagcuugagaaucacugcauuaagcu

SEQ ID NO: 6780 - RNA, 509 nt, Mus musculus
cgagagugaguauggcugcggggucgcggcucugaaauccggcgccauccgcgccuggcgcggggugggcaggcucgauggcucccgcaaagaaggguggcgagaagaagaauggccguucugccaucagcgagguggugacccgagaauacaccaucaacauucacaagcgcauccauggaguaggcuucaagaagcgugcuccucgagcacucaaagaaauucggaaguuugccaugaaggaaauggggacaccagaugugcgcauugacaccaggcucaauaaaaccgucugggccaagggaauaaggaacguugcauaucacauccgaguacgcuuguccagaaaacguagugaggaugaggauuccccaaacaagcucuacaggcugguaacuuacgcgccuguuaccacauucaaaaaucuacagacggucaauguggaugagaacuaaccugcucaugucaaauaaaguugcagaacugccuucaaaaaaagagaaaacuca

SEQ ID NO: 6781 - RNA, 57173 nt, Mus musculus
caacacaacagcggcugcgcggacagcccgcagcccucacuuaagauggcgaaagcuuccucagccgcccgcucuucuuccucagggaggcgaucgggcccgccuccccgggcgccacagucgcgugacccgcacaauggcuaacagccaaccuaaggcuucccagcaacgccaagcaaaagucaugaccgccgccgcgggcucggcgagccguguugcggugcccuuauuguugugugcgcugcuagugcccgguggcgccuacgugcuagacgacuccgacgggcugggccgggaguucgauggcaucggcgcagucagcggcggcggggugagcgcgggcuggcgggaggcaggagugcggugcggcgcagggaccgcagggaccgcagggaccgccggggccgcccccucccacaagcccccgcggcguugccgggcgagcgcacgccgcuuccccgcgcgccggggugagaugaacccgggcuggcgguuagauugcaauggggagccaggcgucucgaggggacaggcgucugcugcagucaaguggcccgggcucgagggagcccucguucuggaucgccggccagggcuguccuugccgcgcuggaagggucgccuccggaaaaagccagagagggacugcgaagccucagcgagaugcuuuggggagggggggggguggguucucuuccuucccagggaguuaguugguggagccgugagucagaagacauaggcaggguuuggggacccuucuugaacagugauuagcaccccgucccucccuguaagaccucuuggacucuuuagaguuguguaaagccugaagcgaucugggauauuguuuuaaaagagggccaccuucauccacuaacagaaacuguggcgugucuguguuggaacgagggaaugcuggcucuguuagggcacauaagaaucauuaggugcauugguuaaaauuuaaguugucuuccucucccauucugacuuuguuaauaaacaccagcuaauucucaaaagaugaggucuugagagugauuucuuguugacucaaagaucucaggacugggaaguggguuugcuuuuaaauugaaaucuuaagaguaguuuuagaucuaccgaaaagcuaggagugcaguaaaaaguucuauaccccaguguguguguguguaauaaugaacuaaucuauucucaguuuauuuaaauuuaaaauagccaauauuucuuauacaaccuuaacgucuccuuuugguaucuuugugauaguaaaucuaaguguaaaggcuuuuuuaaaaaaaugagauuuccaguuuugcuuaauuuacucaacuuuuaauuauuaaaauaauuucauaaccuggugugauguaguaagccuuaguguguguguguguguguguguguugggaauguuuguacaugugaguacuggugcuuacagaggccagaagcacgugaguugccaucucuccagccuccagagcagguaaaucuauuaaauagucaguuaguaaugucucuauacuauguuauguauuagucaguuuaggaaaauaguaaaugaagauggaugaccauuuuauuuacacaccaguuuaaacuuguguguguacaacauguuaccuagcacaguuguagcagcacuuagauugcccucucuugacuuucacauauuuagggaaagcauuuugcuucagugguuggcaugugggcuuccgagguugcuggaaucauucuggcacaggacacucaccuccugguuuugacaaguuaguucauuuuccuuugcuuaaguuucucuucugagggaacaaagcagcugggggugggcgggugguagcauugugaggacaggugugauuagccaauuaugguucuuguucccucuuaaggguuauggagggggaaguuguuuuaagauuucacggugggauguugguaaagugccccauacccuaguuucuaauacuacagaaauacugcauacagcaaaggggcguuuugaccaucgagagacacaguuaccaagacacaagcuguuuauggguccuuuugcuaucuugucuucacugcuuucaaccuagagacccagugguuuccuugguuaccuugugucuaacaccuugccuauucauugauaacagccucccaaaguauaggucuuugauucacuauuggcuuuauaauuucuuucaggcugucaucugggucuagguauggcuaaaucuagcuagugcuuauacuuauucuuuucuuuuaagauaacacaaguuuauuuaugcaaaguguuaggggccagaagucuaagugaaaacuaagcuuaucucuccaacucuuacacccucauaagaaaacuuuagcucucagugauuggauacagaccaaauagcauggcaaaugacccuccacagcuccguuugcucaugcuggggcauguguguguguguuuacacuguagacaaauacagaugauuauacuuguuuucuucauauuuuugaaaacauuuuuuuucccccaggcaaccucccggcuucuaguaaauuacccagagcccuaucguucugaaauacuggauuaucuauuuaagguaaggaagaauaauuaaaccaacgggccugugcuauuuugaaaagauauggugaaguucggccuuagaguuucucagcuuucugagagaaguuuggcucucccuucacugggcugccuaaggccucuacgagguuuuaccugacagagcacucuaauaacacuguuacuuuuuuccacagccaaacuuuggugccucuuugcauauucuaaaaguggagauagguggugauggacaaacaacagguaggaggauuugggacaagggguuucccugacauuuuaccuauccuuaaacauaugggacggaaggaaggccgccucauuugaggagcugcucuuccgcagaucagcuuuuauuucucuccauuuauguuuucgggugugugcacguguguaccuugggcucggugacaucaccuuccuggucuggcuuuucuuauuuugaucuuuaugaaucauguuaaauguaaaauuuccaaaauaguauugagacucucgguugcucauuuaguugaaguagucauuagagaaacacaucuaguuuucuaaaaaucaugcacauuuggaauuucauggaaaaguuauaagaaaaauuuaauuauuagaauauguaagauguuauuaacuuuaaaaauguauuguagaauacaacacauguauuuuagagauacagauauaguuuuuuaaaaaaauaaacacaauuuaaauaaagauacaaccuucauaaccaaauuuugaaguacuucucucaguaauuagauauacuuaaugauuauauauaggucaaguccauuaauauuacuugagagcauuuucuguauauugucuuccugcuagugauuucaagguaauuucuuaaaaaaacuauuuauuuuuauguaacaaauaugcguguuuuaucuguauggguauauguauaccaugagcgcguacuuagugccugcagaggccagaagagaguacucagcuuccugcaacuggaguuuccaguagcugugagccauggaaugggugcugggagccaagccaaugcucucugggggagcagccuuugcugcugagucuccucugaguauguacucuuccuggaguuugaggacaaaagcccuggcuuccaguguaauaaccuagguuuggucacuuauccgggacguggcaguagugacggcaggaaggcccucuuaucauccagacacucugaguaauaagaaaaaggucuagugacucuuggcuuuucuuugaggagccacaaggacuuugaggcuugauugaaaaggggaaggaaggcuuuaaucugugguuugguuagcuagaguuaugcauaguuggccgagcagguaaccuuggucaggcuguggucugauuguucauucuccaggcugcuucugcaauugucccgagccgucuucucccuugagcgggcagcuugauucucuuucuaaccuucggaaggcucgugguucuuuggggaguaguuuuaaucuguugugauaacgguguuuguggaucagaacuguuuuucuuagaauacaagguaacugcagggcagcccaauuuaggagaccucagaaggaaaauaguuaaggaggcaaaaugaagucagagagggagaaaaugagagugagguaggucagucacugggcccugcgucaguauucaugcuuuauuuaugcugaaagaaaaaaagugaaaaucaaagccggugggaaccucccuaacagaagcuugucuaagaaacacgucuuauguugaaaccguuuagauggggagcugaugcugauguguggugcauuagcggaagcuauugagcacuaaggauauauaaguuuaguucuuaggaguucucgugcugacauuaaagaagaaaugggccaggauccuccucagaaggccccacuuugcaaagacuggugucucugaaccaugagcgcacacgagcucuuugaccucagagaccuaccucuggccuuggugguuccucugcuggcuuugagugagagcacaggacuuggcucucguuguaguaggcauguagagcuugcugcgucaugacuguuauauuguagaauauaaggaucggggcucaggaguacagggauucgcagccaagguggggagggagagcugaggugaugcggacuugagcuuggaaaaccucagauugaaagcucagcagaacuuagucugggguuauucaguaauaaaaugugauagcaucugucucaguacugcuuuuaaaauaacauuguggcuuuauuauuuaagaaccuuauaguguuuaagauaaugaaaaauauggaauaagauacuuugcaaagccccuucuuacauaauucucaucugcacaacuucugaaccagaacuagaguagaagaaaaggaucacauuaaaaaauuguuuuaguguguguuugcaugcaagugugugagaaugugugagugugugugugugugugugugugugugugagagagagagagaggugcauguaugugugugaguguguguguauggugugcauguguguguacuuaagaggcucuggaaagcacacccuugggucacgcccuuccuucugcucucccuauucagauggcacugaacccucgcacaugcacuaugagcuagaugagaauuauuuccgaggcuaugagugguggcuaaugaaggaagcuaagaagcggaacccagauauuauacuuauggguaagguaaaacgcuuaggacucuuuuuccuuuaacucuuaaauuuggaaucaugcaugcgaagucucuuuuaauacuaaaauacuaauuuuuggauauuaccccuauacuaccagcuaugaaacauauaccaggaaugaaauuucauugucauuguuuauuaugcugugucuccaagccuugauugauaacuugauuuuuugagacagagucucccuuuaugaccuaggguagccuggaccuugcuguuagcccagacggacuucuaccucauucuccugcugucucucaagugcuaggguuguaugcuuccccaucaugccuggcuugcuuuuuuaaaaccuuggugucuuaggguuucuacugcugugaugaaacaccaugccagacaaugcaagcuggggagaaagguuuuguuuuguuuuguuuuccccugccuuacacuucuggaucacuguguaucauugaaggaagucaggacaggaacacaaacagggcaggaaccuggaggcaggagcugauguagaagacauggaaagaugcugcuuacuggcuuucucaacaugacuugcucaaucuucuuuuguauagaacucagaacuaccagcccagggaugguacaacccacagugggcugggcccuccuccaucaaccacuaauuaagaaaaugcccuauuggcuuacauacagugacaucuuauagaugcuuuuucuuaauugagcuuccccucucucugaugacucuagcuugugucacguuaacauaaaacuguccagcauccuuggugauguuaagaucaccagagacuggggauucuaaacaaauucuguaucuaguuucugcccauauuggguuuggauauuagcauuggacacaacuggauaguugcucaagcuggucuguauucguuuuacaauucuguagccgcaugaaguacuuuaauagccaaagcauagggcuuuuaucacuugaaguaaauuugcuauuuugauuauguucagacugaguuaaauaaaauuauggccuauuuuaaauccuggaaguuauugaaaauuaguucccuugauaauuaaaggaaaagaguauuauuuuucaaauuaaaagagcaauggagacuauuccuccaaauggguuuuuaaauaagagauuccagaaguguuuggaacagucuaagcaucaaugacuugggcacaugcuccccacuguccugauucuaaggugaaaccucauguaaauguagauguucagcaugcuaaaccacacgcuagcaaugccucacacucuggaccuucgcuggacuuagcaacacauugucuuuaaaggcucugcuguugcaauguccuacuuuuuauauagugaaauuagcuuaggaaaaaaauacuaugucugguugauuuugauuuuuuuuuuuuagcagcaaacuagauuggucauauauuuaaguggaaaugagcugcugaaguaggacuuaugaucagugccuuucaguucucucuccugacuucacaggcucacugaggucauacacaugggugagguucucucacccugcugcgcuuuccugcuguguuagguuugcugaucuugguugccugaccuacugccaguuaaccuuaguuuguaaggugauauccuugugagucagaccuuuaccuugcucugaucuugacgguuguuuuggaauaagcuuucagggcuccucagguugaccacagagaacaagagugcaauauugaacaucccugaagagagcagagauguuacaaugugccuuucuuucuguuagaaaaugcugugagggaguuuuuuuuuuuuuuuaauuucauuucauuucauuuucuugaaaggacaguagcaaguauaggacauagcugucaggauuaguaagaaaucuugguuucuauugaauagaaaugauuuuuuguauuugcgugugguggggucucuccuuucagccagauuuaugccugccuggcgcaccaguuucucaccugucuccucuuuugccuacaggguugccauggucauucccuggauggcugggcaaaggcuucagcuggccuuauguaaaucuucagcucacugccuacuauguuguaagauggauuuugggugccaagcauuaucaugaccuggacauugauuauauugggguuaguaaccuaguuuaacauacuuuauuuuuaauuuguauauguauaauuuuagaaaguaauuagauuuuugaucaguuagaaaggaagauuuacauccauacuuuagguauagaaauacucuuugcauguugcauaacaccauaacaggguguuuugauauaggcuucauuuuuuaauuauuauuuauguguauggguuuuuugcuugcauguaugucugugcaccauguacauguaguguccucguaggccaguggaagacaucaggucucccagaacugggaguuacaaaugauugggacccugauugugggugcuaggaauugaaccaagguucucuggaagagcaaccagugcucuuaacuacugagccaucucucagccucuuguuauaguuuuaagaagaaaaaagggaaauucuuuagguuacaauacucagagcagauuuuaaaaagcucuuguucuaacuugagaggauuggggaucugcagcaguguccaucucucacugacaagagcucacaucgcuguuguaacacgacagccacuguccuaccacacaguagaaacucaggacaggcucgcugauaauuuauauuuugagugcaugaaaacuucaaaucaauuucagucaacgaugcauuaaaacgcaaauguuuauggauacccacucugaguaugugugaaacuuuugggguacaguuugaaguauguggcuagccuccaggagucaaaaucaauaaagcugcaauauaaugcuuuaaacuuuuuaacauauuaaaagauguuaaauaacaguuuaggaaagaaggaggcagauuuccagcagccugcaaacucuuguucaucaccuguauuuucaaggucuaagagcgaacaauagcuucaguuucaaauggucacacugcaaaugcuuagguaucuuacuaucgccaaugaccuauuaaugacaaucuaauauuuauacacuagcucuuuauuaaaaaaaaaaaaaaaaacucaggugaacccugguuuaggguacuaacagaaaacucaccaaaaugagaauaaguuuuaaaguauaaagaaaccagauuguuguuuaaaaacuagauaaaaagcuuugaaggagagccaaggaggcagcaguagcacacaccuuuaaucccagcacuaaggaaggaagcagagguaaguggauuucuaugaguucaaggccaaccuggucuacuuggagagcuaguacaaggacagucaaaacaaacaaaaacaaaacaaaacaaccacaauagcaacaacaaaggcuuugaaggaaaauuugaauuggauugguaccaaaaaaaaaaaaaaaaaaaaaaaaaaauccuaaccacaggcaauccaaaugcagacuuguguagucccauccaaacggauagaucuacaaaaccgucccagacacaccuaaggcucagacaacacuccaguagaccaggcaauaagacuguaagaggcucagggaguuugcagugagauuaugacuccucggaaugucacaaaugacacccauaaaagucucaccaccgugacugcacaaauaggagcugaacaaggacaccaccagcagacaggccgaagcgcaggaggaagccaugaggccuuacagaacuacaggcaacugaggaaagaugugaggcggaggggugaucguccccagagaaaagcacaccagcuggcugucuaaggccaaauggccagccccaaaaacauacauacaaguacauuguauggacgaucaggcuguauguaggaauauauauguaugcauacacauagaugcuugcaagaacaauuagugaaaaaagggggcggggaaugugcagagucaggaguggugugggagagggcucggagggagguaagggaagaaagccaagugauuuuacucucaaacguaaaauuaggaaaagaaaacuugccaguugaaaacauuuuacuguaaaaaaaaaauugaaaguggaggaaaauauucaguaccauucaaaggcaagaauaacuuagacuggcaaagaguagcaacaagaggucagcugcgguucauuuguaauguuauuagacaccaaaauaacaagucagucucaugacacaaaaggauuagucaucaaagagccacagcagcaagcacuagguaggaggaaggacuaagccuuuuuuuuuuuuuuuuugguuucgacuccaucauaggugauuuggcuugguucuacucaugguugaucuaugagcucagcuuucuguuucuccaaaugacaaggaccauuuaugcauucccuaaaaaaaaggcaacauggcguuuugggggguuuuguuuuguuuugaggcaaugaucuaaaacuugggcuuccucucaaccacacugacuaggaauuaaauaaauugaaaauacaggugaugaacaagaguuugcaggcugcuggaaaucugccuccuucuuuccuaaacuguuauuuaacaucuuuuaauauguuaaaaaguuuaaagcauuauauugcagcuuuauugauuuugacuccuggaggcuagccacauacuucaaacuguaccccaaaaguuucacacauacucagagugggucuccauaaauauuugcgguuuaaugcaucguugacugaaauugauuugaaguuuuuuuuuuuuuuuaagccugaaguggcuuuuuauuuuuuuacauuuuuuuuaaaauuagguauuuuccucguuuacauuuccaaugcuaucccaaaagucccccauacccccccccaauccccuacccacccacucccccuuuuuggcccugggguuccccuguacuagggcauauaaaguuugcaaguccaaugggccucucuuuccagugauggccgacuaggccaucuuuugauacauaugcagcuagagacaagagcuccgggguacugguuaguucauauuguuguuccaccuauaggguugcagaucccuuuagcuccuuggguaauuucucuagcuccuccauugggggcccugugauccauccaauagcugacugugagcauccacuucuguguuugcuaggccccggcauagucucacaagagacagcuauaucuggguccuuucagcaaaaucuugcuaguguaugcaauggugucagcguuuggaagcugauuaugggauggaucccugcauauggcaaucacuagaugguccauccuuucgucacagcuccaaauuuugucucuguaacuccuuccauggguguuuuguucccauuucuaagaaggggcaaaguguccacacuuuggucuucguucuucuugaauuucaugcguuuugcaaauuguaucuuauaucuuggguauccuaaguuucugggcuaauauccacuuaucagugaguacauauugugcgaguuccuuugugauuggguuaccucacucaggaugaugcccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguugggacaucuucuggauauaugcccaggagagguauugcgggauccuccgguaguacuauguccaauuuucugaggaacugccagacugauuuccagagugguuguacaagcuugcaaucccaccaacaauggaggaguguuccucuuucuccacauccucgccagcaucugcugucacaugaauuuuugaucuuagccauucugacuggagugaaguggaaucucaggguuguuuugauuugcauuucccugaugauuaaggauguugaacauuuuuucaggugcuucucagccauucaguauugauuugaaguuuuuaugcacucaaaauauaaauuaucagcgagccuguccugaguaucuacugugugguaggacaguggcuguuguguuacaacagcgaugugagcucuugucagugagagauggacacugcugcagaucccuaauccucucagaggaacauuaagacaugaggaugagccauggccacaggcaggcagucaagacuuacugcuuuucucuccuuuuuuuucuuuucuuuaauuagguauuuucuucauuuacauuuccaaugcuaucccaaaagucccccccuccucccccccacucccacuucuuggcccuggcauuccccuguacugaggcauauaaaguuugcaagaccaaugggccucucuuuccaaugauggcagacuaggccaucuuuugcuacauaugcaacuagagacaugagcucugaggguacugguuaguucauauuguuguuccaucuauaggauugcagaccccuucagcuccauggguacuuucucuagcuccuccauugggggcccugugaucuauccaauagcugacugugagcauccacuucuguguuugcuaggccccggcauagccucacaagagacagcuauaucuggguccuuucagcaaaaucuugcuggcauaugcaauagugucugcauuugguggcugauuaugggauggauccccggguauggcagucucuagaugguucauccuuucgucucagcuccaaacuuugucucuguagcuccuuccauggguguuuugcuuuccucuacuuuuccacaauauaacugacuguuuuuaucugggaacuuuuuauuuuuaaauguugguccauuuaacuaaugugauuaaaugcagauggaucucuuagauuucugauaugguacauguucacaaacuauuuccugugaaugaugauaaucugucucauuuuagucucugguuagucacaugcaguggggaggcguucuuuagauaagaucuuuaucacaccuagacuuaggcuccucuguagacuacaggacuggaggccccgagguucccuuucaccacagaaaccacccccucaggauucugaaucgaagagaacaaagugugcuuccuucucacuuccucaccaagagccugcucuuguguucuugcagaucauuccguuccucugcauaaacaaacuccuucuaaccauucccugguaaagaacuugcuuuuuacugugucuauauauuagaauuauuuaagugguucucauaccuguuuguucuccaaauguccaguguaggauuuguacacauuauaauucuaauauuuauugcaugaaugcauauuaaucucuggaauaaaugccuuucuuugaaaaaauaguuuuuauauauaugaguauuuggcuguguaucuguaugugcaccacauauaugccugcuguccacggaggccagaagagggcccuggaucgccuggaacugaaguuagagaugacguuggccacuacagugugcagggaaugacuggcccucgagagagcaccgagugcucuucauguuggauugucucuccagccccauacaugacuuuuugaaaaguauucccuaaauacuuuuuaaaaacuugaaaguguuaaaaguuauuuugcuuuacaaaaguauaaauucuaugacagcaguuuuuaaaguuuggaaacuagcucaucagauaaaugaaauguagugcuuuaaugauucaguucaucuuacguuugaaaacuuucauuucagacauuuugaauuuuuguuuugcagauuuggaaugaaaggccguuugacgccaacuauauaaaggucugugaaacaaaucucucuuugcuuaugcuuucauacaaagaaauuuggagaacaguuagauuagaaaucuuauuuuuugacagcauaguuaauuugcuagaauuugcuagaugugacauaaaauaugucuaugcuccugauauugaagaauauguauguaauucuucauagguccugaauggccuauaucugaagaguuggguugaauguuuuuuucuuuuuuggaguaggguaggguuuggcuaacaguggaauucaugcuuacuaguucuaucuucagcaucaaaagaaaaaaaaaaaaaaagaaagcauuagguaggcauaguucuacacaccuuuaauucuagucccugggaggcagagcugggauucugagguuuugaggccagccuggucuccagagugcagucagugcuguagagagcgaccugaccccaacaagcuagcguguauaugcacugaugaguacauguguaugugcacgaccuuaguuuuagaauucugauagacauuagaaccauuggauuauuuuggauuuuaaagacuuaagaaauuuaacuuuauucguuaucauauuucugauauuuuugaaauacuuaugacauuguuggaguguguucuaguuacauuuuugccuguuauaaaauauucugaccaaaaagcaauuuugggaaggaaaggacuuaucuggcuuauguuucuaaguuugucauuaucgagccaaaugccaauuuaaggagcauggagcagaaacuugggagaaaugcugguccuuggcucacucucggguuccugauugcuaccuuucucauacggcccaggaccgucuguggagggauggugcugccguuagggauugggccuuccuguauuaguuagccgucaagguaacccccacagacauggccauagggagaucccucaagugagacucucgggugacugucggcugugccagguuggcaguuauagguaacuaggacagaagauguucuauaacguaguucugugugaaauuacugaacagguauccugcacugcuuuucucagggcauuuuaacaccuucaagucccucuggugcucuugucgucaguuuuaagaaacagaaaagugaaaguuuugauuccugucauuggaaaaacccaguaguuuuacuucucagauuuagcuguuguuuucuaguuuauuuuuuaucgcuauuugucuugucacguguguauguauauauauuuuaacaaaucagguguauuuuaacaaauauguguuagaaggagguaggguauuguuuugagcagauccauggcaaccacagugagguggcucagugucacugccaggcugcaggcauggaguaggaugguaaaagaugaugucagcgcaguggcaaagguuaagagguaguuguucuggagacaaaugcaaaugacuggucuaggaacagauuuaucuugcuccaaauuucauauucaguguagaagcagauugaugauguuccauaguaacagaacaaagaaaguuauaaaucaagacacuugucaaaugcauuaguagaaacauuaaguagguggucacagcaaagcagaaagaucaacugcacaacaaagcagaaagaucacuguaggcaucagacguggucuaaugacacuuugggcuuguuggcugguagaaacuagaaaauaguuaaguccugcauccccagaugcuuuuccuguuagccguggaggguuagaggaccaaagguagccuaugaauuauacuuaggcucuggaccuggcacauuccagccucucccauaacugaaguucugaucaaucuacugcgucuuucuaggaguucuuguucacagaguuggaggcuggguugggugugggagguggcacagugggugcacaagauuauuagugggaggcuaugagcuuuaugagucagacagaggcaggaacagaagccccaguuagugccugccucgcauagugcuugugauaaugggguuuguuuuauuugggggaacauuagaguuaacauuuggcuuucauuuucuuuuaaguuagugauuggauugcugcucugagauucacuaucgguguuuuugagucgucagacuucauuuaucuuucuucugaccuugaguuuuccuaaaugucucaggauauagaaacauguaauuuaugcuuucuauuuuuagagcaggaggguuuauuggguucugugaucugcugaaauuucuauugcagagugaaaucauuaggaaugacuaagguacucaguucaugugacuuuaacgaauacuuagucccugguguguggcgaaauggcuucuggagagaggaaggguuuguucuucacacugaaguauauauaauaccaguucuuuaugucuccugucaagugcaucacuuauuuugggauugcuuuugcuguguaguuauguaguuauguuuaagauugacuuugguuucaggguaauuuguaauuauggugucuggaaccccccuugcaguaucugagaguuuuagacagagguggacgugugaaucucugggccucucagaccgucgagccuucuuuaccuguagauagauaagugggugugguuuuguggaugggugggugugguuuuguggaugggugggugugguuuuguggaugggugggugugguuuuggggagagaaggggugcucgaugacguuugagcugucguaaaacucugcuguaaucacucugacugugagauagaaacugauucauaaaucacagcuuacagacugugugcauccacuguauuuaaaaauauguacaaaauuccugaugaaucuuuaagaguaaguucauaaagacuagaagcauugacagugacaaaugaaugcaagauugacuaaguuuuuuuuuucugcaagaauaagaaaaaaacuugaguaauaaaacacaaaauuugauuucuaguauaggguaagggguucuccauccuauugacguuuugaaguccuugggagaugguuuccaccugucacuuuaucugucauuauguuucuuaaccuaguauagcauacaauaucauaaguuuaaaaaaaucuauuguaaaguacaucauggauccaauuacaggauuuuuuugcuucuuuaaaaguacauuuguugcaaauuucauuucagaaaacuuagaauguuaaaaagaacauacagaaaacauacagagggaaaaaauaaccauuauuucuacauaauacucuuugauaaguuucauguacgcccauccccuccaacuccauacuucuguuguuuagcauaauuuuaaacucaggaggaagauagaugccuccacugcauuaugccggacacccaguccucugagaagcagugcggauauuaucguuagaauguagaauucugaaagauacgcuggcuauuuuggucauauuccaguagcuaaaggcucacuuguaaccuuugcuguguccuguuuaugucucccaaggaauuaagaaaaaugcuggauuaucaaggucuccagcgagugagaaucauagcgagcgauaaucucugggagccgauuuccucuuccuugcugcuggaccaggaacucuggaaggugguugauguuauaggguaaggugcgauuuacuuugaccaccaacaguuugugguuucuuuacccugguguuaacugugcauuucuucuugcccucucugccccuggauuacacuccuauggcaguauuuacucgguaagacguugauugcucacaguucauuccuuucucuuugagauguguauuuggggcucugugacaauucaaugcauuggugacuuuuuaaauaaaucaguuaauguuuagaguaauaaaacagggauuuauuuagauuuaaaugcagauauuuaauuuuagaaguuaccaaggcaaugaaauuaguaccuaacugaguuuuccugugacucuguuccugugcagacaauuauaugcacugacuuuagcuauuuuauuguauccuuaguauuuuaacucuuagacuuuggccucuauuucuuaauccauuucugccuuacagcucucuggguccuaacuuuguccugaauuguguucagcaauuuguuuuugaaaaguagacagguguucuauguaucaugacagcauauaagccuuugaagccuaccugcguaugaaauuugauuuuuuaaaaucaguuaggggauggcuuaaucucuucauauacuuuauuucuaaaugaaaaaucuuggauuuuauuuuauuuuuuuaguacguuaauuuugucuuucaucuucagugcugggggucaaggccagggcugcguccaugcuagggcgagugcucuaccagugcacucuauucccacugcaaggguuuuccguguacacagaaguaagccggacaaugagugaguucugcucacuccgccucugacaguaagaaccuguggccauucuucauucccgugucuagccucugcuuuucccaucuuguccguguucuggaagagacuuagacuuugugcuguaugucuucuguguagauuuuaucaugucucuccaaugauguagauucuuuucccguuuaucguaaauaauaccauuauuauaacuaaacguguaauuguuucuugauauuaucaauuauugcuuauuguuuuauaguuuuaauugcuuggaucugaguccauuuaauauuaauguauauauuaauguauuggaugguaauucagucucuuccaauugauuuguaacucaguccuuuuagcaucugauuuuuuauuuuuuauuuauuuuuuguccuuuuagcuaacugcagaaacugggguuguuuguucugugagauuuucuuaguuuagauuuuacaaauuguauuauguuucauuuaacauaugucuacccuauuuuucuggaaaaauuuaugugauuaaauuugucuugggcuuuuuuuuuugcaaaagaaaguguaauuauaaauuuauguuuaagcacuucacacaauaaaauggaagauuuugccuuucacuagagugugugugcguaaguagcucaggucugagggaagcaaaaguauucuugaaugauuuggcuaggaacgcuauugaguuggaggauacuucuauuauacuucaggagaaagaacauuugcuguuugauuacucauugcucauaugguauucuggcacaaguauuuucccucugagccauuacuuuaguguauaguuucuuuugcucacauuaaguuauauaaugguaaauguauuauuuaaauuuuuuuccuagaggauuguuuucugccuuaggcuauauuaucuacuaggggacagauugggcucaguauguaaauccacuuguaauugcauuguucgggugaucugugcagagcugccuugcauauucccucuuccguccguccuucaguccuccaguuuugucugugagccuugcugcccaguuacuuguacauagcugagguuuuaucucugugcuuugugacuauuggugauagagaaugccaucccgugacucauucgguauuucuuaagcugaauuuugcuuuauauaugauugagagaaucuugcuuucauuucuaauuauuuauuacuuuuaauuaauucuuuuauuuucaaggucauuuuauuuuagauacauuucucgcaugaauuagauuuugcuuucgaauacugcucugaaaaaaaaaaucauuguauuucuuuucuuuuuagauauuugugguguguguguguguuuauaugucucauguaauaugugcccuuggagggccuugaacccucuggagcuggaguuaagaguuugugaguugugugcuguguguguuuggcaacuggauuugcagcccccugauaggagccgcagcucugguaaccaccgaacuaucucucccgcccgccccguauuuaccauuuaugguauaaccggugcuuguguucuccauguuacagauauuuucuguuauugaaugaucuauaucaugauucugcuaugguguuugccuuuuugguucuuguuuaaggaguuauuuuuaaccagacuuguuuuuguuucugcuguucacagugguucugguuuauaguuugauacugguuguuucagccggggauaauuuuaucuccuaggaaacauuuggcauugucuggagauauuuguaaauaucuuagcuagauaaaagucaugcucuuaauaucuuguggguagaugucaaaacuguuuguaaacauuccugcauauacaggucagcucucccauguaaauaaaaaaacauaacaagccaagaauuucaguccugcugaaacugggaaccugcuuuaagcucauaugcuguucucuuuguuguuguuuauuuuuuaaacaguggugaugagacucaaaccacauuugggguugguauuccucaugcuaggccauuacucuuuuuggugguuuggaucuaagucauagaccuguagcucaugaauuaccacaggcggaacauccauauggaccugucaccagggaaacuguaaaggucucagucacacuaauuguagaaagguauccaaccugacuuguaacuacuaaucugaccucuaacuccagcaagcaguuugccuauuugagaugaguaagauggcuuuuuucaucauuucccucuccugagcacuuagaaauauaccaagaagggaaacaaagcagaaaagaaaaacgauccuggaaaaggauguucugucuuuaaaguuugcaaaucagucagacaugagcaccaucaguaaacaagggaaacaguucgcuuuaauguccucuccgaacuuuggaugcacuuugaacugccagccuuuuggaucacggauauacauuuacuuguucuaguuuaugaaaugaugcacaccuuuagccccaguauucugaaggcagaaacaagcagaucucaagauuucaacaagcuguuuggauaaaugcauuguuggccccguaggauguugauuucgguuugucacugacaaauuccagauaagaaggaaagaccuuuauuggggguuuucuucuuuguucuuuucucugguccaaggcugaucucaaauaauccuucugacuucaggccaggcugugaugacuccaggcuugagucacuacaucuaucuguuuauggucuucaugaugacacgcuacacuacagacaguccucccuaggucagaaugaccuagaacgcuagucagguuucuguugcugugaugaaaacaccaugaccagacuggagagauggcucagcgguuaagagcacugccugcucuucugaagguccuaaguucaaaucccagcaacuacaugguggcucauaaccauccauaaugagaucugaugcccucuucuggagugucugaagacagcuucaguguacuuacauauaauaaauaaauaaaucgcuaaaagaagaaaaaagaaaauaccaugaccgugaccaaaaaccaaguugggaggaaaggguuuauuuggcuuguuuuuccagaaggaagucaggacaggaacucaaaugacuggaaccgggaggcccugcucaugcagaggccacagaggggugcagcuuagccggcuugcucagccugccuucuuagaaaacccagaaguauccacuucuguauuugccaggcacuggcauaaccucacacaagucagcuauaucaggguccuuucagcgaaaucuugcuggcauaugcaauagugucuggguuugguggcugauuaugggaugaauccccgggugggguagucucaggaugguccauccuuucgucuuagcuccaaauuuugucucuguaacuccuuccauagguauuuuguucccuauucuaaggaggaaugaaguauccacacauuggucuuccuucuugauuuucuuguguuuugcaaauuguauguuggguauucuaaguuucugggcuaauauccacuuaucagugagugcauaucaagugacuucuuuuguaaguggguuaccucacucaggaugauauccuccagauacauccauuugcccaagaauuugauaaauucauuguuuuuaauaucugaguaguacuccauuguguaaauguaccacauuuucuguauccauuccucuguugaggggcaucuggguucuuuccagcuucuggcuauuauaaauaaggcugcuaugaacauaguggagcauguguccuuauuaccaguuggaacaucuucuggguauaugcccaggagagguauugcuggauuuuccgguaguacuauguccaauuuucugaggaaucgccagacugacucccagagugguuguacaagcuugcaaucccaccaacaauggaggaguguuccucuuucuccacauccucacccacaucugcuguuaccugaguuuuuuuucuuagccauucugacuggugugagguggaaucucaggguuguuuugauuugcauuucccugaugauuaaggauguugaacauuuuuucaggugcuucucugcuauucgguauuccucaggugagaauucuuucaccuuuagcucuguaccccauuuuuaaugggguuauuugauuuucuggaguccaccuucuucaguucuuuauauauauuggauauuaguccccuaucugauuuaggauagguaaaaaucuuuucccaaucuguugguggccuuuuugucuuauugacaguguccuuugccuuacagaagcuuugcaguuucacgaggucccauuugucaauucuugaucuuacaacacaagccauugcuguucuguuuaggaauuuuuccccuguggccauaucuucgaggcuuuucuauuggauggaacacagggcucccaauggaggagcuagagaaaguacccaaggagcugaaggggucugcaacccuauagguggaacaacaauaugaacuaaccaguaccccccagagcucgugucucuaacugcauauguagcagaagauggccuacucggccaucauugggaagagaggcccccuggucuugcaaacuuuauaugccccaguacaggggaaugccaaggccaagaagugggaguggguggguaggggaguaggguggagggaggguauagggaacauuugagauagcauuugaaauguaaauaaagaaaauaucuaaaaaaaaaguugauguuuugcagccagaaggaaaaaaaaaaaagaaaacccaggagcaccuggcagggccuggcgcagcucaagaugggcugagcuuuccccugaucauucacuaauuaagaugacuuagagccagcucucauggaaguauuuucucaauuaagguuuccucccuucggggaacucuaguuuguguugacuugaugaagccagcgaguacaaaugcuugucccaacugagcaauuuugugacuauuucagguuucuaugugugaacuuuuacacccuuucuccauggucauuuggauuuucuaggcuuuggucuucugagauagucauuacuuggccccugcugcuguaggcaaugcauaccuccuggagccguucacauugcccgaggcgugcacuguagcugcacaguuugcuuaugcugucaguguaccuccugggauuucugcugggcccuccugucccuagugucccuagugccucuguguacuuccccucaguguaaaugcagccgucugauuuaguuuggauucugcuucuggcaucuuauucucauauaacccuccgccaucuccacagagauuguuugguaccugcugcugaacuuguuaaggcccuaggccugcacugacuuacacagucgccaucagucccgcgggucugugucugcaaauguggcuagucuaacuuaggugugucagaagugugaaauacagacuggguuuuguaaguuaauuuucaaaaccaaaagccagccuuuacugcuuuuauauugauuaaauguugagugaugaucuggauauaccagauugaauuaaauaaucuaaaauauguaaucaaagcucaaguagaaguauaugagguauacuuaugguaagagaaagaguucagauuauaaaauuucagaauguagaaauauuuugggagaugugaguccuuauaaagacagaguuaaaauuuacuucuauuacgaccuucugaaaaaucagugaucgcauagcaaauauuucuagaauuuucuuccuuuaaaacauauagauaugugugcaccuucaucagauacaucagacaagccagguaucacgguuuauucgaacacucaggaggcugaggugagggggucucuugagugugaagacagccugguauuacagaguauguuuuaggcuagcuugugcaacagaauaagaucuagucucagaaaacaaagaaacaaacaaacaacaggcauaucagacauacuauuuucugaaagccaccuaaaaauauccugauuuuaauauauuaacagcuaauaucugacugaagugccaaaauggacacucuggucacaguacaaaguuaaggguauaagaauuaaauguaaaaauagcuuagaauuuuagguuugcagucauuaguaauucgaugauuagcaauuugauuuuucgaguuuggcggaauaaguuaaguucauuaauuucuuagcccuagaaggagcuaggaugcucucggggccugugcuggugaccugcaguggugccugucuccgcuguuuggaguacucagcacauuccugauggagcaucacuguuucccagugcuucugguggugcucucugcuguguccacuucucccugacacucaucaucugcguuuaccgauacaaacaacucccuaucgugauugacagauacugauucaaaggucuucacagucauucuucugauguuacacuacuccaagaaaauacagauguuagaauugugauagaacaagucucuuuuauucucaaacugcuugugaaugauuaaacuggaaaguuuauauucuuacuccugaagcuagugaauguacucuuauuguauugccaucuaguuucuaauuuauauuuacuaucuuaguauuuugauucacuuagucaagagucuaccauugucauuagagcaguauuuuauucuugugacaaucagcauauauguagaccucuccugauugacucuguuuacaugcuagaaugaaaggaguugauuuucugggacagauucucagucacugcacuuuugaugucuugacagugccuagauauugcuaccuagccuguucagggcuaacaccccaugacugaggaccacugcugcuuugagacaguaccuccaauuuucucaaugcaguucauucuucccacacaaaaauuaaugauacacuaauaccuauggggacuuuuggauuuguuuuaaugcuuugucuugaaguaaauguccagauuucugucucaagaggacagagauggaggagagguugcuucuucacagagagcauggccagacucaucuuguuugaccuccuggcugucucccucccuuccaaagcucccuagcuuccccuggaaaggcugaaucuuuuuuuuuuuuuuuaaccuuauuuuccacuuuaaguggccuuguugaccuucaccagugacuacacaugcauccauuuguggguuucagaauagucuuauuuuauuugugugguugcaggcuucugcuguugugacuaguugcugucguuuguagagugccuuuagauggaacagugggaaagccacuugauauuucauuuucuucuucuucuucuccuucuucuucuuccagcaaaccugggcgaagagcuguauuugaguucacccaccuacuucacggaaguguggggcuucugacuuuucuccucuuguacccuuucucuuagagcucacuauccuggaaccuacacaguguggaaugcaaagaugucagggaagaagcuguggucaucugaagauuuuagcacuaucaacaguaauguuggcgcaggcuguuggagucgcauauugaaccagaauuacaucaauggcaauaugaccucguaaguuauuuuucaaucuuuugggggcauuuauuauaacgaauuuuagaaaacacaguaaggagaaaaaaaugaaucacuauaauuuuaaauccuagauucaauuguugcaaacauacgguuuauugacuuacucuacauaugucuaauauuuguugcaucuauaccuccuuuucuauguuugagaagaguguguauuaaguaaaguugggucuauugggguacaguguacucaggcaguaugaugguuuugauaauuuacauauauuuuaaguuacuuugucauauuauaccaucauauuuuaauauuugccucuaaaauguaagaauauguucauaccauuuccucauauguucauaucauuuucauaaauaugagcauauaaaauauuucuaguugucauucuuuauucauauuuuuaaaaugucauuugugaugaaagauauagcacaucucugugcauucauugcauuuagcaguuuuggucccagagucuuuuuuaauguagaauuguuaccuacccuucuuucauaacuaccuuuaaaauaaaacaaaaaucaaaaaccaaaaaucaaacaaacaaacacaaaaaccagggcuguagccuuuacuuggugccaacuuccacgcugucuguccggcuccuuuaacuuuauccaacucuucacaaaagaaaguuaacaaagaacagcagagucccuucuguuauuaaagggguacucccuaaauuccuugaugacagcuuaggagucauuagaugcaaaacucgcccuauaauuaugagucuaauaaaaacaagccagugugcacacuuuuguggugacuuguuuggcuggagagauggcucagugguuaagaacacugacuacucuuccagagauccugaauucaauucccagcaaccacaugguggcucacaaccaucuguaaugggauccaauaccuucuucuggugugucugaaagaccgcuacagugcacucacauaaaauaaauaaauaagcaaaaaaaaaaaaaaaaaaaaaaaaaaggcagugguggugcacgccuuuaaucccagcacucgggaggcagaggcagguggauuucugaguucgaggccagccuggucuauagagugaguuccaggacagccagggcuauacagagaaacccugucucgaaaaaaaaaaaaaaaaaaaaaaagauaaugcauguucauuuuagacaauugagaaaaugaagauauguacaaagcgugagacaaagcuguccauaaucuuuccauuuugaaacaaugguccuuaaaacauucuccuguuuuuauauacuuuuaaauaugagauugacaccuuagcauauggucuguugaguaaguugcuuuuuauuuaacaggguguuaugauuuuuuuucucucauuuuaaguauauuuuuacuucauaccuuuucccuuguguuuguuuguuuguucugaggcaggguaccacauccagauacaaucagacauccauauucugucccauaaagaaguauuuccuaacuuugccuaacuguuguaagaaguccugcgguacuugcuauacugauguguaagcagcugcucacacuuccaggguccuggaacuuguacaucugcucagugcucaugcugauucugaugaugcccaaguuucagaaacacuaguguacagaauaaagaauaccaugcaugugugacacagaucaggagaacuuuuaugguguccauugcuugugugucucucuguguguuuaaucagcauuauuauuuucacuuuacaauaagguaaugagaaggguuagauuuucuaagagugccagaguagcuuuauguauugggaggaaauuugcuucagggaggagaaaaucucugggugagugcucuuuguuuucagcugaagggaaaacagccagauauaaaaacuuagguucuuauggcugcauuuuuugaaagcuguagggccccgacccaacucugcuccuggagcucaguauguguguaauuuaucagugucuaucagcugaaaagaggccuaaagccagaccagcaagcucagcuaguuaguaugucgguggaagcagaaaucagaggcuagaguugcaucaauguguuucauccucccagucacccacugauucaaaacagucaucauccuguuuccacaggugagggaacagggucaggggaaguuagcucgcaaagucuugacgugaacccagacagucugacuccaggaguucccaucuuaaaacugcagcagucccaagucaaguucauuaacucugugugugaaauugaggcauuuggagagcugucaggggggagagagagagagagagagaaagagagagagagagagagagagagagagagagagagagagacuuaauucucugauuauuaaaacguuuggaugaacaaugaacuggauuuuuaaaaaucagagugaacuauggcaacauauauuuuguuugguguacuuaaguuaaucuucauuugcuuauauauaauuaugaaggauacuuuuacuucagucuuuuagauauaauuuauguuuuuaauacauaguguugguguucuuucuuucuuucuuucuuuuuuccaucuuucuucccuuccuuccuuccuuccuuccuuccuuccuuccuuccuuccuuccuuccuucuuuccuuuuuuuuuuuuaaucaaacuaauguuuuagcacaauugcuuggaauuugguggcuaguuacuaugaagaguugccuuauggacgaaguggguugaugacggcccaggagccauggaguggacauuaugucguagcaucuccuaucuggguaucagguauggaugucuagauucuaucucuuucuccauaaauucuuuuaaagagacaaaccagaaagcaccaaaggagguuguacaaacuaucugugcuuaaagagugugacuauuuuaagggaguucugccaguguuuuauauuauuauuuuugguaaccugauugcuuucuguauuuuguacuuuauuauucuaagacuagguccuuaagaaaggggguguaagacuguuuaugauaaaagucuuggaaagaucaggaauucaaggcccauaccuaaauaccauauauagcaaaucaguagccaacaucaaacuaaauggagagaaacuugaagcagucccacuggaaucagggacuagacaaggcugaccacucucucccuacauauucaauauaguacuugaaguccuagccagagcaauuagacaacaaaaggagaucaaaaguauacagauuggaaaggaagaaaccaacauaucacuauuugcacaugauaugauaguauacauaagugaccccaaaaauuccaccagagaaauccuaaaucugauaaacaacuucagugaaauagcuguauaaaaaauuaacugaaaucaguggccuuucuguacacagaggauaaacaggcugagaaagaaauuagggaauuucuuucacccuucacaauagucagaaauaauauaaaauaccuuggcaugacucuaacuaggcaagugaaagaucuguaugauaggaacuucaagucucugaagaagaaauugaagaucucagaagauggaaagaucucccaugcucauggauuggcaggauuaauaauaguaaaaaugacuaucuugccagaagcaaucuacagauucaguguaauuccuaucaaaauuccaacccaguucuucauagaguuaggaagggaaauuugcaaauucaucuggaauaacaaaaaaccuaggauagcaaaaacuauucucaacaauaaaagaagcucuaguggaaucaccaucccugaccucaagcuguacuacagagcaauugugauaaaaacugcacgguacugguacagggacagaugguuagaucaaugaauagaauucgagacccagaaaugaacccacacaccuauggucacuugaucuucgacaaaggagcuaaaaccauccaguggaagaaagacagcauuuucaacaaauggugcuggcacaacugguuguuaucguguagaagaaugcgaaucgauccauacuuaucuccuuguacuaaggugaaaucuaaauggaucaaagaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaaaagucagaauggcuaagaucaaaaauucaggugacggcaggugcuggugaggauguggagaaagaagaacacuccuccauugcuggugggauugcaaacugcuacaaucacuguggaaaucaguuuggcgguuucucagauaguuggacauaguacuaccagaagauccagcaauaccuuuccugggcauauacacagaagaugcuccaacuucuaauaaggacacaugcuccacuauguucauagcagccuuauuuauaauaaccagaagcuagaaagaacccaaauguccuucaacagaggaauggauacagaaaaugugguauguuuacacaauagaguacuacacagcuauuaaaaacaaugaauuuaugaaauucuuagacaaaugaauggaucuggaggauaucauccuaagugagguaucaaaucacaaaagaacacacaugauaugcacucacugauaagugaauauuagcccagaaguucagaauacccaagauacaauuugcaaaacacaugaagcucaagaugaaggaagaacaaaguguggcuacuucgauccuucuuagaagggggaucaaaauacccauggaaagaguuacagagacaaaguucagagcagagacugaaggaaugaucauccagaguuugccuggccuagggauccaccccauaaauaaccaccaaacccagacgcuauuguggaugccaacaagagcuugcugacaggagccugauauagcugucuccugagaggcucugccagugccugacaaauacagaaguggaugcucacagccauguggagcacaggguccccaaugaaggagcuagagaaaguacccaaggagcugaagggguuugcagccccauaugaggaacaacaauaugaacuaaccaguacccccagagcucccagggacuaaaccaccaaccaaagaaaacacauggugggacuuauggcuccagcugcauauguagcagaggauggccuaguuggucaucaaugggaagagaggcccuugguccugugaagguucuaugccccaguauaggggaaugccagggccaggaagcuggaguggguggguuggugagcagggguauggaggaggacauagggaauuuuuggaggggaaucuaggaaaggggauaacauuugaaauguaaauaaagaaaauaccuaauuaaaaaaaugcugauuacaugggaaaccaaaaaaaggggggggggaguaaggggaaagaaaggcaacagcccagggauugcggauguccagugauggagacagaggggaucacucaaguaugugaucccacaucuugaaaauagugauggaauaaguauacuuauauucagcuuagugugucaguuccauuuuauugauuguacuaaaguuaguguauaauuauuaccaguaaaaauuaaugauuaauuuugucguugauuaaucaaaaagaauacauguauuaugugaaauaauugguucccaaauguauuaaauauuugaacauaugcauuuuagaaaaugauaugauuauggcuaucauauauauacacacacauauguauauacacacauguauauacacauggaguauaaccauauuaauagcuaauaacccuauaaauaagauuaaauaacaauagcagacuuuuucuuuaacaucuuaguaagauauuuaacauuauuuugcuucaaaauuauaccgucuuucauuaaauccaauuucuucaaacgaagauaaaucuaagaccacuugguucaguuuuaagcccauauuuugauaacuaucaucuauagauuuguguuauucucagauuuguaaucauggcauuacucuaaauuccuuacguaccuuuucaaaauaguggaaaaguuaaguaagacuucuguguugacuggaucgccucuuggucguuggaauucuucuacucacuuugcugaaguaacgcucuucuaaguuugugacuuugggaaguugggaaauauauauacauauguacuuagaaauaaauuugagaccauaaaguaguucugagguacauuuauuugcuuuuuuaaauuuaauuauuuucuuuguucuguuaggauggacugaguagugaugagugggcaaggagugggaagagucacucuauuuugcauuuugggaaaaggagugcauaauuaauacgcuuguauucccagguucacuuaauuuucuccagucauucagaaagucuuccugcagauauacuuuacaguugaaauauuuaaaauggaagcauaaacuugggaaauacuuucuuaaaauagacuuuagcugcuuagaaucaaucagacugaaauugguagacagcuauuuucuuuuaacguugucucauucacuuccuuuucuucuuuucuguagcucacacaacccaguuuacucaaccaggcugguauuaccugaagacagugggccaucuagagaaaggaggaaguuauguugcucugacugauggcuugggaaaccucaccaucaucauugaaacuaugguaauuguccguuguugagacucaauuagugggcaucucauacuucaccaggaacuuugucuuuaacagaaggaucuuguguucuucugggcauaggaaggcaugucuccaagagucuuaugacugccucccugggagaaagguuggagaaggcuggugguuaccuugcuacuucuguuguuuuaagacaucuuucuuuuuaaagauauauugguauaaaguaaugacuggcucuucugaccagccccaaaauaagacucagacucaaaauauauuuauaaauaccuugggcuuugcaaggcuuuucucuuauuagaucauaacuuaaauuaucucacuuauucuaaucuacauccugccauguggcugguuaccugugcucagguaccaugugucugucuccucacaccuuccuaggaggaucuccugccuagcucuaucccacaauucuuucuaucuaucggaugucccaccuucuauucuacccuucucuauaggccauagauuuuuuuuuuaauugacaggugaugcauccauguaauacacaugguauuuucucuacaguauauugggauaacuggugaacaugugucaguuccuuuguguuuguaacuaggaauggggcugccaaguuaaacaguaacuaaugugaagagcugucaguugcugguauuauuuuccuugcuaucagcaguuuauaaggcuucauaagcaguucauagacaauauucuguccaaaaaggacaaacagagguaagauaguugacuacuaagcucugugucgacuacuaagcucugccaagacagaguaagccaguccuugauauuuccuacuucauaaaaaguccguuagaugguucuaggccaaaaggcuaaagacaaauaauccaacuuuauaaaacauuaaaggccauucagauagucagcugucucuguaauuguuuaaguuuuaaaagcuagguugguauuuccuauauacucagacaauauuuaauuuguucucagauuucuaacgugguuaaagauuaguuauagucucauaaucaaacucaaguuguuuauauugagagagaggcaauaaaauaaaagacauaguuuuuagguaauguuacaagcuaaagucuaaaauuauaacucuuuaaguuagaaaugauaguagaguacuuuaucaauugacaauuaugauggacuagauguuaauuguauaucauacuuuguaauuuacgugauuguuauaguuuuuuucaauuuaugucugagaaaagaguuuuuuuuuuuguuuguuuguuuauuuaauuggacaaaaaaggugagauguaggaagugguacugaugcuuugaucaggaagcugcgugugaauuguuccuguuccccaauugguucuugauugaucaauaaagaugcuauggguuaguggcggggcagaagaggcagaacuuccagguucccuccagcaggguaggagacaauggagugggaaggaaaauaaacuauuguuuuggagagagagagccacuagccauguaauaucucggauggaguggccauuggccgcuucccugacugggccugggguagcaggugagagaauagaaacacagcuaagccgagggcagauuuagagguccugagcugggagugaagguaagggcacguuagccucuggggucuuagaagugccuggccauugaguuaaaauacauauuaaaaauaagcuuaugugugugugcacacgcacauaugugugucuuucauccacagguccaaggguaccagggcaguggcugguagggugguccucccagagcuuaaagcgggguuguagauacuacgacgccaggcagcuauuguagauuugcucauauaauuauaggguaggucaggcugauccuagguucauaauccugcuagaucauccucccaaugcuguagaauaugcccaacuucucucuuuccuucuuuggcauucuuugaaguaaaaaagcucuaaauaugugugaaguucacauucgguauuuuuuuuuuucuucuucacacuuaguauaucagacauaggaaaccauugacuaauccaaggucaugcagauuugaaguguagaugcugguuuuuuuuuuuuuuuuuuuugguggguggggguauuguuacaguuuuaagucuuaaaugaggugcuugguguuugguccacuuccuccauuuguguguaugucuagcuggcgagcgagguccagccucagugcggggagggcccugggaaggggacaaggggagcagugcugagugagguccagccucagugcggggagggcccugggaaggggacaaggggagcagugcugagugaagaacuccgcagagucaggagugggcgcaguugucaguugagguguuucacucugccgauucagucgcaucauucuuccuucuuccuucguuugacagagagcugaacccagucuguuauuuccuucaggagaguuuuagcuuaaggguccuuuuacugacuguauacagguguagucgggugcuauaacuuuuucagaagcuuuggaauuuuguguaucaaucauuuugauuuucugaucuguguggucgagcacggaaccucuccuguaaucccgcuuuaguugcuuagggcuggcaggguucuccucuuccauucucuucaguuacugagucauaccuccuccuccuugaucuucugaagguuuggcuuucuaaggggaaagugcuguuugguuuguuuucuguauuucaguauuucacaguaguauuuauugucguccuguuugugcuauggcuuagguuugcucuuuugaaaacugucuagcuucuuaaaguagaaggccagguuauuuuuuugaaacacuuuaaaauauauaggcauugauagccuucacguccucuauaugugguacuuuaguguaguuuaucuguuuuagguuuuguuuuaauauuuugaucacaagguuuguuuuuaauuguccuugugauuucuuucucaauugcuuuguggcaagguauuuuuauauuuguauuucugugaauuucgcaacuguuguuauugaugcuuuauuucgucccauuaugauuggagagcauacuuccuggugucccucugagaggacuacagucauugccacgcugugggcuacacugagaacugcccuggaagaauagcugcuuuguugccuguggaauuccaugugguugucucucagaucagugucucuguuaauuuccuguucugccugaaaaaucucaaguaaaaucuccacuacugcagaauugucuuucuucuuuccccuuguucuguuuucuguauuauuauuauuauuauuauuauuauuauuauuauuauuauuauuauuauuuucuuuacauuccaaaagaugcccccuuccuuccuggucuccccuccccuuugcuucugagaggguguuucuccaccugccucacccccuuaggaucgccuuucccuggggcauuuucagauuuuguuuuuauuucuaguauuuuaacguauugacuucugacauuaaacuuucuguuuauauuuuuccuuuuguuuuaaaaucaguuuucucucuuauuauuugucauugcuacuuuucugugguuucuguugguauucggucccucaccccugucacccuugcuucagccuguugguuuucguuuccuguaaugcauguccucuuucacuggcacaugguugggucuagcuuuccuuugccuugucuggcauuuugguuggacuguuaaaugagcgugaguuuguuaugguuugguuuauucuugccuugugaucuuuguuuucuacaauucgugaugauguuucugucugguguccuccucugccauuuuauuugacauugagugagugcucucugaugcugcuuucugguccuuuaaugaccuuccugcuccagcuuaaagagucaucucucagcagugguuucaaaauuuaccagacaucccuuccugccucaggaccaccucauauauaaacugaugggauccuggggcaaugaaagaaugcuguucuuuugccauuuuuuuguguguaaauuuucccauuuuauuguacaugccacaccuccaacagaaagauaauaggaugcugugaaguuauuacuuuauauguaauuuuaaaaaagauccgugagaagaaaugagaacaguauauguuuauaucauguuacauuuauuuuauuuaugguuauggaucuuuggaucuauuucuaugcauuuaaguuaccauuuaggucauuuccuuauucuaagcuuugucuaggcccacgcaguauacauucauuaaaguuauauuagcaauuuauuuuuuauaaacugaaauaacuucguauuugcuauaaauguuugccauuccugcuacuuuucaggcauugauuauuuaugcuuucuccacaaaauagcuugcauauuguuuggauaacucacauggcucuuucuccucagagucaucaacauucuauguguauacggccauaucugccauauuauaaugucucacaucagcuggcuaccuucacucuaaagggaucuuugguaaguacauguguuuaacuuuuauuuugauuucaaaauuuguguuaggguuggagagauggcuccgugguuaagagugcucgcugcuuuccccaaagaguggaacugguuuccuguacucuuuugucagguagcuuccaacuacauguaacaauagcuacagaggauauggugccuucuucuguccuugaaaagucacacaugugagcuuacagaaacacaacuaauaaguaagauacaucuuuaaaauuuuaugaaauauuugcguucuauuacaagccaucaauucuuauguaucauguauuauagaauuacuaagaaucugugugugaauggacaccugcucuggugccuuguuaucuccugacuuuuaaaaacaacaacaacaacaaaaaaaaaaaaaaaaaaccacagccucauguaaucuaggcagccucauuuaacaauggagauuggccaggaacuccugaguaucccaccuuuacucugggagugcugggaucgcaggcaugggcuagcacgucugccucagggagugugggguaagaaaccuggcugaauuuaugaaauuccuagccaaauggauggaccuggagggcaucauccugagugagguaacacauucacaaagaaacucacacaauauguauucacugauaaguggauauuagccccaaaccuaggauacccaagauauaagauauaauuugcuaaacacaugaaacucaaggagaaugaagacugaaguguggacacuaugccccuccuuagauuugggaacaaaacacccauggaaggaguuacagagacggaguuuggagcugagaugaaaggauggaccauguagagacugccauagccagggauccaccccauaaucagcauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauuccagggccaaaaagggggagugggggggcaggggaguggggguggguggauaugggggacuuuugguauagcauuggaaauguaaaugaguuaaauaccuaauaaaaaaugaaaaaaaaaaaaaaaaaaaaaagaaaccuggcucccuugcaugcuagccaagcccuccaccaacuaaggucucuucugggcuccguagugaaaugggcagaagccaacaccuaauaaggcugucuggggcuugcuuguccuugguggggugagcaucaguugcaaggucuaaggacuuuucuuuuuucuuuuuauccaaacugggcuuucucuguguagucuuggugaggagucuucaagcccugaaguuuagaguauucuauacugaaaaacaaacaaaacaaaauaaagaaaaaccaaacaaaauacccaaagucaccauuuuaaaagccucuuaauguccuaaggaugagguuuuguuuugaugccagaguauuauuagaggaccagcagggcugggagggagggagggugacaaccaaccagaguguguuauguccgugcguaaaguuuuuaggagaacaacauuuauuacuaggaaaauuagagaaaacaucuaauaauuguggucagaaagcaggguuguuacguuaacccuagcaaaggcaaauuugcucaugaagcacaacguggaagaguuuuauuuuguguuugauuaaaccucugacuccaguaagcuggaaggcgucagaaagaggcacggauagaagacuuuugcagucagacuccaaaaucagcccaaaagcuauggguuuuuuucaguugcaaguucuuguuauuugcuuuuuuuuuuuuuuuugauuauuuuauuuacuuacaugucaaauguugucucccuucccacucucaccucugcaacccuccaucccaucccccuuccccuuugccucuaagagggugcuaccccacccaccuaccuccccaacucccaccucucccucuagcaucccccuucacuggggcaacaagcccccacaggaccaagugccuccccauucaucuagagcaugugacaaacacauccagagaccuucaacuguuacgaccaccuaacuacaugugcaggcuguaguaacagaagcccuaagaugccacuugaaauccuuugucccacauuguuaaaaaaucaugugauguguuacuuucaacgcaauucuucugugaaucuggagauuauugccugucauaaucuuuguguguguguguguguaagucuagaauuaucauugucuguggcacuuaugguaauugcagacuuaguugaaauuauccugcuuauauaauaaugauaguuaaugauaauuauuaaauaugaaaaacaauuuuugaucuuuuagaaugucauuacuuauuuguacaagaucuucaguucuggguuauucucugucaacauaucagaucaauauucacuuagcauuuuugcaauuauauauucuuugaaggaaaaauauuagaacauaaucuuugaacaagguaaauuuuauaugaugauuguaacauacaagaagggagaagaaaacaguuuaagauuuuauaguaauugucuuagucaggauuucuauuccugcacaaacaucaugacccaagaagcaaguuggggaggaaaggguuuauucagcuuacaauuccauacuacuguuuaucaccaaggaagucaggacuggaacucaagcaggagcugaugcagaggccauggagggauguucuuuacuggcuugcuuccccuggcuugcucagccugcucucuuauagaacccaagacuaccagcccagagauggucccacccacaaggggccuuucccccuugaucacuaauugagaaaaugccuuacagcuggaucucauggaggcauuuccucaacugaagcuccuuucucugugauaacuccagcuguguuaaguugacacaaaaccagccaguacaauugaccccuugccaacuugacacacaaacacaucacuaguaagccucaacccuuacauucuuuuuuuuucuguuucuuuuuuaaaguuuuuuuuuauuguguauuuacuucauuuacauuuccaaugcuaucccaaaagucccccacacgccccaccacccacccacucccacuucuuggcccugucguuccccuguacugaggcuuauaaaguuugcacgaccaaugggccucucuuucacccccaaggucuaaauaacuuuaaacgucccacagucuuuacauauucuuaaaauuucaaucucuuaaaaauauccaucucuggaaggagcucaggggacacagaagcucagaguacacacauacaauuguaucauugcuauaaaaaguuauuuaaaacuauaucucuugcauauaaauggaaaagacucagguauuuggucaaguggaaauauugcuagguacaggugucugugaccacacggaaucaaauacaaaggucacaaugaggcucggcagcugaggauggccuggacccucugggcuggccagggacaugggagaaucaugucacuugauuauaagcuccuuccagugaccaacuugcaggugggcccaggccagggcuggagaaaaagcucugagacuuguggguuucuaccuucaaaaauuuggaccaaaguucuguuuucuaccugccucugacugugcccaguugagaggcugaccucgaggccuuaaugucccuccugcacggccgccuccauccuagccuguuucuaugggagggguucccugcacccugguucuguggaaggcguggaagaguguaaauauuuaugauuuuauaccuguggggcugaggcggugcagaaguccuuuauggugacagauguauauuuugguaacgacuacaggcucaguauuguccuggggccagcccuggccacaucuaccccaucccagaugguguauuggggggagaggggcuuuccauuaaagcaguuuuauaaccgaaaaaaaaauauccaucucuuuuaaaauccaaagucuuuuuacaauuaaaagucuuuuaacugugggcuccacuaaaacaguuucuuccuucaagagggaaaauaucagggcacagucacaaucaaaagcaaaaaaucaaucuccaaccauccaaugucugggauccaacucacgaucuucugggcuccuccaagggcuugggucacuucuccagccaugcccuuuauagcacaugcauuguccucuaggcuccagaugccuguauuccacugcugcugcugcucuugguggucaucucaugguacuggcaucuccaaaacacugcaugaccccuucagucuugggcugucaauugcaacugaggcugcaccuucaccaauggccuuccauagccucucacagugccgagcuucagcugcucugcaugaccccuucaugcuuucaaaaccaguaccaccugggugacccuuauacauuaccaagucccgcugcagcaggaguacaaccuuggcuaucucuggaacacagacucuuugugcuuuaagaaaacacuucccagaagaugucaccucaaugaugauggucucuucuuaaucaccgcuaauuucuuagcuccagcuaaccagcaucaauagucccaguaaugcaaaguuuuugcuuuaguaguucugguaucuuguuaaccacagcugauucuucagccccagcuaaccagaacuacagaaucuucccaaucaaaacagcaauggcccugaaaauuuucccucugaaauuucacaagccagaccuccgucuucuguacuguucucaacauuaucuuccaagcuccuacacaacaucugacagagcucuuaacaaugaauggaucuucuagccaaaguccuuccacaguccuccccaaaacauggccagguugucacaggaauaccccacuaugcggguaccaauuugucuuagucagggugucuauuccugaacaaacaucaugaccaagaauaaaguuggggaggaaaggguuuauucggcuuacacuuccacacuguuguucaucaccaaggaagucaggacuggaacucaagcaggucagaaagcaggagcugaugcagaggccauggagggauguuccuuacuggcuugcuuccccuggcuugcucagccugcucucuuauagaagcaagacuaccagcccagagauggucccgcccacaaggggccuuucccccuugaucacuaauugagaaaaugccuuacagcuggagcucauggaggcauuuccucaacugaagcuccuuucucugugauaacuccagcugugucaaguugacacaaaacuagccaguacaguaauaaacaaagacauuuuagaguaaauaguuaaauguuuaacaagguuuuuacagagggcagaugaguguuuugcaucgaaggcacuaagaccuguuuaaucuucgcuaguguucucagguguuaaugcaguggguuaauuaaaugaguuaaaugaguagcgauuucuggacuacagugcucuccucuguaaaaggaagcauguuagguuucuucagggacacugggcacagugcuagaggcaagcauguuagaaacaggcacacucccgaacauucgcagcggaagggaguuuaacaaggaauggucguagacucaugcuggaccuaccuagugcaaggucagagaacacauacaugcucaaaaggggacgaugacaggggugcuucugagcaugcccaguugaguguuacagugauuaagcuggugccagucaguguccccaggcugugucccgcuuuccuuacgcguuuaggugaaacgaaagcagaaaaagacaggucccuggaggcgguuaaugcagcugcuugcugcuccuggugacaggacgugaaagauuggcuuaaacaauguccuguuuuccaaaccuagagguggucuuuucagcgacuggaaacagugggcauugcuuucuugagguauuaauaacaggaauugaugaaucucucaaguauguuuucuuguguuuucuccacagagagaaauacaagagcugcaggugugguauaccaagcugggaacuccgcagcagagacuucauuuuaaacaacuggauacucuauggguaguuuuaucauugauuucuaugcuugggacguuacaacgguaaaaaggggcaaauuggaucaaugaauuaaaaugaagaugauuuuauggcuacgggacaguggagauaaaaugcauucauaucuucaucagaaaucgugaugaaggugugagaagcuuuuaugugcaccgcugugcuguccuuagacacuaguuauguugguggcugugccaccauugccuggcugccccccuuugagaccauccgcucagucuguguccccacagcaguugacuguaggcaguccugcccucuguggguuucucuuaugcuuuguucuuucuucucucugcuacucguuucuguuuggucucccuuauucguggacagugccccaggucucagcagucagucagaaucucagagccagccaucacaaugcuagagaguggggugccuaaaauaggaacggaucagcagcuuuccccacauagcuuuccucacauuccccaugugagccccacugaccugucacgugacccucacuguccucucaggaagcagaaaacagauuuccuuuucagaugcuuaucucaguagcugguguuuccucccagagugaacgucucaauuuccuucauaucugugaagauaugucaccucaaguguggguuucuucaaagccucacucacugggcccagugucgggcucugugggucucaucacaggcuccccaccacuuugcuguccuggagguuggggauuugccuuauuuugcuuuuaguccagggguuuauggugcuuggaacugggugacuucucaggaaagauuuccaagaauaaagaggccccagaaaauagguuaauuacaucaucuauuugacuuaaucugauggauuuuuaauaaugauuaauguuauaguuagcuagucaauaucaaugguuacaugcccauuaggccacucuguacuuguauaauaguuugcuagaaauaacauaaucaaauugaucuccugcauaggaauauuguuaauccugaggcagaauguggcaucagauauucaugguucugcaucuauuuacccuuaaagcaaugauacgaugcuaaacccuuuaauucaguguagauaaaacucauuaaaguuucaaaggagguuugagcucaagcccacauuaguuauguggggauucaaacggcuccagagggcuacgcuuauuacaggacuaugcucuagggaguauuuccccggggccacacuucgaggugaacuaagcaagaccuuuauaaacaugugguuuaauucucaguguauuguuagcuucaagaaggcuaacugugacacagagucagccuacuaauugaaaucugaacugacuauacgaugaacagauuuuaaguuuuauuucuuauuguaagauguuucuugaggugucugugggcuuuguggguucuuuucuuuagcaaggcucugaaagaagcaagcaggcugcugaguuacauuaauugaauguacccaagcuuuagagagcuuacaguguaauggaagaguagggugacagauagaccuucagguaucuugucauuggcaccccccaucuggugaaauucuauaaaauauuauuuauacacuucuaaaauacccuuaaaguugucaagggccuggguacuuauuucuggucuuccucacguguuuaggagguccuaacagaauggcuguucacgcuuauuucuuuuaccgcuccccagcaccuguccuugaacguggggcugucuucucuuucagcuccuugacggcagcggcaguuucacacuggaacuggaggaggacgagauauuuacgcucaccacucugaccacaggucgcaaaggcagcuacccucccccucccagcucgaagcccuucccaaccaacuacaaggaugauuucaauguugguaagcagucuuagccaggcgcgaccugucauccaccuucuguagacguagggcagggcuucuucuugucagacuggacggagaguagcccuuggagcaguggcucucagccuuccugaugcugcaaugcuuuaauccaguuccucaugcuguggugacccccaaccacgacauuauuuucauggcuacuucauaacuguaauuuugcuacugcuaugaauuauaauacaaauaucugauaaauaggauguccaguuuguuugaaaccccagaggggucgcgacccacagguugagaagcacugcuuccgcguuuuauuugguucaaagguagcuaguguuucuaguucuuugauguggauuuuuguuuuucaguuccagaagaaaugcagaagucauugugagaaugaaaguuauaauucuaaguuguucugggugaaacuuaggguguauagcuaggugcugccguccuggaggcauguggaggcuaaaccaccuuauguaucuuaguacgagggacuugagugccuaacacaguuaugauguaaugaggggcuccaacucauuguuuacugggggguuauagucuagcucucaggucuuuagggggaucugcuguaaagugauuagaaaagccuugauggguagguaacugggggaaaccauaugaaaacagaaggcaugcgcauuguguuugcaucucagaggacccagcaagaacagcauuuggugggauugaagguuucagagaagagucagguagcucuguucuugcuggguccucagaguugacaacuguagaaaagcagcacgcagaggauuagcauugccagugugacguaccguaccccgugcaggggccagccccgcuuguugcacccaacaaggggacucugccacucacugcuggcucucgcaguccaugacaggacaugaacuuucagcugauuggcucuaguacaggcaucuggucaauuauuuggauauauuuccaaauacaucacacacacacacacacacacacccuaaacuuuguuucuaaguauuauguuuuauaaauuagucaaguauuucacaguguaucaccgauaucagaaaggagagaucugguaagggcuugcuaaucagccgcugagauacuaaguggaggacuuacuuuuuguguucugaacagaguacccacuuuuuagugaagcuccgaauuuugcugaucagacuggcguguuugaguacuacaugaauaaugaagaccgugagcaccgcuucacgcugcgccaaguucucaaccaacgaccuauuaccugggcugcagacgcuuccagcacaaucaguguuauaggcgaucaccacuggugugugagagaugcccucaguguauacgcuugcgauuugggguacauucugagugaagggauuccaauaggccgucuccugucaagaaccuaauagguggugggucagaauuaugugaccucaagugaucaaauuagcuuccauguccucccuuuagauuaugccaguuugaagauaauugcggucagagaaauccaacuuuaaugggaaaauugaggauuucuggaccugauuauagguuaauauuuauuugcaggcuuugugaaguguuuuaccagauuugauuuguuaagcugguguugccaccugcuggacaaacaguagaauuacacugccuuagcugguguagggugccugacaaauacagagguagaugcuugcagccaaccacagggucccuaauggaggaguuagagaaaggauccaaggagcugaaggguuugcagccccaaaugaggaacaacaauaugaacuaaccaguacccccagagcucccagggacuaaaccaccaaccaaagaguacacauggugggacucauggcucuagcugcauauguagcagaggauggccuagucggucaucaaugggaggagaggcccuugguccugugaagguucuaugccccauuguaggggaaugccugggccaggaagcuggaguggguggguuggggagcaggggguaggggaaggggcuaggggguuuuuggaggggaaaccaggaaaggggauaacauuugaaauguaaauaaagaaaauaccuaauuaaaaaagaaagaaaauaaauuuaaagacauaugccaaaaaaaaagggagaagcuaaggaaagauugucccaauggucccccauaugcaauauugcucguguguaaaagucuauaauuauaaaaaaguuugaaguuuuauuccaaaaucaaacugaggaugccaaguggacuuuuucuauaguaggaugaaaacgaugguugcuuugaaugaauggcaugagacaaugaacauacuuugcauuguuagcagaaguguuaaggauauagaucuacacugagaggaaagugcacagagaugguggcugcuucagcuuguauuugaaauguccccuacaaggugccuagucuguuuauggaaguaauggagcguuuggaaagugauguauugcugaauggguggccucuguuuuggguuguagcuuuuuuccccucuuuauccaugugagaagccauugccaccagggagucucuccacaaaggcuuuccuacaucaaugggcugaagucugucugaaacuuucugccaaaauacaguuuuucuccuuuaaaaaaaauuaaguagacaagcuuuacuuuuuuuuuuauuacuuuuauuuuuuuuuuuuacaguccacuuguuaucuccucccugucuaccgucccacaguuccucaucucauuccuccuucugcuccuugucuccaagaagaugguuucuccccccuuccccuaccccaggccuccccacuuccuggggccucaaaucucuugaggguuaggcaugucuucucucacugaguccauaccuggcacuccucggcuguauauguguugggggccucauaucagcuccuguaugcugccuuuuugguggcucagugucugagagauccuaggggucuggguuaggugagacugcuggucuuccuauugggucacccuccuccucagcuucuuccagccuuucccuaauucagccacagggcucccugacaucacuccagugguuggguguaaguaucugcuucugucucagucagccgcuuguugggccucucuuggagggcugccaugcuaggcuccugucugugagcucaccauagcaucaguaauagugucaggccuuggagccucccuugagauggaucccaaguuggaccuccuuacccucaggcucuucuccauuuuugucccugugguucuuuuagacaggaacaauucugggucagaguuucugcgugugggauggcaaccccaucccucuauuugaugcccugccuuucugcuggagguggaaguucccucuccccacuguuggguauuuccagcaugcuuuucugcucagggcacccagaaacuccccugcacuaacaccuuuuugccuaauuuccaugugauuugguguuuuggguuuauccuguuuuauauucgaauguuauauccucuauuccagcagcgagauuuguucagagagccacagagacaccaugccugcgacugugggcuggugagggaaguggucaaccccugauggcagaugcaucaugcucaacuuguagauugggaaagggaguucugcaaugagauaacacccacgauuccauuacccacacuuccauuacccacacuuccauuacccacaauuccauuccauguaaauggcagaacugggaccuggccugugucugccggaagccuugcuuuaaucggccagucuucuuccucagagggagacagggaaagaucaguugugugcagcgcugcuuuaguaaggcagucaggccucagcacugcugugugugccucagagcccugccucagcccuagauccugaugagaaccaguaugguaauuugagcaggaaggacgggcuuugcugaagagauauguaaagagauuucugucucuuuguaagcuuugguugugaucugaagaucuccacaaaauaaccuccucuugcucacagcugaauucucuauuacauguguguucucucucucccucucucucccccacuccuauaagauaggguucagcuguacacaauucucuuaagaaacuuugaggaacguaaaggagacguaaggauccauuaucccccugccucauguccagaacagaugucuugguguccuugucuuacuuuagauaaauuguaggauuuguuacuugacaggaugugcaugccuucccuauuugcgguuacaugcugaguaugaagugguugcuuacagggagugauaguauugucucaggaggaaagggcuguacccgggaacaucuuuaagcggaaagcagccgggaggagagcuuacuguaaaggcuguggugguuccuguguggcagaccaucccuguggaccagugaaccuaugcacagugcuuuacugcgucuguaaagguaucaggcagacagccugugcaguguaacacacuucucaaaaugagguuugugcaccagcauccucagaucaucugggaaguugagaugggaauauucagggcccaccucagacuuagugaauuaggcgcugggggacggcgccaucaggcuggguuacccagcaucccauuagauuccagaggucuugcugcagaaucagaacaaaauacuaucuucacauguuuugaauuuauuuuuuaugaauauggguguuuuucccucauguaugugucuguaugccaugugugugcagaccuggcagaguccauacaaggcagcagaucuccugaaacuggaguuuuaggccauuguaaggcuccucgagugcugggaaucaaaccaggguccucuggaaaggcagucagugcccuuaacuucggagucuuagcuguagccuccaaacugacugucauguuagagucagaauugaguuagaucuuuauucaggcauuuuuaaaucuugauagguauaaauuauacucuagucucaaaguagccugaguucugcaacuaucucuuuauggccugcauuuucucugcugguggaaauguaaguaaaccuuucuguucacagucacugaaagccaccuuuaugcagcguagaaauguuuccuuucaaugucacacuugcagaaugaccaaguguuuuaguauauccagacaagaaacaugcuauuaaacaugcuuaaagcuuauaaauauuguccagcaacccacuaaaagaaucaacaaaguugauuaauuuaagcuuguuaaacuuaaaacagucaucagugugcauucuugaagcccauccuugcuacgagcuuaggguguagcgugucagucucucaacugaagacuggaggcuuggccaugccgguacuggaucauagcguagcugacgagggugauguaacugccgcuuucauucugcaggaccaacaugacugugcagugcgauguuuauauagagaccccucggagcggcggcguauucauugcuggaagagugaauaaagguggaaucuugauuagaagugcuacaggagucuuuuucuggauuuuugcaaauggcucuuacagagucacagcugaccuggguaaaugacauguuuucacgugucacaacuuauuuugagccugucuaagugucugugucuucugggaugaauuucaacaugugcuggcgaguacuaagccgcucagaaucauagcuauuugauuuguaaggaaaagggcaucucaguaaaugagaaaauagcagcagaaaggccuuuagggcauucggggcacgcagugaugugaggggaagguuuguggagaacccggugaaggggugacgggagaagagcacucugaggagacacucagacuagaauguuggugcucauagaagucaaaacaaguggagccucuucagauggagagcgccucuucccuaauauacgugauacuuggaaagaguuugccucuccucacugccaugucgcagcagcaccggccugugcagaaaagcugcugugcagggcugacacugaguuacgccuagcucgcacggcuggagugacaaagccccuguggugguaacuucuugauucucggccucuugacuuacuccuguauuagucuaauccccuccccugcaaaccaaucuguccuauaguuuucugcucuuugccccagcccuguuaaguaaaggauuaaggaggugacaggugguaaggaugcuacccguccaggacguaccucacugaguuuuugauccaaagcagagccagagacgugaauugauuuucccugaaaccccaaaacaugucagugguggaaucggaacucgggauuucagucugcagcucaguccccauuguuguaguuuuaaaucaccuguuugguguccgcuccuagguuucuuccagcauccaaaugucauaugugcaaaauuagcuuauucucugucuauuuuaagucgacgcuguucaugugagcacauccauucacuggcagucuuuugcagucuuaggcugcuccaaccagauauagguuacccaugggcuuagaugguaauauaacagacuguaguuaguuuuaagguuuaucucauucauucugcugugaguguacauauuccugugguguagaauagaaucuuaauacaugcuuguguaguguguagcugaacgagggauuuuccuuuuaagucaguuguagaucuggaaaugaaggagcauugcuucauuaacuaaguauaggugccacuuacaacccucccuagguuguugauccuacauaggauuuaggucuuaagaguaagccaguugagauauccguuuuguguuacagguggauggauaacguaugcuucaggacaugcggacguuacagcuaaacgaugguacacacucaccuuaggcauuaaggugggucuugcugaugagacaggauggagauaaaauguuucuguaacuuucuagaauuuucuguuauaaaacaaauggaaggaugugacaaauggugaaaagagggagucugauguggagucgccagacauccacccauagcauggagguguauggcagugacucucaugggaaucaggagucuacuuuucagaccaguguuuccuuucuaacuuuguuuuugccuuuuaaauugaagagugagcaguuaagucaacaagugaauugugguucucaguguucuugaaucaagagucuaaauacaacuuacaggaguaugcagagucauggaaacuuacuucugaucguuuagacucauugaagucucagcacaguuuucuacacuuuuauuauuagaggagauacaggagaguucacaggaugaggggaaucuggccagcagcagcagcagcagcauccuugguugaucaugaagcagauacugaguguuucccaaaggaugcugugcgaucugcgaugugugccucuccugcagcagccccuuccugcuucuguuuagguuguaagcagaaacugaaauugagauucaaagaacaaauuuaaauuugcucuguguucccauccaaccacugaaaaugagaauucucauuuuaaguuguuuauuaguuagaguugaggaccgaguugggaugugagguaguuuauuugaccauacucuuccuagugcacauaauuugcaccacuucauagccaccccugcugggcaugcguggauucuguccggcuugagcuugcacaggucucauuuguggugcaacaauuguugugauuucauauguguguguguguguguguguauguguguguauguguguaucuccccugcuauguccagagaacaguuuuccuuauagucacccacugccucuggcucuuauaaucccucugcccccucuuccacccaugauccaugagccuugggaagaccagaugugauauagcauccuauuuaugguagaccauuuagaagucucucauucucugcaccuagaccaauuugggucuucguguuaaucaccaucugcugcaaaaggaggcuucucugaugaugguugaaagaugcauuaaucuauauauggcucugggcuuaagucauuaaagguuggcuuaauauuaugugugcugacuggaaugauagcaggggcgggaucucuccuggauccuaagacuugucuagccaaaauuucuuggcccugaugauggugccagguagguaagagagaaacauugaaaggucuguuccuagguccaguucugccacuaacggauuuuugagacugggcaaaucaguuaacuucuuccacccuaugauguagcuucaagaucagccaugcuguaugaggaguugauucucagggcuggggaaacauuuuacuuggagaagccaggcaggagguagaugggcuuugugguccauguggucugugcuguaccucuucaccucugcuguuagugugagagagccaugggagagagccaugggagagagccaugggagacgagaugaaagauuagugugccugcauuccagugaaagugcacugcagaaguaggugcuuggccccgaggccacuguuugcuugagcuuuguuccaacucaguaacuuggacgugagugcacacaucauuaugaagaaguuuggggucgugugauaaaauagcccccugcucugccucucuaacuggggaaguuagagaacugagugaugguugaguguagauguaaauggggcagagagcaagcuggguaugaaaggcugcuggucuggccuugugagaggagcaccuggggcuccaggcugccuggagccuggggugugggcccaggaggcaguguggccccaugggauaaacuauguuuaacaugguguguguguguguguguguguguguguguguguguccguguccauguguguguguguguguguccguguguguguccguguguguguccguguguccauugaugacccggugcugacaguuacugcccuagaaguggcagaggauguccaggaagugcugugagacggagacaacugggcagguguguagucaggggcacuggcuucacauugggcauuagguggcuuggauucaguuccuggcuccucugggaaaucuuugacauggaauuuuaaucagcccaggccucagugucuucaucuguaaaauuaaagagcacuguacuaucauuuugagacugaagauuuguguuggguuuuggccugauaaagacucucuaggucuuuaucuuuugaaaguagccuguuuuauauggcuagcugcagacuugguguacuuuugagugugugcucacaguguacuacagcagugguaauaaagguugaaauuuaguuuacugugugccagccagauagcgagggcaacguaauggccacuugcugagaaagacauacuugauuucuuuccaucauuacgagucaaucacacuucauacacacuucccucuucuuuccacuuugccccauuuuucugcuuaacccauggcuacugcucuucugaccuaaggggaggcguuccauauggcucuguaguaacaugcuccucauggggacaaagagaguaaauucaaggcuaacuccugacugagugcacaguccuuaauuagaccuuacacacauagcaguuuguagcaggcauuugggcuccagcaaacucuggaggaaucucuccacuuagucaauguaccaguaugugcaacuacugaguuauuuuaauggacuuuugucugaaguuucauaauacuauaaaauauuaugggcauauuuuuguguuuugauuuuggauagaacaucaggaaauacugagaucucaugcauuugggcaacucuuuuuuuuuuuuuuuuuuuugguuuuucgagacaggguuucucuguguagcccuggcuguccuggaacucacucuguagaccaggcuggccucgaacucagaaauccaccugccucugccucccgagugcuggaauuaaaggugugggcuaccacgccuggcugcauuugggcaacacuuuaaacagagguacuucuuucagaaaaaaaaaaaguugcugaaaauuuguuuucaggcuuuugcugaaacaccugcaauuguauuuuacagcucuaggccuucgaugagggagacaaggcauuugucccacuaaguagcugaggcauauucuuaaauagacuucagagcauuauuuccauuuucaagggauacauuucuuucuccugcaggguuauuucgccuuugguauguugaacggcacgauccuauggaaaaacguccgugugaaauacccagggcauggcugggcugcgaucggaacacacaccuucgaguuugcgcaguuugacaacuuucgcguggaagcugcucgcuaguccacacggggcgucaagacaugauuuggauuuucuauuuuugauuuugguucagggcgaauucugauuuugauggaucuauauaugagccuuugaggcuaacgauaaugaggaguaaauaggggacauggugcauuuuugcuggauccugugaaagguuuauuuagagccgauuccagaggggaugcagguagucuuugacacucucugugguagcucucaaggcccacgguuguucagucccauccuucaggggugcuugggcggguucugcccuugcagccuucgcacuaauaccaagguagcucauuccacauuguuuguaaaugaucgugcaggcaacuggggccacagaggagcuuuugugagccuagccacacgccucagucaaggcuuccuuagaagauggugaugcucaaggggaaacugaugagcacuacagcgaguacuucacugugcagucgucucucccucucccuccaucuccccuccccucacccaugcccucccccccccccccaggaugauacuuuuggaguugugugagaugauggugggaugauuugacaauuaccucauuaauaaacuaacacugaagccauuucugcaguaauaaaaaacaaccagauuaacuggguuguuuguacuuuuuaacgaucuuacauccaacuuuuagauguuaucacccuuauaaccgccuugagcacauuucccccauauaagcuggugccguaggcgaaucuaacugcuucccuguucauuucuugugccuuuugcagugaguccucacaaggggcucugaacgcagcccagcaccggugaaugccuucaucugucaauguguggcaggagggaccgccgaggguuuaacuagcucacagauuuggaucaucuccugauguuuuuggauagaugcacuuaauauauucccaggguuuagauuuaaauguugcuaagcauguuucucauuaguaugauuuauguaacauuaauguaacucuuagaaacagaccaguucuccauguggguaaagugaacucuggaauucuuuauaaggaaaacuuacucauugacauaacgcugcuccaugggaauugguagugcuccagcgaggcagaaguacagugaggucuguauuacuuccgaaaacuugaaaccaaggcuaaaugauuuacuguuuagauuuuaaauuauuuuugaaaaauaacauacaaguguaauuuauaugucuuaaaauauucucauuuuaagugucuaguuuguuuuaauaauuuuguaaacauucccuguaacccacacuccaaugaagcuacugaauauuugcaucacuccagaaaguucucugcuauaccugugcaauccauuccgcucacuccuaauuucaagcaacagugaugucucuguugccaaaauauuguuuguuuugaaagcauggaagugacaggaugcgcuguggacucuucuggauguguguuuuccgucagcgggaugcuguaagauuuguccaguguguaagguuuugccaaagugguacacugcuccuuauuucugaagggagcagcauugaauggaugcaccaccauugguuuuccaucuccuauuuuuaugagaugaaaaauaaaagucaucacagcacuaacauacaaau

SEQ ID NO: 6782 - RNA, 3546 nt, Mus musculus
uggcaaagaugcugugauuuuaucuguuaauguagagaaugacuuauguccuugguauaaacagauccuagcugugaugcauuaaaguuuucuuucuuuuuuuucuuugggauuuuguuuucuuuguuucuuuauauuuguuuuauuuuguuuugauacauggucucuauccauuccagcaaguccuggaacuugcuguguagaccagacuggccucagacuuacagagauccacuucuaccucucuggugcugugauuaaagcauuaagguuuucuuuuacccagugcacuggcugguuugugugucaacuugacacagcuggaguuaucacagagaaaggagcuucaguugaggaaaugccuccaugagauacaacuguaaggcauuuucucaauuaaugaucaaguggggagggccccuuguggguggugccaucucugggcugguagucuugguucuauaagagagcaggcugagcaagccaggggaagcaagccaguaagaaacaucccuccauggccucugcaucagcuccugcuuccugaccugcuugagcuucaguccugacuuccuuggugaugaacagcaguguggaaguguaagccgaauaaacccuuuccuccccaacuugcuucuuggucgugauguuugugcaggaauagaaacccugacuaagacacccaguguggcagugaucagcacauuccaguguucuuuccucuccagcaauauaaacuaaccaguacccccaaagcuccccgggacuaaaccaccaaucaaagaaaacacauggugggacucauggcuccagcugcauauguagcagaggauggccuagucggucaucaaugcggggagaggcccuugguccugugaagguucuaugccccaguauaggggaaugccagggccagggagcgggagcgaguggguaggggaacgggggaagugggggaagaggauaggggauuuucggaggggaaacuaggaaaggggauagcauuugaaauguuaauaaagaaaauaucuaauaaaaaauugaaaaaagcgaagcuguccuaugggcagguauagccguguagugugggccagcaauuccagcucgucauggagucuuggcacacuuggcgggacacugcaggcccgaggcaacacuggacaaccuagggaagccauuauuauucuguaaaauuaguaauucuuugauauugccaaauaccauguuuuguuuucacacaaucucauauuuucuucaguuuguuagaauugguaucuaguuaacuucaauuaauuggaauuuuuuaaaaauccauagcuuuccuccuccuguaccuguugucacuguauaauuuauauguggggaaucugagcucguaguaaauccugacuuaaaacugcagaauucuaaaauuuccacugcaaacuuguggggcgaauuaggucccuaaggccugcagccuccacugagugccaggguucaagaugggcaaaucaccaguuagagaacagcacugagagugcccaugcucucaaguuaggauugguucaagccccagcauccauggcauggguaagaaaaggggggaaaggaagaugggaaggagagaaagaaaggaacaagaaagguaagaaaagagagaggaacgcuggcacgccugcuuggcagaacaaguccccugcugcuuacugagcacagauaguggacuucuaacuccuuucaguacaaaugaaggcgugguuuaucaguaggcagugagaaaagcuaugggagccuuucuggagaaucuggacuaaguguggaggagcuagaaagcaguuuuuaguuagacagugacugcacuagccacagugaccagcaggacacuaaguacaggacagcugcaguaaucuggaaaagaaagguuaagagcugggccccgguauuacgguauauaaagaacacaaggaacacaaggcagguuacuauuacaaagcugauugcuaggagucaggaucugguuuaaugaggugaagagaaaggcagaagugaaaaagauacccacguuucugaugagaacaggaugacugggggaacauagaugagaggcaugaguuucuuguucggcauacucagugccuugggaacauugaauguauuuuggagacauuggauguaaguaucucaucaggagagagaucugggagucaucaggcaggguugagaccucccgaggaugcucuauagcuacaaggccagggaggcugcuacccuuagaauaagucugucccaugcucugcacugugauacgacuaucuguccacccuugagggacucacaagucaauuuuuuuaacauuuauuuuauuguauguguaugugugagugccuacauguauacuauauuaccacauacaugccacguguccuuagaagccagaaugagacauuggacucccuagaacuggauuuacaagugguuaugaacugcuuuguggauccugggagccucacacaggucuuuugcaagaguaaaaauguucuuaaucuggguuaucuguccaacccuuauaguuuuaugauuguuaaaaugguuuauucucuuaacauuuugaauauaaaguaaauaauuuugagauaagaauauuuuugaacuguuuaaauuauauauuuuaauguacuuuaugaaucauuuauaauaaaguaaaauaaacauuaauaugguuauuaauuuuuuuccuuuaguaucuguaauccuauaauuugcuugccucuaugguaguucauauauaccuuuaugcauuuuuaugguuccauuuauaaauaauaguaauuuuuaguuugccuacauguuuuuugccuacauuuuuuuuuaauugauugaguuauuuauuuuacaucccucccuccucuccucccagucucucccucucaccucaccucccucugacuugcaccucuccccaggaaagggauggccucccauggaugucaaucugccuuggcauaugagauugcgguagacuagcgcaucagcucagucaagggaaagggauucaaaggcaggcaacacaaucagagacagccccugcucccacuuuaggagucucacaugaagucuaagcuacacaacuauaaccuacgugcagagggcuuaggucagucucccgcaugcucccagguugccacuucagucucuaugaaccccuauguguccagguuaguugauuccugugguuuucuuguggugucguugaccccucaagcuccuuuaaaucuuccuccccaccuuccauaggauuccccgaucuccacuuaaugauuggcuguggucucuguaucaguuuucaucagaugcugggugaagccucucugaugacaguuuugauuugcccaggugacuaaggguguugaaaauuucuuucuuucuuucuuucuuggcuucgaacucagaaauccaccugccucugccucccaagugcugggauuaaaggcgugcgccaccacacccagugaauauuucuuuaagugcuucuugccauuagagauuccucugucaagaauucuc

SEQ ID NO: 6783 - RNA, 3546 nt, Mus musculus
gagaauucuugacagaggaaucucuaauggcaagaagcacuuaaagaaauauucacugggugugguggcgcacgccuuuaaucccagcacuugggaggcagaggcagguggauuucugaguucgaagccaagaaagaaagaaagaaagaaauuuucaacacccuuagucaccugggcaaaucaaaacugucaucagagaggcuucacccagcaucugaugaaaacugauacagagaccacagccaaucauuaaguggagaucggggaauccuauggaagguggggaggaagauuuaaaggagcuugaggggucaacgacaccacaagaaaaccacaggaaucaacuaaccuggacacauagggguucauagagacugaaguggcaaccugggagcaugcgggagacugaccuaagcccucugcacguagguuauaguuguguagcuuagacuucaugugagacuccuaaagugggagcaggggcugucucugauuguguugccugccuuugaaucccuuucccuugacugagcugaugcgcuagucuaccgcaaucucauaugccaaggcagauugacauccaugggaggccaucccuuuccuggggagaggugcaagucagagggaggugaggugagagggagagacugggaggagaggagggagggauguaaaauaaauaacucaaucaauuaaaaaaaaauguaggcaaaaaacauguaggcaaacuaaaaauuacuauuauuuauaaauggaaccauaaaaaugcauaaagguauauaugaacuaccauagaggcaagcaaauuauaggauuacagauacuaaaggaaaaaaauuaauaaccauauuaauguuuauuuuacuuuauuauaaaugauucauaaaguacauuaaaauauauaauuuaaacaguucaaaaauauucuuaucucaaaauuauuuacuuuauauucaaaauguuaagagaauaaaccauuuuaacaaucauaaaacuauaaggguuggacagauaacccagauuaagaacauuuuuacucuugcaaaagaccugugugaggcucccaggauccacaaagcaguucauaaccacuuguaaauccaguucuagggaguccaaugucucauucuggcuucuaaggacacguggcauguaugugguaauauaguauacauguaggcacucacacauacacauacaauaaaauaaauguuaaaaaaauugacuugugagucccucaaggguggacagauagucguaucacagugcagagcaugggacagacuuauucuaaggguagcagccucccuggccuuguagcuauagagcauccucgggaggucucaacccugccugaugacucccagaucucucuccugaugagauacuuacauccaaugucuccaaaauacauucaauguucccaaggcacugaguaugccgaacaagaaacucaugccucucaucuauguucccccagucauccuguucucaucagaaacguggguaucuuuuucacuucugccuuucucuucaccucauuaaaccagauccugacuccuagcaaucagcuuuguaauaguaaccugccuuguguuccuuguguucuuuauauaccguaauaccggggcccagcucuuaaccuuucuuuuccagauuacugcagcuguccuguacuuaguguccugcuggucacuguggcuagugcagucacugucuaacuaaaaacugcuuucuagcuccuccacacuuaguccagauucuccagaaaggcucccauagcuuuucucacugccuacugauaaaccacgccuucauuuguacugaaaggaguuagaaguccacuaucugugcucaguaagcagcaggggacuuguucugccaagcaggcgugccagcguuccucucucuuuucuuaccuuucuuguuccuuucuuucucuccuucccaucuuccuuuccccccuuuucuuacccaugccauggaugcuggggcuugaaccaauccuaacuugagagcaugggcacucucagugcuguucucuaacuggugauuugcccaucuugaacccuggcacucaguggaggcugcaggccuuagggaccuaauucgccccacaaguuugcaguggaaauuuuagaauucugcaguuuuaagucaggauuuacuacgagcucagauuccccacauauaaauuauacagugacaacagguacaggaggaggaaagcuauggauuuuuaaaaaauuccaauuaauugaaguuaacuagauaccaauucuaacaaacugaagaaaauaugagauugugugaaaacaaaacaugguauuuggcaauaucaaagaauuacuaauuuuacagaauaauaauggcuucccuagguuguccaguguugccucgggccugcagugucccgccaagugugccaagacuccaugacgagcuggaauugcuggcccacacuacacggcuauaccugcccauaggacagcuucgcuuuuuucaauuuuuuauuagauauuuucuuuauuaacauuucaaaugcuauccccuuuccuaguuuccccuccgaaaauccccuauccucuucccccacuucccccguuccccuacccacucgcucccgcucccuggcccuggcauuccccuauacuggggcauagaaccuucacaggaccaagggccucuccccgcauugaugaccgacuaggccauccucugcuacauaugcagcuggagccaugagucccaccauguguuuucuuugauuggugguuuagucccggggagcuuuggggguacugguuaguuuauauugcuggagaggaaagaacacuggaaugugcugaucacugccacacugggugucuuagucaggguuucuauuccugcacaaacaucacgaccaagaagcaaguuggggaggaaaggguuuauucggcuuacacuuccacacugcuguucaucaccaaggaagucaggacugaagcucaagcaggucaggaagcaggagcugaugcagaggccauggagggauguuucuuacuggcuugcuuccccuggcuugcucagccugcucucuuauagaaccaagacuaccagcccagagauggcaccacccacaaggggcccuccccacuugaucauuaauugagaaaaugccuuacaguuguaucucauggaggcauuuccucaacugaagcuccuuucucugugauaacuccagcugugucaaguugacacacaaaccagccagugcacuggguaaaagaaaaccuuaaugcuuuaaucacagcaccagagagguagaaguggaucucuguaagucugaggccagucuggucuacacagcaaguuccaggacuugcuggaauggauagagaccauguaucaaaacaaaauaaaacaaauauaaagaaacaaagaaaacaaaaucccaaagaaaaaaaagaaagaaaacuuuaaugcaucacagcuaggaucuguuuauaccaaggacauaagucauucucuacauuaacagauaaaaucacagcaucuuugcca

SEQ ID NO: 6784 - RNA, 40810 nt, Mus musculus
cuucacauuauuaaacacagacuuuuauagaugugacuuuauuguaucuuaacaguuaaauuugguccucaaaauguuugagcuuuuauuauccccuuugcuaaccaccguuuacacuuuaauuuuuaaaacaacacguuuuugaaaucaguugucuguuauuuaguucuaaaacaugacacaucuugccuuaacaguuucaaaaaccacacauaaaacuccauaguacaguaggccaaguuucauccuauugucaaguuuaccuuccuaucucugcaauauaguucugucauuuaaaauauaccacuuaaaucucaacuucuacauuucaagaaugaucuuuaguaauaacauaaguauauuuucugugggguuauuucugaugauauuuuucagaauaugggaauauauacguauauuuauauucuugugaguucaaagucuguuuucugauacuuucuguacauaugccuguaaaaauuuuuguauacuuuugugauaauguagucccuccaaaauuacuuauaaaaugauaagcuaauaguaaaugggagcauuccaaagaacuguccauauauuuuuacaucgucauuccaacuaugcuuacccuuuaugaccaugucucugcucacuuucagaaaggcacaggaccucgguccacucuaccaaaguagcacucaaaauaaagucugcauuaugcuucucagagcaaauucauuuagacacuaaaaaaagaaauuuaaacuaguuguuccaaagcugccucaguuucaaagccuggccacuguuaccacgcuggguuacagacacugcauuaccuuugggaaaagcugaaaagugcuucagcucugaggacacuggccuucccacagcacuacagcccuaagcugcaaguaccauuaccaaaaaugauauuaaacagcaauguacaaacaugccgcaaauguuuuaauagaauuuggcuuuucuuuaaacugucuuuuucauagucaaaacgaacaaacaaaaaauguugaaaccacuuaauaaacuuacaaacuugaaaaauuagacacuucaguggggcaguaaaauucguauuaugaaagcaauauauucuaaauuucaaagacgugacaaguucuguagaacaucucucaucagaagauggaagcuuucaaacugcaugaucuucugccagguaggacuagggcaucacucacuggauaaaaccaaaauuuuuacguuaacugcuuugcauauaaauaccauauacauuagcuaaaaaguuuugucuuuaaauaauucaauuaugcaguuuaacuucuaggccacaguaaaauauugugaaacuucagucuaaggaaacugauguggaauuccuuuuguuuuuuuauguaugugugagcacacauguggcacccagaggucaaccucaaaugucacacuaccuacacccuuucaaauucagggacucucaauggccuggaacccaucaaguaggcuggacugccuucccagcucuacauacuaagaugucccacauuuuuacauggauucugggaaucaaauuucagauugucaagcuugugagguaauaagcacuuuagagaccaagcagucucccccccaucccugcuuugagacugcugaucaguguguauaauacauccacacagaccagucugcuggccuugguguugcaucuuuacuguguaugcucacaaguuuuagaaaggcugaaggguggagcucacuggguaccuauuaugcauuaggcucuggauucaauaauuagcgccacaaaaaaaaaaaaaaaaaaagaacccaucuggagaugauguagacuaaaaaaaaagucaucacuggauaaauuugguucauguaguaaaucauuuuugcuaaggaauucuuuuaaaauuaauuuuaaaggaacaggggaagaaauaaaacucauugucccucaguuugugugccuauacaacugaagaacacagacaguaagauguaauucuaaauggcgucagcguuuaaagaacgaacuuaaacccucaccugcucugaggucgaauccauuucaaggcgugucuugguggcacaguaaugguggggugauaaaaugugcagucaggucucguacacugaguguuaaaccuacagugcugaacagaaacgagaggagcaaaccuuaaaaucuucaagcuaauacaggaacugcgcaccucacucuaacgcuaacacuccacaguaacaccacugaaagccuuagaaaauacacacaaaaccagacauacacggaauuuaaaauaaaacguacacaaaaaugaaacccaaacuucagaaugagagauuaccacuaaaaccauuuuuuagaaaauaaaacuucuuacuuuugggugguagaagggacauuccauuuucuuacaagcagggaaguaacggcagagcuggccauuagaagacggugcuggugacgacacugacaaucagagugaacaaugcucaaaucuauuuuggcaacaacaucuuuuaaugcaguuacugguaagguuaguaucauuuaauuuagaacaaguuuuaucagucaagauaaaauauagcagaguucuguaagaaaggcagauuuguucuuuaaauacuaaaaucauuucuaaaacuauucuuuuguuguuuccuaucacuuagagccagaaaaugucguuuucuucuuuuugaccugacuauaacugcacaaaguuacuaaccugguuuuggagucaguaucgaggcucuucuacucaugugagugaagggacaaucugcuuuaguacacuuugugucauauuuacaauuuggaugcacaaacaaacauuucucagcaaauuuacaguugggaaaggcucuauaaaacaaaaacaauuauuauuuauauuuaacaucucaaugacuuaggguuuuuugggggggguggggggguucuuuuuagagggacuucacaaacaccaugcccggcuggaaagauagcucagguuuuucaagcgccugcugcucuucuaaaggaccugaguucaggucccaguaccaacacuggguagcuggaggccuggaccuccagcuucaggggauucaaugcccucuucuggccccuggaggcaccugcacacaugugauaucuagucugccugucucacauacacaguaauaauggacuaggaacacuguuccauggaguacuucccugauaaacaugaagcucuggcuucaauacucuguggugggggugaggaguagggcggggcaacuaguacuuuguuaaaugauacuaaauaccaaaauagaacacaaguguauuucagaucuggaagaagucuaacauguugcaacucaaggcaagacacuauaaaauagauuuugagucauucuacuuuaacagaaugccaaaaccuagauuucaccacuucuccuuuuaugacuuuuuaacauuuuuaugugcauugauguuuugccugcauguuaagucugugugaggaugucagauucccuggaauuggagucagacaauuguaugagcugcgauguggguacugggaauuguaccuuaguccccuggaaaagcagacagugcucuuaaccagugugacccaucucucuuaaguagauuuuaaaacaguaaggacauuucugaucaaggcacuguacuguaagagucauacuuagucuuuacauacugaaucaugcuacuacauguacuuacagugaaaacauggacacaguccagucauuaaaucaaacaguugguaaggaaaacuaauccacaucuagaauauuuuuuucauuacucacauaacucaauuuauucccaaucuaaauaaaauagauaucugugaacaaauauauacuaacuguauaguuacacuugauauaccaagggacccagacauuucaggaucccagguaccaaacacacaacauuuucaaaacccacaaagcuccagggaugguuaugauagguaucaagaaucguguuuacugauaaacccucuacagaggugaacaggagaggugguaggauguagagauuacuauggaaauaaccacuggauauuacuacucacuugcaaggugaaaugggaugaugguauacacacucauccccauuuuuacaggcaggccaguacuugcagcgcuccagaaguuuuucugguuucugugccacacucaggucagucaucucggcuucaaaaaggaauuaagaccauuuuguucauuaggcuuucaguacaaggucuaugcaauaaaucugccccaaaccccaaucucaaaguuuuauauuccuuaauguuuguagcccugaaaaauaaccccaagugauauggccaaucaauccuaguacuggaaccuaaaagcuagcagaaagaagaccagaguugucauaaaguccuaaguaaguuucagucucacuucagaacugaaauacagaaguaaaagauaccaaaguuaaaaaugaagcuaaaaacaagcugauaaggaaugagaauaauuuucauauucuagcaaaugacaaguguccaaauaagaaauuauuccaaaucacugaaguauauauagucaguaaaggucugggcacuaaaaucacccugauaucgaaggggaaaacagcuuuacagaagaugagccaacaaaugacacugccuaugggcuuggggauggggguagaauagagaaggucuucuuuuuuuuuucuuuuaagauuuauugauuuauuguaaguacacuguagcugucuucagacacuccagaagagggugccagaucucauuacggaugguucuaagccaccaugugguugcagggauuugaacucaggaccuucggaagagcagucaguacucuuaaccguugagccaucucuccagcccuagagaaggucuucuaacagcuagucugaagucuggcugagugaaagaugcuauguggcagaaguagacagacuaggacuauggccuggaaauaagccuuacccauggaguucacugucugcauuaagucaugcccaaauacuguggcaggagaaugggacuuuuccuaugacguguauacgaaacuaauuuaggaugcagauaacuuuauacaugaagaccauaauccacuaccuucugaucugagauaucauuguuagguuuuacuguuuaugaagccaacucucacuuggcuagacagcagcaggguguccaagcucuaguaggucagauuggcuuugcauauuaguaguucaucuagacagcuugggcaaaaaucuucuaucugugaaacucaccuuauucagaaucagauuaugugaaaaggcgauauuucugcucuagugacccaaugucugcccucccgacagaagaacuuggcacaaaaagcaucauguggugaccacguuacugagacaggagcuucaguaaugaccacaauacgccugauacaaauuucuauacuacuuuaaaaagagcaggacugggagucaguccagcagugaaugcuuaaggcccugggcacccauaaggcccugggcuucuucuccuaggcaacaaaauaagaaaaacagaaaguaacuuauuuucaacauaggauauaaaagaauuucuaaagaaaccccaacagcauugggaagggaaccucacucacuuguagaugaucuuugucccaccacuacaaagaaaacugccccacacugcuacauauacaagacaugaugaccuagaacaaaggaagacuagauccaaagagcaaugcagccagaaaaaugaaguagcuacucaaaauaauaauaaugauaauaauaauaauaaugauuauaauaguacuaguaguaguaguaguaguaaaguauguuacaaggcgauuuucucuuaguaaaaaaaaaaaaggaacaauauauauaagucauggcucuuauuuuccuaugcugauauuuuacuuuauauaugauaaaacuucaaauuuaaauuuccagaggcaaauucacuguguauugaaagcuguaaugugaugccauaugauguucaguggggguguauuaacauagauggugcgguugguuagcacucucaaacaccuccaccaaaauaagcaacccgaagagaggcuucaacuccccgcuugcgcuaggugaagacacaccuuccaggguguagagcuucauccccacacuuaacugaagaguucacaguggcaaaggaagcacucuacucauccacaguggccacaucccucacacaaaauaggcagacccaugacuggcaugguacccagucacugcuucuucccauauaccaacaagcccaagcauggaaacucaccuuuaaauggaaaugggucuuaauagagcuaaguguuaagcuaucaaaucgacaacugagagcagugacaccaagccuuccuaauguuagacaaagcaugcagagucaagaaauguguacugccuauugcaguuuuuaccuuucaaauuuuguuuugccugaggucacaacuacagcucacuccacaaccaagacuauacccccaugauagacuuaaagcaggaauagccucuuacaaguguuucuugcucacagacucaucuguucuaguuuaccauauuuuuugguggaugaagaaacguuaucaauguaucuuuuaugucucugcaaagaaaaggauuacuuaggaaacacuuguaaauuuacugguuuuuccuugaauuuguucguuuuuaggaguuaguaauuaacucuccugcuuaagaugugguguaucuaaaucaggagugaaaaguaugggugggggcuggagaucgcucaguggcuaagagcacuggcuacucuugcagaggacccagguucaguucccagcaccccuguggaagcucacagcugcauguaacuauuuccaggggaucugacacagcagcaggcaugcauguacugcuacacauucauacaugcaggcaaaaugcucacauaaauauaaauccaaacgaaaaaugacaaaaugaagguaaaggacuggugugugcgaggugaggagcgguggaaacacaauaggcuccuaagguaggcacugucugaacugaguuccucugaguacuauccaggaucaauugccacaugaggucuuucaauacuucaaaaguguccugccaaauuagguaagaaaucccuuccaaggaaacaccaaaaucaaaauccaucuuucucucaaguuaacuaugagagauuguugcuggucaaugcaucaagaaugauaguucauccuucagcaaucauaauaaaagguguuuuagaugacacugacugagcuucaucguaucaccagcaucacagaaccccgugaaacaagcacagagggaguaugaaauucaacugguggcuuuguaugacagaagaaaacaggcuacugaacagaaauauaagcgaggccucaaaccaauauucacucaagauaucacaggccaagacuccguucucaaugacagugggcugagaaggcaaagucugagcucucaacacaccguuggaaaagcuaccaucuggguccucaagcugccugcucagcaaaugcaacugcuguggguggaggagaccucugagucccuuguuugaggcugaaguuugguuuacggguuucauuccuucaaagcacaucuccuccucuugaucugacauguauccuggggggcuggggacaccauccagcgucacuauaaacuugggacuugcagguuuaucugguuguacaagaucucugccagacagauaaaaaauaccauagaauuagggaaacgaacacaaaaugcugagccuccuaaaguccucuuccgcagaacuguaguaacaaaggaguaccuuugcuuugcgcuugcuucacuacgauaggcuuagaaugacuuccugauacagccuaaguggaauccuaauacacaacggccauggacagcacuugcagcagcaucacagugaccuucuagccuggacuuacuaauagugacaauauccucucaacugugacucuccauuguccaugggauccuuauaggaucaacauggaaauaaaccaaaaccaaaccaaaccaaacaccuuagaauggaugcucagagcaucuggcagcggcuuuauuuuuaugugauuuuuaucaucuguacauuucuuugcugaacacucugucugcuuucuuaggaaggaaccacgcaagccuuaguccuuaacaccuugcagaaggauuuccugauuuggguuacccagcuuuuaaaguccaauuccuuggguauacauuuaaaacaaaauacuacaccccuuaucaacagaguucaauuauacucagcuuuuauuucuauuuaauggauuucugaacaagaaagaugaacucgaauuuuugagagcugaauuuggcuacuguuggccuagccagugagucacugagagcaccaucuagugggagcuacaggaacagggaagcugggaacuaacagcugaccugcacuacagucacacacaguagcuacacaagaaaaagaaaccaucuaccgugucugcauaagguguccugaaaggacccgaagggcaucugcagucuucauccccgaauccugguugggugucacuacuauuuccucagacagcuuuggcuucuucagaauaaaugaucuugugucugcauggaccauggauuccaugucauaguaaucugagccaaaaaaauuggccauaaauguuuacuucugaauauaccuuuuauucucaaaaucauacaagugagaagaaugucaaaucuuuuauauaauuauaauuacuuuuaaggaaaaucauaacuaauucuacuaagggauaggauuguaauucuauuccaaacaucucuucagagaauucaaauaguccuuuccucacaugauacauuacaaaugccuuucuuugccuaaggcagagaaggguuuuccuauaucacaucuguugggauauuaaaagcacaguaaaaggacaacaguuacuuuuuauuccaaaaucagaaagaauuuaagaaaucuuaauguuuccuaaaauuauguuucaaaacuguucaacuacuuuccccaaacgaguucuauucauuuuucacaguaauauuuaaaggaaauacugccuauuaagaauucacuuggaauaauuucuaaccagguaaacauagaaaacuauuuugaaaggaaacuuuaagaugaauguaucacacuaaucuucaaugcaagucaccacaagcucaaaucaucuacuggcugucuacuucacaaaauguagcaagaacugaguucagaguggguaugauaaccuaucaguauacaaucaagaccaaauucaggcuauuaauucacugaauauuuauuuacuguacaacuaaauacugugcuaggaacgcagauaaaggaaaagaaaaucagaaacauacaauucuaaaacaacaaagcccagaaagggaaugaagagguguugguagaacacaagguacuuccuccagcugauaggucaaagaaguguuggcugaagucgaauauguaaaaugaguauuaaaggaauguguaagaggagagcagagagugagagagccaaugcaggcagaggaaacacauggagcaaggaaggggacuucacagaacauuaagaaaaggugagaaaugugaaauggcuaaaaagaugcaugugauggugugacgggguaagaaagacugaagaaaugcaaugauggaucaugugccuaaguauuuugaauucuggucuagaaauauuaagagauuccuaaguagggaagaaacacaaucaacagguuucuaggaaacaaaguuaacauaucuucuucucaugguggguaugguuauacacaccuucagucccagcacucaggaggcagaggcagggaaugcuugacuccaaggguauccugaucuacagagugaguccaaggucagccaggccacaaaguaagaccuagccucaaauggguuaauaaaaauaaaauuucuguccuucaucccuucaacacacgaggaagaacaacaugcccuacacucccaucaaccaccagggcucuacagggggugggggugggcaaggaggcuacaaccacaggcagggaaggcaaaauggggaagaaagagaugaggcgaaaguagaaaguccagggaggaggaacaguaggaaauuuucaguuuuagauuucuuuaguuugaaauacuuuagaaggaagguaaaaaugugcagucugacagcuggugagaagagagcuaagagcacaaguauuaggaacgcucaggagcucaccucccuuccuguuuaguuugaagucaucgaaucuaauuuacacuuugcacuggaacucacacauacgcacuuuaacugugaucuacugcugcuggacggccauggcccccacccccaaaccccacccuagagaaaaagcugacucauuaguuuucuucccacgucccacaagcccuucaaugaguaccuagcuaacuagagcagagcccagaagcuggucuaaggaaugcugcacucccuuccuggcacucuaaacuuucuguuguauagcuguucucccuaguucauaccucagcagaacagacaaaaauaaugcugacaggaaaacgcagguaaaguuagccauuuagggagcagccagagagaagggcuggaaaaggagaaugaaaggcagugagaacaaaaggauaaaaagcugagaaaaucacgggaugcaagcgucacaagcucguagggaaaggugcagccugaguccaggucucaggccagggagacugaucagugcugaagugcuugccagcuuggcuauccagaacccuaguaaucaucaggugggaguggugagccacaggaacuucagcuucagaaugcaaaggugggagucccagaggaaaacuagucagaccggcaaguccugggucugacugaaacccugccucaaugaggaaaguggaagagcaagggaagaggauuccuaacaucaacuuuaagccuucacacguguguguacacacucacagguaacauauacaugcuacauauacacagaugacaaaaagaaaauagauaucuguacucuauauacccagcacggccugccucagcuuaguaaaggugcugggucacaggcagucccggauaggggggaauaguuugucuggguagagaccugggcucagcucaaacauuuacuucugaaccuuucugaaagcaguuaaaaaaaaaaaaaaaagcaauaaagaguuuuguuuuuuagagaaaaagcuguaugcccauaaggaaaacaacugcaaaggaacaaccauguuuucaaagaaaaaacagauacagaaacugauucuaagacaauaauaaagcaaccuaauuuagacuacaagauucuccaagauugaaaacaagcagcagaggggacugagggaagaguauaaagaacaagccaugcuagagggcugacuucggaaguaaugagccuuuccuacagccuaagucccugcacccaguuucucuguuuggagccucagcacacccacccccucacuacagugaagacuugcgaaugaccagguauguacccucuuguccaucacuacuggagacucagagauaagccagccaguucuaaacagaaagguaccacaacaaaauaacaucaacggugagaaaacuguuuaaaaggcagugcucugaaaaccuuuaccauuuuauagauccucucccuuggaaagugagacuuuagacucucaauaaguccaagaaaugccagcaaugcucaaauaacucuacagugaaacauugcauaguaauuaaugguaauuaauuccuucauaguucugcucuacugagcuaucugaacucugacaaucaagacuauuuuagaagaccuuuauuggcacacugaccagacuaagaacaccuaacugguauuaauacucaggcugcccccaaacuagacuaacagaucauccuccacacaggacccacaauaaaagccaaguccaaacacucacgccccaacucgagucuagaaugucagucagcauuuuacugauccuccuuuaaaacagauaaucaaggaauggagaaccucuaucauaaaagucagaaccaacaacucagagaaaacaagaccaaggagggaaaagggaaauguuaaaaucauuuuuugacauccucaaaauaaaaaauuauuacauacaugagacaaaaucaguauguuaaaaaaaaaaaaaaucaaaggaacguaaagauuguucucagaaauaaaacaaucugacagaauaaagacugugcucacucacgcauaagccucaaaagaacuacuuaaugcuucaaaugagcugggaaugaagguaaaaaacaaaccaagaaagaaugcaccagagcugaugauguggguacaacaaggcacagacuuagacaccacauuuaaaacgacuuuauuauaugcaguguugaaagauggaggcaaaaccaagguugcagcaucuuaacacucaacaggcagaaggcaggagcaagaggaggaguaacaccaucccagucagauggguaggaccugggguuuagauggaggccgacccuugagagcauagcacauguugagacagagacuacagaaacaacugacuguggaguuggacggggugguagaugauuuaggaggcagaaaggagagacaggaaucaaggagcagagcuuccaacaaaaggagggcaaauucacaggaaacgcaagaacacaaguguuagguaugguggcacaugcuaguaaucccagcacuuggaugagaaagcagauggacagcaaguuggaggucagcuugagccacaaaauaaaacugucaagaaaaaaaaaaagaaaaaguuucauguauccaaccaauuguuuccugcauuuccuaaauucggaccuggcagagauuuggggaaccaaagacacagauaaaaauaaguaccucacugcaggccugaagcagcagugggcuguguaucuggguugagcagagcgcuucacagaagcuuuagaacaagugguuaguagucccugagaacaagacuguaaagugaggccaauacacuggguagguugaacuggugcagaggggaugcugaagccacucuggaaauacagcagagacgggagaaggugagcuagggacacaagcuucccugaccgacaaugagcagcacaggguaaaggugguacagggacucuagcugccuucacagcagcuaagucaacagcuaaaagccaaggagcaaaggauggggaaaagaaagcuuaugaaugaggcaaaaccaccacacaugaaggaaaugcagaucuuacauccuggcccuaaaggauuucaaucaucuaauugugcugucuuagggcaggaucuaagagauacaugguacacugaaugagguguaaggacuggggauggcaacagaacgauacagugauaaauggaaacacuacccaccuugacucaucuccauuguuucuaccauuacuggaucaauuugcagucgggauaacaauugccucuguugaguuccuagaauauaaguuuuaaaacuucacuaaguuuaacacaaguauuaauguuuguuuuucagaaauaaaucuuugaaugauuugaaagucuuacaaauaaagcuucuacaauacaauuugcuauuauuauggucuucaagcauaucucuguuaaacaaaaugcugguguuuuguuaaaucaaaaauggaaacaaaguccguccuggcucccaaugugagguggccagucuucuuagagugaagacaauacaguaaaaggaagagugcccaaacaggaggggccucacggagagucugcuuccugcacucuuagcccgacuuacccacacugcuucccuuuccccacgaccuccugaccucugcaaauugcaaagcacaugggaacuuaaaccaaaaccaaacuauaguccauaauuacccugucaugaaauuccuaaaaaacaaacuggcuuggacauaugcaaaaccaauaauggaucaaguaugggauucaggauucugcaacgagagccuccacuggcuacacaacagacuccccaugcgcuucacaagaaugcuccgcugcucaacaguagcuccagauuaccucuuccuaauguagcuaccucaguuucugaaaguagacacuuugcccaaugaugacaucaccuaaggacugcccugucaccaagugacgcggugccaacauaaaucaguggcucucaaccuuccuaaugcugugauccuuuaauacaguucauguuguugugaccccaacuauaaaauuauuuuuguugcuacaucucaaguguaauuuugcuacuuuuaugaacuguaauauaaauagguauuuucugaucaucuuacgugacccaaaaagguugucugacccugaaaagggucaugacccacagacugagaacuguugauauaaccauuuagauuuauaaauauauauuuuuaaguugaucagguaaaguacuuauuucuaaaauagcucuuaaaauuauuuuccaacauuaaguucauaauacaaauucauauuacuacucuugagcacuugucuagaggguuuuaacaggugggcucuaucagguaaggguguucucuucaacugaauauguagcuuuggaaaggaugcagaauggagcagugaagaaagguacaccugcauaguaagugaaaugaacugcgucaacccugguaaccaacggcgacagauucauagccauguggcacucacaucagcaucauacuaaaauucuuuuuuaacauuuauuuuuauuuuguaaguaugacuguuuugaagcauuuauguucauucacuucaugugugccuggaacccauagaggccagaagagggugucagaucccccuggaacuggggcuauagacaguugugagccgccauauggguucugggaauugaagagcagucuucuugaagagcagccagugcucuaaaccaguuccuucucuugagccccauacuaauauuaauauccauacacaaaacaaaacccaaugaacugacuauccuccaaacuacuugaauuaugaaaagagaugucccauuuuacuguaccuguaauucccacugugcuuaaaucacaaguacuuaguaccuaauuucuaauugagaacaaaggcaucaaacuacauguauguggagauggaauuaguaugaguccaaauacugagacucucaguaagucaacugcuugcuaguuuucaggguaucuaguauacauggcuccacaaggauaggcuuugcuuacacaaugcaaacaagacagcaaggucuugccaaguauaucacugaaagacuuaaaauacugaaguuaacauuuuaccagcuguucauugucaaggaagguuuccuucuccagagagacaugcacaaaagagaauaaauuccuuuuaaaaauuaccauggcaaaaauaaucauggagaauagaccuuaauucauagaucugcuuaagcuauauuccuguuggucaacauacuaacauguuaaguuacagaaccaguaauaaagugaguuuuacagcagaauaccaccagagagguacuugaaagagaaucauuuccucucaaguuuuaucuugaagcccauccauuacuuuuucaaaucaucauccuaagccagguaugguggcacuugagaggaugaggugggagaaucacucauaucaucaagaaaccaucaagguuaauuaacuuaaccaaacuaaaacaaaauacucccugccaccccuuuuuuuggagacagggucucauuauguaggccuggcuggccuggaacuuuguagagcugugacugccuccugagugcugcugguacuaaaggugugccaacacagcuggcucccaaaaaaauuguuaaggguguucugagugguugaguucuugccuagccuagcacguguaaagaauuacauucaguccccagcaucuucaaauacaaacaaaaacacauucaagcucugcucaaacauucuagaccccaguuaaguuagacagaguaccaagcacuaaaacccucggcuucuuuugucuaugcugagcuguaccagagcuaagcuagugagaaaguucaaaggaucauaguuuaccuuucucaaccucuguuaggaagccaauuagguuugcaucaguagucucugacugugacucaaauucuagucucucuugaaaaucuuccaacugucuguugcauucagauguugauguuaaauauucauucauuuuaaccucuaaagaugaaauuuuugcuucguucugggacacucuaacauucaaaucaaaaagauuugcuuccacugucaaaauagcugcuuucauuccuuucauuucauugauaucaguugcuauuuuccucaaaagguaggaaauauugcccagcucauuuagugaacaagaagcacuugucagagagccuaagucagcuggcucuggugagaggaaaacugguagagauggugaugaaaaccuugaagacauuuucauaaaauuacuggcauuuucacagccuguuaaauuaucucaucaaaaguaaaagcaaucuucaauauuaacuuuagagugcuagugaccuacaacuaaaaagauuaggugacaccuuucuaaagaaagaacucauacugugaaaaguuaggcacaccagaucaguuuucucuucuacaauuaagagcacugcaaccacuacuuguguccuguaaguccuaccuacuuaucagcuccucugcaaaaaagacucuauuauuacauacaaaauaauccugacuucugauuggcugaucagagacacaugacacccaaggaacuuucuauuauuuacuucauguguugggaauccugaagagccauuccauaaauuaagcaaguauguucacccuauuguccacucaacuguaauuuuggagcuucauauugaguugcuuuaucguaaauuucauuccucugguaucaguagaugacaguacugcccuggaauuaucuuuguagggagagggcagagaagucgacaaaucucuuaaagacuauuuacacaguaaggaacuccagcggaacacccauguaaaaugaugcaggcuggugauguggcuuaagagcaaaguaccugccuaguacacugaggaccuagagucacuccucaguaccacuaaaaucaaaaacaacagugacaaaaccccaaucagaauggugucaguuuuaaaagaggaaaaacuagugcaugcugccuuggguuugauacaaaagcacugagugcaucucagauguuuucauccauuuaugggugcuuugccuauuaccuuugcuuguuuguuuguuuguuggugugugugugaggcaauuuccuuugaaacacaaguuucuauugugauaagguccaauuucuuucuuucuccacuuuaguauucuaaggaacuacuccuuaacuaaaggucacauauguauacuuauuaucccccuaaaagucuuaaaugauaucgauaagugaggucuuuugauucauacugaguuuuuuuuuuuuuguguguguguguguguguguguguuuugauauuuggaaagaccccaacuucaguuuuuuagauacccaugugccccaguaaaagacuguuaaagacuauucuugcuucaccaaauuguuuuauugaccuugcuuaaaaacaaaacaaaaaagauggucaccugauuggaaugugcgucuaccuggacuuugguccugucccucagaguaugguuaacuuuacauaggccacagucacuaugcacuuguauuaugucuucaaauccagaaacuggacacucccaacauuauucuuucaauaguuuugauuccucuagauccuaguuccauaugaauuuuaggauaagguggcuaauuuuuccaaaaauaaagcagggaguuucaauggaagcuaaguugaaauuaucuauucacuugaggacuacuacuauccuaacugguauuuaaguuucaaaugauuuacaugaaagaucuuggguuggagagauggcucagugguuaagaguacugacuauucuuccagagguccugaguucaauucccagcaaccacaugguggcucccaaccaucuguaaugagaucugaugcccucuucuggagugucugaagacagcuacaguguacuugauauaauaaauaaauaugaaugaaugaaugaaagagagagagagagagagagagagagagagagagagauugauugauuucugagcuggaaauaauccuucugagguaucccagaccuagaaagacaaaugccacauuuucugucaucucuggacauuagcuuugaaucaucaaauauguguauuucauuuagaauacccauagaggucaggaacuuacuaagcagucauacagaggaacuuuaaagugaaaagagauagaaugcacuaguaaaggaaacaguggaacagaacagguuacuguggggcaaaggagcagaguuuaagguagagugaguauaggagagacaaaugacacuuuauaaagaccuuuccaaaaaagaaacaugaaaaucuaccacagacguuucuaaauauacagaauuuuaauuuaauuuuaauuuuaacuccuuuuuaaaggagucacccuguaacauguuaggcaacaaugcccuuauucaacaacagagacuaacaaauaaaaaacucagugccaggaaugaguuacuucuuuuggaguuauuggccaaugguucccaaagacccaccaccaccaccaccaccaccaccaccaccaccacauuauaggccaaugcuuuuaguuaccauccagaacuugaugguaagacccuacugcuaaagacaucacauugagucauaggacaugauaaaaucaagccgguucagaacugcaaguucuguccuuacuguggcuuucauagugcuggaagguagcuguaaguuaccagaggcuguccagcugugagcucugggaagaacaauaauaaccagcggcagcaagaggcacguaucaguacaacaguggaugaacaucaugggaguaaccaaguacauuccuacagugugugagauacuaagcccaagccagaacaaaccccaacauggaaaggaaaugaggcacacaaucucaccucugggaacuauuaacuacuggaaaaggaagagcugguuuucucuaaggcuguagccccugguaagcugaacaggcucuaguagaaaacuacaaaucuaagauuauuugggcagcacaaacuugucuuggaaaaaaauguuuaaagauaccccaaaacuggguggaagaggaaagguugggaucugggaggaguuggaugcaaugcauaugaucagcacacauuguacgacacuugaaucucucaaagaacuuaaaacaaaacagaacaaaaaauuauuggucuuagcuugaaaaaaauuguuucuacucugguuuacucgccagguaaacuauccaauuuauaaggaagcaaauuaauagacaaaauucaccacagccucuuaaaaagauucauccuaucaauguguguacuagugagccccugggauccucucucucaguccuaagauuauaagcgcaugcugaccuagcuccacaguccagaagaacaguucuuuauucuauaaaaaauuacagcuuuugcugggcauggagacacaugucugugauaacagcacuugggaaggagcaaggaguucaaggcagccuugacuaccaaaugaauucagaauauaggugaccuugucuuauaaaacacggagaacaaauaaauuauagccuuugguuugcuagucaaauugguacagauuauaauuauagaaacaaaagagucaggugguaauagugcacaccuuucaucccagcacuugggaggcagaggcagguagaucucugcauacaaagacagccuggucuauagagugaguuucaggacagccaaggcuacacagagaaacccugucaacaacaacaacaacaacaacaacaaaccaaaucaaaagaaccccaaacccuuccccuugacccccccaaaaaagaaaaaaaagcaguuauguguguguguauccuuaugaaugucccuaucauuuaccuauaaacuaaucuaauuccuuaaaucuuaauucaaacaggagaaaguauacaaaagucacaagguuuugaauucaaauauaauuuaagaucacaaaacaaacgugaauccagagucaauguuaagaauagcauauucucaauuaagcacugucugcaaaccaguugguucaccacagggcagcaaacuacccagaagacaagagaacacuggucuaacagaacaagucccauggaaacaagggacucaacagugaggcagaugaccccugcauugcuuguggugcccaugccaacuuuacaugaacaacuaagaaccauccagaguccaagggaaagauccagcaauaaagaaaacuugaauauuuuaacacauccuuuagaauaauguugaaguagagaagacuauuguugcaccuauuuccaaaucaggaaauuagggcaaagaaagguuuguaucagcuacaaaggggcaaggcuuggauuuuacacccuaacaacuucaacuucauaaucacuauguuacuguguuuguaucugugaccuguuaaauggagcagaguuacagaacuccaugcaguuuaauuacuguccuauacauacauacauacauacauacauacauacauaaauacugcacacauaauacuaccacuucaaacaucaaauguuuguaguuaugaaacuaucuguacuacuacacuaauacaaaacauuucgaugcuuaccuucaaggagggguguggggaaaaaugggugggugugaguuuccuuuccugcuacucccaauccuccucuuuacuaaucaucuuccuuccacaaugcuuccuguccaguaggaugcacaucaaguacaggagcacccacuuuaugauguuuaauagcuucagaucacucaacuucacauggugugagaaugauacacucagaacacacugugccaugaccauuaacauauucuuaggcuaugacaaguauaagauaaucuccuuuguuauuugggcagcugcagcagcaagacacagauaugaaggcaucugauccccaaaguaggcagucaguccuguaugcuaccauaaguuacacugagaagaaaccuugugucagaucauuuuguccagcuaaaauugaauaauguuaucuaagcagguuacaagcuagacuauuuuuguuuucuguaugugggacugacccuaggacuuccugcugguauucuaucacugagauguaaccccaguauuuucacuuucuauucugagauaaucuuaaauggccuaccuagguaagcccggaauuuguacuucuccuacuuuagccucuuacguaucugguaucacaagcaugcaccaccaugccugacaucuagguggaauuuaugauuaauauuuucaaaagacauggguuuagcuaggcauagagguagacaccuuuaauuccagcacuagggaggcagagccagaagccagugguauuucugagaguuugaagucagaaauagucuacauagugaguuccaggacagucagagcuagaucauggaccagucucaggaaaacaaaaacaaaaacaaaaacuagagaccuggguuuauuggaauauaacccuaucgcaaauuuaagaacauuuguguauguacuuauuuuuuccuuuuggagagcccauuuuuaaaaaaaaccacacaaaacugacuaaaucuuaaaauguagcacugguuugcaaauuauucaaugaaguaucaaaaaaaaaaaucaaaacuucaguuaaauuaguaauauuuaaaucucuauucuaucacccuuagauuacuauguguuaauacuauguauaauaucauuuauacaugagacacaucuacucaaguguacauacucugaaaugaccauagauacuguacacuuaaaauaugaugaaugauuucaggauggaggugaaggaaauagucguaauagguaagguuucgacaaccccagaaaaguagaaaauauacagacaaauauuggcugcagacaucacacaaaaagccuugaacuuccugagcacagacuucaaauguaauaaugguucaguuuucauauaucugauggagaaaaggaaauuucagggaggagaugagaaugaagguguagaagagagacauacaacacacagggguccagguggaacagaguaccagaggggagugacaggaagggaggugaggucaggcaagacacugaugauuacugagaguggaacacagaccaccaggggguucugaguggaggaggagucagauuucuguucaaaacaguaagaaauuaucuaacuuuaguauuugaauaauguaaagagaaugagaggccauugucccaguaauguagggaaaggcuuagacugguuaacagacaaugguuuagucuacuagaagaauaguugcagacagagguaagaaauaauggugaauucuccauauucuaaagacagagaccaggacaaaacuguuuccuggacuugucaggagagcugcacucaugaacucauagugcugcugcagcuuacugcacuagauuaauacagucaccauuccugaacaacagaaguaguucacaagcccagacucagaacugaagagcuacugacaaguuaaugauuuaagagagucacugguagggagggcaaccacaucuauuauuaguggcagacaauccaacaucucuuaguauauaggcagcacaaauuauaauuagugggcuauuuaaaagaagagggaaaaaggacacaaaguugguugggagugauugggaguuagaucuuggggaaguuaagggaaaaauggagcuuaaauacaauaaaaacauacagugaucaucagccaaaugaucagagucaacacugauugacacucuaugguacaagaugcagcuaagcuaugaaggccgagaagguauuuaaauguauuuucaacuuaaugccacuuuacaacuuacaauggcuuuauugagagcaacacaaucacagaucaaggacaccuguuaaaguguaaaacaggacaaaccauagagcugggcauaaugaugcacaacuguggucuuagcacucaggugagugcaaagugcaaucauaggcagauucaagcucagccaaggcuacacagcuacuucaauuccaaugugaaacugugaaacuuuguuacaaaaacaagauccaaagaaagcaaagccacuugacagacaacaaaaaugagaagaguaaauuuucaaaaaauauuuccacccuacagaagaguacagauuuucaaauaaacuauacacacacacaccccauccccaaaauuacuaacaugacugaugacugguuagcauuuaggccugucacagugaaauuuuaaaaacuaauaguauagaacacaaacaaauuacaacauuuuuagagggaggauaaauccagaucauuugccagguuagacaaaaucacucuagccagauuagcuuggggaagauuucuaaaagccccagagaugggguggggcaacagcaguuaaagcauguguugcuuagccuagagagcaucucagcauccacauggcagcuuauaauuguucacauaacucucuuuauaggauaacaauuacccauuaaaacuuaucugaaaauauuuaguaucccauggguaaaguguaagagugaaguggcuaacucuuaccuugacuuuuuccuguauuaucuccuuuugcuuccucuucuuuaacagggggacuuauucugggggcccuguuuugccccuggaccauuucugcuagcaauucuucuugagaaguucgaguucugggagcaacuggaagugucuguuucuguggaacuuuacguaaaagcaaaagaaaggaaaauacacccaugguuacaacuucauaacuccacggcuaauaucacguguuaaauacaaauuccauccuuggauucagaacaguuaaggugggggcuggugagauggcucagugguuaagagcgcugacugcucuucccaagguccagaguucaaaucccagcaaccacaugguggcucacaaccauccauaaugaaaucugaugcccucuucuggagugucugaagacagcuacaguguacuuauauauaauaaauaaauaaauaaauaaauaaauaaauaaauaagaacaguuaagguauucaaagcaaaagaacuacauucaacucauuugccuuaguuguguguaagcagccucuaaagcuugaaucucggcacucaagaaguuaaugcaguaguucuggaccagacuagacuacauagugagagccuguuuaaaaaauccaagccaaaccaaaccaaaccaaaccaacaaagcacacacacauacaauggagugagggagugaaugaguguguguguguguguguguguguaugagaguguguguguaucguguaugaaauaaccagaugcagugauccagggucucacagugauucaaacuguaacuuaaguaggcaaagaaugaauuguucaaaugcuauuuuuaaaaaauucuuuuguguagaccaagcuggucucaaauuuacuacuaaguucaaaauuaccuuaaucuccugccucuauuucccaagugcuaagauugcaggcauauagaaccagguuugauguuauuucuugaaauaugggaaucuccaacuacuuuuuaauuuuucuuuuuagaauuauguauuuugcccacacgcacacaugugcaccaugugucugccuggcaccuguggaggucagaagaaugugcuggaucccugugaaguaggaaaccagguucucugaagagcagcuagugcucugucuuaacuguugagccaucucuccaacccaauccucuacuucugaaauagcuggagacaguuguuaugagcacuggcugugaccuaggaaaaacugggagcaauaaacugauuuuauagaagaucuacuaaacuugcuugggaaauaaguuacacaaagaauuuauucaaggaaugcugccacuaacauaacucaagacuuaguauuucuaguuaacuaaaguuguuagaaacugaagaaagggcugguuuauauagcucuaacauaauuaaaauuuaggcuuacaagaaaauguuucuauuacaacuuuuucauuaagagugggggugucggggugcacaccuuuaaucucagcacuugggaggcagacaggggaagagucuaaggccagccaaaucuacauagugagcuccaggacagccagagcuacaaaauaaaaauauguuucaaacaaaacaaaacagaaaaauccccaacucccaccccagagauuucuucucuaauaugcugccaauuaggcuuuguuuuuuauugugauaaaaggauacacucuugauuuaaccaccuacacauagaacccacagcaaagagucaaaaaacagguuucuauaggcagcucuaacaggaaaagcacuggguaacagccuucauuuuuuaagucccagucugccagcaaguccugguucucuucccaggaagcguaaucuugccauggggcagaaugauccugaauaacuacuaugagaagugggggcacacucacaacaccgacguacgucagcaacugugacaagauuuuugcuguguaaaucucccauuuguccaaauggucagacuuguagcagccugucucuaaacuguccaaaaaugagccuuggagggcaggccuccaagugauuuaaagaugagagcauauacagaaucuagucuaaagcauagcuauaaugcugguaaaucuuucuguucauggcucgcacaucagccagaaccaauaaagacauccugcguuaaucaaucugugacuaccuggaaugguuucuaguggaaggcauauuaacucuguucuccagaggagugggguucuagucccagagucuacaugguggcucacaaccaccaguaacuacaauuccaggggauccaaucaaagcucuuuucugcccuccaugcaagcaaaaaaacucauaaauauaaaauuacaaagcgaaguauuucaaggucaugaaaauccuuuaaaauucuuauucuaagcacuaucacugcuguauaagaagggcgggugugaggaggcgcacuguuagagcagcgcaggcuuuccugaccaccuuuacucuauaugccaagaucuacugaaugucggacauucaaggguaaaugagagaugagaagguagagaaguaccaaaaauuuuuuuacuucaauucaagaaauggugacgugugacaaagggcaaggagaagaaugcugugaggacauucaccaaauucacaguaaaagcuugaggauaauuucaggcugggcagugguggcgcacgccuuuaaucucagcacuugggaggcagaggcaggcagauuucucaguucgaggccagccuggucuacagagugaguuccaggacagccaaggcuacacagagaaacccugucuuaaaaaaaaacaaaacaaacaaacaaaccaaaaaagaaaguaacuucagauuuggcgauuccuaucagcuuaguaccacaaaauuuuacacuggcuccagcagaugaaaagguggacagaauguagcagcaacacaaaacacucaccauuggcagauuagaaugagcauucuauaagaaaauuuuguuauaaaaacuagacaccucaauauuugacaucaaaugauuuuagagcuucuauuuuaauuaggguaagggcauaacaauucucugccuggcauucuauuaccagguuccagcaaaggaaaacagacugguguauucauauaguaacuuaaauaaauaacugcacuggguccaggguucaguggaacaggaccuuccaagcaugcauaaggccaagaauucaaucugccagcacagcaaaaaaguaacuacagacuccucuaccucaggaacuguuauuauacaauuuuguuccuuuuacacauaaguacaaauauaauauuucgaauuaaaugguauuaauaugaaagucucacguuuuucaaaauucccuuucuaauuuguggauuuuaucaaguuuaugcaugugagaguuuacuaugcucaaagaacuccuaugacaguuucucaaacugguaaaaucuuuuaaagccaugcuucuagaagaaucugacucugcuauuguaugcaacaggaaucuuuacuuuacacauuaagacaagcaugcucaauuuaaagaagcaaucucuuaccaguacaaacauacuacauugaaauuaccugcagaauaguuaguugucuuuguuacagacucuugagcuucagagauagccuucaaaauuagauucuuguuagcuuguuuagaagguggaagagaaggucuaaaagaguuuuaagaaaagguauuuuuauaaaguuuucaauuucaguucuuuacaugcuaaccaucuauuaugcuguugcuauacagccugucuuaaacauagcaguagcaguuacagauuuuagaacaugucaauuagauuggaacccuacagcuuuuucaaagaugacuccauauuaacauuuucucccucauccauuucuaguagucguugcaauucucuccaauuuaagcaagcccucuuccauuagcauguaucuuccaaaacccaggugaugcugucagacagcuuaguaccagagcacuuaucuaccaugagcaugcacagcccccaggcuucuuccccagcacugucaaagaaacaaucagacaaaacccugcagcugcaucaggcaguuuaagauuaauuugcagcuauggucacacaccuccucucaggcuuugcugguacugacacgcugcuggacaagcuuccuaugcgggucccauaauccucaucuucuuccuccucuucuccaucauggcuaaaucuuuuuacuuuaacaaccgaacuuaccacaggcaauuuucucuuucgaaaguuuucguccuacaaugagauaaauuuaagcuuacuuugcauugaaaaugaaguucuaacacaauaauauuuguuuucaauuuaagaccauuuuaagaagugaaaagggcuggugagauggcucagcagguaagagcacugacugcucuuccaaagguuccgaguucucacgguggcucacaaccaucuguaaugggauccaaugcccucuucuggugugucugaagacaguuacaguguacuuagauauaauauauaaacuuuugggccagaacagggaccgagcaagugagguugaacggagugagcagagguccuaaauucaauucccaacaaccauaugaaggcucacaaccaucuguacagcuacagcguacucauauaaucaaauaaaucuuaaaaaaaaaaaaaaguacugaaaggacuggcuuucuuauuaaaaaaaugaaaaaugucuccucaaauagcuaacucaaaagaacuuuuaaauuuauuuuauaacaguugcauacagcacuguuaaggaaacuacuaaaagugaguuauaugguugcuuaaagcuaaaacugacacaucuacauaaauaccaauaagaaaagcuagcucaaaaugccaaaaucacaaggcacaugugcaugacauaaaaacuccucuagacagccaguccaagagaggacacuauuuaagagaaacacacaauguguuuaguuacguaaguuauauuuggaauccacaacugccaaucucuagccuagcaagccagaaucuauauacaucuauacgaaccucaauacucauuuuauccaaguuguuucugaagaaggggcuauaagugucuucuacgcugcuaagcacugguggcucacacaaccguccugcuucggauaccuggcugcuuuguacauccagcugcuuggcagcgugagcacugcuuugcugcggaugaaguugcagccuguuuaagugaguaccagugucugcauuucuacuugcagguggucgauaaauuucaauagaagggcgagaagaaccguauguaagugucacuguagguuuuuucugagauaagggauucuccugcacaaaauugaggucuucaucaaugagaucaucugguucuggcuugauaucaaucacaucuucagagggugcugguucccucagagguuucacuguugacauuagccggguggaagcuccaucaucauaugaaugucuauaagcgaagaaaaacacaacauuauaccaaaacuaaagcauuauucacuaaucuuaaaggaauguuuauucagaaaaaaauuuaauuaaguaguauggaggccuuucaaauagucauucacuacuuucaaauuauagucauucuuguuuguuuguuuguuuguuuguuuguuuagagacaggaucucacuauguagcucuggcuggcuugaaauacacccaccugacucuaccucccaagaacuuugauuaaaggcuuguacuagggcuagaggacucagugauucugagagcuggcuacuuuuccagauaauccagguuucauucccagcacccacaugacaacuaauagcuauguauaacuccaguuccagaggcuccuaagcccucugaagaacuccaugggugcuacaagcacauggugcacaaauacagacaaaacagccacauacaucaaaugaaaaaagguuaaaggcuuauacuaccacgcccaucccucauacuuuaaauuuuuauuuacuaaauguaaaauaaaaaaucauaucuggucaccauuaguuuauucaaaaacuugcucaccaucuguuaugguuugaaccugaagggggcgagggagacggccagagcauuacuugcuuuuccagaggauuugaguuuaagucccagcauccaaauggugacucacaaccagcuguaacucuacugccaagggaucgccuaugcgaucuucuggccucuagaggcaccagauaugcucgggguucacacacaugcaggcaaaacaccuacacacauuuuuuuuuaaauuuuuuuuuaauuaauaagauauguuccacagaggcucauguauuaaaaacuugauccuuaguucacuaugcuaauuucaaggcuauagauccuuuuaggagguagagcccaacuggccaacauaggucacuagugucuaggaacagagcauugcugauaauauccaacccaggaucugguucaguuuucucugcucccuuaaggguccacuauguuaggaaucucuuucaugugguuuugcuacaugaacucuaucuaguuugcugcuaugauaaacugagagccugcugaacuuugagccaaaaacaaguuuccuccuccuccuccaauaugucauauuggguauuuuauaguaacaauaaaugacaaggaguaacuaauccacgauuacuucacuauuuccaaaaauugcugaaaauaggaacuaacagacauaauaauuaacauaaguguaacaucaacauacccaucuggccguagcagauacuggacuuuuaccugacauuaguggauuucugcuccugugaacuuguagaaacucuggaaucccucuuuucaggucuagaacuagaaacagcaaggggagggacggcagcuucgugccuucucucaucuccccgacugaaacugcucuuguuugaaggcacgugacuaucgaagaugcuggcgucaggagacuuuagacuagagggcucugcaaaaacaacaacacaacacaugauccugguaauguuuuccuuaucccuccuuccccucaccaccaguucaaaagcaguacauucaauauagaaaauauuuuaauugauuacuucaaguucauuaaaaaaaaauguaaaaacuagucuccugaggcccagggugaccggauauacuaaaaaggaugaccuaacuuccgauucuccuggcuccaccucuggaguauugccaacucugggcgauuacuacuuucccaaguguuuucagugguagggacuaaaccuggggcuucuuacaugcuaggcaagcacucuagcaauuguuccucaaauacgauaguuuaaaaggcaccugagaguaugggcaugggauauaagaacucccucaacagucaauuauuaucaucguugcugcuaccaccacaagaaaauucccacuuauguuguaaauacuaggauauuugcugggugugcucucuucucauuugacauugcuuuuaguagcugaguggcauucuuacacauccuaauagcuuaucugguuuauucccaccaggccuuuagguaucuuucuacuauaagguaaaagccugugcagauuuaugauuacgucagauacacggcacugucaugcucacgucaaaucacaauaaguuuauuguucuuucaguuuaaaugaaccacuaucucuucaaaguugcugaugcucuuccaacagcaacauaacugaaaggaucauauacugauugauuucaguaagcaaucaguuuuacauagcuuaccagucgugacagagcgcaguuuaucuaauacaccauggagccuaaaacaaaacacaaaacaaaacaaagccuuccuuaacaaaaauuuuauuccaauugccacucuaaaucugaugacauuacauccagauuagcuguuucaaaggcauuuaaugauacuaagccaaacuuuccaauuauacauuauuuuuauuuuaaaaggccuuacauacauagcaaagaauaaagaaaaaaaauucuaacauuuacccucuggaagaggaaggagggggaaaagagggagaggaggaagcagcagcagcacccacgcccucccaccucgggugggggagguagcucagcagcacagcagcuaaaguacuggaaauugaagccacagccuuaugcaaaccaugcagcaagcacucucuacuaucacugauacacugccacagcucucguuacuuuuugagacagggucuaaguugucuaagcuggccuugaacuugugaaccucuuaccucagccucccaaguagcuaggaauacacugugucagcagauccaaaacagaagguuagaaaugaacacauacaaggcccugggucaacccccagaaccagaaccaaaggaaaaaagaagacaaaaaaacaucgccugacaagucuuaacaaacaaaacaaaacaaaacaaaccuugcuucuuaggaacuaaagaucaaaacagcuuauaguaaaacaagagaaguaucucaagcacauaauacuguuuaugacagcuguuuuaccugugugugugcacgugugcgcgcaugugcaugcacacucgcaugcucucucucuuccugucuuccucccucacccucuccuauaggguuaaacuaaggacuauguauacaugcuaagcacauagucuaccuaugaucuacacucccuaaucuagcaguuaauauuuauuuuaacuauuuuaacuggcuucuugaacaauguaauuaugaaaaaugaauaaaguuaaaagaauuuuaaaauaggcuauccaacuuuacuauaacucuuauuuucaaaauuaagcaaacaggcuacaacuuugcuuuaacauaaccuuucuuaauagcuacauagaaggcaauuuugcacagccaaucuuucaaaauucccucacaaacaccagaguuuccuauuguuucauuuaggcuccacucacaugucaguuuccucauggacacaauuauuucaggauuaaaaaaaaaaaaaaaaaaaaaaaaaagaguggaaggaccucaguguaaaguuauaaaacugacagcaaaaaaaacaaaacccaaaaaaacaccaggauaggguuggguugagcugggcuggaggaaggcgggaaggacaggggaugacagacacaggacaauacacaccuuuacacacuagguucagcuguggcuaauagagcugauucauagaucccaugaaagagcuggguguuggaaggcaccuguaauacuagcacucauaaggcagacaggaccuugggacucauaggggaccauguggacaagcggucuagauagaccaaaaguaacugguaagcucuagguucagugagaaacccugucucaaaaaacaaaauggagcaugauccagcaagacaccaauguccaauucaggccuauaaauauaaauauacacacacaugcaugcacaucuuguguaucuacauacaaaacacauacauauacuaaaaaaaaaaauaauuaaaaaucaggauaguugagacgggcaguggugucgcaagccuuuaaucccagcacuugggaggcagaggcaggcagauaucugaguucaaggccagccuggucuacaaagugaguuccaggacagccagggcuacacagagaaacccugucucaaaaaaccaaaaccaaaccaaaccaaaacaaaaaaucaggauagucuguuuaauacuagugaccacuggugaaaguaccaaagugaagaaaugacuccuugcaagagaacaugugaaacugcauuuguagcacgaugagaaacucauuuagacuuuaaguucacauucaguaaaugguauacugguuuaagaaaugucuuacauaguccauuaagucaucugaaaaagaaccuaucaggucaaucuucugguuuagauuagcugggcugcaaacccaaagugaucuaaaggguuaaccaaaggccaggucacaacaaugcuuaugaagcaaaacugacuacuuuaaaaagauguguucacaaucacaguauaauuuccucagucaaaaacaucauucgugcugggcuugguggugcaagccuuuaaucccagcacuugggaggcacaggcggauuucugaguucgaggccagccuggucuacagagugaguuccaggacagccaaggcuauacagagaaacccugucucgaaaaaccaaaaaaaaaaauaaauaaaccaaaaaaaaccccaaaaaaccaucaugcauauuuuagaacaaacuauauuaaguaggguauauauccacaaugaagcaguguguuaacauguaaggaucauuguacucuuaauaaugucuccaaaacugaguaguaugaagcagaaaauucugcagauuuuucaaagcagcaucgucacaugcaguugccacagagacgaugaagacuguagcgaauagguuuucagacgucccucugaugaguauuuccucucugugucagccacaccacucuccugccccuuucucacucagccuuaagccugacaaccgagcuggccuuuuuaaacucaaucuuaugcuuauuuucaucuaagggcacaugugguuugauuaaaguauaguccaaaucacgagucauuuauauuaaaaaaaaaaaaucaaguugcucaaauuccaaacugugaaagugacugucugucaaauggggacauacaugugugaggaaaagaaaaacagcuuaacauaaaaccaaaaauaaaauggaaaaaaaaaauuccacauaaaaggcaaaagccagccuagcucaaaaugugauguacacuguaagugcuaugaauggggguagugcgacaaugaacugcagaaggugaaagauacaaaaauggcuaauauacaucaagggcuccuacagugcaguguaucugcaugcacucuguaugcaucagccagguuauccucacacuuacauacacaggugauuuucaagucccauuuacagaugaagaaaccuccagaggcuaugcuuuacagcucacagccagccucuccacagugaaccucacagacugccaagcuccucuucuagacagaauaccaacucugacuuugcuccaaggcacagauauucagaaacauaccauacggugaaucgaauuguguuguucccuagaaacagggacagguccucugucauuugguccugacuuuucuuguuggccaccaucaccauaauguaaucaggaaguucuucaucuauuuaaaaggaaaaguauaccaacuuuuaaauguuuccucaauauuuguuuuugcucaaaaaucaaugugcuuaaaaacagagaaguagccuugauaauucauaccuccuucuaacagaggcuagacaagaacgcucagcuaccaucuuuuccccuucaccccacaaguacuuccauuuuuagaaggccaggaauuggaaaaaacugaugcauuucuagucauaaaacuaggcauccugggucauagaaucaauugggaaaauguacugguuuuugaaagaaaucuuuuuaauguccaucaacuucuagacacuccuagaagguauauauauauauauauauauauauccccaguaauugcacuguuuaguuuucuguucaaaacaguauccaugucacuagggaauaaauauaccucuacucaguaaagguagaagacuucaauuacaucgcauaacugcacaaaacccuacagcaaguguaaugccaagagcucagucauuaguaccaaaggauggaaaaagguuaaauggcaacucaacuugauucacccugccaguggcaaccccacacaaugacugaagguaaaaaguccaagaacauuucaauaaggaagcaaagucaugaggaaaucuaauuucuuucugagaaaagcggguguugucugccucuaucccauggggauauuaucuuaaaacucgaucuuccucccuacgcccucccaaauacugagacuacggacacacacccagcuucaaacaugucuauuaaaauuuccuuaauaacuaaaaugcucauaauuucuacagaaacagaaacauccauaugccagaaacuuguuucaagggaaaaacaccugggggcuggagagacgguucaacuguuuaagagcacugcuguucuuccagagaaccuggguugaguuccuagcacacauaugacugcucacaacugucuguaaccccaguuccaggggauccaacacccucacacagacauacaugcaggcgaaacacaaaugcacauaaaaguaaacaaaucauuuuaaaaaaagaaaggaaaagacucuaaacucuaguucagaagcuggacaaaaagagaaugcaguguuucaaggaagcaugcaagaagugagaaaacgcaaguaacaaguggccaaucuuuuguuuugcuaaaguuucaaaaaagcucucgcuguacuuguaaaaaauaagcuaauccauauuuauacgucauacuaacugauccaacaccaguaacucuggguaaacagcuaagacugcuaagauacuugggcagacagguauuuuucguucacagcaccaaugaaauaauugcugucgcuguaucaguuuguauuucuaaaguuuuauaagagcaguaguuguccugguauagaacggggacaaggaaaggcguaagaacaggucacgaagccagaguggcuacuguaaauuuaggaagggaugaguaugaauaaguauguucaguccuuuuguuuuuuaaaagagaugccagugacucaaacaagggaucuugagcacaaugucaggcagacucuaaugagcuauaccaaguccaguagauuuaucaaacugacuggugaugguuuugggaggauacacaucaaaacaugccaaauacacuuauacacaaacacacuucaaauaugugcaauauaaacuaucaaucauuucucagcaaagcuguuaaaauucacaaguugucuucucaguagacaauacaaugaaaauucgagaaucuaaugcaaaauuagcauguggccauaaaauauucuuccggaguccagaaagaucacugaaauacauucaagucagcauacuggggauagaacacaacaauaacgacugggaagguucagagaagcucucaccucaagcacaugaaugaaaacugaacugucacagccacaccacugaacuauuccaccugagcacagcugaguuuccucacugcuugcuuuaaaggaagggaguaguucuuuguaccccacuuugaaaagcacucauccagagcucugggauucuuucugagcauaaagaaauaugagaaacuauggcuacuagcagggcgugacuauaaccccagcaccaaggagacugcaacaggaagaucaguuaguuugaggcuggcacaagcuauaugaucaacagcaagccagcuugagcagcacuguaugagaacccgucucaaagaguagaacccugaaaacaaaaucuauuuuguucuggagggugaaauauauacauacaucuauaaacugcaggcuuuccacuggaacccaacaugaaacuguuaauccuaaggaauuuccaauuugggaguguaauggugcuaagaguuugcagggguccuagguuuaaguaaagaggaaggagaaggaaagacugggaagcagcagaagggaaggagcugaucaacugugaagauucacuggcacuccagagggccugccucucauccauucuuuaauuaauuauuuuucauaaaguuugacaaaagcaccaaggaccccaaacccgagcucccaaucaucaaucugcugacagccacuaacguagcucucuccacagcccaugugucuauaaagaguaguaauacugccacccaucccagcaguacuuccagaaacacaacaacuauaagcacauguuuuaaaaacuaaaaaaucuuuuuuggaguuugugaaagucagugacaggacugaauguaucucagugacacacugggaccucacccuggccaucaauuagcacaguuauacacgugcagugggccucacacagcuggcaccacuuaguaucaaaaaaaaaaauuaaacaguuagaacuaagaaaauucugguucugcuccauuuuuucauauccaugaggagucuuauaucaauccugaaaaaaccugaaaucuacccaccaacugucggguacaaacuaguaauucuuagcuuguucaguaucagguuccuucugguugauguaucuacuaauauugaccacaugacuucagaauggaccaguuuaaaaggauguaaucaccaguguacagaccacaggcuaacagcccaauuauaucaacuuaaugcuuucucuagaagcuaaaguuucccaaacaaaaaccguaguucugaggauggccuugcuuucuacuuccuuagaucucuuuuguaucaugucagaagacaaaugaacucuaaucaguuuuuuuuugcauuuaaucugugauaaagauguuuaauauugaggaauguaaagaaaaucuagucccauaaauauguaccuugaguauuuuaacagucuuucuagaccuuucuauccuucuaugacacuacacugaaacucaagcaaguauuuauuaacaauauggaaucuaauauaauaccaacugacugacuguacuguuggaugaaaaucaaccuacacaaccuuuacugccuuuuaccucugcauacgguaauguggagcaggcacuuagaaagugcuaguucacuggugaaccaaggacauacaggacauuucauuauguaaagucacacuguuagugccuccacaauuuuaccacagaaaucuuuuaguucugggaagcucucaaguucacagagggaaacccaaacuuucaaaguuuuaauuuucauuuguaaguucaaucugucauuggcaauagaaacuuuuggcuuuuuuuucuggccuacaagugcacaaaaccaguuuaucauuucuuagaauguaaaaugcuuucuacuacugugauaaaacacugugaccaaaagguaguuggugaggaaaguauuuauuucaucuuauagcauaugguccgacaucuagggagauuaggugaggcagaaaacuggaggcagaaaggaaugcagagaccauggaggagugcugcugacuggccuacucugccugcuuucuuaaagcagcacucagcuacaccaaaccagggcaccaugcacaguaaacuguacccccccccccaagucaaucacuccuacaggccaauuugguaguggcauuuacucaauugaggucccuucuucccaaaugacaacagccuaugucagguugacacuucagcuucauauagcuaccuuacuuugcaaucacuaaugccuuuucugaaaacaagcguguaucagcucaguacacuacuauuuuacaaguacuucucugcucuuacagucaaaauacuaaacagugucggguuugguuuuguuuuuggagacaggguugcaauagcccuggcuauucuggaacuuacucuguagacaguaggcuggccuugaacucacagacacuccugccucugccucugccucugccucugccucuggagagcugggacuaaaagcaugggccaccaccucccaauugagaagccaguuuuaaaaaccauuuuuuuuuuaucugucucauugauaacauucuagauggaacuuuuuuuuuuaaacuacaauuauuugaccaagaguucuaguaaaagcuggugugaccuuuuaaacucacugcuuucguauaauccaaguguagacauaguguaaugucaagccuucuaaccauuaugaaaacaaauuugacuccaggggucaguaagggucucagacccugaguuacuauuuuaagguacccaugauuuacaacuaaagccaccaucaguggggucagacaggcuuccucccccaggccuguucaaguaccugaagccuuuguuucuauuuguacaacugggauauuaucauuuacauuuuaauggcuaaacaaugccuagcucagaguaaacacucauucugaaaaaacaaacaaacaaacaaacaaaaacaaaaaaaaucuaauacauaaaacuuacugaaccagcucuguggcaaaugccagaagccugaagcauauaauguucauauccaaaaugagagaucucaaauuaaaggucaugaugagaaaguaacaacaggaaaaacagaacaaaauucgaacaaacaugggugcuuaaaaacacgacagcuucagccgaagguuagaaaagcuagacuauuucaaaauaacaucuuagacaggagaugggggugggggaagggaccucggggugcugcuauagauggcucgauggaacgaggggagaggaaaaccagggcucucaaggcagaccacccgaagagcucuggggcagagucacucacacauccaggcagcuacaagcccuacaguaguauauggaggcgaaggaugagaaucgacuuaccuacguaagcuccuaauucuuguaauuuccccuuaauggcacucugagggagagagagagaaaaaaaaaaaaaaaaacagcaaaggugccugugaaaaccgcgacagugaaagagccgccccgcgcaaccggggggugggggaggggacgccgccccccgcgcggcgcuucccgcagccgccgccgccgcugccgcccaggugccucucacgggcccgcuggaguccccagagccgaccgccgcgccugcgcuccgucugaggcggccggcgcggaggagacgcugcaggccgggcccacccgccccguuacuccuggcaaccgccugcccgccaugcccagcgcccgccgacgcgggccucacccggaucuugcggcugaucucggugccgauuuccauggcucggcggcgggcggccggcucggcacugcgcggcgccucgguuaccuggagcccgccgcgggcugccacccugcagccugggcccccuacgccgcugccgcugccgcugccgccgcugccgccgccgcuccgccuccgccgugcgcguccccgc

SEQ ID NO: 6785 - RNA, 975 nt, Mus musculus
ugaaaauccgacugaacugggaauaaacaaucaucuaaucaagcacacacugauaaagaggaaucuaggaaugacugcugcaaccugagagucaagggacagugaugacagucggcagcagugcaaggcacaggaauggacacggaugcagacagacuugguggggagaaaguccagaucacacuucuuccucagcagcgaugucauugacugacaugaguacauguguauguaacccuuuaguuaagaaugccuaaaagaaacucaguggaaggcaugaugaaagcuaugugacaugcuaauacuucucaggaggacaggcuagagauacaaacauaggagacgguaguacacgguggucauaaacagaaaucaggauagaacuugucauuuauuaccagccaacccccaaaccaaacuucuuuucccugcuauaugauauuacagcugaauccugaggacaguuuugcuuugucagacaauuugauuuugucuagaacauacuguggagggaaagccauuaauaagauaauguagacaaugcacucaucuccaauggaaacuuuccacaaguaugguccagaaacuccaaacugcuacuugacaugacagcagcaaucuguuauccugugaccugagccucuagccaagacuauguugguuaguugucaauuagacauaaacuagagucaucugaaaagggggaaccuuaacugagaaaauguugcucagauuggccugggcaagccuauggggcauuuucuugauugaugacugauaugggaggcccagcccacugugaguggggccagcccuggacuguuggucauagaguguauaaaaaaacaggcugaggaagcugggaggagcaagucaguaugcagcacuccuccacugaucuugcuucaguuccugccugacucuccuuccugauggacggcaucugugagcagauaaacccuuuucuuuucaggu

SEQ ID NO: 6786 - RNA, 975 nt, Mus musculus
accugaaaagaaaaggguuuaucugcucacagaugccguccaucaggaaggagagucaggcaggaacugaagcaagaucaguggaggagugcugcauacugacuugcuccucccagcuuccucagccuguuuuuuuauacacucuaugaccaacaguccagggcuggccccacucacagugggcugggccucccauaucagucaucaaucaagaaaaugccccauaggcuugcccaggccaaucugagcaacauuuucucaguuaagguucccccuuuucagaugacucuaguuuaugucuaauugacaacuaaccaacauagucuuggcuagaggcucaggucacaggauaacagauugcugcugucaugucaaguagcaguuuggaguuucuggaccauacuuguggaaaguuuccauuggagaugagugcauugucuacauuaucuuauuaauggcuuucccuccacaguauguucuagacaaaaucaaauugucugacaaagcaaaacuguccucaggauucagcuguaauaucauauagcagggaaaagaaguuugguuuggggguuggcugguaauaaaugacaaguucuauccugauuucuguuuaugaccaccguguacuaccgucuccuauguuuguaucucuagccuguccuccugagaaguauuagcaugucacauagcuuucaucaugccuuccacugaguuucuuuuaggcauucuuaacuaaaggguuacauacacauguacucaugucagucaaugacaucgcugcugaggaagaagugugaucuggacuuucuccccaccaagucugucugcauccguguccauuccugugccuugcacugcugccgacugucaucacugucccuugacucucagguugcagcagucauuccuagauuccucuuuaucagugugugcuugauuagaugauuguuuauucccaguucagucggauuuuca

SEQ ID NO: 6787 - RNA, 491 nt, Mus musculus
gggcuuucauggacuuucucgcuccccggccaucuugguggcugguguugguuggggguugucccgcaccaaagacaggaagaugguggccgcaaagaagacaaaaaagucucuggagucgaucaacucuaggcuccaacuuguuaugaaaagugggaaguacgugcugggcuacaaacagacucugaagaugaucagacaaggcaaagccaaguugguuauccuugccaacaacuguccagcuuugaggaaaucugaaauagaguacuaugccauguuggcuaaaacugggguccaucacuacaguggcaauaauauugaacugggcacagcguguggaaaauacuacagaguaugcacacuggcuaucauugacccaggugauucugauauuauuagaagcaugccagaacagacuggugagaaguaaacaagaaaguuuuccuuuaauaaaacuuugccagagcuccuuuuggaaaaaaaaaagaggu

SEQ ID NO: 6788 - RNA, 20676 nt, Mus musculus
ucacagcgauaagcacaagaaugcuucuuuuauuucaaggagaaacaacuugagucugagaugucccggugcaguggggggaauccgaugaugucugaucacucagcagcagacagauugguguguuuuaagugucagucccaggauuccucccaggcugcuagggauguccccagacaugucuggcucucagaagagcccuguggguacacaagagggagucuguaauugcagaauuugggguacuccucagcuaaaguagcagacgucuggcauccuccagacugcuggaguagcugucugcagcucccacccacaacgcccagcauacuuguagcauccugagacucaggcuucuccucaguggauggauaaugucacgagagagcugagacugucccuccauuugugugaggggccaguuuucugcuuugaccuggaacucuucccuauuguuggggaaugaauaaucuuggugcuaaacaaaggaacacagaaacaaagagaaaguaauucagcagagugauuucuuuuugcaaaaggguguggcuagaacccaaacugguuuagcagacacacucccuaaaaugaccuauguuccuucuaccccaauggugacugcaucuuaucuccuuggugagagcucgacuucaugguccagugcgauuggcuaauuugcacaaaaggaagugaggugguuucaggaaauccagggcgcuaggaaaacagugucuugcacuauugugccaguggguuagggugaccaugggaaagcaccacaguguaugugacuuuuuguguguacacaucuguuucuguguguguacaaacacguaaaggccagaggucaaccucuggucucuuuuccuugggagccauccaccuuguucuuuuugaaacaaggugucucauggccugggguuuuccaagcaggcuggucuggauaggcagaaggcccagugcagggauuguaugaguguguucaugucucuccaccacugggucccgggaauggaacuuaggucucuuucuuguauggugaguacuuugucaucugagcugucuccaucuccaccacccccuuuuauuaugacaaaccuucagauaaccuagaaguugggagagcagcucuucauccuuaagaguucagcguggcucucaggaacgcguugcucucuguaaccacagcacuuuauccucucaaggaaacuuaaaguaacuccucacagccucucauccacaccacauucagguuucuguacgcaucuaacaaagucuucagggacuuucugcuguuuuguggcugucauguuccccucucccacccccaaggccaaaugcaaguauuucuuauguuucaaguguuuucuuaugacacuguugaacuugccccucuguccucuggaagucaagucuaaaugaccccaggucccauccguuucauuaagcaauuggcaguuaaugccaagugauaccuaacccaucagaucucucugggcuguucccaguuagagaagcugagcuugcucuaggcagcuucccacuggauggggaccugauuuggaaccucauaggcacccauugacagcuucugccggauucauuuccaugggaguuacaagacaugacugauaauccuaccacuagcugauaguucuuaauggggaacuguaaggaccaauuuuuacagaaaaaguuuaguacaauaauugcuccugauggugggaaauaaaucccucuaugugauuuucacuauggacucauggaguuuucuccaggcaguguuuuauaaucaauugcaaccauuauuuugaugcucaaauuauugcagauucagcccaugagacccuuucaggcugcauuuuaugcccuuugaacaugucccuucuagucgguaacuaccuccucguggcuuaagcuucucuuucguuuucuauuucuaagccuugauuuaaaggaaaaacaaaaaacaaaaaacaacaaauuaaaccccccaaaacccauuucaugcagcuaaagcuagccuuaacuucugauucugggauuauagguguguaccacuaugccaggcuucaugacuuuacauacgugcucuuauccaccaagccaacucuagccccuaaaauuuaauaauaauaauaauaauaauaauaauaauaauaauaauaaauuugcucuuuuauuuuuuaauaaaucaacuuuguuggggcauaauuuacauacacauaauuaaauuauacucaggggagauguuuugacuugggcuggagagauggcuuaguagguauaggggcugccaccaaagccugauaaagacuuuaacaccccuccuccccaaaauguauuuaaacauaaaagaacagcaaggcugauaugugcacccacauaccuuccccacugagcccucuccuccgcccagcauauuguuucugggaauggugagcgggcuguggggacuuagacuuuaguacugugauucuugaggacugguuuccugacauacugugauaugcuuaccuggucaccuccuggcagguucugggaguuuuuaaggaauuaugaauaaugcuucuuggaacauucuugagcaugucucuuugaagaccuauggcuuuauucacuggaggaaagccuuagguuagcaaucuguuagguggcccauguacuaagcagaguguaacugucugugaaauugccagacugguuuucaagcaguguauaguacuccuucauugcuuccuguucuggccagugcuuacauugucggaaaguacucauagugucuuauucuaauucggguuguauaucuuugauuguugucuguaguuugaauggucaagcauuuguguguugaagucaaaacauucauguggugaaauaccaaaguuugauuucccucaguucugcuccgauguaagucauuuaaaugaucaaaggcuccuuuacacaccugcugugugcuagacacgggcacaccuguucugaguaaaagagaaauggggguugcuagggagaugguucgguggauaagagaugcagucacaaaguccuauauucaaguucccaguacccaucuuaagaacuggugaauccuggagcccugucccucaucaacugcagcacuugggagagcgggcccuacacccugccuggacaguagagguugcagguacacugccccugagggcgggagagcugguggacugaccagcuuagauaccauucaggcccagauccagggcuuugaauuggcccuccucaacaucuaccccauugaugaacugcuguagaggccaguccuauagaucugaagcuacaggaucugcauaauacaaggcaacaacaggaggagucccagugaggucccaguauugauagaguagcagaagccagaggccucauaccagaucaaugaaucauuacaaagaaggcaaaagaguagacggugggacacuccaguugcuacgaggagauucuuugcuuuguuggaggggaggaugcaaggguggagggugggaaugagggguggggagaugagugggauuggggggcaugaugugaaguucacaacaaacuaauaaaaaguuaaacaacaguuggugggcgcagguggccauaccaguugcagugguucccauaugccuugaguacacuuggcucagucacagugcuaggggaucagugaggcucccaguggucaaaugggucacggaggaggcuuguuaauaucuaucuaaagaucuucuuucauuccuggugauguagcucaguugguagagugcuugcccaguauaugugaagcccagaguucauguauuuuucuuggucaaguaagccuguaaccucagggcugcaaggggaggggaccgaagaauggcuuggccaccagcauagcuccaguuuccggaauaacaucagcaagugauagaaugggacacccggcauccuucucugacccccaugaaagcaugggcucucaaaccuacacacacacacacacacacacacacacacacacacacacagacaacuggggaaaaugaaaacaguugucaugaggcuuauagaugagcuaagaacaguaguuaaucagccacacaugcugugugugcccacagggaggccuuaagaggcugaggcugcccuguauagauuucauccugcuuucccaggaaagacauucuaccuacaugcuccuucacuccauacugguugcaaaauacuuaagugugaaaggcuguaacuugagggcuuguaccgacaggcuucaccccugggaaguuaacaccacccacugugggaacccaggguucccaggaagccagaugagccugcacuugaucguuuggcuuuagguaaaauuccagagccucgcucuucccaagcccugacccucagagucuaaaaaguaagcuaggggugaaacauugccucuauaaucccagcacuggggacgcugaggcaggaggauuguugagagugaugaaagaauaucuggcagggcuagagugaguacucaguaguagagugcuagcuugguaugcgugaggucauaggcaccaucuuuucuaccgcaaaagagaccauaaacauaugcuaagucuguugguccuguguccauuccccuccuguccuccuuuuaugccccuuagggggaucgugcuccuccggccccauuaggcagcucaugguacuuguccugagcuccguacccugcuccacaaccgaacaccuguggucuucagguuuagguggcuggguguucuaaugagaguaggugaacucagacccggugacuacaauuagcucuguuaugucuuggguaagauguccugucagugguugccguaggaucacaggcucugagcuguuguucacucugcaguuggcuccaaaugcaauuuuuacaugcauucugagcaccucagagccauaguagcgauggaugacacccuuagaaaggaauccugccgaguauuuuuagcaacaacauacuucucuaauucuguaaucgaguuccaugcuccacagcuuacuucaccgauggcucugcacuuccaagguacgccauggagugaauaauuacagagguauggaugaccuauuuuucccccugucugugacuuacaucgcauaggaauuacuaugcaccuauugugguguguagauucuaaggguaaaauucuaggguaaucaauucugguuuuagcuugucagucagaguccuggcaggagacugaugccucccugaaguggagucacugaggagaauaugauaaaggccuaguucucagcugagggugagcauaugggaagcagcuugggauggugggcucaggagacagggaagggggaaacaggaugugcaagggcauguucuuauccucuggggcugaagggguuaaaaaaaccaaaccagcugagcuucucaguggucagaagggaccagaacccugagaaguagaugcagcuaacccaugagcccaagaggacccgucugggauaaagcccugccgccugccuccgcccuuccccuuccccacgguucucugguguuucccuuuagaggagccagagaugaagauagugaggaagggaucccguggauagauuguccuaaugucaccuuggugugggaagggagccgguugcucugcugggcaguuugaauaaguccagcacauaugcauugugagugaguguguguguguugcacgcuccuugaguaccuggcucacaagugcuagugggauuagugaggcucccaguggucaaguaggucauggaggaggccuguuaauauuuaaagaucuuucuuucaucccugguaagguagcuuaguugauagagagccugccuaguggacaugaagcccuggguuuaauuccuagcgcucuauggucuaaaccagaucugacagcacaugccuauaguuauggaggcuuuaggaguucaucauccacguagauugaagucaaucucagcucuaugacaaccccaaccccagcccccauaaaagagucucagucaaaaccucaggcuuuugagguaaguuuccaugcuuagaggaggguacaaaaacaaaagcgacagacucuuucccaagguaucauuccuauccucacuguuguaugugucccccacccccaccgcaggccauggaguccuuuccugaaagcugagaguggcacuuauuguucucucucucucucucucuaccucccuaccuuacuuauuccuuuaaacagggucuucacugaaccugaaacuggaucaguggccagcaagccccagugauucuccugucuguaccccauaucccagaguugggguuacaggcccuuggcauauggcagugacaccuagcuauuuuuuuuguuuuuucgagaccuagcuuuuuaaggugugugcugggguucacauuugcauucucucuguuaaaccacaucccuagcacagagaccagagauagacuuuuggccuuccucacuucagggcuuccucgguucuucucugucuuguuugcugagacaggagcucauugagucuggagauucugcucagcuggcagggaccuuucccguccccgcuuccccagccagggaguguguuuguauguggugcucucaaagucaacacuuuagacugaguuaccucccuaccauggggguucauccaguugauguaagucucugguuuuguugggcuuuuuuccguguguguguguguguguguguguguguguguguguguguguguguuuuguuucugaggcagggucucauguagcccagucuagccucaaauuugauaaguagcuaagaaugucuuugaacucuuggucuagcuuuggccucccuagugcugguauuacggaugugugccacuauccuugguuagucuagauaauucucaaagaaucacauuggcuauggcuuucucuuuucucuccucauuucuaugcacacugucuuaauuuuuuuuagauuuauuuauuauuauacguaaguacacuaucuuaaaaugcaccagaagagggugucagaucucauuacagaugguugugagccaccaugugguugcugggauuugaacucaggaccuucagaagagcagucagugcucuuacccgcugagccaucucgcuaacucaguagcacacauuuuaagagauacuuucuugccaagagaauacagaaaacuugccaagcgucagcgcagauguauacaaguuguccccacuuuccgugaugcaguucaucuugguguagccccuuaugcagacagaugugagaaccuugggagccacauucucacagcuguaaauacuugcggcaaggcuggguuugucauauagcucaccugggggaugcagcuuugaacucagccucugccucugccucuuguucuucaugaucuggauccuuccuuccaggguuugguuuuuauggcuaucagugcuuuuaaacaacccucucagaugguguucuaggaucauuuaggucugugaucacucuucaaaacuggccauaccaguggagaggugauguguuugcagacggucacaugccauagugagaacugcaguggcauuggguuugguuuuugaagaaauugucucuguguguguguguguguguguguguguguguguauguauguauguacacaccucauaucagaacgagauuguggaacuguccauugcuuacaacgugauuuaaaauguggugugcagugcguauggaggcagcugcccgaccgugguauuugucacaguguguuuugggggugagggugcagcgacagguuugauguggcuuucauuggucccgcgugagucuguuagcuccucugaguccuaauuucuuucuccugacacuccccaccagccagacugggagaguuauggaguaacaggugucaggugguugagagcgcccugggcacacgguuaaugugaguggcaucacugcugcugucccucugaagcuccugugccacccucauugaaagagcgugcgucugggucguaagcagggcagaaucuuacuccaggugacugggcccuauacagaauacauuaaauaucccuuguguaaaauuaccacaaaccaucugaaaccuuucuccccaacagccuuccauuggucuuugggacacccugagugauugacagcugucauucaaagggaugagcccacaggacuuagguucuuuguguaucagguugcuaugaauucucgggcgagcucagaaagacugacggacagcuguguuguccaaggugccccucuggccguguuagggucuuacagacugugcugugugcuuuagccuuggugagucuccaugugccuggcaccaaaacucagcaaauacugaugauccagcaagacucacagaagcagcauccgugagaaggagggcaugugacaguuauuaauauuaucaaccuccuccgaucuaagaucaccuaagaaggccugccuccucgaauaccuguggaggaguauuuagaugagguuggccccugguugaguuugugagcgauuauuaucuugauuagauuaacgaagugagaaaacccauccuaaaggagcagggcccugggaagaagcaaagcugaacacgaauaccucucucugcugccuuggcugugggcguggcgugacggggcuuagagcuacugugcccugacuucuguggcugucauggagggcacccuuaaacugugagccgagcacacccucucuccuccaaguugcuucuuucaguguauuuuaucacacacacaggaaaagugaccaauaguguggggggggggguaggaggguguucgugggacgguuugccuuuuaaauucccccaaacaggccucuaggagaugacaaaugccccagagaggggaggcuuuggaggcagcuggcuaugugccaccuuccauaagucacuguguuuagaagcucaggccuccacgcuuggcaccgcauagcgggcuguucuagggccaggugagccgccuuaccaucaguaugggacugugagauuccuccauccccugccuccaucucucuuucucugcuguucuucaugugccggccauagauaaggcuccuguucccccuugaaguuuggggcuggcacuuugccucccugauacccacuuuggcagcucacucuuuuucuuggcuuuguccauuuuaaccaaaaacuuaguagaauuuaaaggcccugcaacacuuucccgucauuuggcccuucagcuguccgcuacuuggguccuaggugguuucaggucugucuguagcgugcugccacacaggugagguccaucugcaaacgcuguugaaggcuguuuguucuucacuguucgaauaccugggcuggaacuuaaagucacugggauggcagguucuccuuaaagcgggaucaguacaugccgagcgaggcugugaacugcauccagagcucaaguauucccgggaaggccuuggucuuugccaggaagggugugucugugguuaccaaggggcuguggccacucccugcaaacuagcauacagccccaugacuuuguuuaacucagaacucaaguccugugauuuuugacuuuacuuuuagcaagugccccuaaugccacuucccuugcugugcccaccugucauuaccacuuagagccuggcuugccccguccugcaacuugaaguuuuagaaauaaggugaucaaguuauaugugccaauuagauaagaucacacugggacauuuaaaaauaaaugaguaacuagggguaaccaaaagauaaaguggcccugggagggcugguuguaauccauccaggggugucuguguuauccaggggugucuguguaugucagacucgagccggccguaauugcccucauaaaauauuauugccguuucugagucacccgaaagcuggcagaaguacaggaaagaguuuagagucagccagagccccgcuccgcuucauacagcuucuuuauuacguucuuuccugggucuuuaucguccaaaauuaaccaagauuuuucugaguaaaugcugugagugcuggauuuuacucuugacaucucuuagcuuuacaucaguucccuguuuagacaacaaaaaggcaggaaaagggcaaucauguacaggacuuaaauuuuguuuugaguuuuauuauuauuauuauuguguguaugugugcgcacacgugucacagcaugugugagaacaacucuugaagguucauucucucuccuugaugugugucuuccgggcuuuacacaccagccaacaguuugggaaucaggcacuugacucacugagacuucuaacugccucaaacacaggucuuuauucuucugcuugccuuuguaauuugcuugcaaguuugaggccagcaagacuacauagcaagacuaucuuuuccuuaaaaacaggacuguuuaauacuaauaggucuuauuacaaaaagggggaugcaugcacaucccauaguaguuacacuuuuauugcauuugcauguuuauuguggguguguguauauaugcaugugugugucuaugugcaugugugugauggucagaggacagacaauaagagggagucagucaguucucuccuauccugugagacccaggagaugaacucaguuuaucaggugugguaguacacuuggaaccaucuugccaaucuuuauuauuauuuuuguuuuacaguuaauuauuguuauuggugugucuaugugugcagaugcggaugugggcucauaggucugauguuacccuggcacugauguucgagacugguagagaaauggcaggaugggauggguccuugcccuuuccguguguuucucucuuuuuuuuuuuuuuuaaagauuuauuuauuaauuauauguaaguacacuguagcugucuucagacacuccagaagagggagucagaucucguuacggaugguugugagccaccaugugguugcugggauuugaacuccggaccuuuggaagaacagucgggugcucuuacccacugagccaucucaccagccccccccccccccccguguuucuccuagagauuaauuugauuuuaaucaaauuuuggaauuacuuugguuuuacuuuuaaguguguuaaugcaaggaaauuauugauccuuucugcauagauuaacacacacacagcuccacuauaaaugaagaguuugcagucaucauguguguaaaagaaauccuacccuacuugucccuccuagccacgucccugcagugaacacguaucauaagugucucuuacagagugaggggccauuggagccaccacagagcucauggguuuacauauagcauaggugacaccuuaggugauuuccauccuagucauaguguagcuauuggcaggaauagcaauuuuucucucuuugcuaacuagaggacccauugucucugaguuuggaauauccugcacuggggcuaucuggaaccagguauccaccuucccuugcugaggggcuagucucccugcucccuacagccacauccuggcucucuggacaguguguugagugagaaguuguuguuuuucuccuuuaucccuucugcuuugggguaaaaacaaaucucuccaaacuauuggagaaacaaauuagacagaugcuuaacgaaucucucccccuccccccccccccguucucucucucucagcuaauuucuaagauaguuuucccaaugguuucgaaauguaaagguuucccccagugucugcagccaauaaaauuguggaaaggcccacagugcuccugggugucuguccugugcuuaguguuuuaucuugcugucccucauguuucucgaggcccacgucuggacaguauggugguuugcuagagugaccuuucucuguucuuuccccacccucuuccccgguauuguguaacuucuacuguuaccagagaaguuaaagggacucauugccucuggugagcuggguguggugcccggugcacuguauuugccuuugcagcacguuuuggaccaggaagacuuaucucugacaugcagaugaagaaauguaacgaagaacacaaguagugacgcucagccuccacuccaaguagcacagcaucuuagcaacaugggcaggaaccacgcgggcauauuucugugcuguugggagccuccuuucuagaauguucucuagagaagcucuggcaucacucuuaaccucaggagcuacacucugugccauagagagcgucaguacccugguggcaggggcuguggguagccagcagugcccuggcagugugagccgggugugugugugcacaugugugugcacaugcucuuugcaguuccuggcggugugagcugguugugugcacaugcucugugcaguuuugaggcuuugcucccucaggccucaucguuucccagccugaugguccuguggccucuguuggccguuauagguauucccauauaguuuauugccugccuucuucuagagguccugcucugggaaaauggauucaccuugcccagcaucgcuugccccguuguuuucuacaaaugauguuaaguggccugcuuccagcagagcccaagaaacaugcuuuguuuaggccgaggaagcaugauggacuggcucugaggauaccgcccccacccagcuuccuggcaguuugaacccgaguguagacugagcuccuccaguauaugagggagccagaagucuggaagaggcagagagcaccaggcccagugugugggaagcuguguuguagccuggugggcuccugguuguagcuagucaccugggugaaagggacuggacugaucuacaagacuagaccucccugaaccugggcaaaguuuguacauguugugagccguggcaaugugauaaaaaugccagcugaggccccucuagaaaguguuacuugaugacaggugagugaacuuuauggucuccagcuucuaugugagaacaccucccuacagagagcacagaggcccagagccucccaccuccagcccacacucagcucugcagcccuucccaaaccucugcucucuacuuuauccucugagccaggcugcucccuacccuguccaggaggggcuguaggccugcucuucagagcagaguccucugauaggaagcccagaacucccacagggucaccagcccccuaugagguacauaaagacagaacuccgccucuuuccuggacuauccugacugguucucuaaagcuuuuguuccacucugauccauucauuuuucucuuccaucugcaugcaaacuguuuucuuuaggcugauggaaaaauaaccucuagcaaacaguuaugugugauuacauuuuauuucucauauauauguggauguaugcuguguauguguggaugcauguuugcauauauaugaccauauguguguaggguaugugugcaugcgggggcccggcauuggugucgggacucauuuaugguugcuuuuuacacuuuauuaguugaggcaaggucucaguuaaacccagugcucaccacuaugacuguugucccuaagaggcuugcccagggauccuuugucucugccuucugagaccggaguuacugacaaacccucaugcucacuggacguuuguggauccagggaauccaaaccccacccucauaaccaaccaguuagccagcuccccagcucagugagaaagagacagacagacagacagacacacacacacacacacaggagacagagccacaugaagaugugugcauuucaaugugguuuacauuaauucacagucacaaguagcugcuccugggcaguggcugcgcuuuggagcacagugcugacgaagauggccauuuagcuuuucauuagcucccuaguaacagaagcagauaguuguugugccguugcuaagugccaagcccaguguugucucguuucauccucacuacaggcccaagaagcagagguuguuacagcacucccauuuauagaccaggaaauuggagcucagagcaguuaacuaucuugcccagggucacacagcugagaaguugaaguaaaacuuggacuccagucuuuaggacuccaguuuccaugccaaccaagcuuaaggguugcccuuugaaacacuauugaguaaugcauuuuauggcccagaaaaaucagagucagugauggcccaacauguaauacacaaaauucaggcccuguggggacuuggucuaaaaguguccuaaauuguaguaugcaagaacccagcgcagugaggcacagccccacuaaugauuuauugcugauuacugaugaacaugacuuuuagugugugucuguacgucucccccgucucuccucccuacaggugcucccuauaggugcucccaccugacuuagauccccauugaugcccucucccugaguccugaaggaccagcccaaaucucuuaugagaagcucccuuaccugggcccuucucuuccuggagccauagagcuuuugaguugaaccugaacagagguucggggcucuagggcagagggagagggagccagcugugcacaguggcuuugcaugcgcagcuuccuugaagugcagccacauuggcugguuacaucuuugcuugcuuuuguguuguccugguugccaggguggagcuguguugucaacaacagaggccauggacuucagaggugaaaagauucccucuggcccuuuaagaaaaaguuuaccaaaccugacuccagccgggccaguugacaguagaaagugucaagagcuggaccucuucagagugggcuacaggaucagugagggacaauagaggacagauagacggaucuuggucucuugguguccugccuucaccuccuggugcugggaucacaggucuuugcacagaucuccgcaccuggcuuuauuuagugcuggggaucgaacccagagcuuuaggaauccauagacugacugagaguccccaguaaauucuuacgaauaccauaaccaauacauuugauagauggggucaaagguuaggaauccaacagcaugcuggauuguccucuucucuagccuuucuucuaccuggcuaaguacacaaaaccacuguuuuccuuugccuggcacuuugaaucauucucauauccaguuaguuuucuaaaauauauucugaaguaucguguacucccccucccccucaucguuccuccucucccuucuccuccuuccucuggccuuacacaacucagugccuguggucauuagaccugcauacugagucugacccagaccccucugggcaagcccuguggccacucccagugccugugucccccauacagcagcgccuccuuguccuuguucuucccggcuggucgcuuagccucacaccuuuugucuuguuccucucuggaacauaaggugcgugaaggcagccaccuuucuguguggguguggcuuuuauucauuaauaucuccuccauggugacuggcaaugagguaaauaagaagggggcggggagaggaaagaaggaacagacaaaugaagguuggucaaggucgucagugagauuggguaauguuggaaauaucuccagaaguggcauaugagaaccaucaaaaaaguauuccaaggucaccgagagaacacacccaguucucucuccuuuuuaaaacaggacaggcuccugauggccaaaucccccaaguucagcccaugagccccacauuaaguaugucucuuuuuacugucaggagagaccuuuaccauggaaaggggcgagaaggacgaaaaguucccagccauugucuuagaccgauguuugccgaacacuguuggcugaccuccagcuaggcauacccacuaccuuuuaaccagaacacaaauacacguuacauggguguacacacaaacaucucauugcauuuuucuacuauauuuucuacagauguuuucugcccuuuaauguuugauuuuaugcaguccuauaagacaauccuaguuaugacccauuacgugguuucaugaccuguuaaggcagaagugccauagagcuugaaaacaauaaguuuucaaccauggagcucuagugcuggggagcccagcagggaagagcccaggaccugaggucagaugccagcacacacauaagagacagguugugccugugcccacaguaagccuggcucugggagaguggagcagggaggaucccuggggcuugcugaccauugccagccaugguauucugcuuuaggguaaggcagagugcuggagcaggacagcuggcauccucgucccuuccuguccuuuccccacagugcaaacagcuugcuugguacaugcacagacaugugcacgugugcacguacacacacacacacacacacacacacacacacacacacacugugccuuuccuaaggaauucucuaucuaccaaaggaauuugauuuguuacguuuaacugcuaagugcauuuuacagggcuguaggccaugggguuuucagggcugugggccacagggugauaaugaggcuguagaaaggcucccuccauccagaccucucuaggagucuggaagagaacacaccuuuuccugguaaauuucauuuaauguucccccccuuaaacuuacuuacuuucuuccuuccuuccuuccuuccuuccuuccuuccuuucuuucuuucuuucuuucuuucuuucuuucuuucuuuuucucucuucuauggugacuuuuguuuuuauuaucaguggaguuaguggcuccucagguaguuuuuaacuaaaaagauacaaaaacuuggcuugacuuucaauaucuucucacuaauuuuuccacucuugucuuacauugguuuucccuguggaguaugauguauguguguguuagugcauauacaaucacauaauacaugcacauacauguguauauaucucaaaaaugcacccuucagugaaggguuuuauuguuuugaguuccuuaacauuuaaugguccgugaccuucacaguuauuuccauuaaaaagguuugccuucucuuuuuuucggaggagaugcagagauuuccauaacugcucugacccucagaguuauuacacaacuauaaucaaauuaaaccguucugcaggaggcguuccaugccguguuuccugacccucgaaacuugagcccucuggucgcuaugcauuuccauuucagaaguuuuuagcuaaaccaucugaaucgccacaugaaaccaaagagaaggcuugacaauggguguguuuccagccucuuccuacugccccaaaccccaaggucucucugcuuagugcuuuccccacaggugcacacccaagaaacauugcauuuggcuuuucuuuggaaugccugcacuucuuagaguaggcuaacacuaaaacacaguguaucgucagcaccugucuggugagaaaaacaauagaaacuccccccagacaaagaaccagcaaccccagaccucuguggggucagggcacaauacguuucucuggauccaaagugugagguugauaaugaccuugugcucauuaacacaaagccacacguucugaccaaacucagaaacauagguucaacgaucaugauagcaagaccuaggcaacaggaaaaugcuaggagcugggugguugucagugguguguuaugaaacccuaacaugguggccaugcccgaguaaagaaguuacuauggccagaacugguguguagggugcacgggagggugcacgggaagcggagagagacaccggggaagggggggggggcaggguuagacuagaauaccaaaagaucucaccaaccuauccagcacgugagcaguggccauguuaaacccuucagugugcaagaaccccucuccugccucugcuggagucaaaacuccaucagaugugagguuauggagcacgucuaggcagguauguccucuuucuuaagaucucuucagugauacaugcgggcauggccaccauguuaggguuucauaacacaccaucccugggccauuugccugucucucaccagugagggagccaugacuuucuccggcaccauggauggcuccagacuucccauucugguucuccacccuuccacucagcagcuggaucucuuacuggggaacuauugugcacagucagggcuuuauucuauccacucuaaauaacauuacagcauuauaaacaggauacuugaguugggguugggaggagcgcauucuuggcuuacaguugcucacccaggaaggcugguugggcccugauugcuuuguugggggggggggguuccaggugggugaaagaugaaaccugcccugccuugacagcuaucuuuguuuuguuuuguuuuguuuuguuuuguuuuguuuuguuuuugagacaggguuucucuguguagcccuggcuguccccggaacucacucuguagaccaggcuggccucaaacucagaaauccaccugccuccuugacagccauguugaugaaaacaaaggccccuaguuaggcgccugcugcuggggccaucuccuggcagaaguguuucuauugcaucuuggcuauggucuucccugcagcuuaggacaugcugugcacuggucuccuggcucagggcucaacugagagccuuggaugaagaaggucaggccagcccucccaccugcagcuuggugggugcuuugauggcuucuuuuacuucagugugguaacucacugucuucccggcucugcccacaccuuaccuuuuuaaaguacaccaugcaucauacuccacaggaagagauagaggguguagaaccugcuuuacuuggaaagucuggucaaacccugcaaacuaugccagacuuaaaaacauguacaggaaaggaaauaaaugacuuugagaucuuugacugcccagaucauuaaacccuacagauauaucuucagcauagaugcucugggaccagggaccaggugaccggcaugguucuggguauggccuuugaccaugaaugacuuuguaggacugcccugaccccagaacacugggaaugguucauucuagguguccugcugcuguuacacaggcuugagaacuauuuacgagugcugugaacacacaaggcuuguaagaacacuacuuggugacgugauaacugaaaugcagacuaggaaaauucuucaaagauuuuuuuuuuuuggaauggcuuagauuuagugguccuuccaugugaucuccuuguaauuugcugccucucuguguuaguuuaaagguuuucauguuugcuuuucucaauguuggaagacaccaccaggcuuuguagaggagagugagggaaauuacaaaggaagcauggguggggugggacuaggucauuuagcuucuuuucguuccaaauccguaaauauuuacuguugaccuucucaaaugguuuggguacacugacccaguugaaagcagggcaggcgagagcagcuguuccccacccccacccacuguuaaagcugaucucagaccaauugccuccagccagcccaaaaguggccuucagggaaagcugcccccuuccccccagggaacaguuuuagccaauuuacacuuuuaaagugugaccucuucuaaagauuccuagagacaagagcagauugcugugaacugaaggacaccccccccccauaaaaauaaaaaauacuuugaauucuggcuuagguuugcuauuguugccaggucuuuuguuucugaggggaagguaauuauaaauuccauuccaagcauaaauguucuuuugugagcaagggggacgggauaccaaaaacaaugaguggauuacguuuccauuuuuguaagaucgugccaagauaaugugguuuaaaacagcugggguuuuuagagcagagauggagcuucgaaaggucuucucagcgcccaugaacgucagccaaguuagagacuucuggacgagucugaauauuccuccagauucauacugagaaauaagggauuuuggguuggggguaguucagauuugacagucauguuauugcaucaacauaaucugguagcuacauguucaucugaccucaucuacucggggcaaagaggagcagagagcauuuaaugguguccuguugucagccugagaaaucauuagcaaaugaacaggaaacuuuggagaauaacuacaauauagcccuguauuugccuaccacaaaauucucuguacuguauuaauauguuuucauuuuaauuuuucuuugcagaguauugggaaagggucauuguggugcaucgacccagaguauagacaaaaucuaauucaggcucugaaaaagacaccuuaccacccaccuccuacuccucaggcuuaucaaagguaagugacucgcacuaucggggguuuuuguuuucuuaaagucuccuggaauuuuguuauuuuagcagagacagucucuaaaacuaauuuaguaggccguaugaauguuuuaaaaauaacuacagacuaaugggaaaaagaauuaagucugaugaggaggcacauccauuggcuaugcauuuccugggaagcuuaccgcuucuguagcuccgacugagcggguguggcuccggaagggcuccugguagguaaauagcgucuuccugggu

SEQ ID NO: 6789 - RNA, 8136 nt, Mus musculus
uaagaagccuuaacagcacuagagcugggcagguauccacccucuaugcuaucuugucuacuucccugucaauaacccugagauaaaacuugccacguuccaucugggcugcucguacuccagcugaccaacccucguggccaguucucacagccccuuacccauggcaucuucucucucuuugcuuucagcucucagcucuccucuccucuccuccucauggucuuugccucagaccccaagucuggcaaccaaagcuccaccuaccucucuucugccaccuaccucucuucugccaccuaccucucuucugccaccuaccucucuucugccaccuaccucucuucugccaccuaccucucucucuucugcccgcuauaggcaauaggcaucuuuauuuaacuaaggagcaagcucacauagcaccacaugguuaugugaggauuucuuugucccugaggcagucagaucuggggggaggggaggagggccguacuuaggguuacaauacagagcaacagugugaacucugggcagacuagggccugaggaauagcccugaccguuuccuuagggugugucaggccuacaaguuccucuugagaagcucugugacuuaaccugaagccuugcgucugcucguaggaggggagucuagugcuugacucccaagaaagggcuggguuguuuaaaagcagaguagaugacuuuuaaagcauugagcucucuccagucucacugagaagucuaaagcggcuggcguguaugcucugacuuuccuucagcauaauugugaacuuggaagaaaucucuaaugucaagguuuuaacccagacuguccaacaauggguauauacauacauacauacauacauacaugcccagcuuuucuuugcccucagucaccugaucacuuugcccucucugccgagcagcguagaugcccacugcuccuauagugagcacagaaaaugucuguggcccuugagucagucaggugagcaguguagugacccaggucccacaguuggcucccacaagguaaucugguuucuccuuaaguucuagauugauugggccccaauucugccaucaggggaccucacuguugggugcugaagcagcaguccuacugggaugagaauggagagcaagaggggaagccuagcucucagguucagcuuaugucagaauguggaagcaggguucccaaaaugcuagacccuaacggacucggcccuccagccuccaggaaauccuucgucuuugagcugaaugagugcgccuccagccgcauccugaagcuggagaaggagaaccaaagccuacagagcaccauccagggucugcgggacacgucgcuggcgcuggaggagagcagccucaaguauggggagcuggagaaggagaaccagcagcuuagcaagaaggugaccuucggggcccuuaacaugucugccgccagacucugaggagggcaguggggguuggaggacaagccaggaggaaaccaggccccagggaccccaccucugcugcuuucucuccucugcgugggguguggugcacauuuccugcuguggaaaggauuucagggacccacguggcugcauuuaccugcucaccacuuaccccacuuuaagcacugagugucaugugacagcucugucacgggauugcucugccuuuagaggacagcaggagaugcuccuaucucaugccuugucuuuuagagcaaagcaaaaaugggaaaagugaccacaugauuuguucucuuagaucucuguggucguaaggcagggaaugucuuuauaaaugggcgcccagucuuguauaauaugaaaaagagcugacauugaagaaaggacccucccacuccauggguucucaggcaggaaagccugggguaucuuuuugcugggcuagagucagugugggucaccucugcccuguagccuauucucuguauaccauggaagauauggagaacucuuauguagggaacucguguucuaggaagcuugggcacacugguggguucccccaucagagccugguguugguaggcggugauaggagggaaauuguccagacaggacaauacauucuggccuagggcagccgcaguggaugguaggagggaguagagugggcagaagggacaaggcuugauugaugauggguuuaccuggagagugacaggaccugagcagcugcacaaggucgccaaacauaaggaaggggaagggaacucuacaguccuuguugggaacguggcgcuaggugcuuuggguaugcggucugacccugagcagaaguggaggacgucaaggggggaaaaagcaagacauagaguagauuggacgugcagcacccuggguagccugggacagacacggggaggcugcugcccagugacuucucuuaccccagacagaaagugcaggucaugucaggccaaugacugagggacugagggaauacauugcugcagagagacacugguacauuuuuuguccccucaagggccuguauaauuaauaaccugggcagagaagggucugucugucugucugucugucugaacacagcucaucuuguuagacugauugucacaggcuggaucuuuacaucugcagauugaaaaguuacaaacgcagcuggagagagaaaagcagaguaaccaagaccuggagacgcugagugaggagcugauccgagagaaggaacagcuacagaguggcauggaggcccugaaggcggacagggccaggcagguaggcacagccauccccguugcacucacacaugccggacgaggagcugaggaggguggcuaugucgcuggguaguguccccagacagcucugauuguucugacuggaaaggaaguaggagaguuccuggcugugacaaacaccaugacugcaauauagaggaagaaagauugcaccuuacagguagcaacagccuaucauugagggaugucggggaagcaggaacuugaaggcaggccugcuugguaccccacccagcauuacauccaggaaacacacacagcagcaaugguggaggaggaugcuucuucucuggcuuccucgggcucuugcuuacuuagcuuuccuauauagcucaggacuaucugcauagggaaugaugcugcccacgguggacgaggcccucuuacaucaauaaauaagacaauccccagaggccaaucugaucuggguagucccucaauugugacucuucucugcuggcuugaggcugugucagguugacaguuaaagcuaacuaggacauggguggaggcugcuaaacauucugcagcacacaggacaaugacuuacuuccaaaagcuguuggugacaagggugagaccuuggcacaccugcaggguucugcuugcuuccagcauccgaagcgucaggguacugauaaguagcucaggggugccaucaggaaccggccauucuaaagccacuggacaucuccaaacucuggagagaaauaaguggagaauaaagagcaaagcuggguuauccgguauuuuaguuuguuagcuucuguuguagaugauaagaacuggggagagaucagagacagcacuguacaugcugagcacaggugggcccuguccgugcagcucagcguggaaggugcguaccgcgcagcaggcucggggaucuuuaugaccagacgaggugagggcugcuggguagacgugcagggccucuuuagagccguugugcaagguuguuuggggcacugaucacgagguugagaagacacaggaagggagcaaggcauagagagcagcagccuguucaguguguccuucaggaagacacugggggacacuagaaugugccacagcaggaggucauggaggugggcaggguguccacuggguccugcugaccacgacagaguggagucugggucaugccuaauauguuuguuuauagauaaaggaucuggaacaggagaagggccaccuccaccaggcuguguggucccugcgggagaggccgcaggucaacagcacgaaggauguggagaaggagaacagagcccuccaccaggcugugacagaggcgggcagcaagcucagccagcuggaguuggagaagcagcagcugcacagagacuuggaggaggccaaggagaagggagagcaggcggaggcgcuggagaaggagcugcaccggcuggagaaggagaaugagcagcugaccaaggaggugaccucccugaaggcagccacugagaaggucgaggcccuggagcaucagagccagggucuggagcuggagaaccgcucgcugagaaagucccuggacacccugcagaacgugucugugcagcucgagggccuggagagggacaagcagcagcugggucaggagaaccuagagcugcgcaagaugguggaggccaugcgcuucaccagcgccaagauggcgcagauugagacggagaaccggcagcuggagagggagaaggaggagcugcgcagggacguggagcugcucaagaccuugagcaagaagucggagcggcuggagcucagcuaccagagcgugagcgccgagaaccugcagcugcagcacagcuuggagagcagcacccacaagucucaggcgcugcagagggagcugagccagcuggaggccgagcgccaggcccugaggcgagaccuagagacucuccagcucacccacaagcagcuggagggggccgaggaggacaggaaggcccuggagcaggagguggcccagcuggagaaggacaagaaacugcuagagaaggaggccagacgccuguggcagcagguggagcuuaaggacgccauccuggaugacagcgcugccaagcugucggcggccgagaaggagagccgugcgcuggacaaggagcuggcccgcugccgggacgugggcagcaagcugaaggagcuggagaaggacaacagggaccucaccaagcaagucaccaugcacacgaggacgcugaccacccugagagaggugagccucgagguugggcaauggcaacaugggccuguuuucagggggcgggggggagguucagggagaucuugguguguccuccugagauguuuuccccugggccugagcaugugauaguuaaaagucugaugaggcugggugagaggcacugggguggucucacugcucacugaugacccugugguaagcauuuccuccuacucugugcccccaugcuggugucccuccacccacaaaggcuuguguccccacccacccccgccccccauggacucccuguagacugaaugccguaaguagaagaugcgcugagcacacacaccugauauccugcccauaggaagcuuacucagcucucggugccugugguguccccccaccucccagugacugaugggcucuagcgcucuggcuuugcccagcacucagagccagcauugagccauguauauuugcuagccugggguaaaacuaagauucccagaaauuaacuaaaaagucaaaagaaccccaagacaaucacgcgccagaagacugcuccauuccagaccacaauggucaagcuauuggguuuuuccuuuuaauuacauuuuccagucuucccacaugaagcagauuucggguuuugggucaugguuuucuuuucuuccauuuauuuauuuacuuuuguaugugugugucuguaggcaugugugagagggagucuuuucugucgucccaacauuuggguucugguugccaggcuugucagcaaaugcccuuggcugcagagucacuguccccacagugaacagguuugaaagccaagauacuaaagccuacagauuuacuuugcuaauuauaggccccuuagauuguuuccaguauuccccgcuguuuuguuuggggcuuggggucuuuuucuuccucuuugguguugaggauugagaacacgcagucuugagcaugcucucugagcagcguccccagcucuucccgcuucaguggucuuggacauccuuggacacaucaggcacuuuguaaaggacguguuccuggaacuggagcaaugggaccaaagugugugaccauuuagccuguggcauccugugcuucccuggugucucuuuggauugucgggugcuuguuuacgguauagcucuagaggacagcauuagcgucugggugguccaaccugcagguuuugucucagccuauguuccaggagucuuccgcucacugauucagguaccaggcuccuuccagcuugugauuaaaccaucccauagcggagcguccuggcuccucagcacauggcaguagaggaucaagggagagagaugaugaugcucucuggagcucagccuaaggcgacuacaggcugcuaugugccuggugagagaaggaaagcgauuucaaagugagcccagagccgugacaaaaggcagcuguugguguaggugagccagggaggggcugaagcccuacgugccacccacaguccaugucuguagaguguuggcagugugggcugugaugcagucaccaccuacccaaggaccuccagagcuuguuacagagaugcacuugccacucaccacagucuggacagcagucugccaucuguccugggauuuaccaauccagggugcuauccugcuccuguuuuuuauuuugaaaacagaaucuugcucaggcuagucugggauucucuauauagcccgggcuacccuugaacucuugaucuuccugucucagucuccugaaugcccaccuccaaagggcuuugaccuagaacuccuccaucgcagcacuagguaugggugguggccauggcagguuagaaggcugucagaaccaaacccaugccagugccccucugcuuggugcagauucaugcagacccaugauauucuaacccuaacccuugccagagcugccuacucggcaccagcuacuaaccugucuggaaaauugcacgguggggguacuauucugcauaugauuuggucggagggauaucugugccucaggcaggagguaauagcuccccccagcgagcuugaggauggaagccaaggggaccguggagaugaacucgaccucaucguccggauucugaaagguuaaccaaagccaggcuuuaaaauaaacucuuccagcauggagaugguggcuuggauggaagcgugcuugccuaguagccaugaagcccucccucaguuagaaucccagcacagaaucaggcauggugguacauguuuguaauacuaguacuuggagguagaggcaggaagauuugaaguucagguuuauccucaauuacacagcaaguccaaggucacccugaguuaccuuagacucuaucucaaaaaaaaaaaaaaagaaauaacaguaacaacaucuccuuucuuuauauucaauuacuuguuaaauguauaauuuuaaaaugucagucauauuaguagaaauaauacuugcugcuaaaagccaucauaacaguauuucugacccguuuugaagagcacuccgguucuguucucuguugccacgugguccguuguucacagcacaggagggcugggaaaggcuguucaccccuuucuuuugguggagcauucuggaguugaccacaccaucagccagccugcuugccugaaacaucugaaaccaacagguuuggggaagagauggcucaaagcugugacucccauccacagugguguuuccugucuugcaggaccuggugcuggagaaguugaagagccagcagcuaagcagcgagcuggacaagcugagccaggagcuggagaaggucggccucagcaaggaccuguugcugcaggaggaugacggucacggugacggguaaggacggcgggcaccuugcauuaccuaccgcucugcucugaugaggcugaacuucugggucacuguguggcucgacuccgugucuguccuaggcggcucaggucuuggcccuaggagucucaggagauauggaaggagauuguuuugugugauaaaaagacuaugugugguucuggccaauaaccccagggccuccugcgugugugacaggcuccagacugaccugcacccagccacaggaagagccacuucu

SEQ ID NO: 6790 - RNA, 8981 nt, Mus musculus
agggaugaugauuguguccaaaagcgaucaucuuugcaucucccaaaccaagcacagugcucgaagcaauagaaauaaaugugcugaacgcacugaacccaccauaucgggaauucccccagggcagugacuucgacuaccucugcuucaucucgaauauauaccagauacuugcuuucucaagaaugaucguucacgcugaggucaacuaaugagaaauacgcaaagacggaucuggacuaguccuggggcucacagugggagaagucucucuuuaaucguucagguaaagaaaggcuuugaaaggggcaaaggaaucguaaaauuaaaggguagaaaaguaggcauagaugaugcuuaaguucuccuugucacaggggccagaguacuggggcuggauauggccugacuucugguuuccugaaaaguacguaagcaaggaaacuaggaaugggaucuugggaaacguggugauugugguagcgccgagagaaguuaauucuaucaaggcguggcaugagccucucaagggucuuuggaauuaaggagcuacgaaggcaccugcuggccucguguucucugagcccaagaugggaaaggcagagauggggaggcuuggggaguacggcgguacaaggggaaagagcccaggcuggacgcggauuaacuuuuagcuccagcugaugaaagcucagaggaacuagacaggagggagggcaaggaggaagcauaggcgcgccccaacaccccgagguuucagcccggggaaaagucacuucucuucccccuugcggaacgcuuguuccaggaaccacggagacugucacaaccgaaaccgcgggagcgcguccgggcgacaccgggccgacgcgggaacccauccccuugagggccuccucccaacccgaaggcuccuuuccgucucccguccucaccugccaggccaaucuccccccggcaccguccgccgcccuucccaaccccuaguggaacgcaggucggagagcgagcagagcuagcgcgcgcucagcggcggagagcagccggcaggagccccugugugguggccgccaucuugggccugagcagagcggcugaggcggggacgacccgggcgacaccaucuguagggguggugacgaaccgggucagggaagaggacagcgcaaaagcucgcaaaccuugucagccuggauccacgucuuauucaaaacgugucgcgaucauucacagcuuaagauguacgggauucgcgcgugagaagggagagagaagcgccgguuugccgacgccacccccucucaucagggcuggcgcggcgaguggcagcuccuuaggucacggcuuccgccggcgccaguggccuagcucccugcggcuguccuuggucgccuugucaccaggcugaaggugggucuggggaccccggcgccacccgugguggugaugcgggcgggaggguucuggggaacgcucgcauggaggggaaacagggucgccuucggugaccccugcgcgcugcccgccccacgccuuuuacaaagacugcucuggggacgaucugauggccuggcucucgggggacucggaaggguucucaaggauccgacucuugagcccacaauagggaaugcagcuccuauccagaagcggggcgcggucgcccaggcgucugucuccucguccaacucuccugauugugaaacccgcacguagccauuugccuuuuaaaaacaaggcuuucugcuugguuuccaguccguguuaugaucucaacgguuucgguuuugcuccauccauuccauaucuuaggugacacuuuguaauaauuauaaagaacugugggguccaguccaacacaagguauuaucucuuaaaaagucuacaugugccugcaguggugguggcgcaugccuuuaaucccagcacuuggaaagcagaggcagguggauuucugaguucaaggccaggcuggucuacagagugaguuccagggcagccagggcuuuaaagagaaccccugucuugaaaaacaaaacaacaaaaaaagucuacauguuuccagcaugaauccagauagaagacucagcaaaauaagacucacagcagugucuguuauucuugaaaagggaaagaaacuuuaaucccagcacuuggaaagcagaggcaggugguauuuaagggaaauaccuuguguuagagaaaaauauuaagaaauaugugggaugugggguuaguuguuuuuuguuuuuaaaaagucucacacacacacacauggagagagagagagagagagagagagagagagagagagagagagagagaggcucugcaaagaagaaaagagaggaggaguuauuuaacuguuuaccuccguacacaggagagagaguagaacaaaagagcuuaagccugaucaggauacagauugucuggggacuaugcuaauccugacucuuuacccuauacuuaaagcaaguuacuuugccacaacuaaauuuggauuucuucaucugaaaaaaaaaaaaagccccaaucuugagacaugguuacuuaaaucugcagucuguggugaggaguauaugaauuagcuaugacgcagaaacgccucguccauguggccuacaucuguaacuccaacuacuuuugaggaugaggcagagggauaguaagccagagcuucacaguaagacugucucaaaaaacaaauacaaaacaaacaaacaaaagauucaguucuuguuaaaagcuugcccaaaaaaaaaaaaaaaauuggaucacuuuaauauuaaaaaaauaaaugaccaagccgggcaugguggcacacgccuuuaaucccagcacucgggaggcagaggcaggcggauuucugaguucgaggccagccuggucuacaaagugaguuccaggacagccagggcuauacagagaaauccugucucgaaaaaccaaaaaauaaaauuaaaaaaauaaaauaaaauaaaaauaaaugacaagacagaguguguggcucugauacggugugugcuuuucaaagccaaggcugcuucccuccuucucucacccccuucugucugccucccccccccucuuuuucuugacacaguuucucuguguagcccaggcuggccuugaacucagagauccuccugcuucugccuucuuagugcaccaccacugcccagccucccaauucuuuuuuuaaaaauaccacaguaccaggcaguggugcacaggggaggcagaagcaagcagauuccugugagauccaggacagccagggcuacaaagaaacacucuugaaaagcaaagcaauaaugcuauauuuuauuucugaaauaaaaacaaaauucuucuuauggccccacaugcagaaaggcaccuagagcuagagagauggcugggcucagggguucacagugcuugcugccuuuccagaggaucugaguuugguucccagcucuccacucacagcucacauguuggguggcucacaacuccaguuccaaagggcugugauaccuuuggccaucuuggguuccuguacgcauaugcacaggcacgcgcgcgugcacacacacacacacacacacacacacacacacacacacguacaaaacguuaauaaaagagacuauuaauaugugcucucauaagcacccgccaggaguauaguccuuaagcaguuaguuggcccuguccuauugguaacauucuuagcucacccacaccaaaccugaagugcagcuuguccugguccucacuagaugaagcucuauggauuuagguccaugaccaagacccucgcucuaguuccccucuuacccauuuucuggugaaucauucugacucacagauguccacuuuugcccucccugcucauguccuugcagaaagacaucucuguagaugauguucacugcauugcuucccaagccaguugaggagcuacugaaauaugaggugccucucugggacuaaggguuucuccuauggaugauacuccuucaugauggcugugaauucugugaagcaucuguuucuuaguaccauugucauuauaccuccagucuguagaaguccauguguggcaagaggcccauaaggcuucccucuuuucuucuuuucuaaguaaaaccagaccaaacccaucuaugccaauaguaaugacucauagccuacagguagcugugagcuuauuuuaaacugcuaugagcugggaauccucaaguacuuguuagugcaaaaaugcugucuuaacagcuguauaaacaaggaagcuaaggacuuuuuuuuuuuuuuuuuaaacauuuguguguuugggcaugcauuuucuuuuuuguuuuuuguuuuuuuucaagacaggguuucucuguguagcccuggcuguccuggaacucacucuguagaccaggcuggccucgaacucagaaauccgccugccucugccucccaaguacugggauuaaaggugugcccuaccaccgccuggcgugcaugaauuuucacgccacagcacacuugcuggugcagaggguagcagacagcucucaagugucagcucuccuuccaucaugugagugcuaggaaucaaguguggguccuuagacuugauggccuugccuuuacuugcugagucaucuuucuggcccuuaaguuugcaauaagggcagaaaguguagguggccacugaguuugccaaacuccaacacagucuccugaacacagacauugacuaguaaguauuuuagaguugagugcuauuaaaaguaacuuccuuuaccaucuccacacuugacuggcucaagauuauaaagguaaucagaucacuuggugagcucuugguuaacaugucaagaaauacuuuaagugaugcuacuuaauaaaagggaagagaacaacugucuuauaggaaaugaaguaagauuggcuuuacuuacguuuaaaucuccaagaagcauuuguauucaaaucagugggugaguuguagugucuggaagggccuauguguggcaagagccccauaguccuaacucaucucucuccugaacagagccaggucaaaccaaucucucagaauucuaguaguaaugguucuguuaguccagccucaucuuggagguaaagccagauucuccaguuuaaaaagggcuucccaggugguacugauguguaguuaagguugagaauuccagccguaacuaggcaacagacuacaacauaacuaacagaugacuaaauuguaaguauauauuuaucucuucguguacuacauaauaauuuuuagagauaggugauguucaaacagaaguuugcuauguggaguauuacauaauaugaacuuuauaguaacugcaacuuuuaacuuaaugguuauagucuaacacugacuuuaggaacuagauucuuaaaaauuugagaaauaauuagaacuguguuaguauauggacccgcucagguagagcaagaaugugaucuaugagcacagauuaagcuaagcacucuugcuggcaguaguguguugcuucuccuaagguugacauguccucucaaccacuguaugugacauauucauucacauguggaugugguuuuguuucucaucuguguauacaaaucguaacaggaaauuggugauguuuuuauugaacucaguacacaguugcuauuuuuuacuuccuugccaucuauaauaggauccaaugcccucuucuggugugucugaagacagcuacaguguacucauauacaugaaauaaauaaaucuuaaaaaaaaaaagguaaaaagcaccagaaaugucucaaaaggaggggaagugugcugugauacagguggcguugugagagaccugaauuuuaacagcagcuugcaaucaauagcuauuugaguuaagcuguugcuuuuuaaaugcauuuuauguguaugccuguuuugacugcauggauguauguguauguacaccacauuugagccugcugcccuuggaaguuagaagucuugggguccucaggaauuaaaguuauggaugguugugaacuguguguaaguacugagaacagaucuacguccucugaaagaacaaaugccuuaaccacuaagccaucuaucucuucagccacaaguucguauccguauaaaaugaggaugauaaaaguuacuccacauucuauauagaaauaugauaacuuaguaucuaguacccaaucuauacauucucuuucccuuuuucuuuuauaguaauuuuugaaucuugugauauuguguucuuuucaauguuuuuauccuacagaaaauaauuuucaauaaauuuuucuuuacuuaaaaaguccacuacuaaaauauuaaauuugcauugcaugagaacaucugcaaauagauuacacauaugaaaguucugaaguaaugcaaaguacaaauucuguuuuuguagguaaauuuaaaaauuuccauuucuugguucuacagcauaucaaaucacugaugaaguaagaaauaagauuucauaaauagugcaaugcaguauaauuuuuuauuauguugugugugugugugugugugugugugugcgcgcgcgcgcgcgcgcguaugugcaugcaaacaugagggucagcguacaaccugugggagugguucucugccucagucauguauguggguucuggaaagcaaacucagucagacuuggcaauaagugccuucauccaaaaagccaucacacugccccgagaacagagaauuuuauaguaaccauuaucaucuaaucuuaaugaauuuuuguuuguuuuguuuuuugacacagaauuucucuguguagcucuggcuguccuggaauucaaucuguagaccaggcuggccucaaacucagagaucuuccugucucugcauccggagugcugggauuaaaggugugcgccaccacugccagguuuuaguuagguuuuaauuacuuucugaugccaagcaaaccuaaagaggcuuuuaacaagccucauguccacagcuagcuuccuauuucagaugcaguuuaaaagauggcuuguuuuaagccaggugcggugguuuucacuuguaaucugaguacuaggaaggcagccaggagcuucugcugaagguucgaggucagccucaaccacauugugguuccagaauauagcuguagucaaaucaagcugucuauaaauaaauaauaaauaaauaaucuccaaaccaaaguguacuuauuaacacguuaauuguacauauuaacauaaucccuguucguacagcucucguugauuacauccacuuuucuuccaccuuugucucccucugcugugcauugugcccggccaucgugaucccugccuaccacuuauuucaguauuucaaagacuguuguacuuuguauuuaagguugguuuuuuguuuguuuuguuuuguuuucuguuuuagcagucaagaugaccuuauuucagcuucuacgugagcacuggguucauauacuugucccugcgggauuugucuuuggauguuaucuagacagaaaggaugaugaaaagcuaacugccuucaggaauaagagcaugcuauuucaaagguuaguucaugcaccuuuggggaguucugucucuuuuguuccaaacaaagaaguggguuuuuuuccuacucuaaugguuaacagucaagugauacuucagguuuguuauuuaaucguuggaugaaacuaugauuaccucuguagugcaaacaauuuuuaguuuaugaucuagccauuucagaucuuugaaaguuucauuuuuuucuuuuauuaauuuucaccuaauauauaaaaaugacuuuaaaauuauuugugugugugucacauguuguaugugggugcccuuaucggccagaagaggggaucagauccacuggagcuguagcuacagauaguuaugagccuccccaguguggaugucaucugagagcucucaugacuacugagccauuuuccugcacccucauggccucuucguacaugcgcauauuuguacuuuucauucccugucacuggcucccuuccucuccaaauagagucucuucuguuucaugucacauauauuuacaucuagauccugcauaugacagaagacacacaaucuuuugucuguuuuuaaaauuacccuuuauugcugcccauuuccuugaggccuccccuugucgugcucccuucuagaaagucagacauuuuaaaacuuaaagaguguauuuuagcguagaaacaaaauucaagccagcuaccccaagccuaucauacucacuuccauauauguuccucuuuacugauuugaugcagcugaaauaaacaaugugcuucacauauggugacugagugguaauacccaccagcuugccugagccuaacauggcuaagaagacagauaguguagccaucugccaguugguauagcugccuaugcucaagggauaugaagacugaguagcguccaggucacuaugcagguguguaguucacaguccaguauuucagcaaagaugaaagaagcuguaaaggaccuagagaccauuauuaaguccaggcagaagaacagagcugucacauaaaccaagaaauuacaguucuuuaaacugggaaagacagacaguaaaaguuugagaguagaaugcauggauaugaugaaucuaagguaagaccuagucaauuugauagaauauaaacaaauauaaacuucaggcccuuuaauaauuuuuauuuacuugggggcuuagagauggcuuagugauuaaaagcauuugcugcucuuaaagaggaccuagguuugguucccaguacccacauaaaguuuauuuacuguuuuuucuuauuucuuuucacacagggaacugaggcccaaugaagaaguuacuuggaaguaaaaaaugguuaaaucacagaauguucacauuauaaaaguuauuggagaaauaaaaacauuuacuauuuaauuagaagaauuuaaag

SEQ ID NO: 6791 - RNA, 45734 nt, Mus musculus
ugguuuccuuauacgccacacuccgaggcugcacaaaucaggcugcgcagguagcccgggcucagcgaucuguguugccgcagcucaaucacagcggggcggacucuagagguggcugcucugagucugcgcgacgcccggaauucccacgguucugcagucaccgcggcgaucacccgcccagguaaucggggaccccggggaggacccgcgccccaugagaggugacuuagcgguuuuuggcuaggcuuuccaucccucgacccuuucugaguaauauuucccuucugaaagcuccuagccggagacuuguuugugucgcgagugugcuuugcuggaacggcggguugcccuggagggcgaaacugaggcaggaggaggagucgguuuacuaagguuucacagccaggcagcucuuggcagagucccggguuuguuguugauguuuuuaacuugaaucaguacaccaguagacaggggcgauucccgaucugaacaaaaacaccccgacaggaauaccccaaauauuccuggcgagagcuaguggguuucagggaggcucacaugcuccuugauagugaaagcuagccuuuguggucccuggccccauaggguuaggauuauuuuguguuaaguacaguagacccuaagggcuggaggauggaaugucugucacgugguccauuuuauagaugaaaaugaguggucaggauuugaaacucgcccuguggucuacagcuguaugcccuauggaauauucuuuacucugggucugcaaaccaaauauuuauugggcuggaguaaguaagguaagcuuuucuuugcuuugagacagccuccucaaacucaacauguagccaugagguugguuuuugaauucagcgacccuccugccucagcuuucugaaggccagaauuacaggguuggggcaccaugcuguguucuuugcaaagauuuuugagacgaauuuauuuuguuggggguagagauaguccuuuguguacagagacaacacccaaaccucauuugggaggaacuaggacuugguguggaggggagaggggugaaguuggagccauggagauagggaguggcuagugggucggaggaggggugugcauuaccuggagaacagcaaggugaaguugugaacagcguuuuuuggaccugggauuguggagccuguuuggauuaagggauuacauguguggagugaauugaugcaggaggaugucacguguaucucaaaugcccuuuagugggguggggaauuuagguguuguccugaauacccagugagcugcuuuuaguguagauuucucuuuaccuuaucggguuuguaggguagaaaguguuagaggaggucacacugaagaccagaagggcaccacagucacccccaggggaguuagagcagugguaggaagagagagacuacaccaugcccaagacacuguuuauugauggggacacauucuuggacauaugugucaguaggcgauguugcuauguguaugcuguguguguggggcuuucacaggaaccuggaugguguagggcacucacuguggggcugcuagguacgaucagagaugguacagugugcaggagaagagcgaggcugcggccugcagagcguuuucuauuuauaguaacugggaggacucucuggagccacacacaaaccaguggagggucauguccugcacauaauuaugaggcuggcagcacaguggcuuguuguccccagcauugcuagggacacaugaguaaagcauugggugacagcauugugacagcuccagggauaguagugaugggacauucuggcucuugcucuucugggcccaccauuguguaugugaugugaaugcuguuaacccagaaaacccaaacaaaacaaaacaaaacuaaacaaaacaaaacuaaacuaaacaaaacuaaacaaaacuaaacaaagcaaaacaugucccacuucacaguguugaaguaaaaacucugcuucuggaauuuuccugugacucuuuuggagaaaugcucauuguuguuccuguuauuauuguugcuguuauuauuauacuuauuuuuuuuugagacauggucucuacguaauccugguuguccuguaacucacuauauagaccaggcuugacucagcucacagaaauaggcuugccucugccuccugaguguugggauuaagguguguaccauaugaggccccauuuuuuguuguuguuuguuuguuuguguuuuuaugagauaggcuuuuacucuagcccagacugaccuugaauuugcuguaacucuccucccucagccuccugaaugcugggaguuuagauugugccaaaaacacuuggcuccagcauuaugauuuuuuuucugaauuguuuuacuauuugugugugugugugugugugugugugugugugugugccuguguuccagcacguguauacacccuauugcacaagccccuuggcccaaguguggagaggagaggaaagcuagccccaggcuagcugguucucagguaucggaaugacacugaaugauucucccgucuccugucuuccggucgaugugcugagacugcagaugcugauucaguuuuuuuuuuuuuuuucacuuggcuucugggaaucagcucgucagacuuucuaggccaguuccuuuaaccacuggaucaucucuauggcccuccgguguuauuuuuuaaaccgcagaaaguugcuuaguggaucaaaguucgaaucucaguuuaugaugaaguugugacgagcauugaggauguuggaaacugaaggauuaugugaacaugugaugaggcucacugauuuuuuuuuaccccccccccccaaaaaaaaaaaaacaaccucauaguuagauacucaaauucgggaaugaaaguuugaugcugucagaugaaaagauagaagaaguuuguauugcuucuugccguagaccaaugguucucaaccugugggucucaaucccuuuggggguugcauaucggauauccugcauaucagaaguuuacauuacaauucauaacaauagcaagauuacagugaugaaguagcaaagaaauaauuuuacagucugggaucaucacaauaugggggacuguauuaggaaggcugagagccucugccuuagaacaaaguagccgcuugcaaaagggugaauuaaaaaaacccaguguccuagcacuggagagacagagagucugugaguucaaggccagccuggucuacauagauuuccaggacauucggggauagguagagagagcuugucuccaaaaaaccaaacaccuucucccaccaugcaguucuugggaauaccauagauauuuguguauaaagagagauuuguugcaguguuugugaguugcuuauaguggaauaccaggacagccagggcuauacagagaaacccugucucaaaaaaccaaaaagaaaacccacaaaaaaccaaaccaaaaccaaaacaaaaacuagaaacagccuagcacucuugagaggaaucaaguguugauuggaugucuguagaucuauuuaagaguauaauaaauuaauuggaaagaaaugcuaauuuagaauacuguauuguggguggcuaagaaugggacugccaggcagagauuccaucuguaauguuuuguggguguuguggaagaugaagcucuaauauuguagcaagauauuaacagcugguaguuuaguaauccugaaggugacugggacagagcgguuauguuuacaucacaucuuuuugcuuuuuaagacaggguuucccuguguaaccuugccuguccuggaauucacucuguagaucaggcuggccucaaacucacagagaucccccugccucugccuucuaagugcugggauuaaaggugugaaccacuaccaccuggcuuuuuuuuuuuuuuuuuuuuuuuuuucuuuuuucuucaggacacagucucacuauguagcucugacuguccuggaacucacuguguagaccaggcugguuuugaacucauauauuggccugccugcuuccagagugcuaggacuaaagguguccacccaugggccuuaaauuucuugaaguuuaaaaaaaaaaaaaagguacaguaacuucagugccagccuggugauaccugccuuuaaucccaguacucuagaggcaggcaggccauucucugauuuugaggccagcccggacuacauugugaguuccaggauagccacagcuaugacuauguugacaggccuaaaaucaaaccaaaucaaaauccaacaagagccuaacgucaaggccaggugugauagcacacaccuuuaguuuuagugcucagaaagaggcugguggauauuuuugaguucaggccagucaggguuuucuuuuuuaaaaaagucuaacuucagaauuaacauagauagucauuuuuggaaaaagaccacagacuuaauggaaccaaguuucaaaaaauaauaaccuugguuuaaaauaauucaaauuugaaauaggcaucaaaaauacaaauauugagaagcugucagccuucugcuagacauuguguuauuagaugccugaggccuccuaccaacaguuuugauucuguuugcuuauguuagaugcuuguaguuucugugaugguaaaagauacguuguuuuguuuuuuugguuuuugguuuuuggauuuugguuuuucaugacaagguuucucuguguagcucuggcugucauggaacucacauuguagagcaggcuggccuagaacucagaaaucuagaaaucugccuguuucugcccgcccccccccccccccccagugcugggguuaaaggcgugugcuaccacgcccggcuguuuuuguuuuuuuuuuaaaggugacguuaucacuguauacaucuuaaaaaugagcauguguuaagaguuuugcuuaauuauugauaaaauuuauugguguuacaacuaguucaaagaguacuccaauguacagccaugucuguagucuguagacuggagauauuggggugugauauguggguggggguggauugggggcaaaagaaagucuguguagccaccuuugaugguuuguauaugcuuggcccagggaguggcauuaggaggaguggcccuguuggaguagguuugucacagugggugugggcuuugauaccguuggacuaacugccuggaaaccaguguucuccuagcagccuucagaugaagauguagaacucucaucucuucuugcaccaugccagccuggaccauaccaugcuccugccuugaugauaaaccuguaauccagccacaaguaaaguuuguccuaauaagcguugccuuggucauggugucuguucacagcagaaaagcccuaauuaagacaccacccuuuguuagaaucauuugcaugucuacacguguuauuugcauaacucuuauccacaggaaauagguagacagaaauuauggaacgauaacucuguggcccuagaaagguuaugcacucuauagucuagaacuggcucauugcccaucucaucaucucuugcugauaagcucaucuggugagacauuuucauuugagauaggauuuaguuaccuuugucuucagcaggaaagccaaaagacaugagacugagaacuucauacuguaguccugcuagaaugggagcgguggccccugugucacagaggagccuauuuuacagggagauuaaggccgagaaugaagcucagacauagagcauugccuagcacuugggagacccucgguuuaaucccuaacaccucaaaucauguggcaaacauuggcuagcacuuggggagguggggcaggagguucugggauucuuuugcaugcacuugaggaggggggcaguagggagggugauucaagauagggcuucucucucuguauagcccugacuguccuggaacucacucuguagaccaagcuggccucgaacucugccuagccuccggaauacuggcuaaggaucuggaauucuaagucauucuuagcuagguagucacuuugaggccagccugggcuaccugagacugucucaaaauacagcagaauacaauccauuaauauaaaacagaaagcuaacacagcaaaagaaaauucgauuaaggaaagagccuuagcuggccagaaguaguuaugcacaccuagaauccuaguaguuuggaguuggagcagguggauugugaguuccaggucagucugcuauauaacgagacccugugucaacaaagcaauaagacaagaggccaguccauaccacgucuuuguuccucugacacguuguuagcugguuacaggaugccuuuacuuuuaaccuccaaagaacagaguaugaugaagacuugccuguuuggaaaguucuucagugauguugucaucuaaauaacuagcuucuugguguggcuuuggcuugcugcaccugacccagugguagcuggcaaugagaggucggucucaccuguggugauggaggugucauaccuggcuuugaacuugacugggugacuuuagauggccccaugaccuugccucuguuacuuauaugcuuuguggugacaguuuagaaugucccuuuugucccacugucccugguugaauuaagcccauuugaugaucuuuuucucugaugucaagugaaguccuuacguugaucuucuggccuaccuuguagaugaacagugucaagguggcaauggcaaacgauaggacgaaccuuuggcaauuggggaaguucaugagguuugucaugugacuuagggagugugguuaaaggucuccaugauaggggcacagaagagcucccgcuaguaccuugagcuagcaugugagaggggucauggguguccugggggaaggacugaagauccacucuguguuuggaccccaaacuggaauugucagcgucuggucaugggacccaccaggauuucccaggaguggucuaggugauguagugugacaggcacagcccgcucagccagauucaugucacuggucugcaaguuucaccccuucucccagucuugguuuccucccugucugcagggagcgauguuguguucccaggggucgucugugaacucaucagcugugaggaugagugaguaaagggaucugucugcuacuccugccuagcaguacugagacaacguguaugagaggaacgaaagguaaaucagauaccgugaggaguacggccaagggcuggguuuguauggcugcugcagggcuggccaaucgaggcagcggcuaagugaggcggcuagacuggcugugucuguuuugcugcucgcagucagguuggacauuguuuccagaauagucaucugggcauccuugggacggcuuccaauugcucaaguccuuuaagggaaaccgcauuguuugcauagagccuaggcuuacccuccuguaacuuguaagcccucguuggaugacuugaauaccucgaauuuuuacaggugcuaaguuaguugucauccugcugugcucuggaguagugccaagaacaaaaaauucagcauagaugcaacccccaugcgcaugcguacccauauucaugugaaugcaggugccuguggaggucaugaggcaacuucugguguuuauccuucccauuugauuaagacagagucucuguaguucacugcugaauaggccaggguaucuaucuacccaugagcuucugcagguucucuucuuucuccccucucacuguaggagugcagggauuacaggugagcucgaccacacccaugggguuugacaguggguccugcugauucaaacucagguccuccuguauguguggcaagagauugucccugagcugccuccccaaccccugaaguguuuuugauccaagcuugguaaaaucuguggcucuggaaacguugaaccuugaaagccauguguuauuaauuucucuucccccuaaauaugaggagaaagaucacauaucaaugccaccuauaggaugagucacucaaaugucacucaaaccaaacucagcagagacugauguauaaaccaggaaccaguuuguugauuuuuuuguuuuuguuuuuguuuuuuguuuauuauuagguauuuuccucauuuacauuuccaaugcuaucccaacagucccccauauccuccccccgacucccccccccccccaacuuccacuuuuuggcucuggcauuccccuguacuggggcauauaaaguuugcaaguccaaugggccucucuuuccagugauggcugacuaggccaucuuuugauacauaugcagcuagagucaagagcuccgggguacugguuaguucauaauguuguuccaccuauaggguugcagaucccuuuagcuccuuggguauuuucucuaguuccuccauugggggcccugugauccauccaauagcugacugugagcauccacuuauguguuugcuaggccccggcguagccucacuagagacagcuauaucaggguccuaucagcaaaaucuugcuagugugugcaaugcaguuuguugauuuuaaugggagauuauuacagcuauucaagaugcccuugggaccuggagcugguucuguuuccuaagggcaaagucuauaaucuggcccacaggucaaacuugucacguauuguuguuguuuguuuauuuguuuuuaauagauaaaguuuauucuaacagccauauucauuuauuuccauauugucuguggcugcuuucaugauacauuggcagggucgaaugacaauguuggagauggccugggcugcaaagucaaaaauauuuacuguuuggccuuuauagaaaaacauugcugggggcuggugagguggcucagcggguaagaacacugacugcucuucugcagguccugaguucaaaucccagcaaccacaugguggcucacaaacacccguaauaagaucugacacuucuggcaugucagaagaccaauacacuguacuuauguauaauaauaaaucuuugggcuggaaccagcagagguccuaaaaauucaauucccaacaaccacaugaaggcuccaaccaucuguacagcuacaguguacucacguacauaaaaugaauaaauaaauaaaucuuuaaaaaaagaaaaaagagaaacauugcugacuggauuuuggggaguucuuucaggcaggugaaugugugcagggugaugaagcccucuggggguuaugugcaccuucugguagggcucauggagagcucuggggacauuuguuucuguucuugcuugcccugugucugaauaggccucaugggggcccuaaucaggccuuugggacuguggaggagucuccggggugcauaucaacagaucagcaggcccuugcauugaaacuaccucggcagcucacuaaccucagcuguuauauaucauacuuccccacacccuggugaccgaccgcagaucugugagcauuuacuauaguuauuccugcaggacuguugcaguaaaacaaaagaaaugggaauucaagcuggguaugguggcaagugaugcaaucucaacacucaggauacuaaaguaugaggugggguggggugagggagaggaggaggaggaggaaggggaagaagaagaggaaaaggaggaggaggagggagagaggaggaaggggaagaagaggaggaagaggaagaagaggaggaagaggaggaggaagaggaagaagagggggaggaggaaaaaggaaccuuaauuugcacugacugaggauuugauucuugaguuugagacauuugcaauggccaagcagcucaaucccagcagccaggaugcugggcuuagggccaaggaggaugggagcccauaagacuuaugcugacaucucugcauccaaguguagucugagcagcaucuuuguacccaggagugcuuuagagaugcagucuguaccuaaggagagccucaugugaccagaugcaugauguagccucauuggagacaucagcuuaggugcccuggcuucuuucccgucucccucucacugcaggguuaggccagaggaugggguucuguuaggagcggguguggcggcagucccaaaggcgccagggacuguagcuaagucguaugacuugcaccugacuuccucauauaagccacaaacaucuugagagcugcgcaggugcaccaggauaccggugaauccaguuugauggagauuugccccugcugcccugauuagcugaagccucgugacuggcgagggggcauggccugcagugcguggaugagagagaguauaaaaggagugagaggcccaggguucgggggagauauauaaacaagggagauauaaaaacaagggagauauaaacaggggagauauaaacaagggagauauauggagaaagaagaaacaggacugaauaaaugugugcagaaggauccuguagcagcgucguucuuccuggccaguugagcgcgcgcaacaaguggugccaaaacccgggaaaagaaacaucuucaggcaugagugaagacccccugcuacagggaggauucagaacugcaucacggggaaggagugguuaauaaaaguucccguaaaacagacuguugagaaggaucuggcguggauucagaacucuucagcugggggaacgguacugaugaagagaaagaagaaagaugaagacugaauaaacugcuguuagaaggacugguggucgugucguucuugcuggucgagagcaggcgcgacaauugguggcccguacggggaaccgacucccccaccaaguucagaacuuucagcagucagugguugcuggcaggguaaguucacggugagugaaacuugcgaccccaggaguuugggaaggaccucggauaaaauagaggugagcauaaaguugccaggaaguaggcacaaaguaacccaggaguuugggaaggaccucggauaaaauagaggcaagcauaaaguugccaggaagcaggcacaagguaacgaaagguucccggcuuugggacaaguuaagauucccgguuuggggacaaguuaaggaacuaugauaaccucgguguagugaucaauagauccucgcuguguaguuaugcuuuuuucucccauugacccuuuguggguaggucugauaguuuuggucuuguuuguucugauauauggacucuguuacuguuugaaucaagaggcagucaagacaggucagaaaauccuuauagagcaacaagaaaguaugucggaaaaggagaagggcuuaaaaagaaaaaggaaaaagaaagaagacacaguaaaaucaggugaacagaaaggacaaaacaaaagagcugaggcggaggaggaaggcgaauuagcuucuauuccuccucccuaugccuccucagcauccaccaguagguggaccuucuguccggagauuuggagaggaucgaccagaucagguguugaugugggcgagagggucuguuuguguguuuccacaggaccagacggaaccucuuugggugcuggagagguuggugagacgcugcaagaaugaggcuccugauccaguugccccuguggaugugguggauauucccacaagcacaaacaauggagccgagaugagagauccuuucgguauuccagaagccgauaccagcucgacaugacauucaaauuuuuccacgcuuuuugaucccugaauuccccuuaaagagauagccccucuggcuaucuaucccuugcuuuagggaagaugagcgggggugagagcccugggauguaugcuuguuauaguguguguguguguguuuuguguugggcacauguguuaggugcagagugugcaggcccgcacuuucaccaugguagcguaggcuuuugcugcaguggaggcgggacaaucuccucagauucgguuugccgcucuaaaagaaauuaugcugcguuaugccguggggugcgaggcuaagcacugcacagaggauagcuugcuguuggcauccuguggaaggcacaucugauugcaugaagguucaguguccuaguucccuucccccaggaaaaacgacacgggaccuggccaagaccucucugggugaugagccuaagggaugguuuuguguagggccccuaugcuugcacacuggggaucagaccucuaccuucacccaugaggcuugcuugcagcaauuuagaucuggccauagguuaauuaacauccuggccuuuugaugcaccugccacaagcaaaacacaaucuccccagguguggcuuggcaugauagagagguagucagugauaagacucccugggcaugucaccaaccuaagacagggaucaaaccaaugcuguuugucacccaaggacggguaaggggcauggcugcggggggcuaucuacagacauucucucugccagaaaagaaaaaagggggagauguuaggagcggguguggcggcagucccaaaggcgccagggacuguagcuaagucguaugacuugcaccugacuuccucauauaagccacaaacaucuugagagcugcgcaggugcaccaggauaccggugaauccaguuugauggagauuugccccugcugcccugauuagcugaagccucgugacuggcgagggggcauggccugcagugcguggaugagagagaguauaaaaggagugagaggcccaggguucgggggagauauauaaacaagggagauauaaaaacaagggagauauaaacaggggagauauaaacaagggagauauauggagaaagaagaaacaggacugaauaaaugugugcagaaggauccuguagcagcgucguucuuccuggccaguugagcgcgcgcaacaaguggugccaaaacccgggaaaagaaacaucuucaggcaugagugaagacccccugcuacagggaggauucagaacugcaucacggggaaggagugguuaauaaaaguucccguaaaacagacuguugagaaggaucuggcguggauucagaacucuucagcuggggaacgguacugaugaagagaaagaagaaagaugaagacugaauaaacugcuguuagaaggacugguggucgugucguucuugcuggucgagagcaggcgcgacaggguuccucaucuuagagauagaccaugccuuagcugcuguuuguuuucaugggagcagaagccgggcagagccagcccuacagccuccuuccugcugaguccucaguaccucuuaucacagggucacaggccugggugagucauuucagaacaccagagccugggugagucauuucagaacaccagagucaggacacagggagaggcuaaugacacaguuuaugguggccagcauauggccuugugugguagagaggguuuucaagguuugacauuagcaggcuugcgggcacaugccugcagccccggguacuuuggaagcugaggcgggaagauugcuugccagguguuggaggcaagccugggaaacacauuucaagacauuugucucaaaacaaacaaaacaaguuuugacauuaaaguauaauacgggcuggguacuuccuuaagcauaaaguugccggacagugauggcacgcaccuuuaaucccagcacuugggaggcagaggcaggcggauuucugaguuccaggccagccuggucuacagagugaguuccaggacagccagggcuacacagagaaacccugucuugggggggggggggaagcauaaagucuugagauguggaacuaugggggcagaaacuaauaggcuaggaauccagaauacacagggccggucuuuggccaagaauaagucaccagaaacaauggauuugucacuucauaccuucgucugcccuuccucccuuuuuuucuucucuuuuuuagauuuauuuauuuuuuauuuaauguaugugaguacacggcucuccucagacacaccagaagagggcaucagaucccauuacagaugguugugaaccaccacaugguugcugggaauugaacucaggaccucuggaagaacagucagugcucuuaaccucugagcuaucucuccagccccucuuuuuuuuuuuuuuaaagaugaaauauuauuuguuuguuuuggguuuuugagacaggguuucucuguguagccuuggcuguccuggaacucugcuccuuagaccuggcuggccuuuacucauagagaucugccugcuucugcuuucuaagugcugggauuaagggugugcaccaccacugcuuggugaaauauuuauuuuuauuauuagguauguauguguguauguguguauguguguguggggggggguuaugugcacaugagugcagugccuguggagcuuggaccccacccccuuccagcuggauagcauuaagggcgguugagagccacccaauauggauucugggaacugggcucaggcccucuguaagagcaguaccuacucuuaaccuuccuccuucuuaaaacacaugaaaguguuugcuccaccugguacacagacacgugcacuugguaagugccagacaaagacaggaaguaaaguuugacuauagcuuauccagguggcucacacuaaggcuuaaauugccaucucuauuggugacacagaaacacggcucucacugcguggagaauaugauuuuauucuggagccaaauaugaaugacauggcccagggaacacauacaaaagugguugcaugugguuuucauuagggacaaaguaaaaaagcguccuaaaucagaguauuuuccuuuguagugguagugggaaccauagacagcaaagagggcaucgcuguuauuggcucagaugcuaacugaugucauucuuggcuuuuggauuggugaacuguaguaguuugcuaagggcuacauuguaagguuuggauagucacaaggaugcuaagggcuacauuguaagguuuggauagucacaggauguuagauuagacacagggaagaacaaugaauggcuuucaaagggcuaaaaauaucucagguauuugacuguagucugcaacauuuuaacuccauaaucucgaagccagaagcccaaucuuccuucggccuuguagaaucuuuaacucuucccccuccccccuuucccucccuccucucccugugccccuucuggggaacuugaguuuacacucuuguuaauauuuuaaguucuuguuaagugaauauuuacacuuauacuauaaguaauuggaacuggugagauagcucaguggaugaagauacuuacugcuaagucagccaacuugaguguaaaguggaaggagagaaccaacucccuaaaguugcccccuguguggcaguacauaccccaccugcuaugaauaacuuuaaaaauguaaguacaggcuaggaagauggcucaguggauaagagcucuggcugcucuucuagagguucugaguucaauucucagcaaccacaugguggcucacaaccaucuaaaacaguaucugaugcccucuuuugcaugcaggcauacauguagacagagcacucauacauaaauaaauauguuuuuaaaaauauaaaagaaauguaaauacauuuuacaguaauaaguauuuauuauaauaaaaaggggcaguuuaggagauuguucugaucuauccauuacccaacaaaaaaacuccuguuuuauuuauaugucugcuuuguacauuuucccacaaacaacuaggaauguguguucuugcacaaauaguucagggauuggugggaugcuaucugcauucugaguugaaaaguucuaaguguuuucugacuuuugguuggcaguuagguaggguuaggagguagggacaggacugcccacccccagcagugaccaaaggucuuagaggcuuuuuuuuuuuuuuuuuuuuuuugucuuuuuaucucaguuguuauccucagcacauuccucugggcugauuggccaauccucuugagaccaggugauguucucgacccuuuuuaaauugacucugucuuuccuuucagucuucuguagcggacacggggugcagaaugaccuggagaguggcugugcuucucagccuggugcugggugcuggugccguucccgucgguguggacgaucccgaggauggaggcaagcacuggguggugauuguggcgggcuccaauggcugguauaauuaccgacaccagguaagaaacccaugcguucuugucacuggcuuugugccuacaaaauggccauuccauuuuggaagacaguuuugcuuuagucucaagugggauuuccucaccuuuccccaguggcggccuuuagaaccaggcauuaaucccuuuuugggucugcacuguaucacuugccugccugucacaacucaaaaaucaaaaugcauuuagauaucaccgcauaucuugggggcucaagauuaccaggugagagcucuuguguuaacaccuucccuucauguuauagaaaggacacgcaggucuagagagaggaggugauuuaacugagaccauugacaagaggcgagcaguguggaagcucuggggaacggacuccuggccccucuguccuccaugccucugucccuuuacaccaccuccucccuccugguguuuccugcaaaucagcuuguggaagugagagagaagggcauaguugacaguccagccuccugcugggaggaaggggguagccuuggggaagcaucaguccuguggaaguuggaacagcaaaucuugcaauccaaagaucccaccccaagguguggcccccaaaaggaaugaaaacaugccucuguaaaaucuccugccgguaucagccucaggagcaugauuuggccacggaaaggauggagcaauuacgugugcuucauuauggacaaaccguaagcacgugcuaaguaaaagaagccagucacaaagaccaaacaguuaauaauccacuaaauggcacuucagauuaggaaagucuacagggaagugggggcugggcagaggagagucagaggaguugacugcucguggaauuagauccuguuguggguagugagaauguucuagaauuagaaaguggucgugguuuugcggagcacuguauuuaaaaggcugacauccaugugaaugguaacacugucauuuaaaaaguugauuuagccgugcaugguggcacacacuuuuagucccagcacuuggaggcagagucaggcagaucucugaguuugaugccagccuggucuauggaacagagcuagcuaaaagguugauuuuucaugccagguaccuagauuaucacaggaucauauugcaggcucuccuuagagcauugagagccuuuacuccuuaccacugggcaguguggagcuggaccuguucuuaccucucuuuaucuaccagcacuuggauggaggucuggggaggccagcaguuugcccagugugguggagcuguaagcagcacaaggagggggugggguaggauccagacccagccagcuggcuugagagccaccuaauccaguaagagcagcgugagucauggaaacguuucuagcagccacauuugaaaaagcuuaaaauauguaggaggggccacggagagagagucuguucaguuaaaugcccgcugcgcacgaggaccugaggucaacuccuaggaaaacaccaaggaacaaugcugucugcuggaaucccaguucuguauauggagguggaaauagcuggcucccuggacucccuggccagccagccuagucuaccugauaagcuccaggccaguaagagaccaucucgaagguggaguauugggggccaggcuggagaaggagggaggccagugguuaacagcacuugcuauucuuuuggaggaccuggguuugggucucagcuuccauaucaagcagcucauagccuccucuaacuccagcuccaggggaccugaugcccacucgggacuugggaaacugcaugcacacaugcagacauacauauacacaaacaagaauaaaguggcuagcaccugucuuagccacuguucuguugcugugaagagacacgaucaaagcaacucuuauaaaagaaagcauuuaauuggggacuucuuauguauauuuucuggguauaauuucagaggguuaguucuuuauugugucaggcagcguggucuggaugcagcagguagagaguugcugggccuggugugggcuuuugaaaccuggaagcccaccccuagugacacacauauuccaaguaggccauauccccuaaucuguccaauuaggucaccaacugggaaccaggcuugcaaauauacgagacggaugggggccauucucauguaaaccuccacagcacccaaggagcagacaccccagauuguucuuuugccuccacauucacacacacacacacacacacacaccuauacacaauauaaacacauacaugcaccuauacacaauauaaacacacacacauuuacaaacaauaauacacacccuuauacacaaaauaaacacacacacccuuauauacaauauaaacacacacuuacacacaacauaaacacauacacaucccuauacacaauguaagcacacauacacacuuaucuacaguauaaacacauaccuaaucacaaauguauaaacacagaaaaauauuuaggaaauuaauuuugacaucuuguuuaaaccagaaguccaaaugaauaucaauucaucauguaauuaauaucgaaauuaccacugagauagccuguauccuuuaacaaaaaguuucauuacauuuauuuauguaugcaugaauguguguauguguguggguacaagccuauuacgacacguguguugaggucagaugauaaacuuggcagguguugauucucucaaucugccaugugggucucaggggucaaucucagguugucagacuuggcagcaaguaccuuuaucaguagagccaccuugcuggccccuauauccuuuuuaguauguacaugaucccagggugugucaguuuagauuauccacgaugcauguuguuuggcugcugaacagccagugaccagcuguugggagguuggcacaaauggagcugugucccugugagugucggggugcuuggcuuccauaucaucaaggguuggcuuuggugaaguucugacucaucuugaguggccucugugugcugguccagaaaggaaauuuagcccgauuaagagcuguuaucauaacugauugcuuuuccuuugagugaaaagauaaguuaagccccgagaccacaggcagcaaguaugcuggcucaucagccacuugguuuuuauacaaccaacguaggaaaauacaguggcuaaacauuaccuggagguuaaaucauucacggacucucccuugauccugugcagguuuuaacuggauguauuuauaggggcaugagguucuuuaggacugauagauuuggcaggccucaaacccaagauauccucccgccucugcugagacuaaagcugugcgagcgccaccaggcccggcaucuccucaguguuuuaaauagcaaguguggagaguccuaggauggccaguuaaacucaggccauuugacucaaacccauguuuucaguuuugagguccugucuccagacaaguacugguuguuacgaaaugguuauuaccacagcuccagguuuuuagggucacggggcaugcaaauaacgagggaaggaccaccaaagucagaaauaaacuaaaagcaacuuuauucacugugaggggguuggugguggcuggcgcuucuaauggauaggaucuuggucagucuagggagaugacacaaugaccuugaaagggugcgagcagucuccuuugaagcauaaauccaugggcaggggauaauaaaggaguuuguaugcugaggguuaguucugcagcccaggauguggugaauagcaggacggugguacaggcucaaugccaggggccagccucagcuuggucugggugucugagaguggcaaaaacaaaagacucaagucaaauccuguguccaagcuggcggccuauguucugcuccagauggcugccuagauagcucucuguagacaguucuuggcuuuguagucugcucaagacagcuuuucagaccccccucccucugugugugugucucucucucucucucucugugugugugugugugugagagagagagagagagagagagagaucugcucuagauagcuuuuucuucuauucuaaaaaacucugguugagacagcuaaguuucugcuugagacagcuuucucucugcuaguaaaaauucuaaaagcucucuggauagcugauaggucuucugaucaagucaaaaauccuguuagaaaaauucuaaaaguaauucuuucuaaucaaagucagaaagccagaaaaaaaaaucauaaagagcugggguugcucuucagaaagccuucuuuggauaggugcuagacagcauucuacaagagcugugucagcucucuaguaauucuugggauuucagaaauccugucagaaaaaauucuaaaagagcugaguuugcucuucauggauuuucuugacuaaaaucagcaauccuguuagaaaaaaaaaaaauucuugaagagagcuguguuugcucuccagagaucuucagauagcucagcucuggcaaaaaaaccaaaaccaaaaccaacccccccccccccaucaguuucugccggcucaucucaugcagaccaaagcccacauuuuauuuacauaucaauucaguuauuccagguucccucuugacccucucaugaauaagcauucuaugacucuagccucuugcucuuuuauuguuuguuuguuuguuuugagacaggauuucucugugucacacuggcuguccuggaacucacucuguagaccaggcuggccuugaacucagaaauccaccugccucugccucccaagugcugggauuaaaggggugcgccaccacugcccugcuagccucuugauucuuaagaagagacagcaaacauaagcacagacaguaagaugcugggugggacccugcccgggaaucaccauuuuaaccaugcuuggaccuaaauuuguucugacccaggcugacguugaacucuggaaucuccaugcccuuguaucugccugucuuuguaucuuucuggcaagcuggcucauaguguaauugccucugcuccuuuagaucugugaagcuccuuauacaguucauauugcauccuuacguuuuugcauaguucagaaguuauauauuuuggaacuuaauguuccuuuuccacagccuuaagcgcuguccugaaggucccagcgguuaccauuuggcugagacauuagccacaccuuugccucccagacucaugaugucucugauuagcauggagucauuaauguuaaccgggaggacauuccuccgaggaccgugaaaauaacaaauauuauacaaacaagcccucucucguggagguccaagcuauuccaauagcaggaaccauguuauucugucucuaccaaggccacacuggacccaguccuaucucaaccuuuauggggcccaugcagaccgcgagguuuuaggacaacugaaaaagaauguaaggcuuaagggcuugcaguuccaugggggccgcagacagaugccaggaauuacucugggcccuucacaggugucacauccagacaaaaauucuguagaggagagagagagagagaucaugugugcuagcuauuuauuugccagucucucaggugugagccuuuuccugggagucagugggggccuuggcaucacaugcuuagguuagcaucaguuccuggagaggggaggacucucucggucugacucagagaagcucccagcagauuacgcaagugucacaugguucagagagacugggaugggcaugguggggagagcaugagccgugauaggacaaguuuacaaagccucguuuucuucauguugacugaaccaggcaacugaaauuugauggaggccggugugcuaaugcacuccuuuaaucccauugcucgagaggcagaggcagguggaucucuaugaguuugaggcuagccuagucuacauagugauuuccaggcuaguuggaguuacauagugagacuguguaauacacagauauuuuugguguguguauguacgcauguugguagauacagggucucuuuacauagcucuggcuguccuggaacucacuguagaccaggcuagucucaaacucauagauccacuugccucugcuucccagggcugggauuaaagguguguaccaccaugcuggacuaauaacaguuuucugauagaaaaguugaguuggcuccuauauauuaaucggggcggggcaacccaacccugggaacuccugcuuacucuguccccauucucacacacagggcaccaccauugcugugugccuccaggccagucagcaaacuuuuccaggaagagcuagguaauaaauauuuguauauuuggaguccaggaaggcaaaauggaggcggauggggacaggagcuaggcugcagggagucagggaggcggaauagcaggauguggaagcagcagccagugugggcuggacagucuguccuuuagacagucuccacuuaggcuagugucuugaaguuagucaguuucaaaggugcaaagguccgcugcuugggcuugaaacaaaacauccuuugaagagagcacgacagagagggcuggggagugcuggguggggcugggauggggaugcugggcccaacagugaugaaggugggcguguuuggggguagcuggagugucuguaguguccuaggucuugcucagacccccuauugcuguucccuacuaaaccugcuguguagggggaacaaaugacaucagcucccuuuaaaccucagccucuuccuucggacuugggccaggcacugcagaaccccagcuuagcuccuccccacugcugcacuuggguggaaagagcuugggaagcaggaugcuggggaugcagggugcaggucaggaggggaggagcucacacacuugugagggaagcauucccgguuggaaagccuuucccuguugcuaaauacagagcgccagcuguguuuagccuucuggacaagcucccugucgcaugcuuacagccgguggugaugggugaggcccacuguacaugggacauugugggggagagaugccaguaucaggucacaggauuccucacugagcccggcccacucccagugccagcuuugagaucagcugagucacagcagucucugcucucugcagaggcuguggccugcaucgagguuaugcuuaacucagcaucaccuccuguggccuaucugaagggaaaccauccauugugcuguuuuuacugagcucacuaaacuccacuguauuucauauuaacuccgugcagaccccuuugaaguuacuaauguaugugguggcauccgaguacuucugaggacccugccugcacauagcccccagcuucacuuggaaacgacuggauguagaggugggagcguggggcaggagccuggguuuaaacccugauggaaugagcaucucuccaggacccgagggagcucuggcaugcaccaacacaucucugugccucuuaaagccucuccuugacuaaggcaccauuucugugccauuccaucccauuucagacacacaacucugaguauuuuaguaauuuauguaguugugcaaaccuucccaugaaccagcagcagaacgacaacaucaccccguguacccugggcggucugucuuguuaugucacagaugaacaugucuguguccuugcacagcaucauaauuuuuuuugaauagcaauaaauucacaggugcuacuguagcugguugcccgauaaucccauccacuuugauaaucuggcugaggugacuucagguucuuuuauuccaaucuugacuacugauguuaacuuuuuuuuugacacuggguuucuggcugucuuggaacucuguaggcugccuugaguuuagggacucacuugccucuuuaaucccaagugggauaauaaacccaaagccagcggaaaggaagaagcuguuguuggggccuagggagaggcuccagggacagcugggaguccuuaaugcauaugcuggguaucagaugcugcaugcuacguugcguuggugucugguguggccuucucauagggaccaggcauuaggaacuuggggagguguuauucacauaccacaguugcuguuggaugguucucauuauuuuacagaaaugaagauuuacguaucuucacaguucacacacauacggcuguguuccacaccaggaugaguuggugaagggcagacuucauaaugugacucugguuccguaagaacgauugcuuaggcacgauagcugccuuaguuuauggaaauacuggauagaauuuccaaacaaugcaauucucugugacuguauaggugcugacugaugacaguuuuguuuuguuucuguuuagguuuuuagcccuuugcguucucuuuaggcuucgguaaacuuagugaucucucucucucucugcccuugcaugaggaccaucaagaucuguagucagaaugcuuggccuucugucucugagcuguucucuccacaacugagagaugaggguugugaccuuugacaccugaggacugaagaccaaugagauaaggugccuagcggagcagggcagggcagauugaagguggauacacuugguuucacacuuagcuguccuucugucuggcagcuccugugugcuggcauguagucggagcagauggaugcugaaaacaagucuuugccaucacgcagguccaucugaacacagguccaucugaacgggcaucugcaggcaacaguccggcaugcugggugcuuuaguuucuuacucagagcaugugcugucuggggugcucugugcuguggcugcauauaugacaugaugucagugcuggccauacacacccgucuguauuccuggaaugacacuguuagaaaguuaggcaguguguucccccucugaccuacauugauguucugcagaguguggugugcaucauccgaaacaaggaauaugugguccaagaauugcagcagggaugcuuucuguuccccuugguugccuucuuuuguuucagauuaugacaauagucuuuuguuguuguuguuuuaauauagacaggauuacauguugccuagacugguuucaaacucaguauguagcuaaggacgacuuugaccuucuugccugccuuaaucuccccagaccugguuacaaaugcaaguaagccccaccacacccacuuguguaguggugugcuugaacuccacuuugagcaugccagacaagcacucuaccaacugagcuacauuucuaguaauaacaauauuuuuagcauucuuaauaaaaauaauaacauuauaauauauaacauauaguaauaagauaaaugcuauuauuauuauuauuacugcuaacuauuaucaucauguaaacagcacauuuuucauuuuaauuccugaauugugcuuuguuuuaauuuuuuugagauagcuucaggaacccaggcaggccuuagacuugcuauauggugcagccugcucuugaaugucuguuucuccugcuuauacaggcagaaggcuggggucacaggagugcaucacaagccuggcuccugugaccccaggguuggacuucacuccugugguugaacgaugacuguuagugugucagaagcuguggacccacugcuucauccuucuggggcagucuguuugagaccugaaucugugauuuugcuugaauucagagcuuuguuugugugcucugaaaaaggaaaacaaauuguuuaggacuucaaggacucuuguuaaccuguaggugugagugugaguguguguguguguguguguguguguguguguguauguguaugcguaugcguaacuaugugcaugcacaccgagguauauggauaauaaagguggggaaucuuuaaaaauugaaguuaaaaaaaaaacgaauguuuuaaaaggggaaugaaugaaccccagcgagucuucuuauaagauagaacgugcccccagaugggccuccuccccggugguagcuaaaaagcugauggagucauuccuucuaggcagacgcaugccacgccuaccagaucauccaccggaacgggauuccugacgagcagaucauagugaugauguaugacgacauugccaacucugaagaguaaguggggugcgcuuugaacuuggcugugaauccgaauuuaaaaauacugccacguuaaggcuuucugugcugccuagggcagcggcccaauuugggaacaggaguagcccguggugaaaagccacaggguugucauguauugagcacgcaugucuuagggugcgcuaggugggguggcaggaaagaggagaugagaggagggggugcucugagaggcuggaagcagggccuuccugcuguggagugcugugcccuggaguugggagccuguccuguguguaagcucugagcugaggugccugccuguagaagguucuagucuacaggaagccuuccuuucuagucuuccuuucuggcuuguguuuaauguuauauaugauucucuugaaugcuuucucaaguucucuggaacugagaaugacggguguggcucuaaaccaagaaauuccuggcuccccugcucuucucagaggaacccacccuguagugagaucgcaccugggcucuguuagagucccuccugauaguggcacccgagccuuggauucaguuuugcuuugugucccgcuguuuccugagagcaguguugacgugcccggucuuaccccaagauucucugguuccuuaguagguggcaggacaccuguacuuugguuucucuccuggguuuuaagaacuccauuccugaggcgaccuaagccacagcagcagcggucgccaucuugguccgggacccgccgaacuuaggaaauuagucugaacaggugagagggugcgccagagaaccugagagcgucuggaacaggcggaagcacagaggcgcugaggcagcacccugcgugggccggggacagccggccaccuuccggaccagaggacaggugcccguccggcuggggaggcggccuaagccacagcagcaucggucgccaucuugguccgggacccgccgaacuuaggaaauuagucugaacaggugagagggugcgccagagaaccugacaguuucuggaacaggcggaagcacagaggcgcugaggcagcacccuuugugggccggggacagccagccaccuuccggaccggaggacaggugcccgcccggcuggggaggcggccuaagccacagcagcagcggucgccaucuugguccgggacccgccgaacuuaggaaauuagucugaacaggugagagggugcgccagagaaccugacagcuucuggaacaggcggaagcacagaggcgcugaggcagcacccuuugugggccggggacagccggccaccuuccggaccggaggacaggugcccacccggcuggggaggcggccuaagccacagcagcagcggucgccaucuuggucccgggacuccaaggaacuuaggaauuuagucugcuuaggugagagucuguaccaccugggaacugccaaagcaacacagugucugagaaagguccuguuuugggccaucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccaggggaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuacccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucuaccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagagaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggacccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuagacacaugaaacucaagaaaaaugaagacugaaguguggacacuaugccccuccuuagaagugggaacaaaacacccauggaaggaguuacagaaacaaaguauggagcugagaugaaaggauggaccauguagagacggccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccaguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaagaaaaaaaaaaagaacuccauuccucccagcucccaccgggaacgcgcuuggguucgguucccgagauccgcagcugcccagaccacgugcauuggugccugacuaagcgacaggaagacaggcaguggcuucaagaacagacuugcuauuuguucgcguaauggcgaguuuuggagggagacacauuuuuguguuguaacuuuguccuuuaacuuucagaaacccuaccccagguguugugaucaaccgaccuaacggcacagauguauacaagggaguccugaaggacuacaccggagaggugaggacauucucaccugaagccagcaacuuucauugauauauccccaccccuuauuuaugcuugagaaaugaguggggagagauugucuuggggauacugugcuggggcuggagccagggcuuugugucauugucuagucaaguguucuaccacagagccauauccccaaccuuagguuuucauuuugauuuuucagauauagaaucuuuuucuuuccuuuucuuuucuuuucuuuucuuuucuuuucuuuucuuuucuuuucuuuucuuuucuuuucuuuucuuuucuuucuuucuuuuuuuuuuucugguacaaacuagccuugaacuccuggacucaugcaaucuugccucuuccccggcaaggggaccauagguucguacuacuguuucuaauuccauuagagcuucggaaggcaacagagaaaaggaaaaaccagggaccguguucaaaggguuagucugcugauguguggacucuagucuucguauguaucgagcaugguaguauauuuuauuuccuucagugacaaccugugcuuuuucaugaaaaucaguuuucucagccccacaccuagcacagaguacaucaggguuuuccugaagauacguuuugaaaaauuaauuaauauucuaauacauuccuucccgaagugguuaauuuccucccaguuuauugauacugugcauuuauguuuuuuuuuuuuuuuuuuuuuuuuuuuuucccgagacaggguuucucuguguagcccuggcuguucuggaacucacuuuguagaccaggcuggccuugaacucagaaaucugccugccucugccucccaagugcugggauuaaaggcgugcgccaccaccgcucggccacaggagucucauaaucagaucuccuacauaucagauacuuacauuacacuuuauaacaguagcaacacuacaacuauguuaugauuggggucaucacaacaugaggaacuuuauuuuugugucauagcauuagaaaugguugagaaccacuggucuauaaggacaugugauagaauugggggugauuccccccccuuccuuuuuuuuuuuuuuuuuuuuuugcauugcuuuugauaaccaaguguccuuggaacucaggcucugagguagcaggcuggaggcaaauuggggcaccaacccucugcccuaucccagagggaguucucucuuccugugcugguagacucuuuguagggggacuguccuuuauuccauaguggugaagaagaaggaauggaaagcuugcugaguugccacccaccccaaacaaggggggacuuugacaguucauaggcucuggguccccaaggaagaugggcuuguccuugggugggaauguuugcucuugaggucaaagcugggagccccgagcaugucacauuaacaacuaacugucucuggcuuugacuccccauuucucauaggaugugacuccagagaauuuccucgccgugcugagaggugacgcagaagcugugaagggcaaagggucuggaaaagucuugaagagguacccucuguuucauaggucuauuauauucuuagagcuguagccuaacgcagagaauuuaagcaggcauugcuguucgcaccuguuuccuuggagacguuagagcgggcagcauuguccugacccaggacagcucucauggggcuggugcugugguuugacuguuucugugccucguacgccugugagccagggucccuugugaguuuuauguucccucaugacuuucuggacaucccacuaagcuacaacccuggccagccuacccuuuccucacugccugucugccucucccucguacaacccccaagaucuauuuuuuuucauacagggugucacuaaauuguccaggcugcucuugaacuuguagucugacucugccuuuggaguuagcuggaauuauagucauauguuaucacaucugaccucacuaaacucaguguuuccuuacguaacgcuuuuaugagacguuagagcuccacguucguguguguuuccguuucuguguuuuugagacagggucucucucacuauaguccugguuggcucggaacuuccuauauagaucaggcuggucucacucaaagagauccaccugccuuugucucucaaauaccgggauuaaaggcgugagcugccucgcccugcucagauuucuuaacuuuuugaugaaggcauuucuucagagauguggacaggggaacaggagugggaagcuguggcucccuggcucacccgcucugugcucucuugacaguggcccccgagaucaugucuucauuuacuucaccgaccacggagccaccgggauccugguguuuccuaaugaugaugugaguucuagcuuaccaucucaauuguaugucugggucgucgccauugcuguuugauccuggaggcugaguguagcagggccuuguguguguguuagccaagugcuauauacacugagcuaugcccccagccauguuuccuaacauuaaaaauugauuuuuacauuuuauuuuguacacguguguacauucacacacgugcuacgucacacauguggaagucggaggacaauuuucaggaguuggcuuuccuuuuccauccugcagucccuagggauugaacucagguccuuagguuuuggcagcaagugcucuuaccugcugagccaucucauugcccccuuugugaccuuuuaaagauaacaaggauaguuuuauuuaucuuaaaaauuuaaaguaaaauagaaaacauggccugcguggacaggguagcagcuguuucucuccaugccacaauguuagccagaguguacagggugcacagacaguacaccaaagucucuggaugcccaggacaaagcugugcauggagaagugucuucucuugucuuucaguaugggauggaguggccaagaugacaucuagauuuuacugcccgccaugguuacuuuuacugacugggaaagggacuuuaugagguguuaguaguuucucuuagaugccagucugaauguucacauuccuaccuuucagcuucaugucaaggaccugaauaagacuauucgcuacauguaugaacacaaaauguaccagaagguaacaucaucaguuccugagccccuggggggagggaggagccuggguugcagagcaaagaccacacccgcauagcuggcccuucgacagguugcugggcuuucuggauaggcuucccccuggucagcauugaccaguggugucccaggauucacuguaccucuuagagaacuugucacuacacagugugggccucaccccaagcuuggacccagcagguguugggagaggcugugaauuaacugcuacggguacggggagcacacgugagguccgcugucccacagucugcccagguuugggauaauuggggaagaacauccacuaccuuauucuguucgcuuuggcacucuccucucuguacccucgguagcaacuguauaggacagaugggguguaugugaugguagugcagagagauggcugccucguggcauggcucucuggagcugcucauccucagacagcagaaccagucucuucaguguuguacggcuuccugugcguucugcuaacucagaucauuuucuuccauaagugaagaaacaggauuacuuuuugucaaauggcuuuccacagcccuuggccauagccucuguauagcaacagugacuccccagauccaaggugcaggauagugggcagggauggaaagagugacagcccccaguggcuggugcugagggcugggagcucaccugucucggaugccuugcagaugguguucuacauugaagcuugugagucuggcuccaugaugaaccaccugcccgacgacaucaacgguagguaucaaacaggcugagguugguugucauuggauauugcccguuuaauaccaagcguuccaccugugcagggccacucagggcugcuugcuaucuagguggaggucaugcccccuguggucgggucugguuucuacuccacaagcauucauaaggaauaaagacccugugggggcccggagacuuggcuuuaguggagccaagccgcucuuguagaagaccuggguuugguucccaacugcuacauagaggcacauaaccaccuguaacuccaguuucagggcaagcaacugauguccucuucuggccuccuggguucaguacacaaacaggcaaacacacacacacacaaaaacaaaaacaaaaaacccccggcaauaacacccccucaaaaacaaacaaacaaacaaacaacaacaacaacaacaacaacaacaaaauaaccaacccaacaguguaucaaggagagucuagauacaagcugcaauggcugcccaaacugaaccaggucuguuccuuuguuauguguugguacccacucucuccgaucucaggcagguaggugguucuugaaccuggggauaaugauagugccugcacagaaguuccaucuuaaaugcagauacuguagaggcccugcccugcugguuuucaugagacagaaucucgggcauuccaggcugaucucaaauuugcuauguaacugaggaugaguuugaacucugauuucccuccuccucccaagugcaggcaugcacugccacgcuugaguuuaacuguuuugcagggccacacagcugcucaucaaucaguccguugcucuccuggccccagucuccaguguuuucuaaauaaguguuacaccucccucgaaaccaaacugggcccguauucuucacguuucccauuugcccgugaucgucuguguucuaaggacacuagcacacgagugugaucgucuguguucuaaggacacuggcacacgagugugaucgucuguguucuaaggacacuagcacacgaguguuugcucauagcugcaauaagagccuuuuaugugucaguuuccuuccacgucugagaggagcuacuguucuuucuuuccuuuuuuuuuucgaauuuuuaauuuauuuuauguauaugaguacaucauaguuuauucagacagaccagaagagggcaucggauccuauaauagaugguugugagccaccaugugguugcugggaacugaacucaggaccucucgaagagcagucagugcucagacaucucucuagcccagaguuuuuuuuuuucucucucucucucucccucccucccuuccuuccuuccuuucucucccucccucccucccucccucccucccucccucccucccucccccucccucccucccuuucucucucucucuuucucucucucccuuccuuccuccuccuggucacccacucccacaauccauucccgaguuuuuguucuuaauggacaggaccauacucucccugugcugaguacaguagcagcuuugaugucaccagggggaaaaggagggaccccaguuucaagaguaguccaaggccaggagcaaaacaugacucaaagauaccuuucauccacuguaguuuaugcaacuacugcggccaaccccaaggagucaucuuaugccugcuacuacgacgaggagaggggcacuuaccugggugacugguacagcgucaacuggauggaagacuccgaugugguaaggcccuugccagggccagccagccugcuacaguauagcccucaggcucuggucuucccaaggaagaccuuggcugggguuagccagccugcuauaguguagccuucaggcucugacuuaugugggcuuuuuucuugcaggaggaccugaccaaagagacccuucacaagcaguaccaccuggucaagucccacaccaacaccagccaugucaugcaauaugggaacaaagugaguggggccucgcucucuugcuccccaguccuggaggcccaggcagacucaugccaagcuuugucucuugaugaagagaaacgggaucccgguggggaauggucucagacuggcucugccucauauagauagccacucugucccagggucucaggcuuaggagccagaccaacuagguuugcacuuccagaccuagagcucucaaccuguguccgaccucauuugucagaacccacacaugcaggguagccaggaaccccagagaagguggugugugggaggcacugaacaagagcuggucacagggccagaggcuacagagaccgaaagcauacguucuguuuuaaaggcuguccacugaacgcugcaccaugccuucucuaaagaucugucccaggccaaacugcaggucauuaguuuuccucauuggcuagaagcuguaccaacguacaacuuuguaagcuugagcuuuuggugggaaggcucuaggauaugcaguuuagcugaaaaaccuugaaagggaacucccaguuugccauuucucaggccugaaagagcuugcccgcugagaucuauucuuggcugcaagcucaggcauucuaggagaaaacugagaucagaaagcccagcucucuuuaacacauccugcagaucauggcccgagugggucugagcccuucagccugucagcagugugauagccaccgcauaugagaaguguacguagguuggguguaggagagaacagggcaucgugaaaaccagacggaugacuuaggaaauguccgcuccacuguguggcucugucuucggcuuccuauucuuaguacaggugcuggucuauuucuagucugucugccugucucugucucucuguuugucucugugugcaugagugaugguucuuuuggaacuugcuguuuuuauauuuguguuuugauuuuaacuucagaguuuugcaccgauguugcuuaacucauuuucuccccgcgguugggucugccuugacuugugcaagcagaacccagccuggcacuuguacacauuuuguuagagccuggggcccagugucagcccagccuguggccccagcucugccaagucucacgggacccagauuucagcagcacccuggacagaugcuugaaaccuugcugcugguccuuggggccagacaggggagcaggggugugcacauccaggguuguggaaguuaaaacaaauugcacaacuguggaucugcaguggguuuugcuugugaaggagcucuuugcugcaaagcacucuggguauuucugaaguucuucagugguggauuucagccacacaugugcgacaucuugccuccugccucagucgaucacgugccuuugggugacuggagcccuucagaguguuugaaguuaggagggaaccaugacucucucucggagaggcugagccagaguaugcuuggcacacauaguuucucagcaaacguguugaauuuguauucucucuccccuccuccuucuucagucuaucucuaccaugaaagugaugcaguuucagggaaugaagcacagagccaguucccccaucucccugccuccggucacacaccuugaccucacccccagcccugacgugccccugaccaucuugaagaggaagcugcugagaaccaacgacgugaaggaaucccagaaucucauugggcagauccagcaauuucuggauguaaguaguggcuuacuaaaaggacucuccaggccauucuagauuaaagguguguauguguguauguguguccguccugguauaaacacaaccggcaaccugaacucgggguacuuccucuccagauccagaaaggagcauggccucugugcucuuggaaagcagagcaaagagcagaguaguagcugucuucacucuucauccuaacuuugaccucuuuaacuuugaccucuuuuacguugaccuauuuaacuuuggccuccuuaauuuugaccucuuuagcaguaggaaggaaaggcucagaggccuggcuuccuggaauccuguugagaagcccuggcuuauggguggucccuuugaggcauccugucuuacugcuucuugacuuauuagucacuacuccauuuuuuuguuuuuuccuucaguguacaaaaaucauucccuugucucaggcagguugcgguggugcacgccuuuaaucccaggaauugggaggcaaaggcagguagaucucuugaguuugaggccaaccugguugacagaguuccaugacaaccagagcuacacagagaggacacccccccccccccggucucacauccuguugacucaguggucccagccuguagcccuuccugaaguugacgucucugugccucauagcugcugaggucugcaguugguggacuuggcagggggguccuccuggucguagcuguguacucucucaucugugccuguguguuccaacaaagccagucuguggucacgcuugucccccgucaacacgggacacugugggauaugugaaguuuaaaagugaaacaaacaaacaaacaccuuuugaucuauuuuacuuuuccaaguagaaacccauguaucucaggcuggccaucuccagcuugcuacuuagccgaggguggccuugaacuucugauccucuuccuccgcuucugagcgcuggcguuuuaugcucccugaguacaugguucuuaggauuaggaauugaacccaggguuucacacaugcuaggcaagcucucuaccaucugugcugcaugugcagcacccaugaauguguuuuaaaugccaaucuuuucucauucauucauucauucauucauuuugaaacuugucaccccagaauguugacaaccugaguagccaggcuguuuuuaacuggugucaaacacagugacaauaacuguccucuuucuuucuaaccucuggccucuugagucccgcuguuuauuguucccugggagguuuugucugugauggguuauuguuauagugucuuaagagauaaaaugauucagacacuguguccaaugccuccaagucccagcccucgggaggugggggcagcgagaucaggaguuccuuagcugcuauauugaauuagaggucaaccuggguuacaugaggccgugucucagaacaaguaacagcuccgugaaaagagccuuuugucuuuguccucuggguagacauggaaaccgaaccagaguuuccuuguauuggccucugagccauuguguauauuguagaauuucucugguuuuggcaguaaaucugaaaacuaucucuaagccuacacacuuacugauucaacaguuuccugcuuuacaccuuuauguaaaauaaacuaagaaaaagaaucaagauaaaaacaacauugaacucaugcagcacaguagcauugcuucacguccaccgacggcugcgcccagugugacagggaacagcugguguuuacucuguggcccugggguuuuugcugaagcaugggaagccauuacgggguccgcagggcucuagggacccccguguuugggaccacacguggcuccaucacacaguuucuggcgagugugaacaguucauccaugcagaagaugaacacuggguuggucagagacuucguggauguuuggguucagcagugccuucuuuauguugcuauuucaucaucugggaggaacacguagugggggggggguguguguggccuguguucucuguguacucacccugguuuccugagcaugcagaggugcccaggagcaggcagggacugaugaggauagcagugugcugaggcaggucucagucaggcacaggcgaaccuccaggugacacgggucaguucugcugugaucuagaaggucuggccuuuccagugucacagaaaccaaacacauaccuagcaucucucuugaaugcaucuguuaaauugguuuaauucucgguggguugagggcagugucaggauaguucucugaauaugcugcuuacuauagagcccggggagaguacuuuaagcuagacucguuuugaaaugcugccugucuuuuuuuuuucccuaggccaggcacgucauugagaagucugugcacaagaucguuucccugcuggcgggauuuggggaaacugcugagagacaucugucagagaggaccaugcucacagcacaugacugcuaccaggaggcuguaacccacuuccgcacacacugcuuuaacuggcacucugucacggugagcccagcuaggguccucaggucuccugcaucugagauguuagugcuaaacucaggugcacuggcuuguauggaaagauucucucuggaccguagucaugugucuugucuaccagagucauaggugacaacucccauuacuguugccuuugaagggugcuugcuucucaugaugaugugacccccacaacccucgcaucauccucacaucuccagacauuggcuucuuucuuccuccugaugucuucugucuauuccccaagauuuaucauuguuggagcacacgcuagucuauggagaaggaagaacuauguuucggccaguuguagagucagucagcuagucggucccuaaaacgcccuguggucacaaugggaugcuugacuccuccuggagcaaggugggcagacuguggcccguagaccaaacccuggcagagccuggcuuugaaccuuugucguccaguuuggcauuugugcgucaugcuucccuccucagcuggguucccagaaucagcugaagcuggacagaguuucagcagccccagcagcccugagguuugugugcgaauguuugucucuccccgggagagcgugugaaugccuacagauugccgaaagaagauggcagaccugugacccaaacggaccuccaacuccuggcugaaauggcuuugucucugugacuacugcauggugaggugcucacgugugggucucuguuuucuugcaguacgagcaugccuugcgguacuuguaugugcuggccaaucucugugaggcaccauauccgauugacagguaaagcagcgcuuggcuggcacugggaagaugggcaucauuccagauguacuggggagggcaccacuggccugaggagacuguaguuccugaggccacucauugguggaaugggagggcggguucccaguggugauggcuagggacuuugucccgcaugacuccccccaugucuuguuuucugcaggguugacuuaacucaucugauucaucuuccuguuucuugcaggauagagauggccauggacaaagugugucuuagucacuacugaacagcucgcuucccaaugagugagcacaguccacuggaauaugaaccaaccagagacugaaagggcggagccagaggcagcacccgcgccccuggcccccaggaauacugcccgcccaccccagggcuugcuuuuugaagauaccugcuuacuaagaagccaguuuggguggguaaagcucucuggaagaaggaacuuugcuucuuaggaguuuuuuuguuuguuuguuuugguuuguuuuguuguccauuagcuuucaagagcaaauuccccgcggcuucucuagccagggaaggaaucgucugagaaauucaaagcugaaaccucuugccgucuucacagugauuucacugaagaagaggguggaaagcaagccccuaugggagaauuauuuuuagaauuauauaauuuuugauugcuuuuauauuuuauucuguaauaauggaugucuuaaaacaaauaagugaagugagacauuuguuucuggac

SEQ ID NO: 6792 - RNA, 4204 nt, Mus musculus
cagcccugacgugccccugaccaucuugaagaggaagcugcugagaaccaacgacgugaaggaaucccagaaucucauugggcagauccagcaauuucuggauguaaguaguggcuuacuaaaaggacucuccaggccauucuagauuaaagguguguauguguguauguguguccguccugguauaaacacaaccggcaaccugaacucgggguacuuccucuccagauccagaaaggagcauggccucugugcucuuggaaagcagagcaaagagcagaguaguagcugucuucacucuucauccuaacuuugaccucuuuaacuuugaccucuuuuacguugaccuauuuaacuuuggccuccuuaauuuugaccucuuuagcaguaggaaggaaaggcucagaggccuggcuuccuggaauccuguugagaagcccuggcuuauggguggucccuuugaggcauccugucuuacugcuucuugacuuauuagucacuacuccauuuuuuuguuuuuuccuucaguguacaaaaaucauucccuugucucaggcagguugcgguggugcacgccuuuaaucccaggaauugggaggcaaaggcagguagaucucuugaguuugaggccaaccugguugacagaguuccaugacaaccagagcuacacagagaggacacccccccccccccggucucacauccuguugacucaguggucccagccuguagcccuuccugaaguugacgucucugugccucauagcugcugaggucugcaguugguggacuuggcagggggguccuccuggucguagcuguguacucucucaucugugccuguguguuccaacaaagccagucuguggucacgcuugucccccgucaacacgggacacugugggauaugugaaguuuaaaagugaaacaaacaaacaaacaccuuuugaucuauuuuacuuuuccaaguagaaacccauguaucucaggcuggccaucuccagcuugcuacuuagccgaggguggccuugaacuucugauccucuuccuccgcuucugagcgcuggcguuuuaugcucccugaguacaugguucuuaggauuaggaauugaacccaggguuucacacaugcuaggcaagcucucuaccaucugugcugcaugugcagcacccaugaauguguuuuaaaugccaaucuuuucucauucauucauucauucauucauuuugaaacuugucaccccagaauguugacaaccugaguagccaggcuguuuuuaacuggugucaaacacagugacaauaacuguccucuuucuuucuaaccucuggccucuugagucccgcuguuuauuguucccugggagguuuugucugugauggguuauuguuauagugucuuaagagauaaaaugauucagacacuguguccaaugccuccaagucccagcccucgggaggugggggcagcgagaucaggaguuccuuagcugcuauauugaauuagaggucaaccuggguuacaugaggccgugucucagaacaaguaacagcuccgugaaaagagccuuuugucuuuguccucuggguagacauggaaaccgaaccagaguuuccuuguauuggccucugagccauuguguauauuguagaauuucucugguuuuggcaguaaaucugaaaacuaucucuaagccuacacacuuacugauucaacaguuuccugcuuuacaccuuuauguaaaauaaacuaagaaaaagaaucaagauaaaaacaacauugaacucaugcagcacaguagcauugcuucacguccaccgacggcugcgcccagugugacagggaacagcugguguuuacucuguggcccugggguuuuugcugaagcaugggaagccauuacgggguccgcagggcucuagggacccccguguuugggaccacacguggcuccaucacacaguuucuggcgagugugaacaguucauccaugcagaagaugaacacuggguuggucagagacuucguggauguuuggguucagcagugccuucuuuauguugcuauuucaucaucugggaggaacacguagugggggggggguguguguggccuguguucucuguguacucacccugguuuccugagcaugcagaggugcccaggagcaggcagggacugaugaggauagcagugugcugaggcaggucucagucaggcacaggcgaaccuccaggugacacgggucaguucugcugugaucuagaaggucuggccuuuccagugucacagaaaccaaacacauaccuagcaucucucuugaaugcaucuguuaaauugguuuaauucucgguggguugagggcagugucaggauaguucucugaauaugcugcuuacuauagagcccggggagaguacuuuaagcuagacucguuuugaaaugcugccugucuuuuuuuuuucccuaggccaggcacgucauugagaagucugugcacaagaucguuucccugcuggcgggauuuggggaaacugcugagagacaucugucagagaggaccaugcucacagcacaugacugcuaccaggaggcuguaacccacuuccgcacacacugcuuuaacuggcacucugucacggugagcccagcuaggguccucaggucuccugcaucugagauguuagugcuaaacucaggugcacuggcuuguauggaaagauucucucuggaccguagucaugugucuugucuaccagagucauaggugacaacucccauuacuguugccuuugaagggugcuugcuucucaugaugaugugacccccacaacccucgcaucauccucacaucuccagacauuggcuucuuucuuccuccugaugucuucugucuauuccccaagauuuaucauuguuggagcacacgcuagucuauggagaaggaagaacuauguuucggccaguuguagagucagucagcuagucggucccuaaaacgcccuguggucacaaugggaugcuugacuccuccuggagcaaggugggcagacuguggcccguagaccaaacccuggcagagccuggcuuugaaccuuugucguccaguuuggcauuugugcgucaugcuucccuccucagcuggguucccagaaucagcugaagcuggacagaguuucagcagccccagcagcccugagguuugugugcgaauguuugucucuccccgggagagcgugugaaugccuacagauugccgaaagaagauggcagaccugugacccaaacggaccuccaacuccuggcugaaauggcuuugucucugugacuacugcauggugaggugcucacgugugggucucuguuuucuugcaguacgagcaugccuugcgguacuuguaugugcuggccaaucucugugaggcaccauauccgauugacagguaaagcagcgcuuggcuggcacugggaagaugggcaucauuccagauguacuggggagggcaccacuggccugaggagacuguaguuccugaggccacucauugguggaaugggagggcggguucccaguggugauggcuagggacuuugucccgcaugacuccccccaugucuuguuuucugcaggguugacuuaacucaucugauucaucuuccuguuucuugcaggauagagauggccauggacaaagugugucuuagucacuacugaacagcucgcuucccaaugagugagcacaguccacuggaauaugaaccaaccagagacugaaagggcggagccagaggcagcacccgcgccccuggcccccaggaauacugcccgcccaccccagggcuugcuuuuugaagauaccugcuuacuaagaagccaguuuggguggguaaagcucucuggaagaaggaacuuugcuucuuaggaguuuuuuuguuuguuuguuuugguuuguuuuguuguccauuagcuuucaagagcaaauuccccgcggcuucucuagccagggaaggaaucgucugagaaauucaaagcugaaaccucuugccgucuucacagugauuucacugaagaagaggguggaaagcaagccccuaugggagaauuauuuuuagaauuauauaauuuuugauugcuuuuauauuuuauucuguaauaauggaugucuuaaaacaaauaagugaagugagacauuuguuucugga

SEQ ID NO: 6793 - RNA, 10139 nt, Mus musculus
cguaauuuccugggugugugcgcgcgugugcgugcgugugcguguauauaaaagccggcauagcauugcugcugcugccgccgccaccgccaccaucaccgcuguuaccaccaccgcuacugcaguguucccgcuggugcagagcuuugguagccagacuacagacccacucccgccauccuccugcagcagcucguccacucuuuccgcaccguccggcucgcuaugcgcuccaccgcgguucuggcgcuucugcugugcgccgggcaaggugagcggcuccgggcugggcagcacgauccccucucuugccccaggucccuagaggagccggaggauucagcaccucggacagcaccaggucuccugcuugaguccaggcgcaagacccauaauguuggcuauggucgcccaccacacccgaagaaacuauaaagccugacccaaccccacugggcagaccauccccacccauguccgcacaccacccacuggugcucuggcuccacgccgaccaaggucacuggggggagauaggggacuggcgcgggcuucucaaccccucuccuguccuuccacccuccagccuguccuugaucucuucccucaccccugcucuuucccgccacgucugggguuucuccccuugccugccucuguuccuaucucagucccacuacauggcugggccugggcuuguuuucauugaacuugauuucagcucuguauucccauggggaaggguugaggcucuucagugcagccucugagcccagcccccccccgggggugcagcauggagggggggauagcagaaucagugcugcuaacuuauuuggguuuugaggguguguugguuggugggucccuugagccucccgcagggaaggacugggguucccucguugcagagagauagccccaauuagcaaucucaagugcucucucucucgcucucucucucucucucucucucucucuccaguuuuugcccuuccugugaacagccccaugacaaaaggggacaccaagguaagaaggaauguugggguacccugggagaggaaggguucccuguggacuccucagggccaauccuugggcagcugcaggaaagagucuggcauagagccaaaaggcagcacugcagcggcugagccugcacaggggacagcuugcacaagaagacaucaaagaucucuugcuuuuguugcugcccagcuacagugacuucccaaggggcccaugucucacccgaugaguccugggaccagggacacuggucugagccaugaccauagcuucuccugcccuaggugcacagaccugccuggcugucaccucucuuugucauuccucuucuccuacccucacucugcccagagcuuccucuggcaguaagaaagaagccacaucagaugcuaggaccacauucacaucagagccagggguguucuuccuccagagaaucggaaaguuccguucucuauguucggagggcuggcuucuucugcaagaagccacaguuuaaaaauugugccguuaaagggaacucaccguuuacuuguugaauuguauuuucuuguuuauuuguuguuaacugaacacaggccaguguuuaaguuuucacuacucauucuagcuguguaaccuuggaaaauucaucucucuauaucucuaucucuaucucuaucucuaucucuaucucuaucucuaucuuccuuccuuccuuccuuccuuccucucugucuaucucucuuuuuuaaaagauuuauuuauuguuauauguaaguacacuguagcugacuucagauacaccagaauagggcaucagaccucauuacggaugguugugagccaccaugugguugcugggauuugaacucaggaccuuuggaagagcagucagugcucuuaccugcugagccaucucuccaucccucuuucuuccuuccuuccuuccuuucuuucuuucuuucuuucuuucuuucuuucuuucuuucuuucuuucuuucuuucuuucuuucuuuuuuugagacagggucucucuaugcagccauggcuguccuggaacucauuauauagacgaggcuggcuugaacucagagaaaucuaccagcuucucucucccaagugcugggauuaaaaauaugcaccacauuauacugcaccccagcauucuuuuuuguuuguuuguuugauuuugguuuuguucuagacaggguuucucuguguagcccuggcuguccuggaacucacuuuguagaccaggcuggccucgaacucagaaauccaccugccucugccuccggagugcugggauuaaaggcaugcaccaccacgcccggcugcaccccagcauucuuaaggcccuuacccaacuccugucucuuggugucugcccucaaaggcuggugguugccaaguauucuccauguaaagucuaguguuagggagacaguacaugcuucuaggagauacuuaccugguccacuccacaccauaguaugggagcaggggucaggggugccagcagguaaggaagaccuguaugcucccuuugaugcugcuaugacuacauacccugacaaccuuugccagcuugcuauggcaucccauagacacagccucccacaccuucacuccgugcuaguguugccugacgcaugucuggcaccuccugcuucuccacccagcugcaggcugucgaagcaggucugaugugauucccucccugagugagcaagcgagccugcguggcacuucauagugggcagaguguuuugcauuggggaggaguucucauccugcuuuacaugagaggaauccaaggcucagagagacuaagucacuugcucaaggucacacagcuagcauaccacacaacaguggacaccaacuucagaaauuauccauggugcuuugugauuugcugcucaccucacagggucggauaaaauauucagaggugugucguguuggucuggaccagacauccagcuguaacuaguuaguauccacauccaaccaggggauucuucccgugaaaacguggagccacacacuguggcuguagaaugggaggugguccuguuucuggcaaguucaaauccagguagguucguguucuucaaugggcagucuggaggaacugacccuauggacucugcuagaccccaguccuuugcaagagguccuuuuaggucucagaggcagcgccauccuuggagaacuaccuuacgagugagaacauguuaggcaccugcucccaccccuccuuuagcagugguucccucaagacacaugcuggaaugcccaugugauuugacuggcccacaguaagcagugugugugugugugugugugugugugugugugugugugugguguguguguaguguccuguuucuguggcucuauggucuuauuaaagaagcagagcugggccccauggccccuugaagacaacacaaaugcucuucugcccuucugggaaaguugcccuggcaccucaggggcugagcuccauguucacaccggccacagcccaccuugcugucucccaggugaugaagugcguccuggaagucaucuccgacucgcuguccaaacccagccccaugccugucagcccugagugucuggagacccuccaaggagguaggagucagaggcuggaggaggaauugggaggccagggugugggaggguagcucuuaaucaucacauccaguacucauugccccagugcccugguaugugcuagaaucuggggaagacacaggaaugggugacagcuccugggacccugagguuuguagacacucagagggacauauggcaguuaacuagaagccugggcagaaugaaggagcuggaacagcaaggugcagacugggugcccugcguacuaggguucuguguucuguacucucaguguuuggagucucgcugacaccaguagccguucucuggaucugggaugaauucagugcugagugggccuaaggaggaccacaucuuuccaaacagacagcccaguuugucuagcgcaugauagcgcugggacagguagaaaaugaggaaggaugucaggaggaacagacaacaggcagcauggaaaagggaaaggaagaauuuacacacucacuggagucugagguccacagucccuuccuuggaggcugggaccagagucagcaggugaccuuucugcugcaguaggaaggugauugacaucuuggaaaugaggaauuuccaaugcguucuaccaagauccaggcuugcccccuggugccaaguuuccagaauaaaugcuugagcucagcugaaaauguccacacuaaucucuucugagaagccaccaguagccaugcuuucucccugcagacgagaggauccucucuauccugcgacaccagaaucugcugaaggaacuucaagaccuggcucuccaagguauuucagcagcauacgcaguuccacacagaaaagccagcaacagagccugaggggaccuggguggaggcugaguguacucuuccaggugcucaguuccagagcagaaaggcgggguccucugugucaccuggcuccauugucuagagacuaagagcucaaggcucagugaggcucagggauucccucagggucacagugaguagaucuuguuaaggacagauccaggucugcugauguuccuccgccauccagggaggccgagagagcucuucucugcagacccagaaaugaacucacacagagagaagacuuucauuuccugcgacucuuuguucuauggguaaugcuugccgauaaacacagagcagaugaguguguuucggacugagagguaacuugcccccaagagauuaagaaaacaguagacaggcagugguggcacauaccuuuaauccgaguuaagccagcugaucuacagaaugaguucugggacagccagagcuacacagagaaacccuguugcaaaaaaacaaagaaagaaaguaaaaaucaaaacuaaugaacaaacaaacaaucaauacaaaaaagaaagaaaggaaggaaggaaggaaggaagaaagaaagaaaguccacagauacuuuucagacaggagugugaggcuggggucucauagcauugaagauauacaagcuagacagcggcuaggauggagauguucuuaggcugcagucucccacccuuccuguuugaggucgugcuauagauugaacccagggcuucaugcgugcuuggcaagcaccccaccaaaugaagcccagcuccaguucuauggcauauucaugguaucuccuggcacacggaggguggugggugguauagggguuguuauaaucaauuuuguccuggcuuuguaaacacaaacaaggucucauuguguagccacacuguccugacucugcaguccugccucagccuuuugagugcugggauugcaggcaugagccaccacacccaccaugccagguccagguacaagacacugugggucugccccuuaaacaugcccacuuuccucaggaggcauccaggguagaagcagggcuggaugccaggcgauccggucuccgggguggcacuuuuuaaacaaaacauuagauauuuuaaugauaaauuuaaaauuaacuauugggcagauauucuauuuaaauaaauaaguaauucaaugagaccauuagagaggagugugcucuauucuacguucucacaagucuggaucuaaccaugcacagcauccagugcacacaggguugguuuccguuaugaggauacugggugugucuucagcuacaucaucaucaccccauucccuccugguuucuauauaauagccuugcauggagaccucccuccacuuuaacaucuaccacaagucuguuuauaaccuuggggagcccauguuacccaaggucacagagcuauaggcauggccagggcaggccuggagcucacugucgcuggguugggcuuauuuccuagccuacagugaccccacagcugcagagcuguguccugauucagacacggcugcaggauacucagggcaacaucugcagcaauagcugcagggguuagguuggcagagggacucugggcaauguagguauaacccugggcucaaagguagacauagcacccaccuuuuccuggggccagaccuggaguuccagaacaguggaggcuguuuaacaaaagagcacccaugagggcgugcugcccuggagaucugucugucccauuugggccuuuauugcucucuaagguacaaguagaacuuucucacauuucccacuagggacacugagucagaggggugguguggccugauggguauagcugagagccuguacccucaagggaggccuucaguguuacggacagguaugucagguccacauggaaccuucccuuguccccuccuacaaggugccaaggagcgggcccagcagccgcugaagcagcagcagccgccgaagcagcagcagcagcagcagcagcagcagcagcaggagcagcaacacagcagcuuugaggaugaacucucagaaguguuugagaaccagagcccugaugccaagcacagagguuaguguggccagcuaggggggaagggagcuacaaggagaacaguaguccccaggugaugcugcuucuucacagcaggaagucagcuaccauugaacuuggccucaggaauccccuagggcauccggguccucugcuugacccuauccauuuguguuugcagacgcagcagcagaagugcccuccagggacacuauggagaagagaaaggauucugacaagggacaacaggauggcuuugaggcaaccacagagggaccuaggccucaggccuuuccagagccuaaccaagagucccccaugaugggagacagugaguccccuggggaggacacagccaccaauacccaaucaccaaccagccuccccagccaggagcauguggacccacaggccacgggagacagugagagaggccugagugcccaacagcaagccagaaaagccaagcaagaggagaaagaagaggaggaggaagaggaggcuguggcuagagagaaggcugggccugaagaaguccccacugcagcauccaguucccacuuccaugcaggcuacaaagcgauccagaaagaugaugguauguauggggacagggaccucaacugaugugucugggagauggguggguagggacuucaugccaaccucauaauaauccugaaagaugaauagcaucuccacuguguguguguguguguggggggggguagggagcaagaggcucagcgagguuauguaauuugccuaaggcuacacagcuaauuaaagacaaguguaguuucaagcccaguuuaucugacuccuaaaccaagugucaaccacuccucuacacccgggagcaagaggagcuuagggggcagguguuccucuuagagaagggagagacaacagggugagcuucagugaggggcucugccaacuagcuccuuugagguuugcagggucuugcuucaugcuccccaguggagcuggcuggauccugacggugagcuuggcuuuagagguggcugcacaaaagaccuugaggaguggcaggggcuggggaaauggcacuccuuccucacuuccuguuccugccacaccugcuccaggucagucggacucucaggcaguggauggagauggaaagacagaggcuuccgaagcucugccgucugaagggaagggggagcuggagcacucucagcaggaggaagauggggaagaggccaugguagggaccccccaaggucucuucccccaaggcgggaagggccgggagcuggaacauaagcaggaggaagaggaagaggaggaggagcgucuguccagagaaugggaggacaagcgauggagcaggauggaccagcuggccaaagagcugacagcagagaagcggcuggagggcgaggaugacccugaccgcuccaugaagcucuccuuccggacccgcgccuauggcuucagagauccugggccucagcuacgcaggggcuggaggccaucuuccagagaagacaguguggaggcccgaagugacuuugaggaaaagaaggaagaggagggcagcgccaaccgcagagcagagguugguauaggcaagggcagccacccccagaagucccucucccacugaggugacgugguucccuuaggugggugcuggacuugggauagggggaacaacuggcuuauagcaggggcucaacagaguuacugggucagguggacagugggaaauggcuggaacuggaggccucagaccugccugagggacacggagugggggcauugucucugcugguaugugagcaggacacgggagugauagggucaggccuggugcuuuggauggagagcuuggcaggacuugccuggggccucucaggacagacaccucuggucccaggaacugggaacggaugcuagggggaccaguggugaccgaggaagacagccugguugauggccaugucuuccugguccccagggaacucaauugugccuccuccuggguuuaaacucacagaggccacaauggcauagcagggcgagcagauagggagucauggaggugcuggcagauuuggguuccagcuggcccuggcugcgugacuuugggcaggccauuaccccucucugggucucacuuguuccccuuugugaaguggaaguaugggaguuccucuaacuuaccuuaucauaaucagaacaugaccuugaaaacccuacuaugcccagggccacuugggcagcugcaagggugguauagggacacagagaugugaccucaugggaggugagagcugggcuucuuggcagggcaggaugccuccugagcuggugggaccuggcuaggccagugcuccggagggaguugggcuccuauagggagccugaucuauccacagcccugacuucaaggcucuuccaaucaggcacagaagaggaccuucuuuagguccugccccugucuuuccaccugaaacagggucccguugauaccugagagcaauaggcucuucuuaggagcgggcgcuggcaggaaacaucuguuccuggaggugggggaagagugaaagcauugugcucaagaugggacagccucaagaacccccuuacccacccauaaaagcuucuuucucauggacaaagggaaccgguagugaagaagugguagugaagacccuggguguuauggacauggugaggcuugggagagucucguuagaaacuuuagcaacacagaacucauacuccagaggcugcucuaagaucaagagaucuagaaucccuaagucaaaggcggccacugucaacauucuguggccaucgcauuggcaggacaguguagaacaggcuccuagugguccagagucccauagacaaaaugggggcuggauaaucagccaugggggccuuggacauaauggucuccagagaguccuagcaucacuggguggcaucguugugccuauaaugcggacaaaucuucuggggcucagaggcaaagucacuugucugagccuagcagcuaacaaacagcaggguuagucuggcacacugugccaucgacacuucuaacacaggccaguaccaagugacccugucuguucccuccuaggaccaggagcuagagagccugucagccaucgaggcagagcuggagaagguggcccaccagcugcaggcuuugcggcggggaugaggcccuggcugguggggccagccauggcuucaaggccagacugcugcucgaguagggcugcuuccagccacagagcccagguuacccccuuugccccucaccuucucuuguucucagccccugcccuggacacuucugcagggcagcccugaaugucagcacagauuccuucucugaacacaggcagcuuucuagaaguuucucuuccaccuucuuauccauggggcacaacugcaauaacuucugaccuuugggcgaaagccgagaacuccugacuauuaagauauuccagauaaaauauauugaaggaagaauaaagugcuuugggcucuuugcuuucuuuga

SEQ ID NO: 6794 - RNA, 5895 nt, Mus musculus
aucuggaccaaagaggccuccaugcucagccccaagugugcuguauuuguguuucccuucucagcugccaggacaggauaaaacacuacuuguuacaucaucccaaggauacagcagggaauucccgccccgaccccauuuauugguuccuuaguucuccaucggguaccaacagcgagcuguucagucacccugugggagcccugaggcaggagacccacccugugggucugggcucaggcagggagugcagcuugcuucuguacgauagacuuggcaaccucugguggcuggcggagagcgugguguucaaggcucuuccugcuagcuggcugaggcucucuugggucuucaggaccuucaggugcuggcacaguuccucaugguuaaggcaaggggaugagaaggugggaaaucucaugccgguucucaguagguucgcccugcagggaagggacugagcucacuccaggacucuuguuucccuuuaaaaauuaaaauagccuacaagguuuuugugagcauuuuuuuaaauuaauauaugcauaugugcuuggagcagugccuggcauggaaugagaacucugugugugugucugugucucugugugugucucucuauguguguagguaugugugugugucugugugugugugucuguagguguguggauauguguaggggugugucugugugugugugucuguguguguguaggugugugugugugucugugucucugugugugugugucugugugugugugucucuguguauguagguguauguguaggugugugucugugucucuguauuuaggugucugugugugucugugucucuguguauguagguguguggauauguguaggggugugucuguguguguguguagguguguguguggauauguguauguaggugucugugugugugugucugugucugugugugugugucuguguauguguagguguaaacacugaccguuuuccuccguguugucagguauaugguaguacaugcagacccuguggcaccaguggggcacucgcuaugcuucuaauaaaacugucacuacagugacagcagcacuuugcucccagcuuuaucuguggccauagccaguuuauaaguucucaauuguaauuggagccaaugaggcagcaauuaugaaagugucccugagucgaggcacgccugugagggggccauggaaaugugacucugccuaaaaggcagggucagggagaggcaguagccagagggacuuggcuguuauuccuggcucugcuccucaccaguuagcccauguugguuccagucacugugccugccauacgagggacguuuuagaugauacuuaacagucaccuugggaucgccccucacuaguuccuaaguguggcuggcaccucccaagccauagccccauccacccuucccucucaaguacggaugcaauagcacaaguguggaguucaauguggcagccuccagcacugagcagccccuaguggagggucuaugcugugccggaggauggaggagaaggcaaggggacaaagguuuccuuguucuugaccuucuaacccaguuaggaagccaacaucuaaacccacaagaaguuguguaacagucuaaagugagcuucuguugguuugcaugugggccucuggggucagagcuagaacaugggacccagaaaagauuuucuauugucacagcagauggaugacagaggcugucuuugucuagucacguaccauguggacacccugccuggauccugcccaucucuuacuagcuguuccuuaucucaauccuugagauaacagaaugaguuacgaauuuuucaggccuaaggaagcugccaccucccgaggaucauuuagaaagaggcaggacuguggcuaucacguauauucuugucauaugugcaugaggggcuccuuuggacaguagcuaauggugccuuuagcuacuucccuuucccucagcuggcuggagggucaguaacucagggucaccuaggaagaguucaguaccuuggauugcuucugacccagcuggugccaugugcugaugaaacacaggcuaacagaagccaagggacucaacgcugcuuauaucccagucccagaacagcagacucaguacagggcggccauguggucaaccucaggaugacugcaaaucucagccagaaggccaguccccccauggagaccgucauaccucccauuguuuauuuaggucguagggacugggcacugcucuuucugcugaaggaggaacucaauuuaaugccuuugucuggcagaaggcacuccuccuauccccacuguggauagaaaacccaagcccugccauuccacugcccaguaucagaguccuuacaagugacagguaguguuuuaccucaagguuuggugcaugcugaguuuuagaaauguguuuauuggcagagcgugcugguacacgccuauacucucagugccugugagguggaggcagaagaaucaggaguucgaaguuuagugauaugagauugucucaagucaaacgaauaaacaaaauaagaugcuucauaguguguuuucugccagacaugguggcagacaccuguaaucccaacacuuaggggacugagggaggaagacugugagaccccccaaaauaagcaaacaaccccaagaaacauuuucuaguuguaaagaaagcauuuguacccauuacucaguuucucagcugcuggucuauugacaucuugaacugcguaguucuuuguaguugggaccuguccaggauguucaguggucuguuuggucuauaccugcucaauacagcaguacccccaaacauucccuacuguaaggaccaaauaugccuccagagacugccauagaguuguugggagaugucacccuacuuaggcacuacugugcuuuuuaaaaaaaaaaggguaguauuuuuaucuuugugugugugugugugugugugugugugugugugugcaugugagggcagugcucacagccuaaaaauggacauucgauucccuggaguuggaguugcuaguaauugugagccuccagacacggcugcuguaaacugcgaucaaguucugugcaagccugcucuuaccugcugaaccaccucgccagcuccagggcugcuucuuaggguauuguuucagcagcccugagagccuggggucacgaaagcugguucuguuugugaguguggaugacgaagccccaagggucugcuuuccgagccuggggauggguucccagcacuagagaacuuuguccugugggcuccugccugucucugcguuccuaguuuaugaagggauucuauaugcugacugguaucugugucacccauguggggcuguaguuaugaagcccagcuuccuuugacuuuauggaauaagccgugucucuguggaugguaucugcauccccagacugaggcuuccauaccuucugaaugaacuccagccucuggucugcuucccaacccuguuugugaaccucuccaaugaucuguaguaaccagacaucacaaggaccacuggagucauucgucauucaaucagcaaguacuagucggguacuugcuguguaccaggaaucaaaaaacauugcagaaaccacaauaaguuagacaggccaggcagauacaguguaugccucauggacugagcucacacauaugccuggguaugugcacguguguguacaggaauggugcaaacaaggcacaagguauuagaagaaaaagaacgcagcuccaguuacaguaagguccagggggaaauaagacauagccugugauaauagagaacuggcugccuuuugugugucguagaggaagaaaccucaguugaggaaaugcuuccaugagauccagcuguacggcauuuucuccauuagugaucagugggagagggcuuagcccauugugugugaugccauccugcacugguaguccugggaucuauaaguaagcaggcagaguaagccgugggccgcaagccuuucuccagugauggauuaugaucuggaaguauaagccaaguaguaacccuuuccucccuaacuuguuuuuugguuaugguguuuugucaaagcaauagaaacccugacuaagacaaacaggaagagucuuugaagacaagugauauuugugaggucccuuuuccgaugacugugacuucaccaucuagugccauuuuccucuuugcaagcuauccaaggugagcagccaucaccccacccccacucaccuguggcaguuauuggugacaugagagggugcacacuugcuggcagagcaauucucaccucugagcuugccugggccaaaacauguggcccugggucuauugucuacaccgcaacaugcgagguuagagugucuggcaauaagaccuccugcucugaggccuguuggaaacuagaagucuggaaggcugcaugugcaggugcggaacccaguauccccucucaagugacgccugcccuucccagaguuuaccaguggcacugcacauagaaggaguccucaagaccugcuuuucucugcaaguuccaggguucugcuuagguguuccaucuacaaaccaacaaagcacuggagaagaggguagggaaccuguggcuaccaggagucccugccugcucccaggaacucagucagaggcaauccugcaggcugcccuguuguguuuaugccuguaacugaccaguucuucauggaugggccuuuagacaguucugaucucauuuuagaagcaagcugcaggugacuguccccguaugcauauggggggucuguaggauaaaucccaugguagagacaugaacucugcacguuuuucauuuucuccccacauuuucuccccaugaagguuauaccaccuucguccccaccaucuggguccaucuccuaauuaguacauuuuggccuggagcuacccucugugaagggugccaggauuccagcaguguccugggaagggcuguguuggcugaucuaauaauggggcuggccucaaccaccuugccccugacuaucuaugcugagcaccauacauggcccaucucuucugcauccuguguugucagguucugacgucuuguccucagguauaaacagggcugaggaacagggagggcuccaguggauucucuuguccuuucuaucagcucuccaaaaucacaaagauggagucaguguaaauggucaaggguccaagggccccuccccaagucucucaugaacgugcagugcaguccguguaccccacuauaucacacuuacuaccaaagcuuguauguuucuugcuuauuccccaggucaggggauuuauuauauccacacuccuuagcuggucugucuccaggaccucagccugaacuuuccuuugagacccacccauguccagcccagcugccugguucccagguaaucucagugcccuuucccaaggccucugccugaaaugaucuuuuuccucuugacuugugccccugacucuucagcgucagugggcucaggaacccccucccuacauucccuuauggccagacucgugucccccucccccaaguccccuaccccaccgucaucccugcugccauuuagacgaucuuuaucuccgugaugguaggugggaagugguggugguucuguagcuuaauaggcaagaaguuauacucacccccucuuccuaggggcuggccucuuguacuccuggaggcuuugggcugagggcucagacaugagagaucucucuggaauacaaaugagggcugguuaagaccccagugucugcuggcaggaagcucaacucuccagagaagccuucucagagagugaga

SEQ ID NO: 6795 - RNA, 3852 nt, Mus musculus
uaaaguuugaagaauuguuuguuugcaaggacacauauuuuuguuuguuuuuuaaaggggauuggagggagcuaagcaauuugguccaguggaaacugggauccuuggagaauugguaagccccaggccaguaagaaagacccugucuccaaaaucuaaauggauagcaccugagaaaacauguucaugguuguccucugcccuccauauauacacuauggcacccaacuuaacauuuguacaaacagagauaagggaaugugauuuuuuuuuuaaagagcagauuaaccuuguaaacuaaccauuaauaaauuauaucuggaaaugccuuuaaucccugcaaaagcaguugggucuuugaguucaaagccaaccuggucuacagagcaaguuccagguuagccagcgcuacacagagaaacccugucuugacaaaaauaaaaauaaauugcuacuacuuccauacuaauuaucauuaauuaaucauuuuuccuuaaguacagagauggaaucugaagccagauagauauccuggguucaaaucuuacuucaucugauuuuuuacuguuguuuucaggcaggguuucccuauguagcugacuguacuagcacucacuacauagacuagauuuacagagauccaccugcaucugccccugaaugcuagauuacaggaaugugccaccauacccugccuauggcucuuagcuuggcuuuuccaguuacuuacccuguccauggacagguuauuaauuccugaauacuucagucuuguaaaauggcacuugucccaguagcaacagcugccuugguauugggaguaaagaguuggugaagaauacuucuaaaacauuucugcagcaugcauauuaaaagcacucaaaagaugcaccugauucacagaaguaguuuugucaaacuguuucccugaaauacugaauauauuauagcaaaagauguguuauuucagcaacuaaacugaguugguuuuugaguuuguggguuuugguuuuugucuuaugggggguuuuuugggggacagggucugucuuuguagcucuggcuguccuggaacuuuucauguagaccaggcuggccuccagcucagagauucgucucucugccucucaagugcuagcaugaucaagggcaugguccaccaccaggaguucauaaaguagauucugaugcuuuugagauacaaccaaaaaagauuaaauuuugccauggaauuuuagccucucuguucaaauacagcaguuagugagguugcugagaaacuuuaggacuaggguuauacaacacaguaguuaagaguuggcuuguauguucgaggaugucaguuugaucuuuagcaccacaaaaagcucccagaugguacaauuugggaaaaaaaaaaaccuucacuaaaacucauuuucauuuuugguaugagucaguauacacagguaaauaguugauguuuguacacagcaugggauguugugucaguggugaggaacugcaucaggcuaaagugcugcucucauucauaagguuguuguuguagcucuaaagcaaugacucaaaagccaugguuauuaaaauggugugaaauguguuaguacuacuaccacuggauacccugauuucacccaggaaaggaacaauaucucuucagugaucugugcugguacaccuggugucuguguuauuucuagacuucaaccauuucaucuguucaguuccuacauaguuuuucaaagaacuauagauuagugguuuagauagccauuacccaaaaagaaaagaacaaauucuguguaucuaaauagccaucaucauggcuggaaauguaauucagugguaaaaguacaaaaagcaauggguuggugguggcacaaaccuuuaaucccagcuguuggggaggcaggggcaggcaagaauuugaagccagccugaucuacagggcaaguuccaggacagccagggcacacugaguaacugucuugaaaagcacaaaggcuuagauucuauccccagcacucuccccuaccuacccaccucccccgaaaaaaacagaaaggugauagccaucucauuaauuuucuaccaauuccauguaaacugaaagcaggauuagugucuuagucugaaaauuuuuaaagcaagcaaaguaauuguauaaaauuuaaauuuuaugaucauggucagaccuuuuuacauuuaacacaauggaaauauuuuccccaauggaaaaauuucugaaucauacuauguugcacauagaauagaaauaaaaaaauucaggcgcuuauucaaguuucuaaagacugcagguuacaagccacuauuuuacuuccaaacucugaagucaucaacaugauuguguaguacuauauuucaggcuuuaccuaaaaagucauuauucagauaaaguagucaguccucuugucacuuuuuaagucucguuccaccacaacuuccugagaccugugaagaaacugcagucuuguggucagccacuauacagugcuggcagucuuacaauaagggaaaccggugauggguguuaugugucaaucaguuguagucugcugaucugauuagaagccuugacaaaugccugaugacgauugcagauaacugccaagcauauggggauaauacaguagcccacuguuuugggauccgcucucguacaagaauaaaggaacaaaaacaucuguaaguacggaaucaagaaaauaauuguccacaaccaaaagggcagggaaaguaaccgagcuuucaaggaguguguccaugugguuccuucccgaggcuccucagggugcugcagaauguguuccaaagccaaccuguuguaagucucauugauuucaaaaacauaauaaaacgcugcugcacuugcuagcaaauacagucccacuccaauccaucccauccgcugacggaaguucaucauucuccaugcucugugccuucaaugcaaacacagaaaaauuauuguuaaggucuaauaauguugccauggcaacuauuccaagugcacaugauuuaaauucaagaguucugaaaagcacgagcauuuuaagauuuaacagcuguaaacagcuuacaggugguuuuauauaacaguuguaagcacauaaaaauacugguuucagugucuacugagugcuguuauuuaugugaaccccagagugaaugaaucaucacuucuugcuugaguagacccaguacaccuucguuucagauaaugaaacaucuaguuuccccacaggacguugcucuugacaguugaaaugcuuucuggcuuaacacuauuucagacgugggcacuggguugaguucuacucguuaaaccaacgucggaguccccaaguuaagacgguaacucuuucaaacacuuacaguggucccgaaaaucuuccuguucccccugcaagcgagcaagagucacucaguucugaacagucaggugccuuuggcauuucagaacaagccaccuuaagagaaacccucugggucgcgcagcugaagaaggugagcgcggcggcgggagcacgagcuaguagugauuaagcucagcgugacuacggcuggucacgcggcggcggcgggccccgucgcccuccggagccccaggcggggggaaccaccuggagaugccgggcccgccccccacugcacccgccgccgagcugagcugggcaguggcgccaggcuuggccugcagaggcccgagcucggcucccggccggacgccgggccagccugacagccaagccgagcagccccgggucucaccuuccuguccugaguggcccgcccgcucgcagucccggauaccgccgcauucagagcuuc

SEQ ID NO: 6796 - RNA, 19786 nt, Mus musculus
caaucagaaaagcaacuauuuugaauagguuuaauuuggauuuuacagaaaccugauugaaguauauugaguaauaauuucuacaaaaauguacauacaaugccagaauuccuuaaaagcaacuaguaucacauuuucuucugcauaaaacaugcauuaauaucaacugccacauguuggcccaaaccaucucuacgagaauaguaagaaaacuaguugugaauagguacaaaaagagguuuucugguuaaguagggaaccuuucuuaugcaagcccuucaacauaggcuggcuguauuuuugcugcucacugacacugcugcuaagccuugguucugaccuaucaggggcagacaggaacuuggugguuaaaucugacaucugggaagagagaaguuuugaggaugugcugguacauagaaagugcaacucucaaauucaaauccucagcucaggagaccccgaggcugugggcaccgggggucugccugagcccuauccaggccagcucagugcacacaggcuucgccugcagcgggaagaaccuugcagcuccacauagcagucuucccaggaucugucacuagaaggcugcaagcuguauacaguaccgaagccaugccauuuccugaggccuuauuuguaggcuacuucaucgugacaaggaacucgaguauucaugcauacaacugcugcccacacacaaaaauccccaccaacauguggccuaaaaugucuuuaauguaccucaccguguacuagggaagaccuuguuccucuggagggugccacuuaggucuuuguggaucaaaagauguuuuccacauagacugagggagcuuaaaaagacuucacaccaucugaaagacuucucucaaacacaggacuuuauacaacaauccaugaagacccuccgagccgucaggagggaguggcugugcgcacuuuuacaaagacucaauauguauauagcugagggcuuuggcuggaauccuccaucuucuagggcugucacugccccacuuacuaccacuauggucagucaguauccuugccuucagcagauucaaggggaaaaauauucagguuccaauaacauuuuccugacagaacaguauuaaaauagguccauuuuuaauauauguuucugcauaucccugauaauguaaggaaccagaggacucuguaaagcacccacguuaggggguaggaucuggucauuuuuaggcagcagcaaaggggcucacaugaguagauucccuggaagcccugggagcaguacaguacuaacgcugauguuggagggccauuagaauaguaaugaaauuucacuucaaacuaaucagcgaaauucagaacaaaggcuugcuuccucaauccugccuuaagccaaccucccacagacgacaucagucgcggcuaccgugaaggucgguacagagaaaagucccaucucuucaagccacgaucgaaucucagaaagcgcugagcagacuggcagagcgggcuugaggaagcuuugacccaaggcaccgugaucauggggcagaggggacugcuccccagagguucgggcuaacaggaagagacccugcaagacccagaagacccagagggcaauagcucugugagcguacauauggaagucauggaacaaacugcuagaaaagaagcuaauuugcuuucacaagaucaaaucaaacuucucaaaccaugaacagaaagaagucuugggcauccugggcaggagagcugacgucuguggaaugagcugucacagaggccgcuugcugagagaccaguagaaacccugcagcuacuuaaggagaaggccugaggccacgggaggauggaaaggggaccaagugugacacaggucucuuuauuccggaacaguggcauuuucgugaaccugaccgaggaaguggcauuccacuuuagcugcaguaauacuguaacccguccacucgccuucucuuuuuugauugaaacucuucaaagaacugcugaaugucuucucucuuaacaaccuguugaugaaaagccaagauuugaaagggggcuacauucuacaauagcaacaagagaucagagcacucacaagcaagcaaaaggacucgacugguuaauuccagaggcaggaaagcuacccugguagcacagucaguaauccuaguauaggaagacagccacaaguucaaggccagccugggcuaccuaaugugucccaguuucaaaaacuacaaaaauaaaacaaaaaagaauugcaggcaccccuccacucaccacaggauuagauguggauaaguucacugcagugcgaaacugcgguguccacaccuaagcuggcaagcaccagagcagagaacauaggacgcgcugugagcguacauuugugaggcugucacugacaagaguggcagauuuacgacucaaaugaguuuaaucaguggcacugcuuucuuuucacagcagugggagaaaucuuaaggcaaauauucuucccuaucaguguagaagaaagcacaaagcugagcugaggguggugagacaaugccuucauucccagcacuuggaaggcagaggccauguaugucuuuguguuccaggccagccagggaagaauuugacaggucucuguaucucaguguagaguuaacaucacucuuuuacagaaaugcucaccaaggcccacagaggcuggccacucagucacacagccaggcagcagaggacaauggcucaaaccucaguuuguaugaaaacuauagaagcagcauccaucuagcagagccacuugaagaucaggugagcuagagucuaugaugcacaaagcaucagaauccccacacaaugacccgagagaccuaaggucacugcacaugcucagcagcacagcuuuccuucugcucugcucugcacagcacaucaaagcacucugcucuaggucugugcuuucccguuguacucuguagccguggcuggccuggaacacaaagacauacauggccucugccuuccaagugcugggaaugaaggcauugucucaccacccucagcucagcuuugugcuuucuucuacacugauagggaagaauauuuuucucuaaaaaaauuuuuuuuaaauauaccuugagucugaaaaagaugguuguuauaucaacagaaaaaugguuggagagaaaauaaagaaaaacccucaaaaaaagagucaaauuauggaugcacugcuuuuaaguuaugacaaaggauuuaaagcuucguauacaaagcugucuguaauaccaagaccaaggaaaaacauggauuaaaaugagguaagcugggacaaccuaucccugagucuacugcagccaucacaagacagguuucuucaccucuuuuaaaauacaaagacauguguuuauugguaggaaggaaggauggggacaagaggaagaggaggaggagaaggaggaggaggaggggaacagaagaaaaaugcacuugaaugcacaugagcaaaauaaucaaucugaccuaaccuuggauuacaaacauuaacagcaagccaugaaggaaaauucuauuuacucccagguauugugguuaggagaccucagcccacacacagcagagugaaauucugaauucuaguugucuucggucauguucaccuauuuacuagggggaagcacauguacaaaggucagaggauaacucucaggagugcccuccuuccaccauguggguuccacgcaggcuaucaagccugaugacaggugcccuuauccacugaacaaucucauuggccacacaaauaauuaaaaauuuauguauauuuuaugaguauggguguuuugccugcaugucugugcaccaacuguauucagugcccacagaagccaguaggaaguguuggauuuccuggaauuggaguuacagacaguuaugagcugcccuguggguacugagaaucaaacucaggucccguggaagaacaguccuccuaacugaugagccauaucuucagguccccaaauaaugcccccuccuuuggagacaggguuucacuauguaguccugaguguccuggaacccagugaaagagauccaccugccugugccccccaaguacugggauuaaagacaugugcuaccaugccuggccugccccaaauuuuucuaaaacuacauuuucuguucuuuuaaauuauccuaucaagugcaaaauuuucucuguagaaaauaguaucaaauuguaaacugaaaaagacauuauuuuuuucuaauaugguucugagaauggaacuaggguguauucucagguaggugugccuggugugcacacacacacacacacacacacacacacacacacacacacacacauauauacguguccugcuaagaucacuuugcacuguauucuguacuaggguguauucucagguaggugugccugguguacacacacacacacacacacacauacguguccugcuaagaucacuuugcacuguauuccguugaggcaggauaccuacugaagcuggagcuggcugguggcugagaagcucuugcaaucuuccugucucugccuccacagcacugggguuacaguugcaugcaauuauaccaagcuuuuuauauacacuuuggaauuuaaccucagguccaugagaguugcauaucaagagcucuuuucugcucagccaucgccacgcuacaugauaaacuuaacaaagagcacugugaccacagacuccaccagaaucagacagugagcuuggcgcuaaagcacccuaagggucugaggaguacuaagguuacacaggaggcaaaagccacacuguucccauggcacauucaauucuagcucaaggagagacuuugcagcagagaaagacagcaaagauguaacccacaagauguggcaaguagggcuggcucuaaagcacaagcaggcagagcugagcacagugacgcacaccuuuaaucccagcacugaguccgagacaagugguucugaguuuaaggccagccuggucucaagggaauucuaggcuagccaccacuaaagagacucugucucaacaacaaaaccaaagccauuugggacaagacccuuuuaguguucugacuuuacaauucauuuuacagaaacagcaucuuagccccuaucuagaaacccagagacauagccucccucauccacgaggaccaagucagagcccaaguagacuggcaggacccacagcagcagugcacccaagggccucacccagaugcccggauccacagagaugaaggugagauucugccauacacuugagcagugaagacugggaaguaccaauacauuuauccagaauucuuuuuuuuuuuuuuugguuuuuugguuuuuugaagacaggguuucucuguguagcccuggcuguccuguaacucacuuuguagaccaggcuggccucgaacucagaaauccgccugccucugccucccaagugcugggauuaaaggcgugcgccaccaugcccggccagaauucuauuuuuaaagcauuauacaucuuacagucaugcuaucuuacaguaaggacuauuggugcuggagauaugacucaguggcugcucuugcagaggaccugcgcuugguucccagcaccacaugguggcucacaacagccuauaauucaguuccagggcacccaacuccaucuggccuccuaggggacaaggcaugcaugugguacacauucauacguagaggcaaccaucauacacauaaaacaaaaauaaaaucuuuaaaacagcgacaacaaaaaguacagacuuccuacacaggagaauguuuuagcccaggaugggaagucuccuuccaacucugggcuucucagaguccuaguguaacuguuucugcugagucauccucccauucccgacccaggaucugaaucagcagauuccuuccaauaguccuccacuacagucagacccuauguaacuguccugcccuucacguuucgcugucucuuuucugguccuuccuaauccccccugaccugccaguaccuagaaaguaguuucugcguuaaacuuucaccuccucagccaggcacggugcucgguccugugaucccagccuuugggaagcugagauaggcagcaaaaaggaagucaaguccuccauuuaggcugugcuuuucuuuuguuugguugguuugguuuugguuuuucaagacagggcuucccuguguagcucugacuauccuggagaugucucuguagaccaagcuggccucaaacucauagaaucaccugcuucugccucccauggugcugugccaccaugccugguguuauuuuaaucuuuuuucccccuaacaauuuuuuaacauuaaagaaaaugaacaauucauucaagccaaaaagcugugaauaagguucuugaacgcaacauaccgugccuucaucagcaaaucucuucagguaguccuuaaguucagucuucaagucauuguauucuaaaccaaaagcacaacaguaccucaaauucacauagggauauacuuuuaaaaccuuugccauugcuaggcaaguguuuaacaguuuauaccaauguuuucuuacuuaaaauccagagaacauuguuucccgcuccucucaagucuggcuucccucauuauggugucuggguuuaacaagaacaaacaccucccagaaauauccucacauuauaaacacuagcugagccuucugcaaagggcuaauuucuccguaaaucaacuaacagacucaucagaccacuuuuguuguuguugcuuugcugguuuuaagacaggguuucucuguguagcccuggcuggccuggaacucacucuguagaccaggcuagcuucaaaccagcuugagaccagcuugccucugccccccaagugcuaggacuaacggagugugccaccaucucuaccagccucaucagacagcuuuaaacucauguagucacucaaauuuauguauacuugaggcauuaucacagcugaugaaucucuuaaacacagacccuaucacugaaaaacagguucuuggagucugccugugcgugugcgugugcgugugcgugugagugugcgugugugugagugcgugugcgugugugugugcgugugcgugcgugcgugcgcgugugugugcgugcgugcgcgugugugugugugugugucuguguguaaaaaaaaaugauuauaagggaaaugaucaaugcuauaauggggacacaaguggaaaguggcuaaaacuggaaccuuaacucagcagagcaugcuggagcuuucugacuuccuguaaagcaucaagcacccgaggacgcucaaaacugccacacuucccaaagggagguacagugcucaguggaaauucuucucgaaggaugaaacacucuucuuacuaguuguucagauaccuacccucaguuaaaauaguucaugcugagggcuucuuucuuuuccuuucuuccuuccugacuggucucaaacuuacaaaaauccuccugccucugccucccaagugcugggauuaaaguaugcaccagcgccaccuggggaaaacugugguuucuuaaacauuauuguagcaugaaaugcuaaugauccuugguaacagcaacuaaacuucagaauuuuuaaaaaucaaacaauagcuaaggucuacuacauaauucuaguucucguuagaguuacaaacacaggugaucauccauuuuccugcaaaaugaagaaagccuugugaacagaauuuaccacagaugagcuccacuugcuggacucuauucaugcugcuaaggguguccauuaaagggucccuucuaucaguugccuggucguucuugccuuuguucucauaagccagaacuguaucacauucaucugucaggaacaggacgucuaguucuccauacauuuucuuuaaaaaaaaaaaaaaaaaaaaauuuuuuuuuccaguucccccauuuagaaugucauuuucagaaagucaaauuaaggagaauaaauaauaacuuuaaaauuuuuuaaauucacaccuagaaaauuguaagcuucaaaguugacuuguugaauuuauacuuuuggcccagauuuuuuucagaaaucuuccaacuuccacagucuauauacucugaauucaaaaucuacuaguuuacuuucuaagcaauucuaagauggcucagcgguuaagagcacugagugcucuaccagagguccugaguucaauucccagcaaccacugguagcucacaaccaucuguaaugagauccagugcucucuucuugugugucuaaagauagcuacauuguacucauauaaauaagucuuuaaaaaaaaaaggaacuucauaaauuuggcccauaggaaaucaguguccccugaacucagauaucgauccuugaauaagucucgcagugucuacucugugaacaucaaguggagccaaacacucaccauacagucuugacaggugcauaguuugcugcgccaguucaagggccaauagguggcagcaucuuucuuuacaaacugcuuggcuuggaguuccugaagucugcagcuggacuguggcucaguuuugauauuuucuuucuuaaacacugucugaaauaaaauuaaguuuugaagugaguuuuuguauuuuuaaguuuaaagaaauaauugugugugggugcuuugccugcguguguuucucaccauggugcccaugaaggcuguaagagggcaucuggaaaauguggguucuagaagucaacuccagguccucuggaaagcagcccagugcgugcgcgcgcacgcguucucacucucucucucccucucucucucucucucccucucucucucucucucucucucugugugugugugugugugcgcgcucacacacacacauguguacauguguaagaaggacacugacauucaagagucuucuucaaucaauuucucuacuuuauuuuuugaaacagggucucucacugaaccuaaaacucacugauuggcuacaauaucugucaacaaacuccagggaucggcucaucuccaacaucccaacacuggggugcagaugcauacugcacaaggcuuuguuguuucagacaggcuaucacuaugcagcucagguuaaacuagaacuugcuauguuaacuaggccagcuucaaacucacagagauguaccugccucugccucuaagugcugggaucaaagugccauccaugccaaccuggccauuuuguuucaucaccuggguacuagagaacucaaacccucaugcuugucuaucaagcacuuugugacugaggcaccucuccagcccaugcccagcaacuucucaugggucuggggaucaaacuccagguccaagcacacagcccccaguuucacuugggauguggcaugaaugucauacacuaccuggaggucagacucagaacuagagcugcugcagggcucguucuucugcucagcuuucaccucguugacagaaucccugccaugcucgggagcauccucuuucaggccauuaucuuggggagcuccauuuucaggcuugcuaacaucuucaucucccaugccaguagcauuuggcagcagcccaucaucuucagcagauauccuggugacuguggguucaacaagacacacaacaaagcuggccauaggccucucagaucaagaaaucacauucuuaaaauaucucagacuaggaaacaaggcaaccugaaccucuguaacaagaaaugaauuaggggcuggagagcuggcucagcaguuaagagcacuggcagcccuuccagagguccuggguucaauuccuagcaaccacgugauggcucacaaccaucucauaaugaaaugauguccccuucugguaugcagguguacaugcagauauacauuaaauaaauaaaacuuaaagaaaaaaaaagaaagaaaagaaaugaauuagcacucuuaccaguaugccugccuagccaaauaaaugguucauuaaaaaauaugcaucacuacauaagcaccuuauacauaaagaauauacuacaccuguuaaaagaagggcuaacuaaagaaccaaggcagugggaaaggauuuaacuauuaaaaaaaaaaaagaaaaggacaauucgaaaacacgagcuuucaguugcaaggagggucuggagacaaacagcaaagaagcucaugguggguaagggugcugcaaucuagggcacagcaccugacacggagagaaagauaagaaaaacccagacugaggacccaugaguuugaggccaaccucugugacagagaaaccuuacuuugaaaaacagccagacagugcaaggggaggcugaguggaaagcuccugccuagcaccuagaccugagggucgggguuugauccuuaggacgacagacacaucagaaccaaucagccaaaagcaaaaaggaaacuccugugggaaaugcauauagcucaaaugucuguaaaaggggggcacuaucugggaggagaaugaacaggaagagcugugaccgcagcagcccggagguugcuaguggagggagaucuuaggcacagcuauagcuuguagcuuuuauguucaaaaucccuaaaggugagcccaggaaaucaagauggcacagcaggaaauacgcccaguuaaguggaaucaucaaauagagcuauccccaugacaucuugugcuuuuacuguuucucgguguguuaccucauaacaugucguuuccccaucuucuaugggugggauacauacacaucacaaaauauguaaguuaaaagccaaccugcagugcugugguaucaaaagguauggcuuuuagaaggugacuaggucacagggccucccaucauaacugcaauuaacauuccuaggagacugcauguucucuccauggcuugaagacacauguaugaagaauggccuucacauccaucaacuugaccuuuacugucagcuuuaagaacuaugagcaauauuuacccauuauucaaaagucuaaugcauugugucacagccauaagaauuaugaugccaauccuuucaaaacaugucuuauauuuaacuacguacuuuaguucuauuuguucuucaaaaucccacccaaauacuuucucuaacucuggucacaucaauacucugcaucauaguauucaaguucacauuuguuccugguaggcucccaaccaguccacuggguagaagaggggcauagcuggauguuucuagaucucucuaaaguccaguuagaaauagcuacuaaaaauucuugauugaacacagagauuucaugagcacaaaccugugucacaucaaccucacagaaacacucacucaccugccaacugggcagcauaagcccacaagaaagaacagcgccucauacaagccuggcacaccaucuccuggaaauccccacucucagggggaauggcaccaagaugcuguggauagagaaacccagauguuuccugugaucgccaaguccucuaugaugugugcuuuuauaaacagagaguacaagaauacacugacuacauccucaucaaaaggaauauaaaauaaaacagaaaaauacuguuuugagacagggucucacuauguaagugcuggcaggcuuggaaauugcuaugugaaccagauuggccuugaacuuacagcugucagccagucucugcauuccaaguacuaggauuaaagguguguucuuugacccagugagcaauuucccagccccauuuauuugagacagggucucaaguagcugaggguagccuugaacuucagaucuuucuuccucacccacuaagugcuagaauguugcuuacccugccauggaaccagucuucacagaccacacacuguaucaucucaucuggaaccugacccaaaaaaaaaaaaauguuaaugauuguuuugaauucuagggaacagaaguaaaucuggcccacagcagaauuaaaaauuagguaauuagguaauucucuagcaacucugaggaaagucaagaggacaggcccauucuagaugaaguaguuuccaagugagcaucaaagcuccuugacagucaacacuaggaaaacugcaccccaaaguagagucuggggggugauuuucuauuuaucuuaggcuuucauaccaacuaguuaacauuuuacuguuuucccaucccuuuacugugguguuuuauuaagaaauacauacauacauacauacauacauacauacauacauacauauauacaauagaaguuuuguuuuguuuucugccucuuaauuuauuacuguuuugagagggagggagucuucuguuucaaaaguacugaaaguaaacauuuuaccccauucuuaaaaaauauccaguucuaaaagauauuuguuaaagacacuucaaauuuccccuuauauacaaugugauucaauaauuaugguuccaagugauuaaaaagccagaaagguggaaguuaacuccucuauaugcacaaaguacucuuucagauccauaaauauacaaacaaaacauugccuaaggauaugaaaagccagcacagagaucauuguagauauccccaaaacucagaaaacuguguaaucucaucaugccuagggagaugacucagugguuaagaacacuugguauucuaacaaagaacccagcacccacagaguggcugaagcccugcugaccuccaugugcaccagguacacacuugguacaccugcauacacauggguaaaacacacauacauaaaauacagaaaaacaauucuaaaggaacuaauaauacaugguccuacgucauuuaucugccuggcaaggcuuuaaaggguugauaauacauggagcuaagaguguaaagaaaauuguuaagggaucccugcagucaaagcugaguuuaaaacaagacaagacuacacucuaagacugucucacuuuuuugccacgauggcacugaaaucaaaaagugacuaucccccaccccaaagccaaagccaaagugaaggccuugaaagcccaaauggguguguuaaaaagcauccacagcuacaaaaagauaugcaaugccacccaccuuccugcagcccaagauccaaauaccaucaaaagccaggaggaacaagcuugacuucuaagcuaucaucaaacuccccgugaccacugagucagccacaacaagaugagagacaacaacauacuuguguucacuguggaugucaaggccaacaggcaccagaucaaauaggcuaugacacugauguggccaaagucaacauucucagaaggccuaauggagaaaaggcaggaagagggcuauguucgguggacuccugauuaugaugcucuggauguugccaacaaagcuggcaauugauuggcaaucuaaaccaauuauagcuggcuaacucuacauguacacauuuuuuuucaccauuaaacgaaaggaauggagggagugaggaaggaagagaaauacuaucaaaauaacuaccacuggcugaacucuuuugguagucacaaucacaauuuuaaauacagacaagaguauucuuagacccaccaacagcugugcuuuuauauaacaccuagagugcuauauagaguuagauaccuguggauggacacugaagccuguaaggggccaucuagacaguaauguucugccacagaacaguuaacugacuuauggaagcuacaaggcaggcuuacauuugucuucuccucuuaucuuguagagacaggaucucccuauguagcccugacuggcuuggacuucaucaugugggucaggcugaccuugaacuugugaaugagugccagccucuaucuccugagagcuaagacuaaagaagcugacugggaaaagcuaguugcagaagugaaugcacagaauaacucagggauuuuguuuacacuuguuauugaaauuuuaaaagaagccuauuagcauagcuauuuucuuucacagaggaaagaagcugagauuucuuagaaaauaucugagggugggaaaagaaaguccucuccgaaauuuucauucuaugguauacaaaaauaagcaaacaaaaacuaaaacaagcagcaauaacaaaaccccaguucaguuugaguuuauuuuaaacuucugauucucuuaccucaucuucaggaucaggauaaggucucuuacaaacgcaguauaauccaaaaaaguugucauuguacuuauugcaagaauuuaccuuugauuuguccugaaagagaauaaauuucaguaccuauacugucuaauacuaggucaugcaccaugcaacuuauacauuuaagaaauccccgcacuaaguaucuuccuacaagcuagucauuaacuuucaaguaacaaaaaaaaagucacuacucaacaaauaauuuuuuaagcuacagagacaaaaacagaaaaaaaauaccuuauuuucucuaucuucuuuguagcaacugagaaaauuuuauuuauauacucauacaauaaaacaaaaaaaaaaucauauguaugaccagcuugucuaggauuucaauacacucuuuuaaaaagagucuucgagcugggcaugguggcgcacgccuuuaaucccagcccuugggaggcagaggcaggcggauuucugagcucgaggccagccuggucuacaaagugaguuccaggacagccagggcuauacagagaaacccugucucaaaaaaacaaaaacaaaaacaaaauaaaacaguuuuugagacagggucuguguauuucuagcuggaauccagggugaccuugaucucugagauccaccuguuucugacucggcaguucugagaauacaggugagcaagcaccaccauacuucacuuccuuuugguuugggcacuugaguguaggcgccuguagaggcgaaaggaaugauucccuuggagcuggagcuacagacaguucuacacaacugggugcuggaugcuguccuccagaagcacaguacaugcccucagcugccaagcccucucucuaacccagacauuuccuuaaaugcaggagugaauacuaagacuuucagguuauuggaguacaaaaggaggaaaagugauuaucaaaaauuagucauaaacuuaaaggaggaaacagguuucagcaauuauuaaugaugaacauggcguucuccauccuucuuccuucaucugcaguuuccuacagcuucugugaaagcauuguuugauuguguuuugcagacaaguucuuagcacagcucuucacucagccccaugcuuugcucuagaaaccucagcauggcccagguaaagaucagccuaaagagcaucuccucccagaccuggacuauuaacuauaaucuauauuguagacucucaacacauuaucuaguguuuccaaccacauaaaagugaaaauacucaagagaaaauguuuuggaaaauauuuugguggguuuuuuuuuuguuguuguuguuuuguuucuuguuuuuuguuuuguuuuguuuuuuuuuuacacuuugguaaauaccaaccucagcucauuaaguacacuuaaaaaaaaaaaaagauuucuuuuuauuuauauggggcaggugggguccccuggagcuggaguuacagguagcuguggaugcuggaacugggaagagcaaucagugcuccuagcuacugagccaccucuccaucccugcucccaaguacauuuguaaucacagugcuuacuuacaggaaauaauuugcauuccaaguuuuuaaacuugcuguuuccacaaucacaacgaaaauuucuauuaaaaaaaaaagaacauauauuuacgucuucuuuugaaauuaaucacucuuucaguaccaaccauaacucccucugacucauuccuagacucuaaauggcagccuuucugauguucgugucucuuguuggaguuuuccaacaauaaaacagauaaauacaaauuaccauucuggacaucacaacacauaaaaaacaaauaucuguaucacucacacacacaaacaaaugagauaaugaaaagaugagaaguuugagccagucuccauaauuaaaaggccuauagaaaaaccauucucucccauauuaauuuuuaccaacacacaauuauucugaauaaaaagcaagauuaagcagccauugagguugcgaaagaaucuaaacauucagaagacacucaggaaaaagcauuaccuuuuuguguauaguucaaacaguuuauggcuuccaugacauucguaacugcaagcuagacaaaucccugcgggcucuucucccucuggcgugcaggugcugcaggcguacagugcuugucuccccacugagcccugagacaccagcccaaaacaaaagggaagaagaacagaaagacuaguuaaccaacaaagggucaaaaccacuauuucaagccccagaucuauucggaugcuuagcuuuauguaaauuuuuuucuuauagcaauaggaaguuuaaaucugugaauaacuugaucuguuuaaucauuuuaacacaugaaaauaaaggugaguuuacaguuuacagguuuaaaagauuaauacaccuuuuuuuuuuuuuuuuuuuuuugguuuuucgagacagggguucucuguguagcccugacuguccuggaacucacucuguagcccaggcuggccuuagcucagagaucuggcugcuucggccccugagugcuggguaauccgugugccaccaccacuucgcucacauuucucuucuuuuuuuaaagagguuuuaguuauuuauauuauggauaugaguacccuauuugcacguaugccugcauaacggaagagggaaggcauggaccucauuacagaugguugagagccaucaugugguugcugggaauugaacucaggaccucuggaagagcagccaaugcucuuaaccacugagccaucucuccagcccucacauuucuuauuuuagaaauucuuauaauucaaccauacagaaaaauuaaucauuuuaauuuggggagagauguauggggaagcaucuagaaguauaauuaugcccacuacuuacugucaaguaaugaaguauaaaaaagggcaaguguguucaacagagacaaauguuuuaaaauguugaaggaaaaauagcaaaacuuagaaguguugguaaggggauucucagcacacagggccgugguagaggggacagagcacagguccauacuggugcagcaaaugcuuuacugagccugccagugaacuaccacacacacuucuauucuauuucaaucugcuccuaguuuacuaaagaauuugccgggccagcgagauagcuccguggguaaagucacuggcucuguaagcccggaaaccuucgguccaccuccagaaccuauacagagguggugaggacaaccgcuuccauaaggcuguucccugaugccugucugcauaugcuaugugguacaugugcccacacacaucaguaagcaagcuuguuaaaaucaaccuggaguuagagagagauggcccagagcuuaaacgcacauacugcucucucagagaacuagcauugagucccuaguaccguguuggcagcgcacaacccccugcaacuccaguuccagggggaucagauucuucugcccucaagagcaucugugcgcacaugcacauagccacacaaauacuugaaaaucuaacaaaacaaaagacugccaggugguaguggugguacacacuuuuaaucccagcauuugagaggcagagggaggcauauuucuaaguuccaggacagccagugcuacauagagaaacuccgucucaaaaaaacuaaaagaaaauaauuauuauuauugauauacuuauauagagauaugacuauuuaaaaacaaaaacuuaggaccaggccuuuaauccuagcacuugggagggagguggauccuugugaguucaagguuagccuggccuacauagugaguuucagaccaauuagaaccacucaaucugacugucucaaaaaacaaaaacaaaauucaccagaaacaagacuuuaagccaagcauggugguacacacuuguaauaccagcagcacuugggaagugaagauagucaaaaauucaaggcagaucugagggacauaagauccuacccccaauuuuaguuaguauuguauaaaaauaaguauauuaauaaagagcuuacauacagacuuaggaucuuucuuucuuucuuccaaugaaggggugggugugugguuuaauggucacaaugaaaaagagaaauaaaaaggaaaggacaugccuguuccuugggagguugaaggaaaaaguuuacuauaaaaggaagagcucggaggcaaggacuuuuaggagaguccagaggcuaaagauucugaacugggcccugggagaagagcaaggaaggguaggggauagggauggggagccaggugcuacagccaggagacccaagagagcugcauaaacaaaacggcugcauuauuuagggaagggaagcugggggaaggguagcccggcuccugggcuggagaagucugggaaaguggauuggguaugucugccaggagagucccggaagggacagaagggcagggagaaccaggaggccaccaucggcuuugauauguuaaauaggcacaacagcagaguccaggguuugaaaccuaacaaugauccuccaaauuuaaauaccagcgaccaugcugugacuacuucugggauacaagauuuauucaacaauuuuacagugcaaacccaacuuggucaacgaagacaacuaguauuaugacuucaguccacgccacaccauaacuccaagucccuucacuccuaccccagucucccacuccacccaugggcauaguuagccuguuuccuuccaccaauucucauccuuguuguuaaguuuccuuccuacccacccuuuuccacguuaguacuuaaauguacaguaugcgucacuaaacacuacaucucagccccucaaacucucucguucaaaaggucccacaaaugccaaacagauccuuuucuccucuuggcuuuccaguccccagagagaggggaugucacauagcacauacacacgaaacuucauuuaaccagaaagggggugaggugggggcagcuagcaguuaaacuagacuacaggaguguccggaagccgaaccucaccggaagauuuucaaagccggcccacuuucccuuuacuuuuccccaucuggucccuaauuaagauucuugggcggugggagaaguggagcgaagaauaucuggguuugagagaucacgagaacaaccucgugaaaagcaggccaccaagaggcgacaacuggaggaccggagccugcaguguaccaucagcggaaccgagggacagcccugguggcgacaagcugaggaugaaauggcagccgggccggggcuguagaagcacagaguaaagggccgccgugagugggcccggccgcggccagcgggaaacagacaggacggcgggagcagccgggccgcgcgcaccugcgaguaggagcacuucuccgagucgcugccgcccaggacggcgcacgccucauucuccaacuccucgucuuccucgagcacguccaccagcgacaccacgggcuccagcuccgccuggcacucgguggggcucucggcuccggccauccucaacugucaccgggcuccgcugcgugggcccaggaggaggcgggaaaaguggccgccgccaggggcgucgcgagaaggcggggccccg

SEQ ID NO: 6797 - RNA, 646 nt, Mus musculus
gcucuucaggucccaggcgcugcgggagccgcggguuaccgugcagacauggccaagaccaagaaccacaccacacacaaccagucccgcaaauggcacagaaauggcaucaagaaaccccggucgcaaagauacgaaucucuuaaggggguugaccccaaguugauaaggaacaugcgcuuugccaagaagcacaacaagaaagaccugaagaagaugcaggccaacaaugcaaaggcagugagugcgcgcgcagaggccaucaaagcccuggugaagccucaggccaucaagcccaagaugccaaagggccccagccccaaacucaagcggccggcuuucaucgcucacccuaagcuugggaagcggauucgaagcuacauggccaaggucagaggcucugccaaccgaagccuaagguccaaaccaaggcaggggccaaagcuccagcuaaggcccaggcuucagcuccagcccaggcucccaaaggugcccaggccccugugagggccccauagaaaaggcucugccagugugaagacagacggacugcugugacauaccuccccacacacuauuugcagaugaccaguguccuaugcuguucuuacaaauaaacucaggcaagaucuguuaaaaaaaaaaa

SEQ ID NO: 6798 - RNA, 9810 nt, Mus musculus
aaauguuuacaaccucaauuuuauuacuucaaguuucucccacagcacugucacuggaaggaaaaaaacccacuggcaaacguguuauauuuuacaauacuuuguaaaccgauuaacacucagaacccucaguaaaagaauagugaauuuuucuucccagccaaaacagcagugggaauggaaauuuuucucauuggcugccuuccaucacugaguguuucuucaaucugaguggauuugucgggccuggagagagcuggggaaauagaaaccuaucuuauuggcugucuucagucacgggguguaucuucaacuagaguggauuugucgggccuggagagagcuggggaaaucgaaacuuauuucagcagcugucuucagucacugggugugucuuccugcacaguggacuugacgggccuggagggaggagaggaaauugaaaccuaucucauccucuaguuuauuuacaucauuggguaugucuucuuugaccacaguagaguuuuccacucugaaaugaacuggguuuuccagaaacgaauccaagauccagcuguugguaguaguggggguggggaugucaguuggggucuucaggaaaucuucaguggguagguccagaacagagacccuacucagaugccccuaggccuaggaggcaaaaguccucagaggcugaagggaagccaauguacaggcucucucagaagccgucuaguucuugaaaaggcaccuaucuauaaagguaauggguuauuuuuccuaagcuggcgcaaugagauaauucaagucagauuaauucuauauaggcagauuuaucaggaagcugcucucaggcaagaucacuggccacaaggaccaaguucagggaccucauuauggugauaggaggaugagacagagacaugugcaugcaccaagagagaacagaaguccaggaagagacaguuagacaccagcaugucuggaccauuuagggaagaggccugggcuuauggcagcccagccuuugggcuggacaguucaaggguugggccaggguaugccagggagggacugagggaugcugggagaaccuggaggccaggucuggaaccuggaggucaggucugcuuugacaugucaaauaugcaccucagucucuuguccuugggucugaaaccaaauaguggguguguuccaagaaggaagggaccccaggcccuauuagucucugaaggcuagagguuggugaagugagcuauaaggguuaagaguaauguagucagccugccacuuguaagcagcuggaccaggcugguuuggugccuaaggucuuugcuauggagccuucuggccuggagugaaucacuugcacugucuaaaauggcuccuuaaucccuacaagaagcaggaucucagacccuagggcuggggccaagcccaguguggccaccaauucugagcagccucucucuccagccgggagccauucaguguuugcagguucguugguggaauccagcucuuggucuccaaucucaucaaaacuccaauucacuccauagauucgguuccuguuuggaaacuuaacugguccucauggcguuuucgggcacagggacacugguggcuuccauugucuccaagaugacaucuucagcagccauggucaaagcuggaggggcagucucuggcaccauucuagcugguucgaagggugagugcccauggaagaauggagagugggcugggggguggggcuggggacagcuauggagcauguagcauccugaccucagagcugcccacugucucacaucccacauagucuugacucugaaaaauaccugagggagccaagacuaguguaaugaggcugggucugagucccuagaaacucagaccuaccugcuucacagggucguccucuggaacuuuggucccuggggucuggagcuggguccucccaucucuucucacugacucaccaacaagguucaucuuuuguggaacugucaguccugcuggcuguacaagccgugguauggacuuaaauaaaguuagcuccuuccuccagcuugugaaggccucucugauuuuauuuauuuaauucccuugcacgaaucuucuuucucagcccccaauuuccagccugcuguggagauuuucuuuaucauuugccugacugaagagggcaauggauaacauucucaauggauagcauuagggcaccccguuacuuuucucacacuuagaaaugaggcucuuaaaaacccacccuaagccgggcagugguggugcacaccuuuaaucccagcacucgggaggcagaggcaggcagauuucugaguucgaggccagccuggucuacaaagugaguuccaggacagccagggcuacacagagaaacccugucucagaaaaaaaccaaaaaaaaaaaaaaaaaaaaaaaaaaagcaaacgaacaaacaaacaaacccaagaacuaaccaaaccaaccaaacaaacaaaaaaacccacccuagaagaagauaaaaaaaaucagcccuucuaaaucuauacagaaucuuuguguagcuucuuuuucuuucugucacccagggcagacacucucagccccccacagcagucuuuucaugaugguuugagucccuucaugagggauacauuucugaccccucucugaucugugauuuuacccuccagggcucauccuguuaacacagagugcccugggcucugcaacaucugcacuuggagcacugaagguuggcaccauuuuaucuggguucucugccuccaccuuggcugcuucccccauuggagguaacuggcccugcauguccaucccacacuccugcuugggacccaggucuacauggagaacaaugacaagccaccucucucauuccuuugugcuuaucagggauucagagggauaggaaauuuaucagaggagguaacuuaagaucaguagaauguuagugaauagaacuuuauugcaugcauucacaucuuaauugcuagccuauuacauugguuaguucauugaguuuuucuaaugaccucagaggaggguaacaucucucucucccacucccccucccccucucuacuuccccucccccucucccucucucucuccucuuggaauggaggcucacucuauagcccaggccagcucagagagcacuauggauguagcccaccaugauugaccuuaagcuugucacaagguguggccuuguuggagaagaagugucacuggggguagucuuugaguugcaaaagcaucacaacuaccugccuggugcccugcacccugucacaaugauugcuuaucccuaugucaguggcccucagcccuaaauucuagagccaguacucugugcugggaggcuacacacguguucuauguauaccuacuugacuacuggucuuuuuccuuuuuuucauagaagccagggcagucacucaacuaccaacguguauggcaagccucugcuuuugucuguuuuuuuguuuugcuguagaggaaccugcuuuggugggcagggagaagaaaagugacuucagauuuuccuuccccgcagcaggcaaagcagcaagaaggcagagaaaggaaggacaaagcaaaaucuaccugaaggguuuugaguucuccagaggcaagcugucaggaccugcucagggcagagcuaugcccuggggucucucucagggauaggcacacagggcucauuccuucuugugagcuugguggugguggugggggggggggauagagaccauucucacaggauuguuuuuucuuucuagccaaggcuguuguggcugugcuugggggaggugagugacuucacgcaaugggugcagguucccuccuaccucucccuguaagcaucagagccaagacaugccccaucuugucccaguuggcugucccagagguaguggggcaaacauggugaugaaauagggaacugguugaaagaaggaacuagaaagaaggaguguagugguguagaggcaggagaggccacaccucccucagugcccuuguccuccugggagagcagucaccuugugaccuggugcaugauuugaauuccuuugagcuccuaauuuuuacccugaaagauaaaacggaacuguuuaucccauuuaguaauuaccaagggggcucuaggacggaaaaagcacuuggaauguacuagaguuugcuguguguuggggucugagagucgucucacauaccacaugaacacugaucuuacucggagaaggcuaguguguugagcauucaccccaggucugauugaucaaggccucagacaagacuuaggaucuaacugcuaucuggaacuauaauccuacagagcucucaagccugaaauccacaaguaucugugccuaguuauuuuaccaaucagcauugaggguuaggagacuucccuaggaacaugucucucuugcacauuuaucccuuucccauuggguauggguaaucaagugugguaggggacuugccuugccuaacuuucacgucguagucugccaaccaggaugucaguuacucauguucaugaauauuucugucaguaggaugucaauucuccgggaggucuugggaacuuaaaacuuuuuauaacccccgacucaagguggaagucuuauuucaaauggcuacuuauauuguguggauuuccuauuauguuggggucuauacccagagcaacuuauauuggcaaaaaccauaaaagcacauagccaugugcaggaagugugcuguagcuuauugaggcuacuuauacaaagcaguucuaccugccuuccauugugauugcauccuaaaaacacugaagcauagaacauuacagaauaugcaaaaauugggcaugagaaaguacuacuaguaacagcauaguagaaaauuccuuugcuacaguaaucagagcauaggagaaaguucccuugcaacauugggaacggcuuaaaaugccuggcuagacaagcagcaguuacucaggccuaaacacucagcagucacuaucagccugguggcuucugacauggacccaagcagggcugggagaugccuccuccagucauuccaguuggguaucacuuauguucuuugucugagcaagauguucuguagaaacacucauucagggcugcucuauucuccccacauuacuccaagacagacauugagcccagcaagugccuuucugaaggucuugcucccaauccuagccaggcaagaacuccacccucacugacuaacaucuccucuccuacugugcucccugaauccugacuaccagcacucuaguucagagagggccucuugccuugcccuucaccuuugcucucuaggcuucuccagaguuacagggaagaggagaagcccuggcucaguccccucugcccauucucuccuucuccagaccccugggaguccuucaggcuuaacggaguauauuggggaaugggggaucccuguccccaagcccacugacauagcuccucuucccacagccaugacaguagcugcuguaccaccugcgcugagugcugugggcuucaccgccucaggaauugcagccuccucucuagcagcuaagaugauguccuugucagcuauugcuaauggggguggagucccagcugguggccugguggccauucugcagucugcugguaagugucauggcaggaggaccagagggaggacaggucauagccuacucucuccguuucuuuuccuucuuucugguguuuaccaggggagguggaggagggagaggauaauugcaggaugguuuaccugggcuuaacucuccccuuaggccuagccuuuucccugcagagggggaugguaucuagauggacuauuaccuaguguuuggguauggaguguccccugcaaaaaugauagugcuaaacacagacuccagaaauuuugggaaagagcagggauaccguggagaccccguucuuccagacauccgggugguucuggaaacucugcuguucucugacuccuuaguuuuauuucaucauacauuggucaucgucugugucuucccaggagcugcuggacucuccgugccaucuacugucaucgugggcucugcagggucugccguuguggccagugucaugaacaucugugagaguuucuacccuuuucucaugggaucagagguggcagacauggcgacagagguggcagauauggcgauagagguggcagacauuucaacagaagaggcacugcccaacuugucuaacacagagaaggauuaauuacccccaggcgacaaucuccuaacacauauugccuagguggaaauaaauuaaaccgaguucuugccagucucauuguuccccuuucugugugcuacuugcacaguaaagguaggggccugagcucucugcuaccugggccugagguaggcuaggcucaacucuuccucccuccauguugucucagaccaacaugguguaggugcaugcucggcuggaaugcaucuaaaugugaaaacagaagcugcucuuugcccugcuacugauccauaacucugagcaugccaccuccuucuuauacagaggauaaugaggaggugaccuuccugacaucucagauaccaaccaggauggggaucucugaguaguugugauggcauccuucuaugaaccacucaucucaaagccagaucugguuugcauucacacccuccuauucacacccuccuccccacuguguauccagggauuauugcugguagccuagaucgaaaccucugucugaaugagaugacccaacugcaaugccaaaccucucccuauccuucaauuauuccacagcuccacuaaagaucuugaaugucacccuuuguaugccuccugcacagcccugcacagagcuugacgagaagaaauaguuuaccagucaugcuaguuaggggucagucuccacuucacacaugcagaauggcucuagcucugagggcugugggaggaauuucccugggacagacauagucuucauccucccucuaagaaagcagucccacuacagcaguguccccagacccagagguccccacucucccuuucaugacuuaugccuccuucucaagcagugcccuggauaagaggauaauucagaacccacccuucucugaaaauccucaggcccucaucauucuccucgagacaggauuuuguacccaccagcugaccuagaucgaaugcccacagauccugagcacccaccuuugggucuggcagagcaucgcugccagacacugcagcccaguuaaaguggguuuuuucuucuuuguguguguccugacugggacuucaauacuggccaggacaaagaggcucugaacagguuugggcagacccuucuacaaguauugagccagcugcuaggcaaaccccuaggaugagauagguaaugcaagagacccaggaaucccacacugggcucccagagugcguaugugagccugacccuuguucaccugagaugcagacaccauaaaaucagcaagcagucaucuuugauauugccauucaggcaccccagauaguagaaggaaacuucagaaguuagaaggguuugaagauaugaaugggucccaauaaauauagauugcucaaauguauccuucugccucaagacuucuaggugucaguguggacccuguccagcacugcagaaugugacauauaagcaaugacucucaggcuugaguaagggaguagucagguugcuucaacauacggcagggguuuaugccuccuuuccauuugauagauauuauagaugauggugaccuguuuugauuuccucuuguuccucagguaccagugcauucccagugagcccagugaauucccuggugguuuucugucagccucucagcaguacagugagguagcuacaggcugcucauagcccuggaugugcacagccauugauagggaaggaccaagagcucagagggucacugucuuagguaccacucagcuuagccucaugacagaaaccucuuguugcccuaccuugaauaagugauaaagugagguccacaaucccccaccaaagcccucauaccacacagauuauuuccauuaaggcaggguccaccuacagcccucugccuacugacugugugcuggccaaccuguuaccucccucugaucuccaggcugaggcugacugggaaagucucaaaccuugaaaaacucccagcccagaaccccaaucaaagagccaccacagcaaaguuaggaacaccagcccauauacuuuguuguuuucaucauucuuugacaucagugaggguucugaaggugccuuuuggaacuucaucuccugcguagucuguacaggcuuugaguugagcugauagaagugucaucuccuaagcucagagcaaggcuccaacagcugccccagcagccccuaggauggcauuuguugauguggagaguccaaggaccccugggaaggagacagugcagugacaggcagugaccugaugcucagagaugcccacccaauuucuaugggaaccuuagggcuuugcuucagccagagcuauuuaaaaugaaccagaaggagaagacagaugcgggccaaguggaauauaggacagagagcuauccacagagaugcucucucuauagcaggacagagggguacucauuguagaaaaaaacacucagggaagauucagagcacaaguagcaugccucagacuccucccuacuuuagccauucagcaccuuucacccaaagcccacacacccccaccuaacucagaauaaaucaaaaaguagggacagaacuagaagacacaggucacuuaagaagguggggcuggagggagaggaaaggugucaccauccuugucuuggacucuggucaucuugccuggccugacacuuaccugcugauuggaguguggcuaccaggcuuccugcugcaacuccaccuccauuggcaauugcugcagcagacaucaucuuggcugcuauggaggcagcugcaaugccugucccagugaagcccauggcagccagggccacaggugccccugccacagccagagcuguagggagaggagcugggugagguaggcucagggaaaugacccacccaacaauucccugacuguuucuggggacuuucuauucugaggagcauggaaggggaucccaaaguaaagaagaaggggagcaagguggaggcaaaggggucaguggaggaugugacagagccgugguguucccaggcuugagaagaaucauccuucacugggccugggguugugaggguuaaauacaacccugcaguguucagcagcugccgcucccugucuucuccacauucaucuacuugcugcucaucauauaugaggccuggaggggcagcugggcagaaaucuuaagcucauuccuagaguagauuuagcacagcccagggcccugcucugcacccaggcagcuccagaauccagcaguagcaggcagcaggaaugguacccaucuaaagcacaaaugguaccccaccaccucacccucaggagcagagacaaaccuccuccuauggcagagccaaacaguguuccuauagagagauggauggauagagaagguuagaguuuguugauggcagggauuucuugguggcuuugcucaggcauccccguucccagcucacucggggcaggggggcuacucacccaacauguugaguccuccugguagcagcagagcauaggaagaacuuagggagug

SEQ ID NO: 6799 - RNA, 6074 nt, Mus musculus
uguaucuucaacuagaguggauuugucgggccuggagagagcuggggaaaucgaaacuuauuucagcagcugucuucagucacugggugugucuuccugcacaguggacuugacgggccuggagggaggagaggaaauugaaaccuaucucauccucuaguuuauuuacaucauuggguaugucuucuuugaccacaguagaguuuuccacucugaaaugaacuggguuuuccagaaacgaauccaagauccagcuguugguaguaguggggguggggaugucaguuggggucuucaggaaaucuucaguggguagguccagaacagagacccuacucagaugccccuaggccuaggaggcaaaaguccucagaggcugaagggaagccaauguacaggcucucucagaagccgucuaguucuugaaaaggcaccuaucuauaaagguaauggguuauuuuuccuaagcuggcgcaaugagauaauucaagucagauuaauucuauauaggcagauuuaucaggaagcugcucucaggcaagaucacuggccacaaggaccaaguucagggaccucauuauggugauaggaggaugagacagagacaugugcaugcaccaagagagaacagaaguccaggaagagacaguuagacaccagcaugucuggaccauuuagggaagaggccugggcuuauggcagcccagccuuugggcuggacaguucaaggguugggccaggguaugccagggagggacugagggaugcugggagaaccuggaggccaggucuggaaccuggaggucaggucugcuuugacaugucaaauaugcaccucagucucuuguccuugggucugaaaccaaauaguggguguguuccaagaaggaagggaccccaggcccuauuagucucugaaggcuagagguuggugaagugagcuauaaggguuaagaguaauguagucagccugccacuuguaagcagcuggaccaggcugguuuggugccuaaggucuuugcuauggagccuucuggccuggagugaaucacuugcacugucuaaaauggcuccuuaaucccuacaagaagcaggaucucagacccuagggcuggggccaagcccaguguggccaccaauucugagcagccucucucuccagccgggagccauucaguguuugcagguucguugguggaauccagcucuuggucuccaaucucaucaaaacuccaauucacuccauagauucgguuccuguuuggaaacuuaacugguccucauggcguuuucgggcacagggacacugguggcuuccauugucuccaagaugacaucuucagcagccauggucaaagcuggaggggcagucucuggcaccauucuagcugguucgaagggugagugcccauggaagaauggagagugggcugggggguggggcuggggacagcuauggagcauguagcauccugaccucagagcugcccacugucucacaucccacauagucuugacucugaaaaauaccugagggagccaagacuaguguaaugaggcugggucugagucccuagaaacucagaccuaccugcuucacagggucguccucuggaacuuuggucccuggggucuggagcuggguccucccaucucuucucacugacucaccaacaagguucaucuuuuguggaacugucaguccugcuggcuguacaagccgugguauggacuuaaauaaaguuagcuccuuccuccagcuugugaaggccucucugauuuuauuuauuuaauucccuugcacgaaucuucuuucucagcccccaauuuccagccugcuguggagauuuucuuuaucauuugccugacugaagagggcaauggauaacauucucaauggauagcauuagggcaccccguuacuuuucucacacuuagaaaugaggcucuuaaaaacccacccuaagccgggcagugguggugcacaccuuuaaucccagcacucgggaggcagaggcaggcagauuucugaguucgaggccagccuggucuacaaagugaguuccaggacagccagggcuacacagagaaacccugucucagaaaaaaaccaaaaaaaaaaaaaaaaaaaaaaaaaaagcaaacgaacaaacaaacaaacccaagaacuaaccaaaccaaccaaacaaacaaaaaaacccacccuagaagaagauaaaaaaaaucagcccuucuaaaucuauacagaaucuuuguguagcuucuuuuucuuucugucacccagggcagacacucucagccccccacagcagucuuuucaugaugguuugagucccuucaugagggauacauuucugaccccucucugaucugugauuuuacccuccagggcucauccuguuaacacagagugcccugggcucugcaacaucugcacuuggagcacugaagguuggcaccauuuuaucuggguucucugccuccaccuuggcugcuucccccauuggagguaacuggcccugcauguccaucccacacuccugcuugggacccaggucuacauggagaacaaugacaagccaccucucucauuccuuugugcuuaucagggauucagagggauaggaaauuuaucagaggagguaacuuaagaucaguagaauguuagugaauagaacuuuauugcaugcauucacaucuuaauugcuagccuauuacauugguuaguucauugaguuuuucuaaugaccucagaggaggguaacaucucucucucccacucccccucccccucucuacuuccccucccccucucccucucucucuccucuuggaauggaggcucacucuauagcccaggccagcucagagagcacuauggauguagcccaccaugauugaccuuaagcuugucacaagguguggccuuguuggagaagaagugucacuggggguagucuuugaguugcaaaagcaucacaacuaccugccuggugcccugcacccugucacaaugauugcuuaucccuaugucaguggcccucagcccuaaauucuagagccaguacucugugcugggaggcuacacacguguucuauguauaccuacuugacuacuggucuuuuuccuuuuuuucauagaagccagggcagucacucaacuaccaacguguauggcaagccucugcuuuugucuguuuuuuuguuuugcuguagaggaaccugcuuuggugggcagggagaagaaaagugacuucagauuuuccuuccccgcagcaggcaaagcagcaagaaggcagagaaaggaaggacaaagcaaaaucuaccugaaggguuuugaguucuccagaggcaagcugucaggaccugcucagggcagagcuaugcccuggggucucucucagggauaggcacacagggcucauuccuucuugugagcuugguggugguggugggggggggggauagagaccauucucacaggauuguuuuuucuuucuagccaaggcuguuguggcugugcuugggggaggugagugacuucacgcaaugggugcagguucccuccuaccucucccuguaagcaucagagccaagacaugccccaucuugucccaguuggcugucccagagguaguggggcaaacauggugaugaaauagggaacugguugaaagaaggaacuagaaagaaggaguguagugguguagaggcaggagaggccacaccucccucagugcccuuguccuccugggagagcagucaccuugugaccuggugcaugauuugaauuccuuugagcuccuaauuuuuacccugaaagauaaaacggaacuguuuaucccauuuaguaauuaccaagggggcucuaggacggaaaaagcacuuggaauguacuagaguuugcuguguguuggggucugagagucgucucacauaccacaugaacacugaucuuacucggagaaggcuaguguguugagcauucaccccaggucugauugaucaaggccucagacaagacuuaggaucuaacugcuaucuggaacuauaauccuacagagcucucaagccugaaauccacaaguaucugugccuaguuauuuuaccaaucagcauugaggguuaggagacuucccuaggaacaugucucucuugcacauuuaucccuuucccauuggguauggguaaucaagugugguaggggacuugccuugccuaacuuucacgucguagucugccaaccaggaugucaguuacucauguucaugaauauuucugucaguaggaugucaauucuccgggaggucuugggaacuuaaaacuuuuuauaacccccgacucaagguggaagucuuauuucaaauggcuacuuauauuguguggauuuccuauuauguuggggucuauacccagagcaacuuauauuggcaaaaaccauaaaagcacauagccaugugcaggaagugugcuguagcuuauugaggcuacuuauacaaagcaguucuaccugccuuccauugugauugcauccuaaaaacacugaagcauagaacauuacagaauaugcaaaaauugggcaugagaaaguacuacuaguaacagcauaguagaaaauuccuuugcuacaguaaucagagcauaggagaaaguucccuugcaacauugggaacggcuuaaaaugccuggcuagacaagcagcaguuacucaggccuaaacacucagcagucacuaucagccugguggcuucugacauggacccaagcagggcugggagaugccuccuccagucauuccaguuggguaucacuuauguucuuugucugagcaagauguucuguagaaacacucauucagggcugcucuauucuccccacauuacuccaagacagacauugagcccagcaagugccuuucugaaggucuugcucccaauccuagccaggcaagaacuccacccucacugacuaacaucuccucuccuacugugcucccugaauccugacuaccagcacucuaguucagagagggccucuugccuugcccuucaccuuugcucucuaggcuucuccagaguuacagggaagaggagaagcccuggcucaguccccucugcccauucucuccuucuccagaccccugggaguccuucaggcuuaacggaguauauuggggaaugggggaucccuguccccaagcccacugacauagcuccucuucccacagccaugacaguagcugcuguaccaccugcgcugagugcugugggcuucaccgccucaggaauugcagccuccucucuagcagcuaagaugauguccuugucagcuauugcuaauggggguggagucccagcugguggccugguggccauucugcagucugcugguaagugucauggcaggaggaccagagggaggacaggucauagccuacucucuccguuucuuuuccuucuuucugguguuuaccaggggagguggaggagggagaggauaauugcaggaugguuuaccugggcuuaacucuccccuuaggccuagccuuuucccugcagagggggaugguaucuagauggacuauuaccuaguguuuggguauggaguguccccugcaaaaaugauagugcuaaacacagacuccagaaauuuugggaaagagcagggauaccguggagaccccguucuuccagacauccgggugguucuggaaacucugcuguucucugacuccuuaguuuuauuucaucauacauuggucaucgucugugucuucccaggagcugcuggacucuccgugccaucuacugucaucgugggcucugcagggucugccguuguggccagugucaugaacaucugugagaguuucuacccuuuucucaugggaucagagguggcagacauggcgacagagguggcagauauggcgauagagguggcagacauuucaacagaagaggcacugcccaacuugucuaacacagagaaggauuaauuacccccaggcgacaaucuccuaacacauauugccuagguggaaauaaauuaaaccgaguucuugccagucucau

SEQ ID NO: 6800 - RNA, 3004 nt, Mus musculus
ugaugauuugcgggauucuccgugaggcacggccgaaccgcgggaggcgcagccagccuagaucugcgcgcuggcggcugggcgaccugcgggaagguaggcgacccucugggcagaacgaaaacagaggcccaaagucgugcgucccggugccagcccgggaauugcaccgccaucgcgcaggccacucuccagcuacuccaggagagaccuggguagaggacuuccauaccauuuguggagauuccucucucacugauaagucugagauaacuucaacgcugucuaaagccguacaauaaaugcuaaguccucccuggcacuggaggagauccugggaccucuccuuauugcucuuccuggguuagagaaucauugcgguaaguuuggucccgccugggcgcagaacuaggcagugcgugggagcagccacccggaacuuaggaaagcguguaccuccgugcccuccagcccacccacgcauggccuaggacacuugauuugcuuacguugcaaauuggggguggugguaaggauuggauagagaccggcuucaguuggggaggugacaguuucuuguuuuuguuuuaagagaaacaaagucuucucgggaacgcuucagaaaggccaagcccaccuagagaagugaccuuuuuccauuacaaugacuuuacugucaccagguuccaggacacaccugcugcccuccaacauuuucccacguucgguucuaaagggagauaaauugauugacaagaacuggaggcugcagugacuucgcuguguucguuuguguuggugguugugaguggauaaggcgcaugcaggggcaggucucuuauaugaccuuuacagggguacaggcagaaacaggagagccugggguagauuccugaaccccugaaacuucugaaaggggacucagauccagacccgacagguacucagccucagauuugaaagagcaguggaauuuugaaaagaauaaaacaaacccacgcccacccauucaugucucuuucagcuugguacuuagugaucaguuuuaacaaguccgggauuucgcugcagggcucgauuucccgaagcccuguagcuauaucagugacccuagaaggaagaggcuguucaccuguagucaagggugccaggguucaagaccuaacauugccaccuggcaaacuaccccuccuuuggaggccucaggauuuuaaauaaucuaaccaaauccgagauuaauugaaucccuuaaaaccuuaguauuuaaugaguuuuuuucuuuucuuuucacugggacaaaggaguguguuggccccaccccugcccaaaggcaaaagcagggucucuucagcuggguucaagauaaagaaaaaucacuuggcucuuuuccuugaaaacaagacuuucccagaaagaagcucccggacccaagccucacaacuacauggguuuaaccgcuacacuccgggagagcucacccguggcguggcugagccuuccugguacaauuguccccucagcccaagguuguucuacuuugucggcugggaggcggacuccgugaaggaagucaggggcccagcucccucgcugugcuuucucugaggaaacccuacaaguguccccaacgcacuaggaacaauccagaauggccgggcgcaauugaaauaacaaaugcgaggcacgcaaauugucccccuccaguugcuaagcgauuguuugucgccccgcaugcccagcucagcaugggagaaccagcgaguccggaggcagccagcgaggcuucggugagaaauaaguaaacacgcaguugauuuucucuauuaucacacaaacacgauuucacacaaagcaaucaccacgcagaagucuaugaaaauguguuuguugggggacucacuugucccaguaauagcccucauuuuuaagcuauuaaagaccagaucaguggauuccacgugcauaagguauaucugcuguuuggggucuuuugaagacucugguaccaucaucaucuccgaauugauucggaguguugaauucaauugcuuuucuaauuuaaaaccuagagcccaaguuuggagugcucaucuggcuaucuuucagagggcugucuccccauuauccuuauaucccagccucaucgcuuuucucuucccuuggggauggggguggggugggggcgggggacgggucagaggccccaacuccucaggguuuauuucuuaaacacucaauuucuggccuguacauggagcaauuucuaauuagacauuuuagguaggguuuuuagguacgugguuuagguaggaguuuuuugagcuaugugcaaaaaaaaaaaaaaaaaaaaaaaaagcugaugcguccuuuucagaaguaugugagauacuguaagagagacauaggaauuaggaaaaauagacgaacccucacgggaaccagagcguacugagaccuccuacgguuuuaaccaagcaaauugguuuugcuguuugcauuuuggcuuuuuuuuuuuuccagugucucaaaaacaguuuccuguuucugcugcuccuuggaggaugucucaggagcuccgagugaucuuccuccgggaguuuggaacugugccgcugagcagagagcucagaaccaccuuaauguagggcacagccagcagaauguggggacugcggcuuccgauccuuggacauuagcuagcugauucuuuguuagaaauuuugcaaguucgaaauaaaauaacacuaaucaaaguguuaggaaagugccccagaauccugggagggaaaaggaugucccccuaaaugacgcguuucccagggccucgggaagagaaaauaacuugggcuucccgguuugcagagagcagcugaguuauuuacccaaagcucguuucaaagugacuccgcagcaccgaggcuuuuguaaaucacagaaugcaaaugaggauaauuuguucuuaaaggaacuuucucuugaaaugauuagcaaagucagucauuug

SEQ ID NO: 6801 - RNA, 64215 nt, Mus musculus
gggucggggcgcggcgcggugcggcgcgggcggcuccgggcccaggugaauggaguaaccugacagcgggaacgagacgacggcgagcggcaggaaauggcggcggcggcggcggcgccgggcggcaccgggaggccugggcugugacgcgcgcgccggagcgggguccgaugguucuggaaggcccgcggcgcccagugcugcaggugaggcgggcucccugcugggccgcuuuguguccgggcccgggggacggcgaugcccggcccgccucuugcgcgaggcccgcgcgggcgccgggagcaggccgcgacgccgagcccgggcagagaacuguccacgcgggccucuccgcacccccgccuuaggaggagcggccuuugacaggucccguuccgcguucgaagcccgggagaagacaggagguauccacgcgggccggcgucucgggagcgacccgggccugccaaauggcgcgggaccccuggaugccuccgaggaucuggagggggacaaggccucagcgaggugcgggcuggagcccugggaaggacuguuguguguuuauuggcaggugaccaaggcuggcccuaggggguggguggcccaggccauguuuugugccccuccccuuuuaggucgucuggaccuugcgaagaagggucuuugcuuaaggggcuuucguucagccaaaucugugugcaucuccagccagcacaccaaauugguguggauugccuagcagagaugagcugcccuugugacuuugccuucaggacagagccaguguccugaagacuugcccaaauggaugacugggagucuaugaucuguaauaguccuugcuuuuaugaguagacuugugauuaaaggguuaguuaccgauauaugaugcccuaaguauuauggugaucaaguguugaaagacgucaucgggugaaagagacuuacuugggaguucgcuccugaguuucugaaucuuugauuguuaguuuucugaggaaccucacuguaagucaguaggaaaggaugcaguucaagaguuaagcaacuugagauauguuuuucaaaccuguuguaaaguaggaucgcugaguuggaaauucauugguauaaacauuuuaaguuuucuaggcaaaaauuuucaugguaaccaaggaccugaaauguaaccgaaaggugaauacugggugaggcuuguagcaagcaguaguuuggguguuuuuggaaauaucuuuuugauaucuuuggggacugaguucuggaauaaucuguuucacuuuucaggcuaccugugaaacaugcaguguguaauauaaacagugcacaauaucaugacuggaguguauuuuauagaacugucagcaccaagggcugcuuuuagugaucaauguaguagccuaaguuugugaauuuacacguggcuccaaaagaugacucgguuggcuuuaacugggugauaaaagaccuugcaacugcauuaauaauguaguugucuuccugucccacacugagcacugcauuauggcaguguuucugggcaggaguuguauagcuaggcuguuugucuguuguugaacuuucuuguuuugguuuuagaagguauuuuugguguaguucauuucugucuuucuugaaagaaacuuuuaggaaguuucucucucagccucugggguaccggaauuacaggcaugcaccaccaggccugacucucuugguccugaucagagagugguuucgugguguuauguaugagugcgucuagguguagcucugcuuucuagggaggauaacguguguagcauugugucacagcauugccacaucugacucucugaccagucugaugccgugagauggggaugucauuugagcaggugggugugcucucuaaggauugccucucugcagccuacaccgcuuauccguggcagggaaggaggacauuugcuaaaucucaucagucuguaccaagacgugucaggcucuuuucucagagucucacugaaugaauucucagugcguucaugcagcauccuccuuccugguuguacacacgagggaagugugacucugaugauuucuucagcgugugaggcugccugagccuugacuggaucaugcucugcuuucagagccugccugccugcuccucagggugugcuguccaaguggauuuaggcagacagcccaacgugggauccguccucagucaguacaguggcgugaguggagaagcacugucccacugagagagucaggugacuucugcuugucucaauguguacaguuguuuuaacaugugacagcauacucaggauugaugcuucggccaugaaguguacagugcagcugcuuucagguuugcaggucucaccacugcccuucuccagacuucucccucacugggacacuuugaccacucaacacugagccacauuccgcccuucauucccaagcgacccccacaguuuccucguuuuccuugucuuugaguuuggccgugcuaggaaccucuuguaagcauggacaugaaggauuuguccuuuggugcuggugcccugacaccuagcauacaccucugucuucaugccaagugcaucugucuccucacuuugaaagacugaaacucuuguauggucccuagcuuauagcaacagcuuuuagccuuaagauguaggaaaaguacaguuauaguaggccuuucuuuuaauuuugaaguuucgcuucucuuuccugccccagucagcuaugugaucaugagguguagccugggaugccuuacauccugcuucguuguucagccagaaaguuugacaagcuaaguauacauguuccucaguucuguguucaacuuagaaguggcugucuagggcccccagugauggaggagcaccuguguaugccuuguucugauuuuccagccaucuguggauagcagcuuccaucuuuugauuuuugaauaguugcugugaggauagauacucaugggacccuuugagaccccacuguugucccuucuuuuggcauauaccucaaaguggucagguuguuuguucaucaaaacacuaggcucagguuccuuccugauucuuaauuuucuacaaauaguucuucagugucaauaaaagacuagaaucuucuccaaguccaggaguuacugauuuuuagaaucuugguucuuaucacaguauggcaaccagggauucuuaucacugaguuuguucaguggaucagcaggcuuauuauguccuaauggaggcagaggagggggcugcgaagguuucuguguacuuugugcaaauagaaaguuuaagcugggugauuauuuuguuuaccuuaggcuuugcuguuugaguuuagcucauccugaaugccagagggguuguguguguguguguguguguguguguguguguauguauguguguguuguguuggcuuuugcuuacagauuuccuuggaauaucuucagaguaggcuguacucuuggaggcaacauuacuuugguaguguuccaccucuagucugugcugcuuggucuuuuuagcacuguuuccugauucuuugaugcuuaccgauauuucuuuuaaagagacuuugguuuuuaaaaaguuguacucauagauaaacauuuguauaauaauucuguguucuuugagaaggaauguagaccguucuuacacuaauaagaagguguuuuuaagaucugagauuaacagugcaggcuuaggacaguccauggauggaggacuaggcgaagagcuucaacaaggauaauucacagcuuugagcaccuuaggugcguucacuuguuuguuuuaauuugccaaaaugcaagaggaacucaggguaauuucgguugcaucgauuaaugaggaagguguacccguuagccaggagaaacagaucuucuuuuucaucaacauggguuauuuguuuggauucuucaacaccaugaugguggucacgaauggagacaguguugacccuuacgcaugaugacugugccucccauuccguucuaaagaaacccugucaaaagcaugagguagagucagggagcaagaguaagccaggcuugugugguucaggugaugucauugccacuggaguugaagugucacuuguagugugaaggccuugacugagggcagaugacaguugguugaggaguagaggcagucagaacuuugcaaacagugguaauuuugcuggccuucaggaguaugcauuggaugagugcuuguguguuaguacggaccugauaaauaaaagaacccagagagaagaguguaugcuugagguguagcuagaaaaaugggaaauuuuggccaugugagaaagcuuuguugaauugcagguccacagugacuuucccacuucucuaaaauggcugauuaauuggugcuccugaucugauaaucaguuauaugcuaccagucagugacugggaugacccgugggucaucaaggaugcccacguagccuuuaggcguggggcugcugacugcugagucuugcuucugagccauggaagccacauagugacaugaaguguuuguagcugugcucagggucauagaaucaaggaucaagcacugcacacgcuucacugccgcacacagcucuguguagagggcacuuaguuuugcugagaaaauuaguuuaucuuuauaaaaaauuuugacaguuuuagaaauuaacuuguggggacugguagcaucuuaaggcuuuggaaaagaccuuaaccccucuaauaauggacaggucacgccuuuggcuacuucucugcuuaugaucuaugcauaacuguguauggaggcauugcagacugagagcaugucuggaauccuggagagagagugucugcagugcuagagcuuuauugguauuguagagaugucauuguugaagugacuaaucacuuauuuuuuaagugacaaauuaguauaugugauaaagauuuuaaaaacauuuugaaaaaauucucuuggggguaauaaaacaggacaaucaguucagaauuuuuaaaagauaccuuuaauccaaauaaugaagagaacgcuaguuuaaaacugugaucuuugggcugaggcuaaagcucagggguggagcauuugccugguauacaugaggcucuggcuucagguccagcaugaguggagguugaccuuugagaugauagaagaagguuguuugcuuaagagcuaacucuguagcuaucuguccuucauuuauuuugagacagcgucucacuaugcagccaugaugauguagaccaggcuggccuugaacuugcagagaucucccugcuuuugacuucuaaguuaugggaauuaaaggagugugcaccuaccuauuaaaaaggaagacaguagacuuaucugacacuuggagaugcuuugaagucggaauuucugucuucugcuugguaacagcaaggcuuaaaacaggguaaggugaccauggauagacagaccugugacugccauccuuucccacaucuugcuccuagccuucacugccuguggcaucuuagagauacuguaugcuucauccacuuaaagcucaacuauuacuuuuucauaacacuuugggagcuaauguuggguggaggaccaacucuucuagcucaucacugagauacacugggcagcugcuggccucuguguuucuguguccuccucuguaagcuuuuggccucuugaaguugggaggaaaacaguuugcugccugguucuggccuauugcuuauuuuagauaaaauuuagaugauacuguuuuucuucagauaugugcuuuagagaauauuuugcuguguucuuguaaauagauuaugucaugacuuuccauguuacuaauagugaaauacauauccaguuguuuuuuuguuuuuuguuuuuugcuuuuuguuuuuuguuuuuucaagacaggguuucucugugcagcccuggcuguccuggaacucacucuguagaccaggcuggccucgaacucagaaauccgccugccucugccucccaaguacgggauuaaaggcgugugccaccacugcccauauccaguuuuauaauggaagaugguucaaaaaagagggcuugugcacauuuucauagaugaguuguccuuuuuugguaauuauguauuuauuugcauauauaaguaacaauacuauugaaagaaaaagaggcccucacugugaggaggaguggggcguggcgggcuggagggacacagggagugaccagugaugcauccguuugugcacauuuucucuuuuccacuuuuauuacaaauagcuguuucguuugcuugguuuuauuuuggucucacauaauuuauucugauuacgguuuucccucccucuauucccagcuccuccccaccccuccucccaucuagauccacuccuuuucugucucucauuagaaaacaaguagguuucuaagggauaauaauaaaauauaauaagauaaaacaaaagcgaacauaucaaauaucuuaggguuucuguugcugugaacagacaccuugaccaaggcaaugcuuauaaagggcaacauuuaauugaggcuggcuuacaguucagagguucaguccauuaucaucauggcaggaaacaugccacuaugcaguuagacaugguacuggagaaggagcugagaguucuacaucuugauccacaggcaucaggggacuacguaucacacuggguguagcuugagauauaugagacuucaaagcugcccuccauggugacacgcuuccuccaacaacacaccuccuaagagugccacucccuagagucugugggagccauuucccaacacuuugcaucugcaggaaaauuuuuuauuaagauagacuuuagcuucuagcuucuucucuagcugggugccuggaagcuuuacuaaacugguucuuugggguguuuauaauaaaaauuucaacugguguauuguagacauacuauuuuuuaaauacuauauuauaaauguauaaacauaagaaaguauaaauuauauaaacauaaagagaaaucuguacacuuauguagacacaugugguggccuuggugccgucuuaugcacgcauaagaugcuuacccgcauugacuguaucacaugaagaauucagacucggaccugugguuucuaggguauacauuuacuuagcuuaugcuaauaaugucuucuaaaacaccacuucuuauuucacuagaaaaauaagguguuguguagauuucuuucaggaucucacuuagcugucccgauucucccuccucucuuucuggaagauugucagcuuuuuucuaauacucacucuugaagaauacaagccacuugucuugcaaagugaauaucaaguuuuguuuguugauggcuggauucaggccuuguacuuugggcagggauaauucaugagauacaugucagugucccacugacuucagggauggacacagaucaccuuuuauugacauagaauuugagugguuagcaguuccaugagagccuggaguggcugcaguuggaugaugucacacuaucugcaguacagaucgacaccucuagagcucuggcaggucuuccggccuuggagugccaaggaugaagauuuauucuguuuaaauaauucaaauuguauaaagucuuuuggaaauagauccugcagaucuuuaaccauuacauuguuacccaucauuccugacuugaaagucauucuccauaucugaacuaauacaugcucaaacuguagaagaguuugagauguagacaaguguaaaagaaaagauagucccccucucaaucccuuuucuuucuuuagguuuuaacuaacacccaagcagauauuaauaauaaucuaaauaaagauugcuuuuuuuguuugaugucacgacauacacauuuuugucuguuauaaucuacuacccuucucaauggcuguacuaaguugccucuugaacccaaacccuaguuugcugaacuguuuccucauccacucuugugcguagacauguagcuguggggugggcuauuagggauagcagugguguagcagcugcucugggguuucuaugguaacacuuagacuaggaauggcuccaggguuuuuaaugacagcuacagcaagugaaagaugcagaaaugucaacaucucucuuguucuuuuuagcaaucaaaggagugguguuuggaucccggcacucuucauuccauucuuuccucuuuaaucuuucgguuuuuagcuugagguuagucuuacuauaacguagucacuaaaaauaguugauagguccuuuauguauaauuaucuuaaauacugugguuauuugggguaugcccuauuuuuuuaugguaaauuuucaaaaacuuaccaauugguggauauuauuucuguguguguauguguguguguaugugcaugggugugcaagugcagaagccaaaaaaugauguccagucuccugcuuggucgcucucugccuugucccuuuaugaaccaggagcuugggacacaccuuuucuugaccugcuggcugaccagugaggacuagugaggugucugucucugccccuuuuagccuggaggcuacaggcucagccaaacccagccuuuacaugguugcugaggaccagcgcucagguccucaugcagacucagcaaguguucuuccccaggagccaucucugcagccccgcugagguuuuuauuauuacuuaagauuuuccuccuuuauuuucauuucauguacgugaauguuuauuacagugauagcaaagugagccggagugagaaauagcaggaaaggagacuugggcuuuuagggcugggagacugcaguaggucgcuagagguauagagaaggagcugcuuaguaaagcguguucauucggaccagucauguuucugccugcugguguagggcggacucucuuccucuggagcaggcugaagggauuucuacuuuagguuuugguagaaaggagaagguggagaccuuguccugaaucuguugaucuuuaaugccuugaccucaaaauagucacugggcaacaguggcauguuuaaaggugguguguguguuuuguucuccuuuaugaauuuguguguuguguguguguuuuagguuaauuuggcuaaaaauacuauguaaacucuugugugcuuuauauuacacacguuuguuuuuuguguguugaaucuuaaauuguauuuuagauuuuucuuuaagaauucuuuaacauuuaagaaguauaguuucuauguuugcuuuacuaaguuuaagauuucauuuuucauucuggagagaugccuuagugguuaagagcacugacugcucuuccagagguccugaguucaauuccuagaaaccaugugguggcucacaaucaucuguaaugggauccgaugcccucuucuggcgugucugaggacagugacaguguacucauaugguaaaauaaauacaucuuaaagaagaucucacuuccuccuaauacagguuccuguuuuugagggccagggaacggcuuuagaggguaguggaugcuugauaugugugcgccuuggccucccugaugugucccuugcacgauaaagauauaaagaaaggaaagauugcuuuccgagucaaucacauucauacugccugcucugaagaggcuccucaaggccagcugagacauugucuuuagagaggaagggauuugggaggaguuuuaaccaaugccgaccauuggauguguggguuccuuuuuaauguagcaaguguuggccuacuuuguuccaucuuuauuuuuaaacuucuucucucuguggaguugaggaacauguuuuagaguuucuugaguacauaaguuccaagaaauggaauuugcuaauuggcaucaguauugcuuguggauugggcuguguuuaagacauuuuaaagccauguuggagaaauauaauuuaagucuuccaacacagacauucucggcauagagguagaagaaaaaggaaacaguuucauuuuugaauaacauuaaacuaggcugauaugcaucgaggaccauucugaagacagcagggauaugauccuuacacacuuaaauagugucuaugaauccaaacccagaaaguagaagcaaggagguucuaagaauugaugugagcagauacgcuaagauagcucugaaugugagcaggucagggacaguggugaccauggagcaaaccguuuauaacagggcaguugggaaacuacagauuccuuuguggggaaacuuguguuggagcugaaagccgguacuacaaaacaggaccucugugaccaauagaaaggaagaaaagaauguauacacugagcugugagccgugcuaccauuaaugagacucuggccucuugccauacaccuuaugucugguauaccacauaaaugauuaucuguucuggguccugcagucaacagggaucccaggugcccguugcugaccacaggcguuagacuuuucucagcaguugucagcuuuauguugaaagcguuuucuuuuucuuuauuuuucauagugguuuguaguccauuccauuucuguccucaaaguaaacuuucuaguguucuggcuuggugauuacaggacagguucauaaauaggaaucagaugacguauuaggccuaucuccuccuggaagcuaguuguuuccuuccuuguaauaguucagagauagugcuuggacucugaaggaaaccuucuguaguuagugcacuggaggcucgacuuuccacacgcugcagaaggagaagggaauucugaaaaaaacaaaggaaaagggguuucuucugauuucaacagaucaguuuacaaaaccuguaauuguuugcacccugugccaagugaucaucucaaguggucacuuggacgcccuggcugguguuagguugucuagauuugcuugcugucuguguuccgaucucccauagcacuucugucauagggaacuuuucagugcuaacaaguuugacugccuguuaaugcuguacuguucauacugagucuccccucucucuugcuuacuggggcuuuauggaaguugcaccuuaggagcucaggaguaggauuaguaggaaggacuucuguaaaguuaguagugacagagacucugggauucuuuuaaugugcuuugaaaggucauaccaggaagucguaguugcugcaagcuuuggacugcaagggcugucucuuugcaccccaaaggauacagccuucgcuaauugggugcuaaugggagcuugcuucuuucuuucuuucuuucuuucuuucuuucuuucuuucuuucuuucuuucuuucuuucuuucuuucuuucguauauguaaguacacuguagcugucuucugacacuccagaagagggagucagaucucauuacgggugguugugagccaccaugugguugcugggauuugaacucuggaccuucagaagagcagucgggugcucuuacccgcugagccaucucaccagcccucuaaugggagcuucuuguuuguauuaaaaccuaguaucauuugcagcuugucaagucaccucaaacucccagagagauuuguagccaucaaucacgaagggucaaagucccaagcccuucuucguguacaugaagcaacauccuaauaucucagaccaugacaauaggaaaagagacaugaccacaguaaagcaggcccaaaagaguuguccaugcuaaugagcuuacuagagucccgcagggcuuaaccaagaagcuucuguucacagacauuccucccugcaggcccacccugagaaguggggguaugguuuuacauaucuacaucccacccugacaaucuuaaagggaccuacaagacagaauuuuguagauuuguaauaucguaucaauuaaaauuagauaaagacuuacuaauguuuauuaccaacauaagucacuauucuauacuugucugauggacuuucuaccuguauacagauugccuaguaguguaacuagauaacuagauaauccuauacugguugacuugaauuuuggcuagagcauugcuagaaacaggcaggcaugaaacagacuagugcuguuuacugcucuagaggcaguaccugggagggugaagcugauacaugagguagaccaugucucaugcaauaaccagcuuuauucagagcaucagacaguucauacucuaaggguuaagaagggucagucauaugaguaaggugcucagucacaggacaagccacacauggcaaagacauggguuuuuucccccauagaggcauguaaacaaauaacaauagccaguuguuuuaaacacucuaaagugagcucacuccuauuugcuacaccuaggaggucaugaaaacacguucuaagaacaaccuuuguuauggaguaacagagauuguaagacuugucuuguuuacauggaguuuucucacaagcucucagacguuuucuucacacagcuuuguucaugguacguguuccuacagcucaugcuggcgugcauggucucugcaucuuacuggguggcauauaaaaugugaugaaaaucuagugaauagccggauuacaguagugcacgccuuuaauuccaacacucagaggcagacaccagcccagugcacauagugaguuacagaacagccaggguuacacagagaagcccugucuuggaaaaauaaaaucuggugaaggaugagguagccuuaggagacagacagacagacagaggcugggaggcaagaagcacggggugcugaagagugugguguucagcaggcuuacaggcaggugggguggggggggaaucugucgugcucugccaagugcuuucccuccugucugacugaacuugcuucguuuucacaguuguauuagagugaaaugcuaauuuuaacagcuaguucuuucagucaugucuuuuaguaaauaauuuuaugaaggauuuuauucugauguuaaauauaaaaagauuauuaaguagcuaauuugugaagucaauuucuuaacauuguuuuuuuguuguuguuguuaaaaaaaugaguugugucuucuaaaauacucucucugauugcuuuuagguugccuaggguaugcauaaauacagacuuggaaacucugaaagaacuuagagucagcauuucgagguaaauauguaccuauuaaaguaguguucuguugucucagucugauuuauuagcagccagcuaaaguguacaaauguguuuaccugcccaugagugcuugaaaggcuugggugucaaugagugccaagagccagcugugcacuggccuggccuugcuguguguucgcaguauggguucagcgagcugacccccaagcccggccggcguuagagcuguuaagaucaggguugagcucgcuaagcuuuuccuaucggcuucuuacacguacuccuuacagcuugcuuucuuuuguuuuugaaucauaauaaucauuuaggaaaggcaucccauauuuauuuuuucccaacacuagcauuguuaauucuagucuugagcugucuuauaaaccaguuugaugaaagaguggauagaacagguuuaacaguucuuggcguuuguauuuaauuucauuuguuacuuuggaauuacuguuggauuucaugcauacucuaaagacuuaacucucgguuuauuugggugucuuggcuaaguaucuccucgcugauuuuuguuugcuuuucauacaugugaaucugggaaguaacacgugauuccuucuuugcuucucuguaaucuguaaagcauggucuuuaccguuugagucgcauguacguauucuuuagaagucuuuccuugggcuuggcugcagcuuucucuuucuguaggucaagcuuuccugcguugccucucauucucugauccuuguuuuagaagaacacuuggcauccuaaaauauccccaacuccuaaaaugucuuuuguuuaaaaguugauacaaaaucauggcuuguugcucagcuccucauugagugggacucuggugugugcauucccuuaacaggcaucuuaugcuugacuguuugugcauuuauuuuagagcggaagcgugggcaugcugugaguuuccaaugagcugucacaaugucagaaugcaguucagacagcagcagcacagcgcucgcagacauuaaaacgguaaaucuggguucucagcggcggagaggacgagggcuuaguuuuguguguuauuacguuauucuuuuugucuguuugguugcuguuuuugugguguuggguccugaaucaaggucuugcuuugcauuagguaagggcucugcgcuacaccccagucuccgucaguauugcuaaguaaggaacucacagaagcugccaaacagcuuugccaguuucaucaguguacauuauuugauaagaaauuaaaacccauaauugaaaagaaucacuuggggguuaauccuuuggcucuaucaaagaaguuaaugauggcucaucgacaagacucaaacuguuauauagcaucagggguucugggccuuucacuuauggcuaaguuuaaaacgaaaucaacugacacaugccaaagaaaguaaaaauuggcggaacuuuucuagguuuuccuguuauuacaugauuagguuaccuauugauguguuaauauugggcuugcuuucccugacuagaaaguguuuuacuggggccagcuaccauguauaaaaugaauaaaaauuaauuuaaauacuaugaucuuauggaaaauauaguuggaaggguucaauugcugucuuccaccucauaacaucuuaucuucuaccauuagagauggcaacauucauuuccaaaccaaauaaaaacauacggacuugccccugauuguguucuguuauuguguggcuaggagcagcagauuugauauacacagagaaaugaagcccaucucuuguucugagggagcuuguguuccaggaagaacacagagagggagagucuguguaaaguguuuauguuaggacagcagagggaagcugcuugcgccacucaacugacuuggcuuucugcacaccugcguacuuuguucguugugucugucccaucugugaaucaggaccguggcucaaagucacacaaucuaauugaccauuuuaaagcaagaggggguauuucaaagcuaagaauuuuuuaaaguucuagaagaauacuuuaguuuaugaauauuaguaauuucaagaagauuuacuaaaaguuucaaaaauacucauaagaacaaauaaggagagaaugucuaaacuucagaagucacggaagcuucuagauggaggucaucccugucucuugcaugagccauguuggacuccugaaugugccuagcuuguggucugccuggcuggagggccucucugggaugaucucaaguuucuagucugauggcuuucuuucaggucugucccugacugucccuuuuucuuucuuucauccuuccuuuuauuucucucccccccuuuagaucuuuuauagaagcaauaauggugauuuauagugccauuuguucagaguugcauaccucacauuggacgguaagggaauuuguuggcucauguguuuggcaaggauguuaggcugagcuuugagguugauugauugagcugcucauugauguuaccagggaccaagucucuuauuguuacucuuggaaguacaucuuuuucauggcugucaaaugauuucagcagcagaugggacuggcauuucuugaagcguguucauaggggaagaauugcuuuucagccagugacugaaaggccccaaucuuuugucauuggauuaucaugaaucaguuccuugcccaaagagaggcgugugccauggggugagggcuaggugacuggcagauaguagaaagugaaacaaagccuuggcagcuuuggcaagcagauuuacucugcugaagaguacagaguggauacugagugauagucacagaguuaccuguuguuccuaaaagaaacaaaguacuuauuuaucuuauauuacaauauaaauuuuaaaaaggauccauuacuguccuuugugagugaaauuagaucuccgaaugauaaaacuuuaacuuuacuuggauguucauugcaucauuguucacaacagucacaauacuaaagcuguaccugugccuuuuugucagcagauggggggauacauacauacauacauacauacacacgacauacauacauacacauacauacauacauacacacgacacacacacccauacacaggcacacgagggauguucagaaaauaauaacaaauauaugcuuuacacauuuagccucacuugcuuuuuauuauuaacuugucugucuccguguagcuucugcuuaggaacugcuugagacugauuccagagucacgauccuuuguccacagauguuucagugaguacuuccuaagaacauagcuagccucugaugugcauguggugaaggcaccacccucaggggaucuuuaacaucuuuuaucugcaguauaaaagauuucauuaauuuuuuuguaaugccuuuauuuauuaaugugaucagcauuaagaaauucuuaaaugcagauagagaucuacauuuguacacuuauuguagcauagucacaggggccaaaauauggaagcagccuaagugucugucagcaaaagagugggcgacacacacacaaacacacacgaauauuugauuacaauaaagaaggaaaugcugacauugugauaaccuaacuauccauggagcccauuaugcuaagugcaguaaggcagguuuagaacaagcaacacugcacagucuuuucugucugugggaccuggcaaucacaggagacaggugugaguguggagacgugagggaaguggacggacugguacaagauuucaguuacagggaauacauccuagagauggaauagccagugggcugcaguugauaaugcuggauaggcuguaauugaaucugcuaaguguggcuuguuaacauucccgucacaccugaauuugggagcuguguaccaauggaugugcugaucaguugagcuguaacaguccaccguguaugcuucacaucacacuccuuaguauagcuaguuuuauugugaaaaaaugucaggcugaggucucuccugagaucagauacugugcguuguugucaggccucuuacuguagcuguagcauguuuucauaguuugcuuuguaucuugugauacggaguuuugaaguauaauuuccuucucuuuuaaaaauuggagcauacuuaauuuccuuuguagaucauuuucaagauuaaucauuauuacuaugguugucugagaaaaaaagaagcaggaggguuauagacaggagggagcugcugaucuuaugugcauaauguuuggaagugcacauguuggcuguugucguuguugcuaucuuuucuccuccauuuuagauuuccaucccuaggauuuagucuuaguugaaaccucccagcaugcacugaugacuccagaugagcaugugugcuauguggaaagucaggggccaggcuuaauuaaggucaaggguucccagacagagugucuauggauaugaagugacagcacagagugguggcaagccaggauguugaggaaacggcugccuuagaugguggaccuucaggguggccucuugaucuuuagaaacuaagugaacuugacacuugacaguucuguaaaaaugcuugaguccucugugcuguggaauuuggaacugugggugucagauguggggugaaggauagagcuuuuagacuuuccaacagaaagugaguuauuucccaugaagaauaugguuucuucgaucccaagcaccuuuguaaaagccaaccagaaguagcagcaguaguagcaaaaaugccugauagcuucuccaaaagugcuguuaccccucgcaugccuccuuccuuugagaaagguaguaagaaugauaaugucgguugguguguggacaagcagucuugcugggguccucugugcucugugcugcuuccuuacaacagugccuugagugagcugugagucaagccuuuauuaucauucuuacugccuuuuucaaaggaaggaggcaugcaaggcauacagaacugaauuaugccaucuugauuucugaagcaggagugcaguguuguaccucgguaugaaaaagacuggaaaguaaaauguuugauuuucaggaaacucuauagaucgaauucucuuccagugucauagaguaauaguagugaaugccacaaagcacaguaagggugacaguuccaaugcaggaaugaauucugcucauugaggggagcugcugauaggcuuccacgaagagucuugacaucuaagccuucuuuucugguugagauuuuuagaaagauugagcuggggaugaauagccaugcagugcuugcagugggaccaugaggaccugcuuuccugaucccaagcaucuguggaaaggcugggcacugugguggucaucuguacuuccaucuguguaaaagcuaggcacuguggugacuaucuguaugcccagcacugggguaggaaggauguggggugugugugugucuguguggugcuugcugguagagauggacagaaccuguggucuugguggcuggccaguuauuaugaucuugcagacugugucaaauguuuugagauuccugucccuucauucuggugcuccaaugacaaaccaaaugacaacuccacuaaaauccagguugggggaaaccagucaguuuauggggcucacuucagagcaccagugagaggccacucacaggagaguaggugaccgcaaaccauuggauagcagccauaccauuggaaauucuugcccccaaauggauggcagcuuccuauagcugcguagauggaaucccugcucuguuaaccuuccacuugagagcuccugaggccauguguauuagagcaggacucuuaacagagggcaggagguagaagagggagcugcugagacuucggguaaguaucccugacccgauucuucugugagcaagacuugccucaggguguccuguaaguaguuccagccacucuggugagaacucagggcagugcuaugcagccccaguguuacugaugcugagcucaguuccagggagaguuccugccucacagagugagagagcuggacaagaacaucacugcugacuucuggccccacacuugcacacacuggccuacacaugcgugcauacacacagaaagguuuuaaaagauuucuauuuuuccaacuuacauagugaaauuuacuucuggagagaguaucugaaaaugggagggugcuuagaugacguggacaguuuuccauguaaggaauaucauggguuuaguuuauugggguggguaugauuguaaauguauaugucugaggauaguuuuaaugugcaguuauagguugucaguuaagcaaaacauuccuguucccagccuuuuaauaaagugauauaaccagcucaaguguuugcaucuuuaaugccugccuguacguuggcucauuuugucaacauaacauuagagaacuuaaaaagaguguauguguguauauguguguguauguauauauuuguauuuuccuguaacaaugcaaauuaauguguuuauguauuugugcaguugucugguucauucuucagauaagcuucuagcuguaggauugccugguuggguauagacugcuugacuuuuaaaaccauccucuuagaucucaagagaagccacagcagccauaggaagaaccugaaaggcuugagggagcaguagugugaugucucucuuguucccgugcuccuugagggagcaguagugugaugucucucuuguucccgugcuuccuuuuguuuuaacccugcaugguuguguaaugguauucuuuuucccuuuuguaguaagcugugcuagaacaaaaugcaaugaaagaaacacuggaugauugaaaagcccugcuuugcagccccucagcauggcaggccugcagcucaugaccccugcuuccucaccaauggguccuuucuuuggacugccauggcaacaagaagcaauucaugauaacauuuauacgccaagaaaauaccagguacuaaugagaccacuaauacuggagcauuuuucacacaaauggaaaaaucaguauagaguugacacaacuuauaaaacucauuuaccccuucaagcccgccucuucugauuaauuuucuuauucaaaacacuuuuaaucuuaauuguucuucucuguucuaacaucugcuggguaauugauuuguuguguugguucuguuucuuagcuccuuauccacccuccuugaaauccacacuguccuuucuauccauuuggguaccaguccuaguaagcuggguugggauggagguuguuagguguucaguccugagcgggagaagcauaccucguguaggguucagucauucgugccauuuuagggaaguggccugugcagaaauaauuauuaaaugacauugcuggugccauuucaauguuuguuuccagcagcacagcuguguggcagccauuuuacuccccuguuacucuugaguaaaugugaagauagugguuuucuuuuugcaaaguuguaugcagaagauuuuagaaaacggggacauuucucuauuuaaagcaagccgauucuuaaguguggugccuggcuaagaaguaugugaucuuuucccauguuucagguugagcugcuggaagcagcucuggaccauaacacaauugugugcuugaacacuggcucagggaagacguucaucgcgguccugcucaccaaagagcuggcccaucagaucaggggcgaccucaacccgcaugcaaaaaggaccguguuccucgucaacucugguaaucaaacaucauuucccacacgugaggagaaaauuggaugagccuucauaguuaaaaagauuaucucuguggguauuaaauuauugauaguaaaacgaguuugacaaauagugugcuuacugaaguccugcuagccaaaauaccauuuuauuucucaguagaauuucucucaauuguucagacucuguguuucucuuagaugaggacuucuggggagauggcuaaguuguuaaaauuccuuccauucuugauguuuuagcuucauaaagcaggcugaaggcuuguugacuagaggugggugauuuuugcugaggcuguuuuagaacguuccaugcuucuuaaaggcuguuggguuuauguuuggggacugcagacugaccuccguuucugucuuuaaagucagucuaagccgacugugauuugaauaguacuuguugguggauugacuugcucuccuuaaggagagcaggagagcagguguagacuugcucgcucgcugcccauccagccugccaaggacuuagagcuuagguuggaagucagcugugaaggguaugugguugucccggacgugauggaagaggacggggaugggcucacugguggcuuugaaagguaaucuuggaacuaugauuuuuaaauuagcuauuuaaaaaguugguggcuagauauaacaacaacugauaauuuucuuaacugcucaggagccgauuuggcacgguguucauauucacauauugucuuugugaucagcaaaccagguugcucaacaagugucagccgucagaacucacucggaucucaagguuggagaguacucagaccuagaaguaaaugcaucuuggacaaaagagagauggagccaagaguuuacuaagcaccaggugagaccugcagagaugccucccugugcggagcggauacgacaaauccuugauuuaauagcccucagccuuagcuagcugaggaaguuuaagacccucaccuucccauccuuugcacucucuguuucugaagguucaucugagaugagguaaauuacugaagugugcuauuuguggguaggaaagagagcugccauuguuuaccugcuagaaaacuacaaauaccuguggcuuacuuugaacuugaaggaaaugaacuucugaguuacauauguugaaagucggaaaaguuuccugguugaagccucucgucuaugaggaggcucccucugccuucauguuuucauguagcuagcgugugcuaagggcuuuuguguguagugcuaggagauccagagugguugagggcugcauuguaacugaccuucagugaccuacauacuggaaugaauccacauagauagagccuguccacagcaaagacucuacaaaguuuucuuucagaaaacccugucagcucaauggggaaaaaauuaaaaacuugugaauucuuuugugauuugacaagguugacaggucucaucugccaagguauggcugaggacaccucaggucaacuuaguaacuuauuauaaggacaagcucugccuuuauaaggacuuucucucagucuuucccacaaauuucaucauuuauauuuuggucucaauguuuguauguuugauguacauaugugaauguuuuggcuuuaauuuugauccaugaauuuccuaagccuugcuuccauacacagacucaugugggcucucuccuagagguagaggcaggcagauuaauggcguuuguguacugaugucaguuuuauuuuagguucucauuaugacuugcuaugucgccuugacuguuuugaaaaaugguuacuuaucacugucagacauuaaccuuuugguguuugaugagugucaucuugcgauucuagaccaccccuaucgugaaauuaugaagguaaguuuuagacuuuaucagcuucaauaauucauagucaaauuauuaaauuaugaguauguacaguuuuaaauuuucuaauuuuuacacauauaggaguuugucccaugugugucugugccagaggucagaagagggugucagguccuucuggaacuggaauuacacaugguugugagccagugucugaacacugggaaucaaauauggguccuuuaggagggugaccagugcuccuaaaugcugagccagcgcuuacauacaguauugaaaacaacaaccaaauuuaauuugaaaaaaaaagagagagagagagauuuaaagagcaguggugauaguuaccaguacugggaacuugauucuaguauacaagugaauuauucuuaauguucauuuaauuuauauaauuuauuaaguuucuaacauuguaauaucaacugacauauuuuuuuaguguauccaaaugugcccuuuugagaaauagaucuuuaaauaaaaacuacaguaauuuauagucuugugcuacuguuccagagaaaugggucuuagugcuuccuguauuugguuguggcaguguccuugcuguggcacugcgugaccaaguccuuacugccuguaucuuucauuauguuagcucugugagaguuguccaucaugcccucgaauuuugggacuaacugcuuccauuuuaaaugggaaaugugauccagaggaauuggaagagaagauucagaaacuggagcgaauucucaggagugacgcugagacggcgacugacuuggugguccuggacagguaggcuccugagagagcagcggcaggaggaagcugcucaggugcacccacacuugggagaaggcuggaauuuugcuuucucacagaaacauuuuaagaaugugucuucauuguaaucccagguguaaggcuguagggcugcuucagacuguccacagcagcuggccacgcuugccucaugcucuagcaggagcauaguuuugccagcugcagauaauuucugcgauugugugauuuugauauuccaggaacuuuucagaggguacauaaaugugagggccccaagaggugaaugggggugggguuguaggacuuuaagggacauuguuuacaguuuguuaguagucguggucaaagaagaaacaaaaggaaagaaauucuauucagggaucucuuccccuuuauccuuguuucucuccugucuaguguuagggugaaaccugggggugggggaaacaaaggguggggaaaagaacaacucacaaaguagcaaagaccagcuccagccaugaccagcggggagucuuugguguccuuucagcaucucacauuugguaacuuugaacaaauggcugcugaagggagugaacaagacugaggagucuguuuuaaguacaguuaccagcaaguccaaaagcgucuccucuuguuuuuguagauagccucaaauggguuacugccaccuucagugagggugaugcucggggucacuguccuggcuaguuuuaugucaacuugacaaagcugucagucaucugagggaagggaaccucaauagagaacguacuuccaaaaagaggacugacuuauaaacagacacaccuguagggcauuuccuuagugaucagcgagggagggcccaacccacuguggguggggccaucccuggacugggguccuggguucuauuaagaaagcagcugagcaagccaugaggaguaaaccaguaagcagcgccccuccaugaccucugcaucagcucugccuucagguucugacuuccuucgacaaugagccgugauacagaaguguaagcaaaaucaacucuuuuuuccccccaagcugcuuuggucaugauauuucaucacagcaauagucaccuaagacagcucuuuuuguucccugguguugcuagacugggggcuuaaucaguguaaaggacauaccaucagcuugugcuuuucuucugaccuagacaucucucaggaugaauugaaggacucuuaagagaacucaguaguauacuuuaaaauaucugagaaacacccccuuguuuggaaaauuuguugcaaguuucugagaaaagugcuguuugugauuugugaguugucucguuugaggaguuaacauuuugggcugcuguaauuuaauugauguggaaacagacaccucuacacagcucgacugauguguuuaccuuuauagaaaggagcuauggugguuaguaaaaauugccauuuuggcagaaucuagaauuaccugggagagagacaaaccucuggcagauuaucuuaaucagguuaauuaaggugggaagacccagccuaaggcagauggcaccauucccucggucuggagucuucaauggaauacaaaggagaaagugaguuuaagacaggcauccauugcugucuguuucuugacuguggaugugaugugaauuguugcuucaguuuccugcuguucauugugaacaguauugcuaaacugugagcuggagcagcccuuuccgauuguccuggcugguguugugucaccuugacacagcuggaguuaucacagagaaaggagcuucaguuggggaaaugccuccaugagauccagcuguaaggcauuuccucaauuagugaucaagggggaaaggccccuugugggugggaccaucucugggcugguagucuuggauucuauaagaaagcaagcugagcaagccaggggaagcaagccaguaaguaacaucccuccauggccucugcaucagcuccugcuuccugaccugcuugaguuccaacugcuuuggugaucaacagcaauguggaaguguaaguugaauaaacccuuuccuccccaacuugcuucuuggucaugacguuugugcaggaauagaaacccugacuaagauaccacuuaaauuucuuuugccaggguguuuuauaacagcagcuuaaccaacacuaaguuaggaagccuuauauugauuaguagggaaauggguuaccauugggaacaaauggaguggauguggaagcauguuuguaaguaaagauucaguucccaucagaagagucuaauguccuugcuagcaaaccgcuagugaaucuucccauuuuugggauagauuguuccuuaugucccuuggccaacacaguuguggugucuauacauacacaaugugugcuuuuaaagucauaucacauuccauuuaucuggauugaguuuauuugcuuggcuuguauuaagggaggcuuuggggagaaguagagcauagauguuuguaguaguaacacugugugaacuuuuagcucacacguccugguucuccagacagcucuaaguguguauaaguuccaguuugcugucuuuguuucuuuuccuguuauucuuguaaaguacauagcugcuuuaaguuccugaugccuugaggagaucccaacagaauagauggucuuuggccugugagcucaaauucuuucucugaagguauuuuaucucacaacaagaaaagaaauguaagacauuuggguuaaggaaaaugaaaacuauguauuaaguguuuuuauuguauuuuacucacuaaaauuauugguaugcuuuuggaguagugugggcuguucugguuguugugauuugugaaaggcacacuggacucgagugacauaaaaaugaauaggauggccuagucggccaucagugggaggagaggcccuuggucuuucgaagaucauaugccucaguacaggggaaugcuagggccaggaagcaggaauggguggguuugggaccagggcaaggggaggguauaggggacuuuuggaauagcauuugaaauauaaaugaagaaaauaucuaauaaaaagaaaaaaugaauaaaagugggcacugggcagcuuaccuuaccaaaaauggauucauaguuaacagggccagugggguagcucagcagauauagaccccacaacaaauaaauaaauaaaucuuaaaauuugagauuuguagaaguuaaaagaguccacguuagggguuggagaaauggaucugcaguuaagaguaccugcugcucuuccaaaggaccugagguggcuuucccaguauccauauaaggcucucgccuuggccaucuaugcaugcacacaucuauacauaauuaaaaauaacuaaaagaaaauuucagagaguauguuaagcuguacauuuagugauaaaacauucccugaugaccucuacugaugaguucuguuuccaaaaaauaauuccuggauauuuugaauauuuuuugucuuccauucugccuaagugaacaaaagauacuaauuuaccuacaaaacaaagcccaaguuaggaacuccagugaaauauuuucaccaaguucuuugaauuguagacuuaugcagugguugcuuacagcuaacucaaagaagccaagugucacuuaggaggcaugcugggaguccgccuuguugcuuaguagaggccuggccuaaauagagaugguaacugagugauaaaagaugaagugaagggcauuuggggaaggcaaaggacuguagcugaaagagccuucgucaaagcggagaggagacaugcuggaguucccugaugcgauccacauuugucuccucugcaguccccggacguuaaauuggaguggagcucccagcagaguuguaguaaacauccaaccugcagucugucuucugucaucugucuucucuuccagaggaucugggcuccacuuacaucacccacaucggggcucacaacugucuuaacuccaguuccaggggaucuggacacgguuacacagacauacaugcaggcaaacacuaagcacaucgaauaaaaauaaauuauuaaaaacaaaaagauugcauauuuguuguggggaaauucagaaauaugaaaaaguguaagauaaauaccuaagauaaauucuacaacacgcuaacauuugggauuuuuuuaguguccucuuuuccuugucuuucagaagcagcuuugcauguucacuggugauauugacaacuuguuucugauuuuuaaagauacacuucucagccuugugagauugugguagacuguggaccguuuacugacagaagugggcuguaugagagauugcugauggaguuagaagcagcacuugauuuuaucaaugauuguaauguagcuguacauucaaaggaaagagauucuacuuugauuuccaaacaagugaguaugugcagagccuuguaaguaguaaagcgcuuuucucuauugugagccuuggaaugagggucuuuccauugaggcuguuuucuacacauuuuaguuuaaagccuuacuuuccuaguucacugaaccugugaucacaucagaguggagguuggguuuuuaugacaggcacuuguguuuguaugcucuagcccucugugcaggacuaaggguuccuuccgaucaugccugcuuaggagcugaguccccuuugcuuugcuuugcuuuuggucagauguguugguuccugaugaacuuuuugcucugaguucuucacuguuccuggugucuauaacagaaccagagcuguccggacaacggucuugaguugguuccacgcgugcagcagccccacaacaccugccgccucagcugguugguugaagggaaauuuaggggacccauuccuggccugcugagucggugaggagggcuccgcagaagggacugagucugacaggucccuccaguggucccgccagcacugaugcuugacaaccagaaagcacucuaggggcuugcagccaguuuuaauaucagcacccucuuaaaugaggcucagaauucuucuugguggugauuuaauuuuuuaacagccaugucuagguuguuuuuuuuuuuguuuuguuuuguuuuguuuuuuuuuuuaauuguuuuugagagagucucacugugugucucugguuguccuggaacucacaauguagacuagucuggccucuaacucacaaagguccaccugccucugucuccugagugccaggauuaaaggugugucaccaugccuuaccuuguuuggguuuuuuaaccuuacaaaucuuaguccauauucaacccacugucuuuacugcauauaaaacugguaauugccccacauuuuuuuuuucaagucagcucuaagauaagagccagcccggugguguaaauuguccagccuuuguagagggaaguucucgugcuggccuggccagaagucaccuggacaucuuaccauuucauuuuaauacugauuauaauagaaaaaaaaauguaugaaugacuugggauuaguuagcaugaguacagcugaagggaagucgcucuggucuuugcugaagaggaaggccggccugcgcugcugcaugccguagcucuccacagcacuggcagggaccaaccagauggugcaguuguagugcugaugaacccuacaucuaaagugcgguuucuacaucucauacaguucauguuuuagcugcuacuucuuauuuuugcuaggagaaaaggggaugguucauagaucugugaagcagguugggaagaccgcuaagcucccgucugaugucgggguaugaaucucugcucugaagcuccagcucagcuguuugaaaguaugggacgcucaucagcuuuuggguuucuucacuuuucucguagauccucucagacugccgugcaguguugguuguucugggacccuggugugcagauaaaguagcugggaugaugguaagagaacuucagaaguacaucaaacaugagcaagaggagcuacacaggaaguuccuauuguuuacagacaccuuguuaaggaaaauacacgcccugugugaagaguacuucucaccugccucacuugaccugaaguauguaacucccaaagucaugaaacugcucgagauccugcgcaaauacaagcccuaugagcgacagcaguuugaaaguguugagugguacaauaacaggaaucaggauaauuacguguccuggagugauuccgaggaugacgaugaugacgaagaaauugaagaaaaagaaaagccagagacaaauuuuccuucuccguuuaccaauauuuuaugugggauuauuuuuguggaaagaagauacacagcaguuguccuaaacagguaacuguuggagucggugucuguucccuguggggaagcagugcugggagagugggagcagccccccucagaagggcuuucucauccaguguccugagcuaacacgggagacgccuagacauagucacuuucucuaaaggcuaauuuugacacaacugagguuuucaucuuaaaggaugcuaguccauccuaauuaauccaaaauggagaauauacaaaaaaaaaaaaaaaggaagcaaagcauuccuuguuuguaugcaguugcuggagucaucucucacagcuguuucuucauauguucccaagacauauuaucugauuacugaggugauuuuuuuucuuaaguauuaaauuuuucgccuuaaaaaugauagugugaaauauucagguuucgaggcaugcauguccuaaguccuuagaaccuucagaaugaaaauuguuauuuauaugcuugaagaauugcuuggcuugagguuggucugagcacucccuuccccagugcucaggagggaagaaaggacugcaggcugaguugauaaccaguggcuacugguuuaagcagucuaccauaaaagagcacuuuucauuaaggccagaccauaaaggaagagagcuuucagaccgcugaagcccuggauggcccuggaugguauggaccuaauuuguaaaauaaaccaguaaacaguguccugggccuuuuggcugcuuugaagaggacucugcuuggggcuugugacugacaucugaaaaguaggagcauuucuuggcaacugaaccauuccagcuugggaucugaucauaucucuaggcugcuaaguuacaggauaccagcagcagcaugucugcuuccacagagcugauugcucgcugggagaaauccuguguggcuucuuauugacuucugugguuaagagccuagguaggaggaucauuguucagccuucaaggccacaccggggaaauuuagagguagauuugcaguuuggguugguuuauuagaccgcauaguaaaauauucugggguggaagagaacguuacaacauucugaggauauuagcaaagauaaugguuaguccccauccauauuccuuaauaaguacuggguuuuccuggcuauggagcugugcuuuauauauaaacugugacaggugcugcucguuuaauguauggugguucugauuguuuuauuuuguugguagaugguagaugcuuuaucauuuuaaagaggguccuuauuuuuuuguacuuaaggccguacuuuucugggagauccauuaauuggccaaaguucgaucccugagagccuuuucugaaaguaguccucuguggagaaauuaagcuuuguuuccugagguaauugcuuuuuuuuuuuuuuuuuuuccuuaacuacuucuugaauguuuaggaguuuuaaauuuuuuugaguaacgggaaauuggacuggagagcagucaucuggcaguuuucagucuggugauuuucuggucauugagccugggccuccugauguauaaggagugaaauaacuggagguacugaauuaaacaggacauuaagguuggaagggaccucacugaacaucuaauccaaccacucagcucuauaagaaauacagcaggaggaaaagugauuugccccaaguucaauugcuagucugugacagagacaguucuagaagccuaauacccuagcucucagcuuccauuucuuucuacgaaagucauaacacuccuggauguccuugaacagcagaaccuauagcaggacucaagccaggggaccaggaagcauguggcuggaggcggggugagggggagauguggggguauuucuuagaauggggaaaggcuuuucaggggucaagaaguugaacacugguacaguccuacgucuugcuguggagagcugccugcccugggagccauggcuuggagagaaacaggugucucuucuuucucccuuuuaaagaacuccggcugggucugugugugugcuauguagagaugugucaguuuccauugcagaauuauuagccagaaaaaguugaccuaaaaucaaucacuuuguguuaacgcaaggaugaaguucacugugcucagcuuuugugaaaugugacugaguugguauuguaggaugaauggagggcaggcugagguugacuuuauggcaucuaacuaaguguacaguagaagugugguucuaguaagcuuuuaaauaagcuuagagaaacuuggugcaaucuggagucuuuccucccaucuauuuaacaggaaaccccuccuugccgagugaguguggaagcucuucacacaggcugcucuccagccacgcugcugcugugugcugcaagcacgcuuagucucacauuugcaauuucuuccuguguccccuauagcagugcucacauacuccaugugggagaaagguagauguuggcacagggucagauccaagugucgcccugugcuugagggcaguggucucacccugguuuacuagggucgugaggcacaggcauugggcagaccuggguuugcauccuguuugucuccaacuucucccuuccuaauacuuuuuauucugaacuaauuuuagauuuacagagcauuggauaaguagcguccugcauucucuccccaguuuccccaugauuaagguuuuugucucaaccaaggaaccaacauuaguguagcacugggccugcccuccuggcuuuauccugcaguacugggccugcccuccuggcuuuauccugcagcacugggccugcccuccuggcuuuaucccagguuugccaguuuucccucacacugguacucccucagucuuagccauugcucggcuugcaggcuuggcucuguuccuucccuuuguuagguuguuauagggggcguggucucacuuaacccagguuguccucaagcucacucuguaguugccuuccuuccuaacuggcgcauaaagugugucuccacugcagagcccgguccuccuucccauuccagggguuguagagcaucagcguugucuucucgaucuucucugcuguuuuccuuguuucugaugaccuugagggucaggaauauuggucaggcauuucauuggcugccccuccauuugcguucggugaugguguucucaggguuaagcuagggguagggaauuccaaacacuacuguagaguuggcgguccuuucuggucacgucguauuaggggcugguguaacagcaccaucguuggugauguucaacuucuguuacugucugccaaccuccccuacuguaaaguguuugcuguuucuuaauaaaugcuuuggaagcaaauccccacaucuagacagucuacaggaggagggaaugauuauggucugccuggggaggugguguauaugugccuaugugugccguuguccuccacucuuacucuguuugcucccuuucuguuugugguuguuggaucucggauguguugguguagaccaugucuggacuauucauuacagccccauagcauguuguuuaucagcugccuggcucuucuaaucugggccacgagguguuguuuguggguagcuugcuugcuccauuuacccagcauccuucugugugagcucugcuuuacauggcuaacagauuauuucaccacugcucucaccuuuauagguaacuuuuaauguauuguuuuugacauauaauuacaaggcuccuguacuuucuguugccauagccauaaucagucauuuuugcaaaggaccuccuguccuuuuuauacccgauuuuauaggcacauauuuuguaaacuuaccuaauuuuaaagccuacgcaucugcauccauaaaauacuaauaacaccugcccucacucuuacugugaguaccuaccugccuguguacacagaaaugucuuguuagcagugugcuguccuuuaacuaguaggggcagagucacgaaagaguaauguuugcuuuacagugacaagauagcauaaagauuaagggauacugcuaggagaauguaauguauuucaaguacaugguagacguuucagauguuuguguauaaacauguucuguuuugucuguagaauguagcauguguauucauacaacaguuuuaguaaucuaguucuguguaucuucuguauuuggucaugcuauuccaguguacuugggaggcagcauguggcgcaugcuauggucuucccucugcucugaguugcauagagagauugaaaguccauguguggacacucugagaagcagcuugauaaagaaauuuaugcuuccugaauguaauacaauuguauuuuaaugccuuuuaaguuucauuuucuuagugguuuuuguuguuguuguuguuguuuugguuuuuguuuuauggaauuuuacaaaaaugcagguuguugaggaauuggggagguuuuugaaaaaccuggcucuugacucucauguggauccaaagagaacaguggggcucagcacauaguugucagugccuugcaaugcccgcaggaacaaggucugcucaccuguucaguccugccaagaaaucuuuaacaggcugugccagucacugucaguuccugaagacaguggaacacuuauuuuauuuuccuugaggccuauggcuuagguuugggaugggguuagacauucuauacauuagucuaguagaggaauaaucuucuuuuuuuauguuaaugcacauauguaacauuuaauuauugcuuacaauauaauuuuuuauuaaugugcauguugucucuucagcucugcaauuugaugccaacaucauuaaggagaaauaaauuccuguuaguauuuccauuucucagcuaauugaaaccugccagcuugauaauuugggcaaaauauauucuuaauuaggaguaacuugaauugcauuuuaaaaccucccauuaugcucaaguugauacguauuuauguaaggcacacuaacagcacaagggauugcuaagguaacuuguuccagcuuuggcugcgcuguuuguuuucgcuugucuguucuuugucacugacguggugauguguucaccacaguaacgaaacagaccccagauuggaaggucgagaagcuucugauucugaacguuugagucauugagccuuagaacacacuggauaaccuggccaggacagggucugggagcacaggagacucugcaugcccauucaguuugccaggccuuugauauuagccuguuucaugugucuauuuaaaaagaaugguuuuacuuaaaaaugcaauuuuccauuaggaauuuauacuauguagcaugauuucagagggaccauguggagucacuuaggucagguguggaaccauuuauccugugcugagucuuugaaugugggcauuuucaaauagcuguaauagcagcacugacuguuaaccuucgucuguguaacacgaucugaccuguagcuuuuuuccauguuuuagucaaaggccccuauggguuucugguacuauagguuaaugccaaggagcagguggggaaggggccguggcucgggguucucucgugacagugcagugggaugccuucagcauugcuguggacagcuuuugcccaggacugcaggaugagcucuucaaugcauggcuuggggcccgaaagaggacuugaauagagguaacaggccuuccuuucucaagaauucugcuucuagugaucauguauuggguaaggugagcagcagugggcccugucuuacuguagaggagcuugagagguuuagacucugcacucacugcugugugagcuccuccagagguuuguguguggucgcuguugaagccaggcgugcccgaagugugucgagcugucuagugguucucugacuagcuccaucucauccugggacaucguucuguuaagucaucgucaguaaauugaaaguuggaaggaaagugacccuuuuacuugucagugugagccagccuuauauuuuuauagcaagugcccagccugcagaucuguguggucaaacaugguacugguucuuccuaaaguuugguaggaagaaaagacuguuguucuggcuaagccuaacugucagcuagacacagccuagagucuucuaaggggagaaccucaguaggggaauuaucuagaucaaauuggucugggggaugggagggauuguccuguuaauugauaguaggaaggcccagugcagugugggcaguaccgccuuaggagacggggggacugggcuggaagcuggugugugagcgccagcaagcauugucuucuguggucccugcuguacucugguugugaaauaaguucuguggucagagcuggguggaauagcaaguuggacuaccaucaaguuucuuccugagcgagcacuggccucagcuucccugaauggugggcugugaccugcaacugugagcugaaauagccccauuccuccccaacgcuguuuugcucagagucuuuuaucaaagcaaggaaagugagacuagagcaacuauuugguuaggaauguuggccuaauacaagaacaagugugaaugcuggacuugcauuacugucucaaaggagacuggaagcuagauuuaaaaaaauuuuuuuuaauuuuauuuauuuuuugauuuuuugagacaggguuucucuguuuagcccaggcuggccucgaccucagaaaucagccugccucugccucccaagugcugggguuaaaggugugcgccaccacugcccggcuggaggcuagauuuuaaaccaucuggagagaugacucagugauucaguacauacuacuuuuuuagaggaccaguguuugguuccuauauuggguggcuauugguuccaggauuucuaaugucccucuccuggcccucugggcacucuacacaucugaugcauagauaagcaggucucugucucugucugucugucugucugucucugucucucucucacucauacauacaaacaguagaaaaaugaaaaaauauaagagaacccaaaaguuaaaauauguuucccuuggaaguguuuaacuccuugugugccuuacauccuuagauugauaaaggaagcuggcaaacaagauccagagcuggcuuauaucagcagcaacuuuauaacuggacacggcauuggaaagaaccagccucgcagcaaacagauggaggcggaguucagaaagcaggaggagguaauagugacagcagggguuuuuaccgcgcauacugagaaccuaaccuagaaacuuccuucauaguccguccuuccgucguccuuccguccguccccgucccccccccccaguuaacuucaguuccuccuccucccuucuccucucuccuuguuuuuuaauaauagauuacuuuuguuuauaaagauauuuguuguucucaugaggcgacuaagggucacugaucuacucagaacuaggguagcuucuggugaacuagucuuauugucauucaacagcucauuuuucuuuauggaauuacuaugggauaucuacgccucauaggagagugaaccuggaggcaguaaauacuguggccuccacaggccugccgagcuacaagcuagucuucagggugccuuuuaugcuuuuaaaggccugccuuugugauauacauaagaccacuguucuuuguaaauguagcuuaaaauuguuugugcucuuaaaaaucuucuauaggaagcagcauuauaaagagacugacauccaaguguccuggcuggcagacaggacccuuuguuacuuaaccuacaaucagcagagugauuucuguuccaggcauuuggcuuuagcauuuugaggggauuccgggucugggaaguugaagagccagucugacaucuccaucugaagaacagcuauuuaacuuagccaugugggaauaaauuaguuacgucuuguaacuaugacagacucccccacagaagcaauuucaggaagggaugguuuguuugcuucuuguuugagagucuccguaaucguggcggggagaaucugacgacugcaguugaggcagccggccaugcugcauuuguagucagaguacagaguugaaucccugugcuuagcuuacagucuccuuuugguugugaccugcacuccaacauaaggaauagugccugcauuuaaggcgccucuuccuaccucacuuaaacuucuugagaaacauuuuuacaaaaagguaccaagguuugucccuaggucaugugauuuaaaucauauuaguugaccaaucaggauuaaccaucacaggagguaguguuaguuuaaauuuuguaugaaaacucuugucuuuuguuuuaaucaguucuguuuccuuccauugaaagcuucuggggugcugaggagaagcauagcucugcuuuugcuuucauuccaagugcacuggaggguuuagugaugccaaggcuugcacagcacauucucaggggcacagguccccaggaggggcccacugucacucacgcagauucguuugugaucagcaaagagaagucagucugaggcauucagugacaacucugucgccaaaucagugcucugggcaugugacuaugcccucccucacuguucugugacacucuucucuucucugggcugaccuuaggguuguagugugccuaagaaauaggucauaaaugaccauuguuaaugauuuuguaaugcuuucuuugggaaauuucuuagaguugcuuuucuuggugaacuuuuuuucagguacuuaggaaauuucgagcucaugagaccaaccugcucauugcaacaaguguuguagaagaggguguggauauucccaagugcaauuuggugguucguuuugauuugccuacagaguaucgaucauauguccagucuaaaggacgggcacgagcgccgaucucuaauuacguaauguuagcagauacagacaagauaaagagcuuugaagaagaccucaagaccuacaaagcuauugaaaaggugagaucagaaagauaaugcaccuuccuuuuuauuugugugcacggaaagagagaaguuugaucucgagagggccgugccggcgccggcggugugaacggaucagagagcugagaguguucucuaaaguaaaaucguagaggaaggguccugggggccauuugagaaggaugucuauggaagggcauuguaagugcagccagcauaguggccagugaugauuuguggcaggagagugaugagacgucuguuuaccaacaggggaccaauaguguccucugugugcaugcacgaugucagauaauucuugcucaguguguuuccauauggugggagcugggaggguccuguggagagcuucacugcacaaauagcuucugaaguauggagagaugguuguguugcacaacauacaucaaaagucaguaaguuuguuuguuuguuuauuuuugagacuaugauauuguguaguccaggcuggucuagaacccaugaucauugugcuucagccuccugagugcugggguuauagguuauagguaugugcugccaugccucgggagagaguuuucucuguagauacucuguaguagauguaaaacugacaucuggcaaagaagagucuuguucucacccuguguccuguuugugaacgucagaucuuaaggaacaaguguucgaagucagcggauggugcugaggcggacguccaugcugguguagaugaugaggaugcuuucccgccauaugugcugaggccugaugauggggguccucgagucacaaucaacacugccauuggacacaucaacaggugagggaggacacacacagcuugucaguguggcaggcugaagucagccuccacaggugagcagacuguucccagugacaagagccaccuccaagaagggacaauaacaacagugagauagcuugaacacuguauuacuucaggauauaguagccaaaaaauguauaagcuggguuuaaucaugagaaaaaucucauggaaacucaaguugagaggcggacuucaagggauaugccugcaguuuuuagggguugcaaaacaaggucacugagaucaaggacagaccaaagauaggaagaugugacagccugguguggccucugauccugcacugcaugcuuugacuacaaagacuguuuuugugaaacauuugcuccuuuguuuuacccuuaagugaaauuuauccugauauauagacuaggccuauaacgguuuuucuuaguucuuuguaaugguaucagcucagggaaaaaaaguaauugugucuaaauccaaauuaacucauaauaaucacacuuaauugcuaauagaaaauucagcaccacacaauacaaaaauuuuaaguggaauauguucugugccuguuuuacuugucggguacuguuuucugugggguucuguucgcuguuaguggagaaugaaugauaaugguguuuggaacuggacuugugggcgugaguuaaaccuucagcaggcagccacugggcuguccuaccgcccaggccucuuuguaggcagagccaaggaaucugcuuacauacauaugucacaugcaggcauucacaucuacauugcugucuuaccuccugauucugcugaccccauucuuacuguggcucuaagucauuuuuaauuuccuguuuuccucuucugugacgagaagucugauccacugugcuugggugugauaugugcucaaccuaccugucugcugcccacucuugucuuuggagcacccuagcugcacaggugcuucccugcaaguuugcuggccucagacauccuccuuccuugggccugcuuccuauucugucaccagacuaugaugugcugauggaguuucugguucuggugccuucuuggcucaacccuaggcugugcuguuaccuuccuuacaugugccauggcuauuggcaaguguaagaugccuaagauaccaacauggcuaaugcacucccacagggugaacuuugaaauacaagcuuuaguuuuaacuaaaauaaaauuaaauaauguaguuuccuaguuacacacauccguuucuagugccuaguucugucauauucacagucaggagcaacaaagaacacuccucaugcaaauggcagcccugcaggagcccuugugaagacaguuuuucuugagacaguuuccugucaaucuuucauuuauagguucaacuucagaauucuuuucuuuacagauauugugcucgauuaccaagugauccguuuacgcaucuagcucccaaauguagaacccgagaauugccugaugguacauuuuauucaacucuuuaucuuccgauuaacucaccucuucgagccuccauuguuguaaguuaagaaaaagacuugccuaguauugaaguauguaugccauuguuuaguuucucuaagacaucugaguuauagaguuguuauuaaaucuacacucugaaaagucacuuguaaguugcauauaugcucuaugcucagauauuuuauagucuacacacuauaaacuguugggacugaccagauagccucccuaaguucccuuuagucucuuacuaauuugaaucuuugugaggaaucuguuagcuguggcuuugcacacagugacugacgcagauguuugagcugcucuggcuggagucugccaucuguauuugcagauguccccgacuaagugauuugaaguucacagaaaagcuguucccugaugauauauauuagagcuaguucuaauguuuuuaccuuuuuguuguguauuuguuggcuaaugaaaauaauacuuuaaaauuuuauuaaaaugcacaauuacuugaaauuguaacaucuuaguuaugaauucauuuugauuagaugucguuuuaaaagaugggauguagcuguguuagaacccuugccucauaacgugugagacccuggauucuaucccagcacuaccaaaguuuaaaacaaaucggaacaacuagaaggcuugaaagcuuguugguauuuucaaacuaaaguacuugguuguggcagcuugggugucagcaguauuaggcagagguucugagucugccccgugggcugguaaacguaauugggaaaugcucuguucuuguuuucaggguccaccgauggacaguguacgguuggcugaaagagugguagcucucauuugcugugaaaaacugcacaaaauugguauguaaacaugcuuggaaaacauuuaucagugagaaaaagguggcaaaguguccgucagaagcacauggaggccucugcggguuucuggguuugucagggccuagacaugcugcuuugacuauaccucggucggcucacuaugccuuuucuguaccucagagacccuacagagcugggcagggcugcugacuuucacagcuucacuguaaacagcugccacuuuuugcuucuguuguuggccccuuuuacacacauaaggaugcucuaacuauuggauucuaagccagccauauguauguuuaauguauuagacuaugucuaauguauuaauguauuagacauguauuaauguauuagacuaugucagguuagucuaugucggugaagaagacaauccuuuaaaaagugaaaaacuugugcuuaaaagggaugugugagccuggcuaguugauauuuuaauuuuggauuuuagaguuagguuuguucaugcugaaugcaugagugucacguagagccccuaaaguuucagcugugacuacuuuacaguguuugugagguuuaucuauccuauguaugugcgcgguuacuugcacugugugccugccugcuagcuggagggcagaugaagguaccugagcccuggaacuguacuuacagauugucaugagucaccaugugggugcugggaacuagaccuggguccucuccgcgagcagccagugcuccucacugcugagccagcucuuuucagugucuaacggcaggggcgcuuugguugcugugcucugaguugcucccucagcauggugcucuuuuagaucauuuacucuucagguugcugacauaagcgcuuuuaaacuucguaggugaacuggaugaacacuugaugccaguugggaaagagacuguuaaauaugaagaagagcuggacuuacaugacgaggaggagaccaguguucccgggagaccaggguccacaaaacgacggcagugcuaccccaaagcaguuaguauugcuuagaacugaggaacgucagccgcucucaguuuaucuccugccacaucacaugcuacaucuucugcucagauguuuccccagguccuugugggucugucuuguuccucugauuccuggcgucuccagagccgccuuuguauuugagcauaacuguugcugggcucuguuguucgguuuugucauaagccuuuccaaaggauucuugaggcauuuaucaaauuaucaaaaauaucaaaggagcaucuuucauuuaaaaaggcacauucuuuuauuuauuuauuuuaguggugugacucuagccuuaguggcccuugcugugaccaugacucucacaguuagcgggugaaugaaaagguugcuuugccgcggcggccgggucugucaggagauggaggaggcugugcugggagugggcagaggucccugcagagcagcaucugccagaccucugaugccccagcagggcucagcucucagcaucucaugcuugacagaggcugaucuuuaaaacauggauauuuucuuaguguuuugucuucaccuaaauauuuggucauuuuguuuuugcaguuuuuacuuuacguaucuguaccccagcuaagcauuuuucaagauuuaaaaguccugcuuuuucccucucccaaccuuuuguguaaagcuuucacccucaagcuuacuugagccacuaaaggcaucggugacgucuccugagagagaugcgcguucugucuugcucgcugcccccgugacccacccaucuugucuuuaguacugccucuuagcccguggguaacaguguaacugugaacuaccaguguagaccccaaccugugagucugagaaaguugaaaacucagaaaaucugaaguaaugaucacaguacugauucacucucauaaugagagcuguuaagaauuacauuagagccagagagcugguucagcaggccugauugcuggaguuuuaguccccgagaaccacaugguaggauagauaacacuggcucugucaguguccucuggguaccacagccaccgcagacacacacauuuucucucucuguccaauagaggucaugaguauuaaaacugacacugauuugcgaaagguuguccuguuguaguaacugaggcacaaacugcuugucuuucugucccuuucucccucuuccugaccucucuucuccccuccuuucccucuugcacauuuaccuuagcuaagucucuguuaugauuccauuuauacugagaaauaaauuuuuuccccauuggugccaagacaaugugauuuguaccgugaaaaagauuuuuuuaaugaaauaguuuuacaaauaguagagcauauugaauguuaccuagagugaugggguuauauacaauauuaaaaacagaucuaccuuuauuuucugauacucugugugaguaaauaguuugaaaacucacggaauaaaaaugcuuuucagucaaaagaaauagaucaaaugauuuaauauuuuaaaaaggcuauuuuaaauacuuuugauauuccauaaaacuguaauaagcagcauagguaaaauugggcagugugcagcucuggcuucccacgagacucgaugcugagugccuucugagcugcugcugcugcuuuguuuaaccccacaaccagaaauaaaugucuuuucuugccagcaucuagaacaaaggcugauuguauuugagcaugaugcuuaauucuucuuuccaacucuagauuccagagugcuugagggagaguuaccccaaacccgaccagccuuguuaccuguaugugauaggaauggucuuaacuaccccccucccugaugaacucaacuucaggcggcggaagcucuacccaccugaggacaccacaagaugcuuugggauccugacagccaaacccauaccucagguaaacccuucaccgagucuauugacauagggauggaguaagcuaaugucauuguugacuaaagguacccacucuucuuuuugcuaagauuccucacuuuccuguguauacacgcucuggagaggucaccauauccaucgagcugaagaagucugguuucacauugucucaacaaaugcucgagcugauuacaagauugcaccaguacauauucucacauauucuccggcuugagaagccugcccuggaguuuaaaccuacaggcgcggagucagccuacuguguucuaccucuuaauguugguaagaaggggccugcuugccaggguugcuuuaucugggcagugagugguuugcuggugacucacucauuguguaucccacgaauccuccuuacuucacuagcuguagacucacauuaguguaccuuaaauggaaaucucaccuauguuauauuuaaccuguuaaaguguuuuucuuccugaaguuaaugacuccggcacuuuggacauugacuuuaaauucauggaggauauugagaagucggaagcucggauaggcauuccuagcaccaaguauucaaaggaaacaccguuugucuuuaaguuagaagauuaccaagaugcagugaucauuccaagguggguguuucagugggaaggaaaauggcagugggacuugcuucaggugugcuugucauuguggcuguggcugugcaccaugucaccagcaugcagagggcagccagggaaagugucucucuacucacgacauuuaaaacaauuccaaagagcacugcagcugagagaguuacauugugaaaaauauuauuucuuauauaaauaaauaauguugcuagccuuuuaagaagucucucuucccuuaauuccaaagucuuccuggagaauuucauuggggagaaugugugugccuuaagcuuucccagaagucauuguuacuccgccuguggagguggggaaggaaccacuugacagaguuagggaguggagccuguggcaguccgugauguccgaauacuugacaaagaauuagagcugggugauugacucugacuuauaugcacgcauaucccuuguccuuugccuucagucucuaccccuacccagagucgcauuguaaagguugcacuagacuaucacuagcauagauaaugaaauacauuuuuuuaaugguuuuagagcuuuauuguagaaaggcagagagagaaggucaaaauacaucuucuauaucagauaccgcauauuuaacauaauaauuugcaaaggacuuacucuguuggauauugcauuuucuguuuugauuguauugaugaagcaaauauuugcaggaacuauuuauuuagcuuuuaagauuaucaaaggaaagacauuuagaagaagaauaagggggaaauggagagcuuguuuuacuuaacagaaauauaguuuuuauucucaaauucuugaaauauuuuuuuuuuggaauuuaaauucucauuaaugcuauuuacauuuaauuauuugaacucucaaugauguguuuccauauuaaaauaguuguacuuugaagauaguugaguuacacaaaaggcaacuugauuaauuuucuuuauuuuuagauaccgcaauuuugaucagccucaucgauuuuauguagcugauguauauacggaucuuaccccacucaguaaauuuccuuccccugaauaugaaacuuuugcagaauauuauaaaacaaaguauaaccuugaccugaccaaucucaaccagccacugcuggauguugaccacacaucuuccagguaagagccacagacaugauacugagguugcacaggggggcuugcuuuguaggguucacuguaccucugccugcucauggccccuuuggacagacuugucuguguuguagaggagugugcugacagagcaacuuagggaauguguaggcauaccuaaguuggaguucuaaccacugggagguguacuuuaguuugcuuuuugauaaaauuguucugaaauuuguauagacugaaccuuuugacaccucggcauuugaaucagaaggggaaagcacuuccucuaagcagugcugagaagaggaaggccaaaugggaaagucugcagaacaaacagguaaugaggugcuagucacgggacuaaggguuuuacauugcuucuuuuaaguuuugagguuauuauaauaugaugacaucauuuuucucuucuuucuucccugcaagcacugccguguagcccuccuuacucuuuuucaaauucauguccccguuuuucaauauguacagccugcucaagcaugaccuaauuugaaguuucaacauuaucaguauagcaaugaccugugaguuuaggaaggucgccauggguauugaguuuacuuugaacauccuuguugguaaaacuuggguuuuccuggccacuggugcauugggaaucaccuucauaaaucccauuuagguauaaaggauuaguuuuagaaguuaaguguugcuagcacuuacgauuuucaccauggucccuuagugaaguuggucuuuauauuaugauuugcuuugcuuuauacuuaccagccugugcuuuucuuacucaaagauccugguuccggaacucugugcuauacauccaaucccagcaucacuguggagaaaagcgguuugucuccccagcauacuguaucgccuucacugccuucugacugcagaggaacuaagagcucagacagccagcgaugcuggugugggugucagaucacuucccguggauuuuagguaugccuguguugcuggccagaaauuugauuugcaacaaaauggaauuaaguuaaaguuguauuuuuccuauaguuucuaaaagaugacaaggaccaugugcccauuuaacacaugaaaagaaacuguacuguuuaucccugaaguagcagacuagaccauugagaucuugucaaguuagagagcagcaagcccccugagaccggaucauugcuccuguagcagugaugcuggaauaggggugagaauggauauaguucuucucaaaacuaaccucauguuagcagcagcagccuccgcuccuucuuauucuggucacuuuuuuuuccuguuagugaacgucuguauaccaaagaaaucuuugucguaauuaaguuuggucauauagauaguuguagagguugaaagcaucuuaacauaguaaugugagcaauagucccaguuauccuaccugaguacuugauacagucugcaacacaggcuuaaacaacaugcucugugcucuaugcugacauaggauguauugaucucaucuccaagagcagaaauugaggcacagagaaaguuuguaaguugcaagaagcugcucacuugguucaggaggugagcccacuaagccaguagccacugcaggaccuccacguuggguccucucagucagcucugcuuugccaccauaaacagaagucaaagcaguaagcuguucugcauuagaaccgacugugugcagagucccaggcagggccagguaagcuuggaagugcguuuucuucuuaggaugacuuuuagaguugcuugcuuuguuugcuuuuaacucaaaguguugcuuuucugagcuuacccuuuggaggguugaaagaaaguuauaaaaaugucuuugcagauacccuaacuuagacuucggguggaaaaaaucuauugauagcaagucuuucaucucaagcuguaacuccucguuggcugagagugauaauuacuguaagcacagcacaacuguagucccugaacaugcugcacaucaaggugcuacuagacccuccuuagaaaaccaugaccaaaugucugugaacugcaaaagguugcccgcugagucaccugcuaagcuccaaagugagguuucaacggaucuuacagcaauuaauggucuuucuuacaauaaaaaccuugccaauggcaguuaugauuuaguuaacagagacuuuugccaaggaaaucagcugaauuacuucaagcaggaaauaccuguacaaccaacuaccucauaucccauucagaauuuguacaauuaugagaaccagcccaagcccagcaaugaauguccucuacugaguaauacguaccuugaugggaacgcuaacacaucuaccucagauggaagccccgcgguguccacgaugccugccaugaugaaugcuguuaaagcacucaaggacaggauggacucugagcagagcccuucuguuggguacuccucaaggacucuuggccccaauccgggacugauucuccaggcuuugacacugucaaaugccagugauggguuuaaccuggagcggcuugagaugcuuggcgacuccuuuuuaaagcaugcuaucaccacauaucuguuuugcacguacccugaugcucaugaaggccgccuuucauauaugagaagcaaaaagguaaggcacgauucucguucugggcuguugcuucuucagugugccugaaaacaggccaaguuacccauggggaauucuccgugagucggugcagcugcuacucauucgaguucauuagggccagugaagcccauggaggcauugcccaguagugacgugagggcaccagugguacagccaggcuucgggcugaccuucucuuacugggaaaagugcaguuuaaaauaaaccuuugugcaaaugaggaaccauuuugcagaugaaaaaacugaugcccagacagugggauuagcuuguaccggguuguucacuagucccaggucguucacuagucccagguauuuaggggaguaugucugagacuagaggccucaccugcuggcugccuucccaguguucuuaagacaggccacgacaacugugacaucguggacaugguggguaguggcggcagcaagguuaggaggaagacauugaggaggcugucagggcugcuuacuagacgaagaucagucaguggagacaugugaaauaagaauaccagacccuauuaagcaggaaagauacuacuuuaacaucucaaaauuucauccauucgucuguucagacccuuuucacuucauuuccugcagaaauauuuauuguuuccucugccugguaucagguggguucagcaucuucuuccagacagacccugccugaacuccagcuugccagucuuaacacaagcuccaugcucucuggacagccugugucuuugcuucaagcuaaccuucccugugucuuugcucaagcuagcccucccugggauuguccucauugccaacugcugcuggaauugugccucacaacaaguccuuaguuguagccuuucuguuccacugagcuuuucucuugacuuagaauauuuuccuccuauugcugucuuccucuugggaugcucucacaugucauggaaaaggaaaccaacauuuauguauauugguuccaugguagacagcugagagguguguugacucgugguaguuucaaacacagccugcuacauugcaaggaccguuucucugucucuuugcacgcuuucuaccagacuguggccagugcugauuguggguaccagaugcuggcuaaguagcaucugaguuacauggaaagggcuccugaaguauuccaguaagguuuuagaaacagggaaugagauuaauggugauagcugcuagucuccaagugagaacuagacagaaaugucagguuuuaaguaaauuagggucaugguagagccauuaggaaaggcaaaaggacuggaaggaggauaguaaagccaccuaggugguguccugcgcagcagcuguucuuuagcaccuuuuacuccagugcugaaugcuauccaccacacaaagagcaauauuugagagugagaggguuggugucacauuauugaugcuuagacucaagagauaacaauuguuuuguauggugaugguucucaccuuacaacauauucaucccuuuucucacugagaauaucaugacaucuugaguuccauggucuugacaacugcucccagccucacuugucaucuugaauuucauauugucagucugugauuuaaaacuuugaaauugaacucuuucuuugacuuauuuaugaggagaggaguuuauauacauuagguuuuuguggauuccauuuuggaucaaauauuugacguggaaggcugucuaguacuuggaaaucuagaguuguuauuuuaacuguguaguccuuauaacugcugaccaucgugcaauacaaaaacacuggcaaaaauguauuggcacacuguaucucccagccauggccauguauggguaaguguuugugacucuuuucugccgaaggucagcaacuguaaccuguaucgccuuggcaagaagaagggacugcccagccgcaugguggugucgauauucgauccuccugugaauuggcuuccuccugguuaugugguaaaccaagacaaaaguaacucagagaagugggaaaaggaugaaaugguaagcucucagcauggagcuuuuuguuuguguugacugaagaauguuguuuuuuguuguuuucuuucugcuguacguuugccauguaguagauauuucauguguuggcaggccgucugugacuucagaaauaguguugguuuuggugcagugugauuucucuuaccuccccuccccauuccagaggcauaaacuucuguuauguuuccacuuagaaauaaaaucagagcccucucagauuccuucccucucauguuacaguguagccuuagccauuugcuggagugacucugcagugaccugugaucuccaggcugugucuggaagaauucaguucagcacagacuagcuugggcagugcuagcuuggaacuauuuccucuugccaaccugacgacagcucgccgccgcuguaugggaagguugcaguguacuacuauaaagacuuuaaaccgggccacagacuggagaauucucuuuaguagcuacagcuuccuuugucuuguccucaagccaccagggggcagcccggaggccuggacucccagcuuguggcugggggucaguugucuuguacuucuuugaaguucucaucuguucaggcgucucgcuugccagauuuauuuuguauugaugacaaaugggcucgcauuauuucauuuuuacuucaggcuuuaaugauaaugccguuucuguuacagguuugugacuaguaucuucccaugccuuguuucugacauuucugucucaaugaguccuaagugucuguagguggugggucucugaggccugcucugauguaggccugcuugcugaguuuauuuauaacucacguaggauuugacuuaucacagaaaugcaacuuagcuggaaaacauuaagagcauuuuaaugcaaauuaagucugaggauggcauuugcuauuaauuuauaacacacacacauacacacacucucgaauacaugaugcacacacucacacacacuuagaaaagugaagaauuugaaccuuagaaaaaguacuucauuuuuacuaaaaacaggccagcaggccuccucuucugucuaauauuugauccuuuagguagcagugacaugccagggcauuccugcguuacauguuacagcguggacuuguguuuucuguccuuuucugcugacucaguccuucguuccuagcacacacucucagacuuucaucuggugccguacacauaaucacuagggagucccagagucggagugguuauggacgcaagguccuuccaguuccuucugccccugggucacagcucagucucugaaugccuccuaggagagagagugagaacaguagacuguacuaucaagagauacacacacacacacacacacacacacacacacacacacacuuuucaaaugccuuuuguguuuuggagagcaucuuugaaguauaacuccuugugaaaaugaagagucugcacagugccagggauguagaagacagcgcaggaucacugggugacagcaccauguuacagggcaugauuuaugcaggaacucugcaguuuacaaccucaggcuaaauaaugucaaguuggcccaucuugucuuaagaccuaaauaauaaagcugaugugguggcacaugcuuuucccaucacuugggauacagagguaggugggucucagaguucaaggccaaccugguuuuacauagugaguuccaggccacccaaggcuacacaguuagauccugucucaaacaaaacaaacagaaacagacauuaguuaaagucuuucauguuaucuuggaaaaaugggauaguuucuugagguuugcugauagcuggguacuuggucuguacaaggugucuauucaccuuguagauacuggugccuguagaggccagaagagggaguuggaucaccugcaacccucauuagaguugguuauaaacugccauguuggugcugggaacugaacccagaucgccugccaagagcagccaguauucuuaaucucugagccaucccuugggccccuguugauguuuaguguuuuuuauuuuucaaaaaaaaauauuuuuuuuugguuuauuuuuuuagugauugcaugugguuacauggcuagacucaaagcuauuuuucuuucaggcaaauacagaguuucuaucuuuugugagucugguuuaaacugagauguaugcuuguuuuaaagucacauggaaaauaguuugaaagcguuuugucacaauucccuggaaaguuguuccauucaaaguugaaguuuacaguccugcauuugcccucaaguagggugguggcgcugugugugacuuuauggcauugcagagauugggugguaucuuagcauugcagaagaugaggucacugcugaaucauagcccauuauuaaaguugucacucacaaacagcuuuugucaaagaaauuggauuuagcaaagauuuugacagaaaugggauuguuuuguuccauuuuagucuaauuuuucuucuguuuugucagccugcuaugaccuguuggccugaguaccacagcucugaacagagggcgaaagaauaauuucccaaauucauauccucuuucaaugggcuuguuuaguuuuuaguuuuuaagcaaagcaguuuaguuuuacauuggagcaaauguuuuuugauuugaaguggaaguagagagagaaacuguuauaaugcccuccuauaguuuuuagugauaaaggguuuuaaaaauaauuuugucugcuuuuauauuauguuauuaauuguaaagauagugcucuuucuacaucuggaauuucauuuuguugguuuugaaagucaagcaaccacauucaaaugcugauagccaauggaagauuccgcucggcaccgcagggcucggcuauccuugcagucuggccgcucacuugacaucugcaugguggauaucaauuuaacuucauccuuguucagaauucuucacuuacagauuuauacuggauaaaggucauuuuauaacuuagaaaaugagcauucaaagagcauguuugacuuuguuuauaugauuaaauaacuuauuuuauguuaauugaaaacaaauggccaugauuuuuaaaaguugccuuucaguauuugugguugucauuugaaauuauccauaacccuugcuuuuauugaguuucaaacccuuuuaaaaacagcagcucugucucuccuccuuccccguccccguuucagacaaaagacugcuugcuggcuaauggcaaacugggugaggccugugaggaggaggaggaccugacguggagggcccccaaggaggaggccgaggaugaggacgacuuccuggaguaugaccaggagcauauccaguuuauagacagcaugcucaugggcucgggcgccuucgugaggaaaaucucucugucgcccuucucagccuccgacucugcauacgaauggaagaugcccaagaaggccuccuugggcaguaugccguuugccucgggccuugaggauuuugauuacagcucuugggaugcgaugugcuaucuggauccuagcaaagccguugaagaggaugacuuugugguagguuucuggaauccaucagaagagaacuguggcgucgacacagggaagcaguccauuucuuacgacuugcacacggagcagugcauugcugacaagagcauagcggacuguguggaggcccugcugggcugcuacuuaaccagcugcggcgagagggcugcucagcucuuccucuguucgcuggggcugaaggugcucccaguaaucaaaaggaccagccgggagaaggccuuggacccugcucaggagaacggaagcagccaacaaaagagccuuucagggagcugugccucuccaguuggcccacgcuccucugcagggaaagacuuggaguacggcugccugaagaucccaccgaggugcauguuugaccauccagacgcagagaaaacccucaaccaccugauaucuggguuugaaacuuuugagaagaaaauuaacuauagauucaagaauaaggcuuaucuucugcaggcuuuuacacacgccuccuaccacuacaacacuaucacugguaaggagcuccagggccacucuccugucccaaagcaggagacuuugugucuuguuuuggucuuacacaaauaagaucugugcaugcacagucuuagugcucaguacggaugcauggcugggggaggaaguaaaagaaagcagaacucuaaugccccgucugcuggggaguaagacugcguggugaugugagugcuggguguggcuccuguauccucucacgcauggcaucuuacaugcugcauguguagaaauccaagcucugguguuugcuaccuaaauaccuuucuuaggcucaguuguggcuuuagcuucuuguuuuacucacauauguggcauguauuucuucaucuuuuuguuguuccuaaacgaaaggcaccucucuugucuuuuuaaaucuaaagaugagaaauuuaaacagaaccauucuauaggaaggggucauugcuucccacuguacaaugcuuuuuuucccucuugauaccuaagagggucccuagaaccagacagcuucagcuggugaacccagauaaagcuuaucucuugcuuucugugugagaauaucaagcauaucaaagcaaaacaaaaagcuugugugugguuuggaugguaaaaaucauguagguuaaagcuguuugcaaaauauuaauccugacagugacgguccaaaguaaagccugcuuuucuuuguggagaggaaaugguguggucuccauccauugcuggaaacucugaggccugggcucuagccuggcuugucucuuuuugccucuuccccacuggauacucuggaacaggucacuucugucccagccucauucucucagcucaguggauucuuuuaauggcuuugaggaaaucaagguucugauccgcccuggacgcguuuucauucugacaagcauucuuuuugucugaguguugugcccuagcacacaauucuuucuuagucccuagguuugucaaguccagugcguuugaguuugaguugaagagucauguuuucccugcugcugucccauguaauauauaagagggaaguauuaaggaauuaugucacuuagcacacauugcagaguguggcugacacacugccucgauggcaguggacagaaggcaugugugccauggauggcuuuccugagaugccaacauggugagagagauggugguggagggaugcccagugcccgccuggcugguauagugcccagggaaaggagagcuaugacuuggauugcaucuggaaaguggcuuucccccccucaaaaauaagcauauuauuugggcacuggaaauuauaugacccaauuuauguauaauaugcuuucaauuaccauuaaaacuuccaggugcauuagugaguauaugcccaauaauuucacuaagaaagguaaaugaaaauguuccucaguagaaaucucaaggagccuaggacugcagcuuuucugucggcucccgugcagauagugugcagaagugcaugugcucaugcaggcucaucauugcacuuuggaucucugcgcagauuguuaccagcgcuuagaauuccugggagaugcgauuuuggacuaccucauaaccaagcaccuuuaugaagacccacggcagcauucuccaggggucuugacugacuugcgcucugcccuugucaauaacaccaucuuugcaucauuggcugugaaguaugacuaccacaaguacuuuaaagcugucucuccugagcucuuucauguuauugaugacuuugugaaguuucagcuugagaagaacgaaaugcaaggaauggacucugagguuagugcuguuuaaacugugaacucggugcugagggaagcagccgacugcgaguuugggcagauugaguccugacuccuggcuguccagagggauaguugcaggccaggaccagggugcccccaugcugccugaucuccaagcgagccgagaaugacuugccuuacucagguaggccuuugagauggggcugcccaccccauggaccacguggucauucagacaaggagccuggguuuucaguuaccucagugaggcuccuacagcaggcauagacaauuguagacguacaccuccucccaugccccaaaguggccuuagccucucugacaccacaggaugaucugauccugucuuuucuaagugggucacaaauauuugguagcaucucagguaaaccucacaaauguacacuugcauuguugaagugggaacucgggaacucuuauugaaaaacaaacugaagugggugccgggaggcaucugccgcugggcugggcugcuuggcuccagugugugugcuucggugugugugugcugcagugcucuggcucuuuguaggcagggauagugcucagcuuccugcacccaggacccuaggagcuuccaucccacuagagggauuuauucucaggucacuguugucauuuuaauuuuugccagcucuucaguggcugcaaacuguuggagagcaguaagucuggggcuaaagcccuggcagccaaacagcagagcuccugcuccugugccuuagcagucacagcccaaauccaagugaugggggccgaccuguccuguguagguuucuguuucauucuuuacaaacaguuaaguuugaggagcucacuaaaauucaauucaaguugucuuuggaugcagcgaggggcuagucagcuuugcugcucuuucagcguucuuuuacugcccuuccuguguacuagcugcaaauaucuggcuguucuaacugaacuauuuugucuuaaggaagucuaucuuuguggcucucagcuuccuuagcuguaagaagagggagcuaaaccugccaggguugacauugucuuuuaucccagagccagggaauauggauguaucaacauuuaauacguuuacuaauuuauguacgaguugaaauuuucuccuuuccuuccuucucuucuacaguaauuugugcuuuguuguuguuagaaaauccaaguaaauaaaaaaagagaauuggagcugucuaguuaguuaugcagcccuugcguggucagcauuagcauuuggcgauaacuguugcuaaggaguccagacuuaauguacagaggcuggagcuccgcacacuacagcugcucccucacgugcugugcuugcagcugaggacuggugcugccgugaucaucuugagauggcucguucccuuaaaugauccuucuagggguuugagcagcuuucguuaggcugcacagugacuaugagugugaggcagaggccugugcgugcaguuagcuauggccagaggcggggcuggcgcccugaaggcuuguaggcuuuacacagggguuguuuuaucccguggaucugaggaugcacugugucggccaugcugucagagugagugcaguucauguuucagugacagggcgacuggggggaagagcuuccgaaaggguuccuccgcccaaagagugcuagucucuaaccucguccccgcgcugcucuugcugggugcugaggggugccuuuucugagaaaggcaguuacuugguuacaggugauugugaccauguuuaucuugcaacucuagauuacaccuaaguucuguucugguuugcaaggguuuucccuuugcuggcaucagguccuugucucuggcucuugggaagguggcuuuggaaugcccacugccgugagucaggugcaccugggcguugguuacgauugugaaauaguaaaaggcagcuaagagaagccagucugggguagauagucuuugaaggugcccuauuugacaagucacuuuucuucaauagcuuaggagauccgaggaggaugaggagaaagaagaggauaucgaaguccccaaggccaugggggacauuuuugagucucuugcuggugccauuuauauggacagugggaugucucuggagguggucuggcagguguacuauccgaugaugcagccucuaauagguacagugcgggcucuuucccccugguguauacaagaacacuauuuaaaaugcuucuagggccuuuagucaccuuauauaaucuauuguucugauuauagaaaaguuuucugcaaaugugccucguucuccagugagagaauugcucgagauggaaccagaaacugccaaguuuagguaagcaggguguguacgugaagaacuaacauaucuacacucaaggguucucaagaaaccguagcuacugaaugagagcgccugcauggccugcauccucucagcguccacguuggugugaccggcuguucuuccccuuuuuguuuucauaaagugaaacugagggagggagggagggagggagggagggagggagggagggagggagggagggagggagggagggaggggagagcggccuaugugugcuaaggccugguacauggucaacucauaagagggacucagcccaggaggacuggaggugucgacugacaguaauaacaaauacuucugauuccuaacucaaacugucugggguuuugcagcccagcggagagaacuuaugauggaaaggucagagucaccguggaaguggugggaaaggggaaauuuaaagguguuggccggagcuacaggaucgccaagucugcugcagcacgaagggcccuccgcagccucaaagcuaaccagccucagguuccuaacagcugaagcuuccggacucacaggcggcaagacagcggaccagaaccacagcuccacggcacaaggaugguucgggcugacacagaacaggaaaacugaaggcagaauuuaaaguuugauaaugagauagauaacagaauaaaacauguaauauguguauaaacucuuuggaacuaauuuugguuuaguuuuugcgcagacacaaucuugucuucuuuacccacccugcuuugcuuagucacaggagugcuuuaauccugguguuuguuagcaagguuuuaaaaucauuuugacagguuuuugguuuuguuuguuuugacauuuaauuucugucgacuuugcuugguguuagaggccauggagcuuaaccucuaacagucccuagaacugggucguccugaccuugcggucccuuacacuauaccuguccugcugcggugucaagcccaacaaaaagggcagagugugcaaaggaagcccccgugcuguggagggcaguggaggcggggccgggcggaccccggguacuauugcacggaauaguaagggacagauuuugaguccguguuggcugcuggugaguggaggccaggcuuucagacgccacauugugcugcagagaggauucuugccuuaaaaggaaggacuugauaguuugcuuuuuuauuuugccuuccccuuauuaugcauuggaugaaaugggguggcagcucacuagggcacuugcaauggaacuauugcagguaggauuucuguuguuuguacugaagacauucuaaaacccagagugaguauauagauuuuuaaagcaucauuauagacaggauacaugacuagaugcccgguuuuccucagaacuuccugccagguggucccaguggcggaaaugcccggucagcugcuguucugacgaaaugagccugagaugcaguguaccuagacacgccacaggucuguacuaggcaguguugccagagucaccaaagcugugcucucuuuccuauggggucagcauuguggcagacugccaggaccaacccgucugggguagaagucaccaguuuagauaaacuaggucauuaguucaucucagacucagaaaguaaagcuguuuaggcauuugcugaaggucucgccugggcuugugggccccucuucacuuacacaccucagucccucccuuugccugcauuuucccguuggugcuacguuuauguaucaugcuugaaguuuaauuuuuugcacugugacuauaauaccucuuaauuuacauuuaaaaaugcuguauggguugcccgugcccucccaccgacacacaggagagcuuugcugcaauuugcccucuuacgcuugaagucucagcaggcugagccaggguagcucgcguuccccacacaucuccugaggcugaugcuucauguaaugcugcacuuagguucaagucacccgcccgagagagagagagagagagagagagagagagagagagagagagagaugcugugugugugcaagcaagcacucgggcugucaggaaccccauggggagggagagugagcguccccaaggaucacgugcuguugcuguugcccaucugcaaagcaggaucugaguuauuguuuggugaaauuaauuuggcugacucaucuuaaguauuuaauucuaacgugcgauuguaguugucuguuugacuuagaacaucccucucccccaugcgcgcgcacacacacacacaaaccuuaaugcaagacauccuagcaugugcaaaccaggugaucuuuugaauguuguagcuauaauuuguauagucagauaguaagguggggugggauugugggagguggaguuuguugucuuaucacaguccuuggggauuuauaaacuaccugauucucugcauugugauucgugcauuuauguccugggauggaugcucuggcauccuggcaccaaaagcagaugguuucacacuuggauuccugguggaagaagaaaaugccucaguauauuuuguaacauaaggagaguauuuuuuguuaauauugaaaaguucagaauuggauaugcuucguucauccauucucagggcucaaauguuuugccacuauucagaauguuguaucaauagcaaacuugggcuguuuuucuuuuucuuucuuccuucuuuuuuugauugcuguuagauaaaaguaccugauaacuaguuugaaucauacugugauuuacccagagaccaaguccgaaaaaucaaaaguaugaguuagacgcgcgaucaggagugcguuuguuuguguuggggguuguccccagguucgcugguugaaagacuuugcauuuuagagaaaaaguuguucugcccccucccucgaugacuccaugagccuccuccacugguguagcaggaggaggaggaggagacagccagcgcccaugaggaggaagcagcugcacagauccuguggcugcaugcgagcucggcgggcacugcacuguugggccguccccuguggcccuuuugcaaucccaggcaggcagagugagugaggcccuguccucuguuggguugugucuguguggcacaggcugggcagugcuccggcacucacgcuuaacccagaggggaggccaugcuugggccucaccgcgguuccgacuugagaacauucugggaugccugcagcuugucacacaauugcacauuugaacuguuauuauuuuugucugugacauuuucuuuuaucuguaaaguugaaagcauggcagagauuuguugacugaacacuuaauuaugcuuuuuaaauguuuugguuacguuucuucuuuuuuucguucauauuaugugaaaugauuaaauuuagaauaaccucuaacacuccuauaauuaucguuuaaaauaccgauguuuuuauuuucucgacaguaguccguccucagaaagaugcagacacccuguguaauuagcagggacuugaggcugcuucgguucugccgcucaguucccguguacagucaccagcagccaccagacaguggcugagagcguggagggagaccagucaaaaacccacaaccacccgcuuugcucguggggccuguugauuuaaaacuacuccuugcucggugaaggcaccuaguccuccugcacaaacuuaacugcuggcaauccgaggccuugcaccuuuauuucacagacccugagcugagccuacagccgcauccuuagccaccucgggcucugugugucuccucugugcuuaacaacgcccaagaacccauagcuucccaucugcugauugcuucucuggaauuuaauuauuucucaauaaauucuguauuuuauauuguacgugagacauuuuaaagauauguuugagaccaaggauaguuaaaaugacuguaaagguagugugucugccauggagacggagugcuguccacuggcagggaaaaugaucaccucaaacuaauuugcaguuauuauuugacucauuauuuucuugucugucuuucuuugauaaacaaccacagacaguuuaaaugucauacauggccucagaauuugccuuggcugcugguuccauagcagaagcacugaggugaagggaagaacauaucugccuuuugugcuguaaauaaagggaaaugacuaacggagucaggcugaguguucugccgacaagaaacggaaucacaucacacucugcagccuucuaaagaaaccuguauccaugcacacagcuaucacugcagagcugugccagcaccuauggaccacaguuaccuuuagcuuuuccguuuuguuuuguuuuucuuuuucuuuuuaauaauuguagucaauaaaguuauugucuguucacac

SEQ ID NO: 6802 - RNA, 3362 nt, Mus musculus
cugggcgacacuggacagaaccuuaccagaugguugucagaacauccugccagcuccuggguguaucgcccugaaacaugaguagaugcagguaucugugcacaaugugagagacagcgacccagcucaaccgagaaaaauggaccuuagaggacccaaaggcacaucugagggcagacaauguccccccuccccccaaacagcugcgucagccacaaagaagacucacacuccugaaccaagaacaggaggcuacacaacaaaacucagagaacaaggaagaagucuuagaagcuaaaaauaaaacauucuuggaaagagaagauggagcaaauccccucagaagcagauacagacagaggugagggauuuaagagacaaaaaaacguuagaagacaagccagggaggccccauacuggggcagccaggggcucagaaagaaagaaauuguaagaggauuuaaggaguuucccaugaggacccagaauaggugccacagcaaaggacaggacacacucaggucaggccaccaagagaaaggagacuggggaugucaaccagggaagggagaguccuugucuuguacaaaggcauggggcagaaacggcaucggaaucuuaagucugccacuggaaagcagcagcaagggcuauguugccaccugcggagcuacacccagccacacaguagggcaggagacagacauguuaagucauggaacaaaacaaaacaaaacaaaacaaaacaaaacuaaagcuuuuuauuucucacauuccauuucucgaaaaguuggugaaaaacagacagaggggggggggacacagaaggaagaggaagagaggacacagaaggaagaggaagagaggacacagaagggaauaguaggagaaacagcugaaagguagacaaaagggacuaugaccacaaaugagccucaggggcagcugcccuuguuucaaaccuacagcacuuucuuauuuaauagaugcuaacuaagcaaggcuggagacgugauucaguaguuaagcgcacaugaugcucuugcacuggacccugauucaguucuucauacccacagaggggaucugaugccuucuuagggccuccauggguaccugcauucaugcgcgcgcgcgcgcacacacacacacacauucacucacucuuuaaaaauaaauuuuuuaaaagaugucgagugaccaacagcuugccagcagcuuuccauaaguggucucuucuacaugccccuacacucaagugagauuauuuuucccuuucaacuagcaacuuccugccaguuugagccgaaugaugcuugggcaucuugccuguaguaguuuuaaaggcuguucuaagccacaggaggcgagagaagcaguaugcgcagacuucggaccaaggucuagacccauaaaauaaacgauucacaucugggccagcuccucuuugguaccucaucugggcaaggacccugcagugugcgaggucauaaaacaucacacauaaaaccuuuaucaucuguacuuuugaacuuccaaugggaccagggagcucauuaagucguucacuuucuuuggagcuuugggccuuuaaccuggaaguguuccaagcccccaaccucucuccucuuagaaagcuucaauucuuuuuuggggggagggggaggcagacgccaaucaaaauggcugagaagccaaguuuuuaacuguccugacucaaugugcuauguaaauugucugagucguugguuugcuuaaggagaaugacuccugggugaagagcagcguucaugucagaugcaagaugugaugccucauucccauuguauccauggaaacacaccucuggaagugacucugagggucuuuccagaaagaggcaaggcuugcccugaaugugggcagcaccauccccuggacugggggucccaaccugaacuaacacacacucuuuccccccuuccccuuccucugccucccgauacaacaugacuagcccccucacauuccugcugccacgaugcccgcuguaugauggaucgcauccuggagcugugagccccuagacccucuccuuucuucuuaaguuguuuucucaguugcuuugucacagcaacaagaguaguaaccaacacauaagccuuuacagccgucaagaacauucuagaaggagcccaggcuaagcuuggagguuaauaaaaggucuaaaaaggacggcuguguuugagugaggacauuuguguaccuggcuggacguuuucuacaaagaaaaagcaauaguuccagacucgggggccaaguggccugggggcuagugaccagucugugauaggcugugugaccuuggccagccuguucugccucucugaguucagagaugcucccugaggcccauucuggacuaacgguuugugguuuuauaagggcugccuaguguguuuuuuuugggggggggguucgagacaggguuucucuguguagcccugacuguccuggaacucacuuuauagaccaggcuggccucgaacucagaaaucugccugucucugccuccugggugcugggauuaaaggcgugcgucaccacgcccugcuagugugugcuuuuugagagggauagcaagggcaagaagaagcuggagcuuugccagacuugagccuucgcaaaguggacaggggacacugggguagguaggggccgaggaagacaggagggugagaaaagaaaccuuucucuuccugcaaccugccugccccagccuauacccugguccuuuccagaaagccuuugcaagaucucuguuugguugaccgcaaaggaugcuggugccaagguacgaaugccuccugagcccagaaaccugcagaaacccucccagcgccaccauuugugggagcuuauuuuggcugggccacuuccagcccccuggggcaaccucaugcagccccucaaaaaagacagguuccauacagaagacucagcagaggaagggagagucagggcuaccccagucagccagagccuugcuuugcaugcaaaucuagacuggcuuucaucugauaggagguccuacugaugggcagguuuuaaaacuagagccguaccucaauucaaucaauaaaaaggcgaauuaaaaacgcaacccuccaagaacaccaaggugaaagacgaauggguuguagcucacaacaaaccuggcagaaacacccucuucuuuggagucugccaauggccggguguaauuuccagugaacgggcagguaugugcuguuuaaguccccagcaauggaugaccaggcuggggcagguuaucgcucaaacacucacacuugaaggcaaacaggguaccguucuuccuacca

SEQ ID NO: 6803 - RNA, 3362 nt, Mus musculus
ugguaggaagaacgguacccuguuugccuucaagugugaguguuugagcgauaaccugccccagccuggucauccauugcuggggacuuaaacagcacauaccugcccguucacuggaaauuacacccggccauuggcagacuccaaagaagaggguguuucugccagguuuguugugagcuacaacccauucgucuuucaccuugguguucuuggaggguugcguuuuuaauucgccuuuuuauugauugaauugagguacggcucuaguuuuaaaaccugcccaucaguaggaccuccuaucagaugaaagccagucuagauuugcaugcaaagcaaggcucuggcugacugggguagcccugacucucccuuccucugcugagucuucuguauggaaccugucuuuuuugaggggcugcaugagguugccccagggggcuggaaguggcccagccaaaauaagcucccacaaaugguggcgcugggaggguuucugcagguuucugggcucaggaggcauucguaccuuggcaccagcauccuuugcggucaaccaaacagagaucuugcaaaggcuuucuggaaaggaccaggguauaggcuggggcaggcagguugcaggaagagaaagguuucuuuucucacccuccugucuuccucggccccuaccuaccccaguguccccuguccacuuugcgaaggcucaagucuggcaaagcuccagcuucuucuugcccuugcuaucccucucaaaaagcacacacuagcagggcguggugacgcacgccuuuaaucccagcacccaggaggcagagacaggcagauuucugaguucgaggccagccuggucuauaaagugaguuccaggacagucagggcuacacagagaaacccugucucgaaccccccccccaaaaaaaacacacuaggcagcccuuauaaaaccacaaaccguuaguccagaaugggccucagggagcaucucugaacucagagaggcagaacaggcuggccaaggucacacagccuaucacagacuggucacuagcccccaggccacuuggcccccgagucuggaacuauugcuuuuucuuuguagaaaacguccagccagguacacaaauguccucacucaaacacagccguccuuuuuagaccuuuuauuaaccuccaagcuuagccugggcuccuucuagaauguucuugacggcuguaaaggcuuauguguugguuacuacucuuguugcugugacaaagcaacugagaaaacaacuuaagaagaaaggagagggucuaggggcucacagcuccaggaugcgauccaucauacagcgggcaucguggcagcaggaaugugagggggcuagucauguuguaucgggaggcagaggaaggggaaggggggaaagaguguguguuaguucagguugggacccccaguccaggggauggugcugcccacauucagggcaagccuugccucuuucuggaaagacccucagagucacuuccagagguguguuuccauggauacaaugggaaugaggcaucacaucuugcaucugacaugaacgcugcucuucacccaggagucauucuccuuaagcaaaccaacgacucagacaauuuacauagcacauugagucaggacaguuaaaaacuuggcuucucagccauuuugauuggcgucugccucccccuccccccaaaaaagaauugaagcuuucuaagaggagagagguugggggcuuggaacacuuccagguuaaaggcccaaagcuccaaagaaagugaacgacuuaaugagcucccuggucccauuggaaguucaaaaguacagaugauaaagguuuuaugugugauguuuuaugaccucgcacacugcaggguccuugcccagaugagguaccaaagaggagcuggcccagaugugaaucguuuauuuuaugggucuagaccuugguccgaagucugcgcauacugcuucucucgccuccuguggcuuagaacagccuuuaaaacuacuacaggcaagaugcccaagcaucauucggcucaaacuggcaggaaguugcuaguugaaagggaaaaauaaucucacuugaguguaggggcauguagaagagaccacuuauggaaagcugcuggcaagcuguuggucacucgacaucuuuuaaaaaauuuauuuuuaaagagugagugaaugugugugugugugugcgcgcgcgcgcgcaugaaugcagguacccauggaggcccuaagaaggcaucagauccccucuguggguaugaagaacugaaucaggguccagugcaagagcaucaugugcgcuuaacuacugaaucacgucuccagccuugcuuaguuagcaucuauuaaauaagaaagugcuguagguuugaaacaagggcagcugccccugaggcucauuuguggucauagucccuuuugucuaccuuucagcuguuucuccuacuauucccuucuguguccucucuuccucuuccuucuguguccucucuuccucuuccuucuguguccccccccccucugucuguuuuucaccaacuuuucgagaaauggaaugugagaaauaaaaagcuuuaguuuuguuuuguuuuguuuuguuuuguuuuguuccaugacuuaacaugucugucuccugcccuacuguguggcuggguguagcuccgcagguggcaacauagcccuugcugcugcuuuccaguggcagacuuaagauuccgaugccguuucugccccaugccuuuguacaagacaaggacucucccuucccugguugacauccccagucuccuuucucuugguggccugaccugaguguguccuguccuuugcuguggcaccuauucuggguccucaugggaaacuccuuaaauccucuuacaauuucuuucuuucugagccccuggcugccccaguauggggccucccuggcuugucuucuaacguuuuuuugucucuuaaaucccucaccucugucuguaucugcuucugaggggauuugcuccaucuucucuuuccaagaauguuuuauuuuuagcuucuaagacuucuuccuuguucucugaguuuuguuguguagccuccuguucuugguucaggagugugagucuucuuuguggcugacgcagcuguuuggggggaggggggacauugucugcccucagaugugccuuuggguccucuaagguccauuuuucucgguugagcugggucgcugucucucacauugugcacagauaccugcaucuacucauguuucagggcgauacacccaggagcuggcaggauguucugacaaccaucugguaagguucuguccagugucgcccag

SEQ ID NO: 6804 - RNA, 1835 nt, Mus musculus
cgguuccuuuugcggugauugcuacgguaacgcggccgguaguccugcgauggcgugcaccagagaggagguggccuuccaugccucaccggcugaggccagccgcgaaccuggcguguccuggucugcccggggcuccagccuccgacccgccaugcacauggacauccaagccguguccugcggccucccgugggauucuuccuccagaaugagguuuuuuuuuuuuuuagcauaaaacuauaaguauuguguauguaugaucugcgugcaugcaucuucagaagacgacuuuuauaaaggguccggggauggaacucuagcuugcaggguaagucccuuggcacgcugagcccucucccuggccucuagaaugaugcucuucucguagaaacguguaaagugcucuagccgugggacggcuggcuuuggggucucggugacuacuggggucgggaaggauugaaagaacaagggaauugguggguugccgggcccuguggccauugucugcaacguugccuugccucuuaagaggcugaggcaggaggaucaguugaacucaggaguucuaaauaagcccgagucagcccgggccguacagcaggacccuuuuuaagagggaaaacggagggugaggauguagcucaguaggaagucguuuuccuaguguaagcgacguccagaguuccaccccgucacaugcacacagacaguaauaaaagagaguauucucuuagugaauuccgguguagaugaugauggccccaggguagagugcuugcuugcacaucugcuggggauggugcagaagagugggcaggcgcgucguuuuuuuacauggacuucccccuagaacagagccccggguguggucaguucucccgccgguaguacgcagauccagauccuggccagcaggccuccgcagcccacuaucuaaucugcagucuuggcccugcgcuggguuagcgguacccuagagcacaccagacuugcagagaaagcagacaacagaggaagcugaggcaugccugcucgagaggcagcaggcccaugugcaauuuuccucugauagggccuggguacuguugccacggugauaauggcugugccgugucauugucgauccaccaacagucagagaagcuuggcagucaagauauuguuuagcagacggagcgguuucuguuggacacuaaguacugccacaaaaccucgagcgacuaagcguguugccggagguggucuguuugcacccggggagugaauguaaaaaaucagaguucacacagagugagccaugggaugugcuaagcuguggcucagagggaaaccggagccacucgcucugaagacagaugggaaccaaccgccuggcggguuccuugucauuguauugauuccugguuuuuuuauuuuuuucugauggcaagccccaaacuaaaaucuuguuauuuugcagauccucugauuccagguaccauacaaagauguuuacaagaaaugcagagguaaaacagcugcuccgaaagccaaccuuuuguguccuuaacggcagagugucaguuaaaucgccccagcgcccggaagcuuuuauucauguuuacacugcugugaguaguuauaaauaaauaaaccaauaaauaaaugcuggcaguuugcuucugggaagcugugugucucgucuacucucagccguccaauuggcuuuggugcucacugggugaagggaaagacuuugcagacugcucuggggaccuggaagcagagcagugguggcaaacagcauguugcuaacuauuagugguaacaaaacuccuggcccaaaaaaa

SEQ ID NO: 6805 - RNA, 10258 nt, Mus musculus
ggcucuguaagcccuggaguggccgcagaggcgguggacagcgagcgggcaugagcgcgucccugagccgggcggcggcggcucugcugcgcugggggcgaagcgcugguggcgguggccugcccggagccggcgugcgggcggcgagcucgggcggccaggcggagcagcuggacgcgcuggugaagaaggacaagguggugguguuccucaaggggacgcccgagcagccccagugcggcuucagcaacgccguggugcagauucugcggcugcacgguguucgcgacuaugcggccuacaacgugcuggacgacccggagcugaggcaaggucaggcccgugggauccgauugcgagggcgcggugaacuugagcagaucccgaggagcaagggccuucccugguuguguagccacaugggcggaggguucgccucggcccaccucggggcgagauguuucugacugcauaggagaggggguagucggcaucaugauccccucugagcaggucgacuggggaguggcuggcugagagggggacucacugcgaauacccuuggggacaauuugagggcuuggaagccagcagcguacuugcuaggugagggacugaugcuacuacguauguagggaagagguuucaggcuugccugugugugccuaacgaggucagaggcugacuaauaauguuuaaggccccgagggucagggacugucuucuugcuggagagaagguuucaccauagucuagccggacucacguugggaaagacacgaaguuuguuuuuuagauacuguagcaucaaagaacaguguguggagacuaagacaugguagaggcucagcggaaagaggaagccacuaagaaaacuucugacccccgaccagauuagcaaacugcggccagguugggcccaaagggcagagagcagaacagcuuuuuacuggccccaaggcaaagcgacugcguccugacgucuaguuggaauccuuuauacacaguaccaggcaggcgccuuucucuccgucuugugcuugcugugagcgaggaagagaaaggccagggauuugguucugauucuuggcaagaaucggucaaggugggccggguaaugggaaagcugcccccuccccgcacccugcuccuccuucaguggaauccggggaacccuguauucaaguagcccccccccccccaucuuacugauuuagugcucuggguuggucacugugcugagaggagacuugucuguguuagaauggaguaugcaacauuugcaauuacugauuauaguuguucgucguauggucauucuucuugaugaggcuggggccguggagagcagguuuggcuuggaaucaucuguggugggucugcagcacagccuacuguaauacuacuucauuauacugccuucucaguauaaugaagauuaugacaccgaaccuggcagaguccacgaggaaacgagagaaaauaagaauuacagccggguauaguaacucacuuccauaacccagcucucuucaggcggaggcagggggaccaccaguucaaagucaggcugcacugcauugugggaaccccccacccccuucucuacuguauauaauaaugucauccucucuggcacagaaggcacccaccacguggcagcaacuuuauuauugaaucugauggcuuccaaagcacuuuuccuccauguuguuaaguggcuaaccccacacuuguucccugugauaguguugaugggcgguaaagcagagaaagggaggcgagguaaugagugcuaacaggaaugauggcaagccaggcauugugcucugaacccugcguuuuccuccucagcuaacauuuggcugcuugugaggcucugggguuaucuggcucagggcaugcaguagcuuugggucagagguggcucccugcaggggaagauaaggggcuacucuucggccucugagcugggaccuaccugcgguagcguguugcccugcuagcggggcucuuagcagacagcugcguugaggauaucucguuuaacauggggccugaggaucuuuggcuuagacuuuccgcuccccugugaguguaacuggagguucgauagaguggguacaaccagcaugaguaagaauagcaagaccuguucugucauccaucucucaucauuaggugcucaaaugacagaagaaaacucuugauuuuguuguuguccuuugcuagccagguuaagccuuucaagaggacuuugucuacaccuguuugccaaagggcaggcaggcaggcagcucaugcucacuuuggcaggcaaggaggggcccucuuaccugucccacugcaguguggcugcugugacagcgguccguccuuguccuuuucccucaugccagaguuuucaaagggcucugguucucacccaggauccaggacgagcgaugcugagaagccuuccgguccucacuuuuaucaccuggagguacacacaggccacagccaccgggcucuugaggaacccagggcacagugcugcuucgugguucccugggcaauggauccuguggcugcugacauugugagauccuaccugucugcacauagcaucucccgcucggaggccaggggccuggcuugcacaguagccugugcugcugacauugcugcuugagcagggcaggcuuucugugacugguuacuaugcuaaggcgaggcugguguuauucacggucacggcacagacuucucugugaccgcucucacugauagucccaugcccaccucuacguguucuuuagaacaggagcagugucugccaggguagguagggggcugaacguuuuugaaugcauaaccguuaccccauguuuucuuguucuuacaacuuguaaacuuucgaugcagaagccuaggcggcauugccguguguguuguguguguguguguuguguguguguguuguguguguguguguuguguguguguguguuguguguguguguuguguguguguuguguuauguaacaaggucagaguaccuggccuagcugucacuuuggacauggugaucucccugcugguugcugguuuuugugucccaggcuuuuccaucuggcucucauguauauuaaagcccuucuuugaacccugcugugccucaccugugaacucuguuuucuucagcuccucccaguccuuuccccacagccugcaagaguuuaugaagcaguguccgaacauccaaggaaauaauuagguacuuacuacucuggugcgccccugugggcccagccaugugcugugggcaucuggcaccagcacuuuggaauuguaacagucaguguuggagaugcacagaucuguuucccuucucccagagagauagucugagguggagacagcuuccucugugaagggccagguggacugugggcuccugggucaccauugcuucuguuucucuguuguuggaggcggaaaguagacucggaugcuguauaaucagugagcaagcugaauucaauaaaacuuuauucacaaaggcaggaagagguuuagcccaaagccuuugcccuccccaccaggccucgagggucccacauaagauacacguguaaggugucugugacaccuuguggugggggagaacgacaagaugggacccuguucuguuaggaggcuggaucagcaaauguuucagcgauccaggguaaaaaaaauacacugugcguagacaaacuagauccugguguaguugagguggcuagauaccagagacacguuuggucaaaaguaaguggcagggaguaccaguggcccaguaaauacugucuguguauacugacaucagaggugugaguccgucccguggacuguacaugcuugugcagugagcggguagcugucggugggacaagcuaugcugagggucauggguucagaggcugacuuuagaaacugaggugcuguccuggacccaccacaugcuaacucugugccuguggguaacuuacuuacccucucgguacccuaacuugaucugugaaacagggguaauuacaucaucaauuacaucaucgggcgucuguauugguuaaguaggauuauuuauggaaaauacucacggaguauggagugcuguagcccacagcucugcaaaugcugcuuccuccucaccguggggaauacccugcaugugccauuccugcguucuucucaugcuugcuguuuccuguguugcucagaaaaguacuucugugacaaacgggacagaagaccccugacagggugggugcacauucaucuauaauccauacgcagcugagccuggcacuucuauaggaaguaagucgucucagcaguuacagaccauuugaucuucucaguaaacccaugacgcagcguggacuucggagccaaggaaacugagagugggggcuuuugucaccucccugaggcugcauccagaugccagugagcccacuccgcugcucugugugcccaagcuauugucugcuguuuccgaucuuugcuguccucuccugaggcucuguuuccaugcugagauccccugacuggaagaugggagaaaacccuagcaugugacacaccuaggccagaaucacagagccugcuaugugacucugggaacuacuccacaccgaaauucuacugggaaccaggaaaaccacggcagugugaugcgcuuaagcgucucacuguagacagcaccuuuuggaaguggacagggcaggcaauuuuaauacauguuuccuuucuuuuuuucuuuuuucuuuuugcuuugauaaacuguaauuuuggggaggggcacaggcaugggugugcgugccugugugugugagcaccagaggugcauaggcaaaagugcccgagggugugaacaccagaggucuacgcuaagugucuuccucagucgcucuacccaguuuccuuacggaaccuggagccagccuggccggccagcaaaccccagggacucuccuagcucuguccccagagcugagguuacaggcacaugugcugcugcgcccaucucugugucaugggcucugggggcucaaacgaaggacuucaugcuugcagggcucccaccuugggagcacagccaucucuccugacucccugacuggaaggauugcuagcuugguuuuuuuguuuguuuuguuuucuuuucuucuuauuguucuuuguuuuugaugucgaucugugaacugagucccagcuuccuagcucgauuuaggguggcuuccaugcaacacuuggccuugaauuugauuacugucuagacugguucccuaauuuucaagaguuccuaccugacugucgccaaguagugaggucuugaacacuaagugggaaguaaauaagccauguuuggacaauccccaugguucauuacaguguguaagguauggaguuacaguaagaaagaacuuuacucccuaggaagauucagcucuaacagaccucucaccugcaguuccggcacuggagauuaacgcaggaguaacucugcaaguuugaggcuagcuugagcuacagcugaaguuccggacgcaccugggcuaaaacaaaacaaaauaaaaaagcucccagcaagcaacaguaacagcaacaaaaguaaucccagcgaccugucaucccguggcacccaguacugccaggaagcugccgugcguccuugaggcagagcucuuuaaaugucagccaugagacaagacagugggcaggguggaacugugacagugucugagaaccaccuguuggcagccagcugaugggcguucugguacaggaccccagucacaggccuugguggcagcgccucacgugugggaccgaccagcccagggcuugggugaagugagugcuaccauguguccugccuuuccugcuucguccaccaugacuuccugccaagauggacugugucugagggcacuugagcccaagcaaacccuguugcccuuggauggaaaacaauucaguguaaaacaauggcacuguuuagauguagaggucagugagguuuggggcaggccucaggcagcgaguguauuuccaguuugauagguuucaaagcugugggcccugaguaaaugcauucaguaaggaaggcaggguugggagacacagagaccucagggacucacaugcagucuccagcucaggagacucagggaauguccacgccugccucugccauaaagaucugccgcugucccauaggcuguuuauauugcagggucaaguuuaaggugcaaacagaaaccaaagcugcacgcccuacacacugaguaguugcucacagugugugcaccccacagcagugugguggagcucagugcaccugauccuggaugccgugaagcccggcaggauuugcccucuacuauagccucccggcaucuucagagggccucucugugagguccaggccugccuuagcugggcgcuggcuuuacaagggugggccaccacaccuagccugugacucucaguguucacugucuggagaagcaagauaagagcuguaacccagucucccuccgacucugucauuuacagcaacucggugcuuuguagagaaagacaggaacucuagaaagaaaguauauacugucucuugaggcccuuguuuuguaucucacaucuguuaauuauauuuggaaaucaaacaucgaaugauaugguaguuagagcaagccuugugcuuuaguuugcauaaaaagcccaccguguggcuggguuucagauugagugcugcuguguguuucuggaagcaccuccucacuugguguauaauuugugugcucguuuuugccuuguaaaaacacccgucuauaguacuuaggccauuguuaauuuguuugucgcugagcugaacugaacugaccugaccugaccuacacucacacuguugggacuguauucccagcucuucacaguagugugugugcauguacacacacacacacacacacacacacacacacacacacacacacacaagcaucuaauacuacucaccacaggcuacauauuuccguccuuaucaggcucugcagagcccauccagggagcugagaccugggguuaggagucuugucccauaggcuggagugcuuugugccucuccucaguaacucucaaggguagaaugcuuucagcgucuugaguggugcucggugguggcccucaccacucagagccgcaggaagaaggcagaggggucacccaggcagccagugaguccaggguggauuucacaguacauuuagaaauggaguugugacguuucuccccugcaaacaugaccugugugguugauuauagcuuugccuggcucacgugccuugguuacacagucccauucccuggggugagucccccggcugaugugucuguuuuaccaagagccuuaccugacucucaugaggccaaagguugaaagagaagccgagguuccugcuaagucaucgcugaccaggagcgggggagggggccuggaauucugccaggagugcuggaugcggcguuuguguuagaaggcucccuugcuucugaucauuucagugacccaucuuccaucucuccacagguauuaaagacuacuccaacuggccaaccaucccgcaaguguaccucaacggcgaguuuguggggggcugugacauccuucugcagaugcaucagaauggggaccuaguggaagaacugaaaaagcuggguauccgcucugcccugguagaugagaaggaccaagacuccaagugagggccccgggcccucgccgagcagagcgcccucuccauccucggggccagaaaagccuuacugcgugguggugcccuguugcugugaugcuugcgcugggccuccuggcagcaagcgggcaggugcuuuuacuuuagucucuggcucagaauucccucuggugaacguacaaccacugcacuguaaaucaaugucgcgauccuguauugcuauaaccgugaucuguucuuacguugucuuuauucucugccggccggcuuugggagucacuucugauucuuguuuggguuguagagaugguaaagcccccugauguuuuuguaacuuccuguaaaagggaaaugauggacagaggagaaaaugugguggcuagaguuguuuuguaaaauuaaauugccaacacagacgugugugugagucauuaaauccagcaagaacagcuccauaggacguggagaacuagcugcuuuucuuuguguuuucuuccauccuucccccagcucucugccacccucugcuucucacgcugccccucucuccucccugucccucccucugucuuucagugcagcccaggccggcauuggcucaucaaguagccaaaggugagcuagauccucuugccucccucaaccuugcagugcugagauguuggcuaucugccaccauagcucaucugccaccauagcgcugagaucaggcuccagggcauuggucacaccaggcaagcacuuuaucagcugagguacagcgccagggccugccuguguccucugauuuugagaaauuaacaguacucccauucaccauuuggcugcucugaaguuccuuucggcuacuagggagcgccuguacaguguguccuugagccagguggcgaggcugugcaggagggaugucaccuugaaaugggagaagccaugagcuggccucugacgcguuuuucuuucucaugaacuggguucucagaggaaaucacuggaacuacgucugucuuccaguucagugucuuggugggacuuccccagggcucaucaauccagagacugguguggaggauccgauuuccaccaucaccugugggacacuucucuuccagugugucugccugugcaggaagccacauucagucucccaacgccuagaagucauagaggcgggagagaggcugccuuuuuccaugaauagggcacagagaaugaguagcggccuuccugagguaggguggaaggcugcgugggcuucccuguacacaggguaugcugggcucccaggauuugggguuccucaagaaggggaggagagccacagccuaagcaugccgccuuccucauuucacuagggacccagucagaggaugacagcccucaccagugacuagugucaaggcugaaagaagaaaaggcacacgagucugaagguuuuuaccucauuaauugagcauucaccucuuuugagcaggcagcugggccugcaugggucccucacagaccuuggaagccuuuuguucagguaaggaaggagccccggaaggaaggcugugcccagcggccugucugggcuggcagcucuguccucugggaauaauaaauaccauuagcaaauggcuuuccuaccugagcaugagugccaggcugugggucacacaucagucggcgguugucccuugccaucacacaagcuguggagugacuugcuuuuccauucuggcugcuuuuggcuuuucccagaucugccuguauuccuuaaggcucauuuugaaaaaaacugaaaugauuaaaaaaaaaaaaauuagcaaaacagcacuguaaguauucucgcuggaguguaagcuggaccaggauaggcugcaggcccacucagagccugugaaucagugagauccuaucagagccacagagaacggggccuuugaagccccggaagaagugugauguucuucccagagguuaacuaggaaugcuuucuaugugcccugcacgcaguaaccagguaggaaguugaggauguuaucucaugcgagucugaggaauaccucaguggucugcauuagaguucacucuaaggauuaaacagugacacgcaaguuccuuuguacaaacagcaucggaccagcccucuagggacaguagaugacgucgcagaugcccaaucccguggaaguagagauaaagacagccgggaaccaucagacuugggugcagggccacugagcccaggucuucuguaagaguagaacuuguguuugacuguggaacccucucuccagcccaagaaagacauuuuaauugcaggugguuuuagcgcuguagccugguagccacaugacugucauucagcuuaauuugaacuauaagguuuuguaauuguuuuaggauacaagguaacuuuucguuuguuuauuuugugacucccaacccuuggccuccugcauaauaaacccacaauucaacacca

SEQ ID NO: 6806 - RNA, 6046 nt, Mus musculus
gaaauuuuaaaguucuacaaagcuuuauuaaauccagccguaucucuaaaauagaaccacauaaaaucccacacauucccuuucaacauucuuacuaggagaccaaggcuucccugggugacccuggcuucucugggagaccccggagcagucuucucucccucauuuauuggcaucucggucaaggauggaagccgauuuggcccaacuuaggugagugaaauauuuaaucagcgacaggacguguuuacacuaaauacagaaccugaacacccagagaggaagccugcacacaggcaaucagagggcccaucugaaccaggcccacugccuggccucuuguucuagugaggccauaggccccagguuugcauaucccuggcugcaagcaccuagguucuaaggaagggcaagagagcucucaggucuuacaccgcucugcaaucaaagccuauguuugcuggguagguggggcuucacaggucagguggguacaggcacaacaccuugagugauggcugaucuggggccuggccagauuccaaugacgaggucuugucccucaugguguauguacugcugagggacccgugaggaagaaggcaaguucauaagucagagacacuaguugucuugugaggccaaagggaaagacggaagagucaaucagcuaagaucaucagaggcacagacaccacugagcaccuagaggaggugaggagaacugggaucuucucuggagccccuugccagggagucagcagagcugagggaccaaccaaggcagccgagcaggcaacagcagcaugggaaggggcagcgucuggccagaguuuucuucuuggagcccaguguagaggaaaaaggacaugacuagcgaacagacagaacauaaguaccaacaucuccccuguggggccaggccugggcaaggcagacaggagcugcaggaccuggggagagaagagaagagaaggcaggguuagagggacagucaaggagcaggcaguggaguugcuggguggguguggcuacucagucccugaugcugaaccucguaucucaugccuaggucagggccaaacacaaacaccgugaagagaguggggugaaaaaaaaaaaaagagagagaaauaaagaaaauauccaauuuaaaaaaaucucugaggaaaaaaaaaaaagaagaagaaauggagaaaccugcuucaguauuaucuguggauccccggcugaguucgugagauggcccagcagucaucucuuagacaaccgauggugaacaacgagucaccucaggggcccugcagacauggauguagccggggcuccuaaggugguaaaggagagacauggacauguccaagaagcuucuccuacucuaggcugccucugaagauagcugccggggagggguugucauggcuuucauagagaagggcccuccuuccuucugauggagcucaggggcgcucaccgggucuggguuauucaucguuggacuccgagucuaucaguucaagcaacauguccuccacgucucuaaacugagggcggagaaggagagggacaagcgaguggucagaccagcccugggaauuccccuuucuuucuggcucagcuuucuucagccuggguuaguacuggguccugaggugagguggcuagcccucucaacugguuucagucagugacuaccacagagggcuccuggugccaagggguuuggcuaagaccuuagaugauggcuucuucuaucuuucuaacccuuaaaaaaaaaagucuguaguuagcuccccuuccauuagcuucugguaccaggguggagggaauauagagcuagcccacaccaaggccggagaccaggaucacucaagaucacccacucgguccuuggggaaagccgugcuugccuugauaugguacaggaucugccaauacauggagucgcagcuucgguaccuguccuugggguacaguugccacauuaaaggcagcucguaaggcaccagcugacugggggacauagcuucccccaaggugacaucuuccuggcgcaagaucaccuggaauuuuucauuacucugcagaggaagaacagaacacaaccuuugccuccugcgcaccaucaucaggcuccuccagagcacaaacaccagccaucucuucugucugucacucaggagccuggggcugacccaacagccugaggacagauaccaccucuggacccaacuccacaggcugcacaucaucuuagggucucugguugggucagggucuagucacucaggguggacgcuuuuccugccaaccuccuauugcugggguaagcuaugcagcccuucagcuugguuucaaguguguguggaaaggucacccacguagagcagagagucaucucuuagacauuaucuacuuuuucuuuugccuacuuguuugagacaacaucucuuacuggcuugggguucaccuaaaaacaacaacaccccccuauaaaaacaaaacaacaagaacaaacaacaaaaacaaaacucaaaccaaccaaaaacugagcuccagagaccggagugcagcugaccugagugcggccucccgagcaaugucuaccgcacuggcuuccucaacuugaucucuggggacugaaguccagaccucauacuuacaaggcaaacacuuuaccaaccuuagccagccuugccagggaucugacuuuuugggcacuguccccuuuuaaacaagguaucuauccauggacccacuaugggaacuaagaaugaaaugcacugccuuuucuaucagaugguuaaaugagacaaaggagucauuaccucuaaagagguucgcaugaagcccuggggcaaaaaucccucugacagcccaaacuuuucuaagaccuaaguauguauucaagguugcaaucuguuuucaaaguugugcuuggcuugucaacagugcagcucugagucauguaaggcugaacucuugaccaacgggugugggacucaggaccccucuggcacaagcgacgaaaccugcacaaauacaacuguaugucuugcugaaaugcuuuggauugugugaucccuugcuggagaccgccccccuccccccacuuucuaacacuuaaaucuggugacagaagccgggcgugguggcgcacgccuuuaaucccagcacuugggaggcagaggcagguggauuucugaguuugaggccagccuggucuacaaagugaguuccaggacagccagggcuauacagagagacccugucucgaaaacaaaaacaaaaaaaacaaaaaaaaacaaaaaaaaagaaucuggugacaggcggcauuuucuccaucaugggcauggcucaucuggacuaauggcaacugucuccuuaguuaccgucuucagaugccaggguuaucaaauucauggcugcuagacucgugacaccuucuccucaugggcagaggaguccagagcccacagaaauccacaaagacuacacaaaggcauuucugucucccuccccuguucuguucacacccucucccgucccccguacccccccccauccacuuccucucagccacaaugugaucccuuguuugugggguucucacugucuguacagcaagccuccccaaauccacaaagagcuagcuuccuuuuaaggcagcccuuuguucaaauguaggucuauaaagaaaauuacuaaggccacguuuaaggguagagacgaaacaugcaguuucauuaacggacaggaguuaagauuuguuguucuaaagcagggccucaccagaucauucuugacagccuggaacuugcucuauagaccuagcugaccucagacuuacagagcuccaccugucucugccucccaagugcugaaaucaagggagaauaccacauaggcauggauaugcgacaucaugcagagucaguucuugucacguguauccugggaaucgaacucaggucgucaggcuugguggcaaggaccuucucagucaccuugccagcucccgaaaaugaguuuuagccaucaauuugggauauaaaaaaacaaaaaaaaaccaaaaaccaaaaaauucacagccuaaacacacaaaacaagccugccccacccccaauacaagcaaauccgacaagauagcccgguugguuaagaccugguggggccaaguggcacaggccugcaguuggguacuaacuacucagugagcugaggcaggaggaucccaaguucaaggccuaccugggauacaaagggagcuuaagguagcuaaguagcuaagaccaaagucucaaaacugaaagacaaagggccaggcugcggcucugucuguaaggcacagagcccuggguuugugcaggggaagagaagcaaccuauaacuccaaacaagucgacucaaaaacaggacgcgcaaccacaaacugaguucacagugugcugaccccugcucccacugugcauuacagcacaacucguuucuccccaccccaugucuacuuucucuccccucagaacucaucgccagccucgccacugcacuggcuaccccauuccccauuguaucaccuucccaagaauaggacuccuaccauacuguacccugcaagcccucagagcagaccagugugugggccuuacacuaagcacucacacgagcucacacgagugugguuccccccccacccccaaggcgagaacagucccugaggagaucaggugaaucuguuaagucagaugguggugccagguguguaagcgccaccauucacagcccaugagucaauaaucgaaccgcuguuaucaauuacucucuuuuccuuauuaauacaagugaacgcucacauguuuaaaacccuggcuuccucagucaugggaaacaaacccugcccugccguuugcuaccaggcuccugaucagacagcgccuaucacagcucugggcuauucucugguucaugguuugggugaaaaagcuugccguuaaccugauauuuaaaagaaauauccacccauguugucuucacacaucugacuuaacguuaaaaaaaaaaaaagaaaagaaaaaccaacuagauauauguaaauuuagcauuguaaaaugacaacaagaguguaaauucaagagcccagaauuguggcuccaucguuugcuagcggugccccgaguccgcgaggcucgcaagcuccacccucugcuagcggcaccccaugucugcaucugcgucugugaggcucacaagccccaccuugguuggaguggagacaguucccagguccuagcgcuucacacacaaucucagcaguuugcuuuuaaagcguucuuuggcuuuacaaguggaacacuuuuccggaaggugccucuagaagagauuucuuuugaacaccaacauuaaggcccauaccgaggcuuccgcacgcaaaacgagguuaaaucguauuacugacaguggauacuacuagcuaccuuaaagauauuccaauuuugugguuuaggaaagccuuguuucaccccgaaugauagucacacacacucacacacacacacacacaccaggcaacgugggagaggggcuuguccacugagcucggggcgcucccacccuccuccaggcccacaggcccgagucaaacgacguucaucugaggucucccuagcccuccuguuucaggcacaagggacccucuguauccuggucuccugcuaccagcaucccccagacccagacagggcauaucccugcugccccaccugcuagccccauggcgguugguaccuugaugacuacgggcagccagcuucgacgaaacucauccaaguacacgugcuucucccagauccacaggcgguuggggugugcaggugucucugcccugugugcccgcuggguagccauggcauccgauaagagcaagaagcagaaaauugcaaugccaguccgugauaaaacugcuuccuacacggugagcaugagaaacgcgucuauuuaucacuaccaggugugggccugugcccccuggagcgaggcagggcggaac

SEQ ID NO: 6807 - RNA, 6046 nt, Mus musculus
guuccgcccugccucgcuccagggggcacaggcccacaccugguagugauaaauagacgcguuucucaugcucaccguguaggaagcaguuuuaucacggacuggcauugcaauuuucugcuucuugcucuuaucggaugccauggcuacccagcgggcacacagggcagagacaccugcacaccccaaccgccuguggaucugggagaagcacguguacuuggaugaguuucgucgaagcuggcugcccguagucaucaagguaccaaccgccauggggcuagcagguggggcagcagggauaugcccugucugggucugggggaugcugguagcaggagaccaggauacagagggucccuugugccugaaacaggagggcuagggagaccucagaugaacgucguuugacucgggccugugggccuggaggagggugggagcgccccgagcucaguggacaagccccucucccacguugccuggugugugugugugugugugagugugugugacuaucauucggggugaaacaaggcuuuccuaaaccacaaaauuggaauaucuuuaagguagcuaguaguauccacugucaguaauacgauuuaaccucguuuugcgugcggaagccucgguaugggccuuaauguugguguucaaaagaaaucucuucuagaggcaccuuccggaaaaguguuccacuuguaaagccaaagaacgcuuuaaaagcaaacugcugagauugugugugaagcgcuaggaccugggaacugucuccacuccaaccaagguggggcuugugagccucacagacgcagaugcagacauggggugccgcuagcagaggguggagcuugcgagccucgcggacucggggcaccgcuagcaaacgauggagccacaauucugggcucuugaauuuacacucuuguugucauuuuacaaugcuaaauuuacauauaucuaguugguuuuucuuuucuuuuuuuuuuuuuaacguuaagucagaugugugaagacaacauggguggauauuucuuuuaaauaucagguuaacggcaagcuuuuucacccaaaccaugaaccagagaauagcccagagcugugauaggcgcugucugaucaggagccugguagcaaacggcagggcaggguuuguuucccaugacugaggaagccaggguuuuaaacaugugagcguucacuuguauuaauaaggaaaagagaguaauugauaacagcgguucgauuauugacucaugggcugugaaugguggcgcuuacacaccuggcaccaccaucugacuuaacagauucaccugaucuccucagggacuguucucgccuuggggguggggggggaaccacacucgugugagcucgugugagugcuuaguguaaggcccacacacuggucugcucugagggcuugcaggguacaguaugguaggaguccuauucuugggaaggugauacaauggggaaugggguagccagugcaguggcgaggcuggcgaugaguucugaggggagagaaaguagacaugggguggggagaaacgaguugugcuguaaugcacagugggagcaggggucagcacacugugaacucaguuugugguugcgcguccuguuuuugagucgacuuguuuggaguuauagguugcuucucuuccccugcacaaacccagggcucugugccuuacagacagagccgcagccuggcccuuugucuuucaguuuugagacuuuggucuuagcuacuuagcuaccuuaagcucccuuuguaucccagguaggccuugaacuugggauccuccugccucagcucacugaguaguuaguacccaacugcaggccugugccacuuggccccaccaggucuuaaccaaccgggcuaucuugucggauuugcuuguauuggggguggggcaggcuuguuuuguguguuuaggcugugaauuuuuugguuuuugguuuuuuuuuguuuuuuuauaucccaaauugauggcuaaaacucauuuucgggagcuggcaaggugacugagaagguccuugccaccaagccugacgaccugaguucgauucccaggauacacgugacaagaacugacucugcaugaugucgcauauccaugccuaugugguauucucccuugauuucagcacuugggaggcagagacagguggagcucuguaagucugaggucagcuaggucuauagagcaaguuccaggcugucaagaaugaucuggugaggcccugcuuuagaacaacaaaucuuaacuccuguccguuaaugaaacugcauguuucgucucuacccuuaaacguggccuuaguaauuuucuuuauagaccuacauuugaacaaagggcugccuuaaaaggaagcuagcucuuuguggauuuggggaggcuugcuguacagacagugagaaccccacaaacaagggaucacauuguggcugagaggaaguggauggggggggguacgggggacgggagagggugugaacagaacaggggagggagacagaaaugccuuuguguagucuuuguggauuucugugggcucuggacuccucugcccaugaggagaaggugucacgagucuagcagccaugaauuugauaacccuggcaucugaagacgguaacuaaggagacaguugccauuaguccagaugagccaugcccaugauggagaaaaugccgccugucaccagauucuuuuuuuuuguuuuuuuuuguuuuuuuuguuuuuguuuucgagacagggucucucuguauagcccuggcuguccuggaacucacuuuguagaccaggcuggccucaaacucagaaauccaccugccucugccucccaagugcugggauuaaaggcgugcgccaccacgcccggcuucugucaccagauuuaaguguuagaaaguggggggaggggggcggucuccagcaagggaucacacaauccaaagcauuucagcaagacauacaguuguauuugugcagguuucgucgcuugugccagagggguccugagucccacacccguuggucaagaguucagccuuacaugacucagagcugcacuguugacaagccaagcacaacuuugaaaacagauugcaaccuugaauacauacuuaggucuuagaaaaguuugggcugucagagggauuuuugccccagggcuucaugcgaaccucuuuagagguaaugacuccuuugucucauuuaaccaucugauagaaaaggcagugcauuucauucuuaguucccauaguggguccauggauagauaccuuguuuaaaaggggacagugcccaaaaagucagaucccuggcaaggcuggcuaagguugguaaaguguuugccuuguaaguaugaggucuggacuucaguccccagagaucaaguugaggaagccagugcgguagacauugcucgggaggccgcacucaggucagcugcacuccggucucuggagcucaguuuuugguugguuugaguuuuguuuuuguuguuuguucuuguuguuuuguuuuuauagggggguguuguuguuuuuaggugaaccccaagccaguaagagauguugucucaaacaaguaggcaaaagaaaaaguagauaaugucuaagagaugacucucugcucuacgugggugaccuuuccacacacacuugaaaccaagcugaagggcugcauagcuuaccccagcaauaggagguuggcaggaaaagcguccacccugagugacuagacccugacccaaccagagacccuaagaugaugugcagccuguggaguuggguccagaggugguaucuguccucaggcuguugggucagccccaggcuccugagugacagacagaagagauggcugguguuugugcucuggaggagccugaugauggugcgcaggaggcaaagguuguguucuguucuuccucugcagaguaaugaaaaauuccaggugaucuugcgccaggaagaugucaccuugggggaagcuaugucccccagucagcuggugccuuacgagcugccuuuaauguggcaacuguaccccaaggacagguaccgaagcugcgacuccauguauuggcagauccuguaccauaucaaggcaagcacggcuuuccccaaggaccgagugggugaucuugagugauccuggucuccggccuuggugugggcuagcucuauauucccuccacccugguaccagaagcuaauggaaggggagcuaacuacagacuuuuuuuuuuaaggguuagaaagauagaagaagccaucaucuaaggucuuagccaaaccccuuggcaccaggagcccucugugguagucacugacugaaaccaguugagagggcuagccaccucaccucaggacccaguacuaacccaggcugaagaaagcugagccagaaagaaaggggaauucccagggcuggucugaccacucgcuugucccucuccuucuccgcccucaguuuagagacguggaggacauguugcuugaacugauagacucggaguccaacgaugaauaacccagacccggugagcgccccugagcuccaucagaaggaaggagggcccuucucuaugaaagccaugacaaccccuccccggcagcuaucuucagaggcagccuagaguaggagaagcuucuuggacauguccaugucucuccuuuaccaccuuaggagccccggcuacauccaugucugcagggccccugaggugacucguuguucaccaucgguugucuaagagaugacugcugggccaucucacgaacucagccggggauccacagauaauacugaagcagguuucuccauuucuucuucuuuuuuuuuuuuccucagagauuuuuuuaaauuggauauuuucuuuauuucucucucuuuuuuuuuuuuucaccccacucucuucacgguguuuguguuuggcccugaccuaggcaugagauacgagguucagcaucagggacugaguagccacacccacccagcaacuccacugccugcuccuugacugucccucuaacccugccuucucuucucuucucuccccagguccugcagcuccugucugccuugcccaggccuggccccacaggggagauguugguacuuauguucugucuguucgcuagucauguccuuuuuccucuacacugggcuccaagaagaaaacucuggccagacgcugccccuucccaugcugcuguugccugcucggcugccuugguuggucccucagcucugcugacucccuggcaaggggcuccagagaagaucccaguucuccucaccuccucuaggugcucaguggugucugugccucugaugaucuuagcugauugacucuuccgucuuucccuuuggccucacaagacaacuagugucucugacuuaugaacuugccuucuuccucacgggucccucagcaguacauacaccaugagggacaagaccucgucauuggaaucuggccaggccccagaucagccaucacucaagguguugugccuguacccaccugaccugugaagccccaccuacccagcaaacauaggcuuugauugcagagcgguguaagaccugagagcucucuugcccuuccuuagaaccuaggugcuugcagccagggauaugcaaaccuggggccuauggccucacuagaacaagaggccaggcagugggccugguucagaugggcccucugauugccugugugcaggcuuccucucuggguguucagguucuguauuuaguguaaacacguccugucgcugauuaaauauuucacucaccuaaguugggccaaaucggcuuccauccuugaccgagaugccaauaaaugagggagagaagacugcuccggggucucccagagaagccagggucacccagggaagccuuggucuccuaguaagaauguugaaagggaaugugugggauuuuaugugguucuauuuuagagauacggcuggauuuaauaaagcuuuguagaacuuuaaaauuuc

SEQ ID NO: 6808 - RNA, 3221 nt, Mus musculus
ugguuuuuguuucuuuuugccugcuugccuucacucuuguuggcaagugcaucuacuuuguuacuggcucugcugcauccuucauuguuacuaggucccagcuuugggcuuccaauguggacuagagaccagcccuccagaaaucaucagggccuucagcacuggccuucagcacuagacugggucugcugagacauccagccuuauauacugagcaacuaccagggucucagucucucuggccuaagauaguccuuguucaacuacucagaccauauuacauagccaaccugauaaaucuccuuuuaauauuugcucauccucucguucgguucugcuguccuagggaguccugauuacuauacugugccuggcccauuccaguuaauagaauguccucaucgaggaugccucguacgacaagauuucauucuuuuuugcuacugaauaguggucucuugugucuauguuccauagucgauccaucuguuguggaacguuuagauggaauccauagccuagcuguugcacauacugaugcaugaacguggucguguggaucuaucucaucagugugcugaguucaggaucucggagagggagggcgcucaggugguaaagugcuugccauaaaaacauagacauaguggugcgugccugcaugggugguggugugggugggacaauuucugaaguuugucggccagucauucuagccaaacugauuaauguaagguuccuugagagagccuggcucaaauuuuaaaggcaaagugcauuggaggaaagacaccaggcauugaccaaucagccucuggccucugcauacauguggacaugcaaugccauaugcauacagcauaugaucacauaccugcaccauauaacacacacacacacacacacacacacacacacacacaccaugaaugaacuagguuuuuuuuuccuaugauacuaaaaacuaugacagagacucagacaaacuaaucaauuacccaccuccccugcccugacucucagaaauccuaaucaaucauccaccuccccugccccaucucuaugucuucuggaauagugaggccugcaaauggcugggcauagaagagacucucugagguuuugaguauuauaaguacuggacucccugaccaagugacaugucagauuauuccugcaagugggaaguuagcgcugaagaaagccgguugaaaagcugcgucacccauaaaaacugggggcaaacucagaggugcugcucccagucuugcugagaaaugucagaacauaacuguugccccaggggcuaggaaugacagccguuuucuguugaaaaauaaaaugcuguagggaggagggugcugguuucuauuuggaagggcuaguaguggguucaacaauauagaagaauaaaugaacagagaaaaagcccuguuuuggggccaacucugacaacaaaaaccucagcgaccccucccccacccccauucucaaaguccuccuggagggaggggcuccucgcugcagagauacuggcuuaagaauugggauguggguccugggcaggugugauucucuggaaggucggucuucugccuccaccuccucauagucaccccagccaggacaacagcagccuuggagggagugaaggaugaggcugggucgguccucagggagguggcagcuguuccuguucuggggcauuaaggaaggggcaggaucuuggcagguuugaggguccuuuagacauggcagaguccuuguauccagcugaauccaagggucuggguucuaccuagagguacccacugcauuugaaaguuugccucaccgucuuuggaggcuguggucccugucugcuuugacgaggacucuuuugugggccuuaggggugcauuuuggaaagguucuggagaaccaagagacaccuuacagaaaaccuaguuacaguacacuuuacagaaaacgcguguucagauuuagguaccccaggggucaguucuuagcuaugaccuucggggaugacuauuuugguuaggauguuaaguuacuuugaaacguccuauaagcuguaaagauuugggcaugccugggccugaggcccagucuggccugagaggccgcaaauccuuaaggaggaaggcacauggaggcaggucuuugaccuccugaaacuagacaccuggucacuggucgggcaucaaggggugaggaacaaagcugucacuaccuagcagccauccucugguuccccgagagguaggaggagcucggugagauaguccagagcuuccaugaugagcacagcgcaagaacaaaauguccaggaagaagagaggcaggccaggaaagggguggcgccucucucacccagguuccugggucuccaaauacuccuugugggugggggcgucucacacacacccacacgcccaaggccacauucacuggcucaucucugcauuccugugagcggcaggccuccaugagccacauagccgccaccugcugcuguaaccccagcacaggggaaccugcaucacccuuuucccuccauccacccucacccaggagccgguuccaaauccucgggaccaggcagaggccacgucuuccccggcccacuccccagcagcgacguggagguagagggaggagcuuuugccggcaacgccagcuuccccugcccccucucccucuagagcuccccuccucuccucuuucauuccccuccuuaucccuccucuucucuccccuucccuccccgcccuuccccucugccgcagcccagcuccuagcgcgucagcgugggcuucccggagcgagucgcuagguaacagggcuagcuccgcagacccgggccagggaagcccgcgcgcgucgucagcaucugcgccgaggggcggggaacgcacugacacuccccuaucggagccugcagacccuucagcugguucucaguccccucccuggaugccuuaaggguggcuauugccaccgcggaguugccccuccccugcggggaccccgacgucgccgcccccuucuccucccacgcugguccgcaccacucuccgcaccgccagguaggcgacccuccgcugcgguugcgguggcugcugguaagcugcgaucuggagcugaggcggggacuacgccacuagcggggcggcucgggccacagcggccggcggaccggccaugugcuaaaguuucug

SEQ ID NO: 6809 - RNA, 3221 nt, Mus musculus
cagaaacuuuagcacauggccgguccgccggccgcuguggcccgagccgccccgcuaguggcguaguccccgccucagcuccagaucgcagcuuaccagcagccaccgcaaccgcagcggagggucgccuaccuggcggugcggagaguggugcggaccagcgugggaggagaagggggcggcgacgucgggguccccgcaggggaggggcaacuccgcgguggcaauagccacccuuaaggcauccagggaggggacugagaaccagcugaagggucugcaggcuccgauaggggagugucagugcguuccccgccccucggcgcagaugcugacgacgcgcgcgggcuucccuggcccgggucugcggagcuagcccuguuaccuagcgacucgcuccgggaagcccacgcugacgcgcuaggagcugggcugcggcagaggggaagggcggggagggaaggggagagaagaggagggauaaggaggggaaugaaagaggagaggaggggagcucuagagggagagggggcaggggaagcuggcguugccggcaaaagcuccucccucuaccuccacgucgcugcuggggagugggccggggaagacguggccucugccuggucccgaggauuuggaaccggcuccugggugaggguggauggagggaaaagggugaugcagguuccccugugcugggguuacagcagcagguggcggcuauguggcucauggaggccugccgcucacaggaaugcagagaugagccagugaauguggccuugggcgugugggugugugugagacgcccccacccacaaggaguauuuggagacccaggaaccugggugagagaggcgccaccccuuuccuggccugccucucuucuuccuggacauuuuguucuugcgcugugcucaucauggaagcucuggacuaucucaccgagcuccuccuaccucucggggaaccagaggauggcugcuagguagugacagcuuuguuccucaccccuugaugcccgaccagugaccaggugucuaguuucaggaggucaaagaccugccuccaugugccuuccuccuuaaggauuugcggccucucaggccagacugggccucaggcccaggcaugcccaaaucuuuacagcuuauaggacguuucaaaguaacuuaacauccuaaccaaaauagucauccccgaaggucauagcuaagaacugaccccugggguaccuaaaucugaacacgcguuuucuguaaaguguacuguaacuagguuuucuguaaggugucucuugguucuccagaaccuuuccaaaaugcaccccuaaggcccacaaaagaguccucgucaaagcagacagggaccacagccuccaaagacggugaggcaaacuuucaaaugcaguggguaccucuagguagaacccagacccuuggauucagcuggauacaaggacucugccaugucuaaaggacccucaaaccugccaagauccugccccuuccuuaaugccccagaacaggaacagcugccaccucccugaggaccgacccagccucauccuucacucccuccaaggcugcuguuguccuggcuggggugacuaugaggagguggaggcagaagaccgaccuuccagagaaucacaccugcccaggacccacaucccaauucuuaagccaguaucucugcagcgaggagccccucccuccaggaggacuuugagaaugggggugggggaggggucgcugagguuuuuguugucagaguuggccccaaaacagggcuuuuucucuguucauuuauucuucuauauuguugaacccacuacuagcccuuccaaauagaaaccagcacccuccucccuacagcauuuuauuuuucaacagaaaacggcugucauuccuagccccuggggcaacaguuauguucugacauuucucagcaagacugggagcagcaccucugaguuugcccccaguuuuuaugggugacgcagcuuuucaaccggcuuucuucagcgcuaacuucccacuugcaggaauaaucugacaugucacuuggucagggaguccaguacuuauaauacucaaaaccucagagagucucuucuaugcccagccauuugcaggccucacuauuccagaagacauagagauggggcaggggagguggaugauugauuaggauuucugagagucagggcaggggagguggguaauugauuaguuugucugagucucugucauaguuuuuaguaucauaggaaaaaaaaaccuaguucauucaugguguguguguguguguguguguguguguguguguguguuauauggugcagguaugugaucauaugcuguaugcauauggcauugcauguccacauguaugcagaggccagaggcugauuggucaaugccuggugucuuuccuccaaugcacuuugccuuuaaaauuugagccaggcucucucaaggaaccuuacauuaaucaguuuggcuagaaugacuggccgacaaacuucagaaauugucccacccacaccaccacccaugcaggcacgcaccacuaugucuauguuuuuauggcaagcacuuuaccaccugagcgcccucccucuccgagauccugaacucagcacacugaugagauagauccacacgaccacguucaugcaucaguaugugcaacagcuaggcuauggauuccaucuaaacguuccacaacagauggaucgacuauggaacauagacacaagagaccacuauucaguagcaaaaaagaaugaaaucuugucguacgaggcauccucgaugaggacauucuauuaacuggaaugggccaggcacaguauaguaaucaggacucccuaggacagcagaaccgaacgagaggaugagcaaauauuaaaaggagauuuaucagguuggcuauguaauauggucugaguaguugaacaaggacuaucuuaggccagagagacugagacccugguaguugcucaguauauaaggcuggaugucucagcagacccagucuagugcugaaggccagugcugaaggcccugaugauuucuggagggcuggucucuaguccacauuggaagcccaaagcugggaccuaguaacaaugaaggaugcagcagagccaguaacaaaguagaugcacuugccaacaagagugaaggcaagcaggcaaaaagaaacaaaaacca

SEQ ID NO: 6810 - RNA, 17252 nt, Mus musculus
acagacagaaugauggcuauuaaaaggagguuucucagagcgcuuaugugacauacaugaucccgguaguccaacgaugccuguuucucuauucugaagaggccgagaaccucaagguccauucuccagcagauccaaucuggugcuagaggccuggagaauucccagagagccucugacucuuaguccacguuggacaccccaaaaaagcuggguagugccaucagugacagccugcagcagcgacagaguagaagaacuuggcaacaaggaugaaugaagugagcaggcaaaaaacaaagcuuucuucucccaaccccacucccugccuuagcugggcugcaugccuagaugcugccugucuuagucaggguuucuauuccugcacaaacaucaugaccaagaagaaaguuggggaggaaaggguuuauucggcuuacacuucccacacugcuguucaucaccaaaggaagucaggacuggaacucaagcaggucaggaagcaggagcuguugcagaggccauggagggauguucuuuauuggcuugcuuccccuggcuugcucagccugcucucuuauagaaccaagauuaccagcccagagauggcaccacccacaaggggccuuucccccuugaucacuaauugagaaaaugccuuacagcuggaucucacggaggcauuuccucaacugaagcuccuuucucugugauaacuccagcuguaucaaguugacacaaaaccagccaguacaccgcccaccgugagcaugcaagacaauuggaauguuagaugcuccagcucccagugucugcaggagucgacucaggcucaucccaucccugagaaucgcggcaucuguggagcccacccaccuccugcuccccccccccccacacacacacaugcagcacaacacgacacugucaugagcaccaaguuuuccuccuuguccuuuuuaaacauucuucuuguaucugaacuugcucucccaaacuguauuugucaggacccuggugggagccagaagguacauucaggcugguggcauuagagagguugacaagccgguucacaucagaguacagcgagcaugugaaguccugagauggcauggccugcacucccugcccuuccccuuuagacagugggcucuuggugaaggccagaaacucuggacccuacggguccccaagacagggagcuggguugccagcaucuccgacuguacuccuggccagacccacugggaggccagauggcaggaucccaggagugguccuaagaggccugacaagcccaaggcaguggagaacaggggaugcucuggagcagggcccaggagaacccacaccagagucccagucaggcagcuuccagauauacagaagcaggggaguagccuguaguugccaaguccccugggcaguaaagcgccugcugccugcgaguugggcaagagagaacacacauuuugcuuuuaucuugaaagcagggccuaacugggccauacuggucacugggggcuuuggacaccuucccagagccaccaagaccaaggacccaaggucuccaggagcugucacuguccagaugaacagcacccagccacagacuagccagucccagggcagaaggggcaucucugcccuucuccuggauaacagaacgucaccccagccccggucauucuuaacguaugcuaaaccuagagccacaaauucaucgucucagacgcccaguuggauuucccccuaaagagucgggaagggucucugaaaggcugacugugggggauucucuuucccaaccucccuuuuuuggagaagcagaaagacuuaguucugaguuucuaguccuggcccugguuuugggagguuccaguaaaucucuuccagugucaccugagugccuuccgauacauuuucuuccccugcuacugucugcacugguguguacacacacacacacacuggugaauugggagaaccugggugcuuuugcgauguccagaaucuucuagcuuaggagugacuggcugcugagugcgagaccuauaguacacccaccuacguaccccaguuuucuacauacuuccaggcaggguugucaugucacacggaguccuggacaguguggaggucagauacgcuaaaacaccugacagaaacaccugagcagaggcgaguuuagacagauucacaguuucagccaguucggucugucuaggcagaggucacgcaguaagagcgugugacaaggagcagaaagucacucagaaccagggcugcauaugaccuacaagaggccugucccaagugacccgccucugcgagaccauccccacccccuaaagguucauggcaugccaaaauagcuccaccccuugggaccacacauucagaauaugagccuguggaggacagcucagagugaacgugugaugucaccuuuuguaagaaccaggcuuucacacgagccuccuggggacacagccaagccauuggccuuguaguugacauugguugggcaaaccuuggugacuauuugaguggcaucccccucuucucugcagccugcaagcuuuccuggacauagagcgugcaccugcauccaccaugugugcccacacgccgcacggggccagagaaggucccaagaccccaucuuucacccucauggagaauggguuuuuuuuucaacuaauuacuuuuuaauguguguaucuauauaugaugugugugucaggugucuuggaggcaagaaggggaugucggauccccuggaacuggaguuauagacaguuguaggcucccaugugggggcugggauuugaaccuaggucuucuguaagagcauccagugcucuuaaccacucaggccaucucuccagcccagaucgguguguuuugaccuucgucccagcuaaugacauucucuucucugccuccccaggaggauccucacuccucuuuguccggcguccaaaugcccugcuccuggaagcuacucggguuucugucggugcaugagcccaugcccaccgcggccuccuuuggguaagucaggggaucuccagcucaccaucggugacuccagggcaggcaguguccuguugugggucaugguugaagggguguuucaaguuaggcucaaagaccaaaucuuuaacaguccccacagccccgucaggagcaacaggaguggcuuuugugggacugggggaaggcacagggacacuucaucacaugugggaugucccagucauugugaagacagggucgccauggaauugacaucugcuggaagacugaagacgaagggaagccuuggggaaacugagucagaguagagccaggagacagggccuccauccugagggaccagugcuggcagcagagaaaaggguccuaacugauccucaacauccugcggcaggugccacugggaacuguccccacagcucucagcgcucacuggccaggcagccuccuggcaccgcuggguuuucucagagugcuggcccucagaacaaauagcaaguggccccggugguacaccugagucuccagugagcaaauaccucccccaaacugcuguuaagaauaugggcucucccauuucuaggaaggggcaaaguguccacacuuuggucuucguucuucuugauuuuuuucuuuaagauuuauuuauuuauuauauguaaguauacuguagcugucuucagacacuccagaagagggcgucagaucuuguuacagaugguugugagccaccaugugguugcugggauuugaacuccggaccuuuggaagagcagucgggugcucuuacccacugagccaucucacuuugccccuuccuagaaaugggaacaaaacacccauggaaggaguuacagagacaaaauuuagagcugugacgaaaggauggaccaucuagugauugccauauccagggauccaucccauaaucagcuuccaaacgcugacaccauugcauacacuagcaagauuuuccugaaaggacccagauauagcugucucuugugagacuaugcuggggccuagcaaacacagaaguggaugcucacagucagcuauuggaugggucacacggcccccaauggaggagcuagagaaaguacccaaggagcuaaagggaacuacaacccuauagguggaacaacaauaugaacuaaccaguaccccggagcucuugucucuagcugcauauguaucaaaagauggccuagucagccaucacuggaaagagaggcccauuggacuugcaaacuuuauaugccccaguacaggggaacgccagggccaaaaagggggaguggguggguaggggauuggggggguggguaugggggacuuuugguauagcauuggaaauguaaacgaggaaaaugccuaauuuaaaaaaaagagagaauaugggcucucuaugccugcagaaaugugcccaaagguuggaaugaagacaucuagaagauuccaaaagaagagccaauaccauaggucaugguguagggcagcccgcaggcagcucaucucugccgcgugaugcccaggcucauuuggaagacacugagucaugagaguggaaacaacacaggcugcauuggagcuggcgacuccccuugcacccgagggugucuggcuuccugcaaguucaggaagacacugcaaugcauuuaauggccccaccuuggaagucacguauccccaucgccacugugggucagcagcgguucacuaaguccagccacauccacaggaagaagaguuagacugggagggauuuuuuuuuuuuuuuuuuuuuuuuuuuuuugguagcaagguguuuuuccagagcacacagcuuaccccuuggccccuccauaauauccucagggcaacaguggggacccucucuucuucccuuguucagucgcaucucccauaucucccuccacacacaucccugucauaccggguaccaccuugcaaacuuuaaucucacuucgugaccccaaaauggacuugagaugggucacuacuccagcuuugucugcuuuguucuccccagucuggagguuuuuaaaaaaucuccuuugggcccaauccaggauuccugaugauggugauggaggugaggguggugaggguggugaugguggugaugguggugaugguggugauggugcuguugauagugaugaugauggugguaagggaggagggaugcugggucugugcccuccugaaaucaccaccuacccaggacucaucacagaggaguccaugacuguuaagagaaaaacaagcuccuuauccacacaggagcuacaggggcucuagauaccucaggauccaaaccaugucaccaugagucacaggccccggccuggcucuaggguagcgccagcccagcagacacuccggggcucuuccugagaaaccucaggaugcugagcagagccuucucaucauucugccuagugccuccuuuccccugccccgcaguggaaggguccucccaucccccacucugcaggugacuagucacacgugcccugggugugcuuuaggcuuuuuagugcaucuuuauaaucauguuucgauauuauucccaucuuacugguuagggguccaaaaacauuaagcaacuuaccaaggccaaacggugaccaggacucggccccagggggaccaagccaaagucucgccuuuccucuuuccaggcaaccuuggcucaccuucugugcuuugcugccagugggcacaggcacaagguucucccucugcuagaagacacagauugucauggagguggcugugcucuggggggccagacugcagucucuccaccuggcauggcaucgcugaucuggucuaauuuauggcucaccugugaccccacucugaggagcugaugggucacggucccacaggggagaggcaugagaaggcagcgagcacaucucauaguggaggcuucaaagggcuccagguguggcauucacgaccauuggaguagccagggaaggauucuuacagaguucagaccaagaaauaucaugucccuuuggucccaggaagaucucucaaaggacuggagaguccaaguccccuagugcuguccacagaccggagucccaccaccuccccacaccccacugccgccgggagucaucagcugaacaauagacuuucugguccaccuguccugugcuccucccuggcccuccaccuccuccuucugcuaucccguuuucucuuccccuccccucccccuccuugugaccugaggauacgacugucucuucucuacuuucuuucagcaucgaaauguucaacgucaccacacaaguccucgggucugcucuuaacgggacccuuucgaaggacaacugcccagacaccgagugguggaguuggcucaaugccauccaggcccccuuccucuggguccucuuccugcuggccgcacuggagaaccucuuuguccucagcguguucuuccugcacaaaaacagcugcacuguggccgagaucuaccugggcaaccuggcagcggcggaccucauccuggccugcggguuaccuuucugggccaucaccaucgccaauaacuuugacuggguguuuggagagguguugugccggguggugaacaccaugaucuacaugaaccuguacagcagcaucugcuuccugaugcucgugaguaucgaccgcuaccuggcgcuggugaagaccauguccaugggccggaugcgcggggugcgcugggccaaacucuacagccuggugaucuggggcuguacacugcuucugaguucacccauguugguguucaggaccaugagggaauacagcgaagagggccacaaugucaccgccugcgucaucgucuacccgucccguuccugggagguguucaccaacgugcugcugaaccugguggguuuccuccugccccugagcgucaucaccuucugcacggugcgcaucuugcaggugcugaggaacaacgagaugaagaaguucaaggagguccagacggagaggaaggccaccgugcuagugcuggccguccuggggcucuuugugcuguguugggugccuuuccagaucagcaccuuccuggacacgcugcugcgccucggcgugcuguccggaugcugggacgagcacgccguagacgucaucacgcagaucaguuccuacguggccuacagcaacagcggccucaacccacugguguacgugaucgugggcaagcgcuuccggaagaagucccgagagguguaccgggugcugugccagaaaggaggcugcaugggagaacccguccagauggagaacuccauggggacuuugagaaccucgaucuccguggaacggcagauccacaagcugcaggacugggcagggaagaaacagugaacagaagccaccaggcaggacuacugccaagugugugaggauuggugggaccggagcuccucagccuggguucaggaaggagcuugaagcauccuaggcagccccagggaaucaggcaggugacuccagcccugucucauggcauaagcaugcuguggggaauggguacccuggggcacagcagggucauucuuacugacugacgcucuaauucuccaugaguggaggggucauggguaugggugggagugacagagcuuccuucccuuuuggggaaggacagaucuccugccagcuuuggcccuguggcuacaugcacaguaggcauggccgccucauuucccaguuucaaggguauaagauuuauuggucuucugaagguuaaauucuaugguaagagcccagggacugggguucuguggcuccuuucaccuguagacaagguggacagcacaaaagaagagcccccaaagcauuuauggagcacuuguugaauacacaccguuauacacugagggcaagaggaaagaacugcauaguuuaaugucuuauaggagcccugacauuagcggagaauaccgagaaggcugcugcuggugugccaaagcaaggaacugugggagacgggagaguacagggcccaggcuagccaguaaccccgaacacgguagccucaucccugccucugcuucuucgguuguaaucugaggguguccugggcuuugaaagugggguguuauauggcugugaggcauugugacccacaccaccacaugcagacgcauugggacucuuggcacagagaaagccacucaggcugaagagcuacucuguggggacacuuaguauuggaaggcccaguaccugccugcaggugucugcggcccucaguccccucuaucuuucccuccuaguauuucaccccuaugcacacaaagcacaaagcauuugcuccacaggaagggcaagggcgggagacagcgaguguuuguuuugcagggaaacaaagaaaaaggaauucugaugggaccugcccagggaauccacaccucacagccuggcuacaaauugguagcuguccaggagagucuaagcugcuucacagagucccugucucagugaccaagggcugcaaugagugguuuuauuugagaguggcucacaaagcaggggacggacacuaccaaagagcagcugacccauccaaggucacuuaacccaggguguuaauucugggccuaauccccugcauggccacagagugauagccucaugagugaugguggguggagcugccugcacccagggaacuaugacaugagacucaaaccacccccaccucugggggacagcacacgugcauauugagcaggucucccaucagggauaugaggauagccucucggauagcuucagggccacuggguucuccguuagaaccuucucaggguccuuaggugagcucaggugucaguggagacaguugccccaccaacucugccagaggcucaggugacagacaccauacucguaguuccagaaucuuccaugggaguuaauuuuuccaugcguccauaucgguuacuuucuaggaccugugacaaacuucuugacagaggccacuuaagggaaagagaaggguauuuugucucucagugucaagaaaggcuuugguccggugcagcaggaacuguaugguaaacagagugccugacagaagcaucauacuucagagaugaccaguaaacggagacacagcuggaaccagggaggccuaugacugucaaaugucugccccuagugaccuuucaccuauaagguccuacauccuaaaagguucuaucacuuuccaaaauagggccagcagccaggaacgaagggaagcgcauuucagacucaaccauuacaaugucgcuacaaacuggcuggccccuggggacauaugaggagcauaucaaacagccuccuacaccaagccacuuaggagcucuccacuugacagccagaggcuacggagacugggggaaaugagcagaguucacuggaguuucuggccaggcuggagccaagggagagccuauguggcaaagagcccauaaauccccaccaaucugacuuugaauuuccuaacagaguggaccccaggaaauucuuuuuccaccccaucuucccggacacuaguccaacaagcacacaggacacuguagccagaagaaggaaacaaaugacacacccauacugugaaggagaagcagggccccguucucagaagaggagcuggugggcuacaagugcaagggucacggcuggccacagccugggucccucgggguggcugaagggucuggaacugggucccugcagggucugcaacuaggacugugggagggaagcccccuugugccuugugucagcauccugaugacaaaucguguccagugaaagaugcagagagcucuguacugugcagaggaaguggccaggguaccaacgagggaggagcgcucugugaaagcacacgacucuccugugcacuggaauaaacagaugaauucugcauaguguuucccugugucaaacuuccugaaccucugagcucugacuccgggacacuggcuuugguagucaaaaggcuugggaggugagggacacauucgguucccaagguuucugucacggaaaagaccaacggacuccaagcuuuugcaauggugcaucccuuagggguuagauggggaugugguggugguggugguggugggcaacacacaacacaggauacucaguuugcauaauuauuaauauucauugaaauaugcaugacuauguuaaacaaauagcauuaggacuuuucagaaaaugcauuuuggguauccccacccccccaugcuacuuuacuccauagacagcucauucccaaaccucuuucagaugcucauaucauagugucagagacggccaaguccagucgcucacauuuauaaaacucuuccauucaaccuucaccucaaaucaagagcauccuguacaauguguccucccagccaugggagucucugugcuucacauucaggucucauguccacucuccauucacucugugaauccacaaacagcacugcuuagucacacacccaucuguccaguccagacaccuggggcucagugcucacugaaccccauccuguucaucccugagugcaggagccucccuuucagauucugccccucuugugaccgaccauccuggcuuacugcuucucaccccacucuuagaugucucuaagcucucauuccucacucucagcaacagcaauucucaaggcuacagucccaggaggcugggaucauggggagcagauaaaaggagcugagguuucagagucagggcgauguggagucccauucugguucugcccugggcucccauuugacucuuuaacaacuguaaaguggggucagcaauggcagcaaucaagucagaaaaauggcaacagguucauguagaagacuguuuaggacagugucugguacagacuugaaaccagucugugagggauguaucuguaaugguauaugucaucugugauggugagugucauccgugauggugugugcuaucugugauggugaaugucauccgugauggugagugucauccaugauggugagugucauccgugauggugagugucauccgugauggugugugucauccgugauggugagugucauccgugauggugugugccauccgugauggugagugucauccgugauggugaugguguuaauaaugcugaugaugguggcaauggcggcgauggcagaaaugaugcuguuucacaggguuccugucucagugaccaagagaugccaguuagugguuuuauuugagaguggcucacaaagcaggggacgcuacccaagagcaugaugguuggugcagaagcuguuggcgaggguggugaauacgaugggauguggaugucgaugaggacacucuucacaggggaaccuuuuauauuccccaacccucuuguaauaaagcuacacauucauacauggccugugaggccccuggcaaucuggccccgcccacccugcuggcuccaccccuucucccccacuccuucucuacccuccaguuacauggggcucaagaugccugggcagaucucaggagauaucucacuucuccucagggaccccuccuccugucagccuccaccccacacucaguacccugcaucugaaauccccaagggagauuccugcuccagggugacagagaugugggcacaacaaaccauucauuuauacacacaauacauguaugauucugagaggagccguggacuggagccggaaucacaguagucagaucuggaugcaggacuggucaacccagccucaccacacgggcugcucucuaggcuccaggaagucagagccaugaggagagcuccugguaggccucaggaaaccagucaagagcaggaaugccacucuggccaggggugucaaggccaagugcagagauauccccagcaggccaggggauccccuaggacucaugugaggccacggaugauggcucgcugucuuaggaagccacuaagaacaggcuuucugguucagcggguaaagugccugcuuccuagaacucagcagcgcauaccucugugucguugcuacccaaucucugacgucauugccaagccucacacagcccuggucccucaucuaagugcagggaggaugugggggucacggaugaacagccauggucaggaguuggcaagaauagcggcugaaaguuuaagacuuuggguuuugacugaggccaggccuaggucagccaggcccauggaacuaagaaccaugccagaccucuccccuuuccauggagguuggcaaaauggggaacuuacugggucuacaauucuuuaguggguguuagggagccccaauaacucuggggugcacaggccuuaaccaacaaacaucgcagucuaccacagacaggcagggccuacaggaaguuuaucccauaaaucgcuauacuagagucugaccuguucacaccacaauaaacagugucuuugagccuuugugaguacagagguccccucuuuacagucguucugccuagacaucuucaacuuuaccauggcaccaggcuuugacgacccagucagacuccuuucccaggcuagugacaugucucuaguugagucucucucugcaguaggcagaggcaccacagcucaggggcugcuccaggauaacagucagaggggaaacaccaccguccaagcugugccccaggcugagacauucacggacacagacguauaaugcagauuucccacgcauauggacagccuccaguuuaggagggguuuauuggaaugaaggcccaccgugaguggagaagcacgugaccuuacgcugacacacgcauauaaaucguguugagauguaaaccaugugccccacacaucccugguucagccuucagugauucacggaguugcacaaccaucgccacuauuuaauuccggaacauucucaucacccccaaagugaaauccccagcccauuagcugucgccucagauuccucccaccccacggcucugguagcuacucaucucugucucucccucggccucucagacaguucauguuggcacacucacgcaugaguacugauggagucuggcuucccucaccugcuuuccgcugacaugugguacuaaugggagacauccccacgugacccaggcuagcgacuccacuccucuucucuccccuggcuuuuggccucaguuucucuaucuguaaugcggaaaguuaauccucuaagaaagaacaucuccaguaugugacucugcggaggagccauagaaaacuguagagggcggggcccacaagaccaaagugguccggcagcggugcugggcuccuggcuccccucugcuuaccgguuuucauggcuggaggaaguuagcucccugcuuaugcuuucucuucuacaagauaaggaaccagguacugugacaacugggugagggaaguugguguacggggggaggggggagggcaagggggugucacacugcaucucccagaaaacaaacaaacaaaaacccaaaaacagaccacguccaauuggaaguccacaguguggccccguugggaauagcgucuuggcacaaggaacagcuuaaagugagguuauacuggagcagagggggcccucagucaaauagcugucauuauugcaaaagagagaagcacccgggguggaagagaaggaugggacacauacuagaggaccuggccuaagccuaugagagcgaagggugacagacagccacgaggaccugaaggagcaagggcaguccccucagggccuccagcugucucgguccugacaucuguucccaggcaugaaggaagcagccuaagaaagaccaucacauacugaccuucugaauugugcagauuuuaccaaacaaaagcggcugggagcucucccaaggucacacagcgcaccagagaccaucccaggcucccagagccgggagcacaggccuggcaggacuggguguguauacccacgucugcauacucagaaugugggcuacuccacuucuuuccuucccccaucacccaagggcagguucuuuugaacuagguuaaagagaagcugagaguccagccuccagccuugcagcuggugcaagccacugagguccuagggaagucuguuguuuuguagauggggacagaguuaggguucugagccuccugaggaugccgccucuccacgguggcaccuguguggccuccacagugggacagacgcagcauuugcucagcagggugggugugccggaugccuuuaugucaacaugacaucaacuaaggucauuugagaggaaggagccucagugagaaacugccuaagauggggccagcguguaaggcauuuucuuaauuagugacucaugggaaaaggcccagcccacugugggugguaucacccugggcuggugguccuggauucugugagaaagcagccauagugagcaagccaaucccagcucccugcuauggccugagcuucagcuccagguuccugccccagcuuccuucagugaugaccagggauguggaagcugaauaaacccguuccuccucaacuugcuucuggucaugguguuucaccacagcaacaguaagccuaagacagcagagggcacgccccccaccacacccccuagcccagcugccucccugugccauggcuugugguucugacugcaaagcagucgcucugcagcugaggauccaagcuccugaaggcagcaugguaaacaagccccaucaaccuacuuggcgugaucgagugaggcuugcgguccuuguggucccggaaagugauuccaugucucauaccuauuacccugauguccaauuugagcccucaaaaccagaugggguucgagccuugaggucagaaaaucugcuaccugguuccaggcaaggccugguuccaggagaucagaaacauguggcuguacguuggggacuucugggauagccugggcuuuccuccuauuuuccauagaaagaugcgaguauuguucugagaagggggagcaggagagagcugugucaccucugcacccuucgugugcacacuguaucuggcacacguggauuaggacacgcuuaaugacauaagagaaguacugcuguuauuagguauaaguggucucugaauucucucaacaaacccuggacaucccacagugcaucagccugguggcugguguugaaacugugaccauaacacaaggagagaggaaacccacuuacuugcugggggaccucacacuuagucagggggcagugagagcuaacacgugaguguagaacacauggaaaguggcaggcagaacgaagagccaggaagccagggaggagguuggagaagaagcucccaaaauggccccauuuccagacacuuugcugggaacagaaagaccugaguggggugagcguguggcuuccuggguaggcugcuccaggcagagggaacuggcaauccaaaggcucugcggugagagaugugucagcucugacgcgguugaggaggucuggagggcuggugagaggaaagcccucucucauaaagcauggggcgugggggggagggcauggggggcuggccugccucuguuucugcuggagacaagagugucaacguuucaaggguagacauggcuuagauuccagaagauaaagagguagagcugaucgcccagguuagggccuuggagacguuuccucuugaggacuggaaccagaacugagcagcccaguacggggcccaagagcauaggugugucuuuauaaacucucccuggcccuuggaacccuggcaaugagcaucuucucgucccagggcacgcccagagcccccugccucggguuagcugcaggugggucaggccagggccacaccugguaugagauggucucauacacacaaccacccucugaaggugucccagugucccuguguuccucagccaggugcuggguaagggcuguggggacaggcaugguggaugaggucugaacagggaaagaugucuaggcaggagaggugcccagcuagccugagggcccaucuuaagcauugacuggucagcuucuccucuagguacuggcuucuccucuucuauuuuuuuuuaacgcaggggacugacucaacaaagggaguucaacagacugugagggugagccagccuugaccacacaugugagagguacacaugaagggucacuucucuccucagacuucuguuuggcccucaugccucccuuucccauuauuuguugcccugaagacaaaggggagccucuguucccuggcccuaggccagcuucccacuacaauggggauaagccuuuuuugaaaaugcucuccaaccuaccccggguggcccuggacccgauccagauaccucauuuucauccccacaaagccagguucaucagccucuaccacguuucugagugcagucccacccaggccuggccuucugcccuuggcuguucuccuuccuguggacaugucgacauaucuucugagaggcccucucuccucccaccagaacuaaucaaaggcucugccgggagugggucacugccaggcagggagacaugugcccaggacaggugcuucuuagccaugguucagucacgacuccugugaaucaagggaaaaccagugcuggcuagugaggcccggcugcacugccaaguggggaagcucacggcuuuugaacuuuucucaggcuacgucaacccuaggaauauacaaagcgccuaccgaaccccagauggcucacaaugccacacaucugcggggugcuggggaaggcgagagaccuucucacaggcuccagcucgcucucuuucauuuuaccuuucugcuuccaugauuucgcauccccuagcaagaagagaaggcgucuggaaacguugcuaggggucgugaaaucauggaagcaaaaagaaaaauaaaagaggagagaccagaugccagacaccgcaggagcaucuuugcuggaugaguuagacucaccucuagaaaucguuccagccaugaaccugggcaguuuccagcaguaagggcagagcgagacaaccggaggaaugaagagggauggcuggccaguggcuggaggguccuggugcucagcucucagagaaagccaggaauuucug

SEQ ID NO: 6811 - RNA, 1340 nt, Mus musculus
ggauccuuauuaagugcaucugcgaggucccggcuacccuguccuccggcuacccuguccuccgauuacucuguccuccggcaucuuugugggcuguggcucagccaaccagauggucccuaugauagcagagacgguuggucaagaagccaggcuucuuggcucaaugcuguuucaauuccagcaggacaguuggaagaguucuuuccuacugggcaauaccggcauuuuauaaagaggugcaucacuuauaaaguucccagaacccuggucuuaaagagccggccugcaaagacauaaaucaguggguucaggcagcuguugacaaaagcaaagaaguuggccagcugcaggcccaggucugugagcuccuuccagaagcaguccuggaucacucucaccuggaccaggaaauccaggaaggcaaagaagugguaaggggcccagcagaccaggaaggaggcuaccagugugaggaucagccccauugucuugcuguccuugggucccccacaccggguucugcuggccuccuucuguccucucagggaggccaggaugugaaaguugaaguagaggauggcagccaaugggaggaggaaacccaaaacguucaacuccaccauccuuacaaagugccaagcuucgugggggaaaagcaggaugcaggcagagauguucagaucagggacgacuuugacggaacgcagaaggaacgugggggugcucaagaggcccccagcuacccagaugagcaggcaggucacuugggcuugccgucgccgccgguucccccagcuggucaugggguauaccagcaaccuguagcgguccugacugauggccaccaccaggaagaugcugaugaacagguuggccuugaugaccccgcugaccacccggcagaggucacuuccaaagggccaguugaaacgguucccaacguucucugcccagaagggcaggcccagcacaaacaccagaucagaagcugccaaguuagccagguagauuucugcuaugguuaggcgcugccgccgcugcugccaccaucgucgccaaggcaaaaggaagaaggacaggacuaaaagguuccccaggaggccaaagaaacagacagugaugacaaacccuggcagcacccgacacagcagaucccaggcuuccggggcgcccucgcaggaggugauguugggaggggccugcuggcuuugguuagaaggcuguagcuucagcgaggccugggacgccauccacaggaaccugaaauugacagagaguauaggaggccaagcccagcuguggucuaucccagacaauaaaguuuuauuggcacacag

SEQ ID NO: 6812 - RNA, 71718 nt, Mus musculus
gggucucgcgaacgcgccaggagcgugucucaggcgggagcgcgcccaguagaugacaacaaauuagucgcgccgcgucggagucuugucucgccucagccgccagcccucucugucugucccucugucucccuaccgacggagcgcuucggaagcucccggcuuggggcgcccgguucugcucagcgcccaguccccgccgggccuagugcgagcgucgcgacgcgggccaugggguugcccugagggacggcggcgccgaaccgacaugcagcggccaccgcgaaccuagauccccaccgcggcuuggggacgccgccgggccgacccugaggcgcugccgcugccuggagcccaggucggaucccccgagucgccgccgcgugcagccccggcucccucgagccgccagcccucaccaugccuuggccauuuucagaauccaucaagaagagggccugucgcuaccuccuacagagguaccugggccacuuccugcaggagaagcugagccuggagcagcugagccuggaucuguaccagggcaccgggucccuugcccagguccccuuggacaaauggguaagcugcugucagccagcagggguaggaacuggcucuccccagggcgagaccugagcgacugucauccagcaucgggcacguucgguucuccuuugggaauuguuuagauucaaguguggcccggcucagggaaguguguaaaguguagcaaguuugcgcuccuagaucacgugcuccggcuuaaacgguguaauggaggcacacacggggcgaaacaaucgagucauugguugggggggggggggggcgcuugugaggcaggcccaggaaaguacguggccacccuugccucuugggcugcgagugucugcgguguuccuaggcaaacaaacccuauuucuguggaugacguuaagaaaaauuaaagaugaagaggaggugacagaaauccccaguuauuuauuuuggucuggaugcugguauauuugcguuugcuggguugguugucuucauucacugaaagaaaguuaggcgaaggccccucuugccaguuugccugcucugcuugcgugagguugugaauggccccaguagugcuguuuagauuugcccuuuugcuucacgugauagaucgacaggucguaaacgcaaauguugcaaaagcucgggagccgaagccgcagcgucagccuuuuuuuaaagaaccuguuuccuccuagaggcugugaguugacuucaccugaacuuugaguauauucaguucgccagaagcaguuguauuugcaucagugggcuaaaaugccuacuauuuuacuuaaggccuuggguuugucgagucuacucuuuuuucgaaaagcuuaaauuauggaaauuccuugacaacuuguauuaagagguaugacacaagguaauuguaacgaaacuaggugacuuaaaccagagagcacacacaaguuaguuuagacagcucuaguuugaguaacagaaagaccugccuuauaccaaaauaguccuaggcuuucacagucugccgaaagacagguauaguaguuaacccaaguucaguuaucauaaaaggacaguagaguccaugccucgggagagcugcuguucuuuccuaucagcaaacgggauuuuuuuuuuuuuuuuuuuuuuuuuuuggccagguuuauuauguaguccuagcugcccagacacuugucguguagcccaggguagccuggaacucaugacaaagcucucaccuuagccucuccaguacaguuugaaugggcuacauuuuucuuuucuguggccaaacugucuuauuccgaggcuggaaaaugggcaggggcugaagagaucaagaggaccugacauccucaggguagauguuuuuggugucucgucacugcugaaagcugacuaaggagucuugagggugggaauguugauggaugcuuuggugugcagugcaguacucuuugaagagacaccgaaacuagcagguggacauuauuauuuguuuuauaaauggcauuuaauacuuuguccugugccacaguuacaaguauuacagcaagaauccaaauucgacgccaagugcaggcuugcuugcuuuuguguuuuuuguuuuuguuuguuuguuuguuuuugagacaggguuucucuguguagcccuggcuguccuggaacucacucuguagaucaggcuggccuugaacucagagauccgcaggccugugccucccaagugcugggauuaaaggcgugcugcgcagacuugcuuucuuagggaacauaguauaagagcacacuugagaaagcucucagggacuccugagcaagcgguuugauuagcuguuuucuagaagucaggguuucuauuccugcuuaaacaucaugaccaagaagcaguuggggaggaaaggguuuauucagcuuacacuuccauguugcuguucaucaccaaaggaagucagggcuggaacucaagcaggucaggaaguaggagcugaugcagaggccauggagggauguuucuuacuagcuugcuuccccugguuuguucugcuugcuuucuuauagaacccaggacuaccagcccagggauggucccacccacaauggcccuucucacccuugaucgaucacuaauugagaaaaugccuuauagcuagaucucauggaggcauuuccuuaacugaaacuccuauuucugugauaacuccagccuguguccaguugacacauaaaaccagccaguucagguguuauuccaggcuuuuucauuugugugguuuuuagacacaggaaauuagaaaugaggccaucugagguucauggcuugacuacaaguccccugguaacaugaguuguggauaggcuuaacuggaagguuguuuuguuuuccugaagagcgcucgcugucagcccaagugauaacagcaaagcuuccaaaagccuuuggugcucuaccuuacugugcuuagcgaaggcuggggcaaaucagagcggggaaagcagaugccgcugugcagucagcuucagaacucaguuacuuuggauacuugauuuuaaugacuuucaggacugaaagaaaaaaaaaaaaagacccuuacacccuuauagauuccuacaagcuaaaggggacuuaagugaaugacauuuuuaacauuucaauucuuuaaaaaauuauucuucuguagcuugauuuuauuauuuugugaguucuuuuuuccacccuuucagcccccuaacacuagauaagagagaaaaaaggauagagaggaaaggaaagagaucccugaauaaagucagggaucagaaacggggagauguuauugugagacuacuuccugcugauuaggggugcugaguuccuuggggcaaguuugaucuucauugugaggauaucuaauuucuuuuucuucuuugcucauggcuacuuaacaaagugagaccaacaccaaccaaccaacaccaacccacuccaccucucagggaccuagcuuuuauauccucucuagaaaguucccagcauuccaaaugucacacuguugcagaaaguaucggcagcuggcaaaaucacaccugccagagcaugaggcagaucauaguuagcugcuguggacagucugaagcagccccauauccuucauccgggauuaaauugaaagcauauucuuauaauauuuguuuuuuuuuuuaaagagacaauuacaaaauucucacaucuugugugugugugugaauuuaugaaagcuggaagaagacaucggaugcccuguggcuggaguuagaggugguguugagcugccuguuguggacuguuggguugcuggaauugaacucaaauccuuugcaagaauagcaaggucauuuaacugcugagccguuucuucagaccaucaucucauuccuuaacucgcaguuaugcagaggaauugguuggaauuggcugcuaauguaauugguuauuuugcuaacuaaucugaagguggugugcuuuuugugugcagucgugaaacuacaauuaaacucaauucuuucaaauucuuugucuggaauacuuuuaggcagguucagagagccuaauauuucacauauuuguuuauaaaccuuccuaguuaaugacuuuccagacuagacucuuuguuacuuuuaguuuuugggauaggaucuugcaagguagcccaguauugaacucaaaauccuacuuagucugcuucuggugucuauguuuucaauagauauaguuuuaaccacaaaaucaugggccaacagaaauauuuccaaauaguuuaaaaagaugauacaacuguccuuugaaaagcagcuauuuaauaucauacucucuuuggaaguauucuccuuacuugaaaagucagauuaaguaugugguauguuuuuggaaacugccaugcagcauacuucccuagcugcacagagaugguugucacaguuagaacuagggcuuuacauagguggaagcugcuugucuaagcccuacucacaaauaccagcguuaaggaaacuaggcagcuagagucacugucacuuuaccaagauuccacuguuuauuauaaagguaacgucugcugaaguaaguuucacuugcugaaguaggaugcacagcugcuggucuuucuguaccaguuugggguauagccugaaaguaguugagugucccugugccuauuaaguauuaggacauauuuaaaucuaaacugugaaacauuugacggaaugucugaauguguccucauccuccuaugccuuaccuguuguacuuuuggauagacacacuucacuugcaugggaucaugggcccaggaaguggaagggagauagaacaaggauuuggaacugugcagaguuggaaugggcugccuagcaguuuuaugagcuccugguuccuagaagugggcaaagaaggaaaagggguuccguccggugggaagggugaacuuugugacucacuucuuuucaacuccugaagacuaggaacuuauuuuaaucauuacuuacagaaugagggaauuaaaaaaauuuuuuuuucuguguaagcaguguauacauauacacaugcacacacacauacucauacacaugcaagaacaugccacagcaugccuguggagauuagaggacagcuugcaggaguugguucucuucuuccccuguguaugcuuuggggucccaacucaggucucaugcuugguggcaggagccuuuauguaucuguuuuaauuuuuaaauggaggcuuuuauuuauaguuuagcauaguugugcauuguggccugcgcugcuggcaagggcuggauggucugauagugaaguggauagugagccuuucucaugagaacucacuuuguuuaggaagauggacagcauugaauuauuacccuggagccuucuaauuucacuucaauaauuuuuuauuacuuugguacuuauauuuuauagguguaugugugcuuguaauaaaaauugacuucaguucaagaagcacuaaucugcaauuauuuccccaaugcuagaguauauacuagaguaugacuuuucuuuuuugacuaucugcugaaacucauuggugaaaacugaaaacagaauggcccuaaacaggagaaugucuuccgaggugcugcaagaaggcagguacgcuugcugagugguuaacucaagcgacuccuccgccagcucuagaacuauuaaaucucaugggagcacuuccaaagcgagggaagagaaaguugucugagucaguuugacugaucagcuuaagaauuuucuccuggggcuggugagauggcucaguggguaagagcacccgacugcucuuccgaagguccagaguucaaaucccagcaaccacaugguggcucacaaccaucuguaacaugaucugacucccucuucuggugugucugaagacagcuacaguguacuuacauauaauaauaaauaaaucuuaaaaaaaaaaaaaagaauuuucuccugcuuguuaaauaaacuuagaauuuucauaggagugaauuuuggaauuuaucauucaauguacagaagauuuuugccaaguacagagaaguauauuuauauaucucauacauagagauauuguacuguaguuuagugagcccaguguaaauuauuauaguucagaacuccuuuuuucuuuugauacuacccuucaauacuguagugcagccuccaaaccacuguacuuaggagguuaauguagccacaaaaauuggggaaguuugguguauacagagaaaagagcuccaucaaauccagguucuugcacgguuuccugaugcugacagauaccgggggugcaaaggcuaagucauugguuuguauacuugaaagugcuuugauguaguuuaacugcucauauaaacaacaaaacucauauauucucgguggaaaaauucagggagugugaagcaauccuuaaacucagcuugucugcaaauggaaauagggcagccagauuuuaauuuuaaauuauggaaauacuacauaaauaagcauuucugagcuuaccuuuucuauuuuauaugggggauuucauuuuuagugucaggcaucugucuguuaggguuuuauugcugugaacagacaccaugaccauggcaacucuuauaaaggacaacauuuaauuggcuggcuuacaguuucagagguucggcccauuaucauggcagcguccagacagacauggugcuggagaagcagagggcucugcaucuugauguacgucuuguucucagguagcuaggggaaacugcuuccacauggaauggagcuugagcauaugugaccucgaagccccaccuccguugugacauacuucccuuaacaaggccacaccuccuuaaaggugcugcucccuaccuagucaaaccaccacagcaccuaaagacuuucuuuuaaaaugaguaucaagacuucgagcgauuuuuagccugggaaauguaaagcauagaagagggagagucucuuacaggacaguuauuagcagcagugggauagaaaaggcuaauuauucacaccgucugcagaaagucagccauugaacuccuugucuucaaggcacugucucuaguguaccgagucuugagccggcacaacaacacuguuugcacuguugguucccaggccuugacacuuccaacugcugcugccuuacaacagcguguugaaagaguaauuguaguuuugggguuuuguaauuugcuauuucugugccuuuuuuugagacggggugucucuauauaccuuggcuggccuggaacucauuauguaaaucaggcugaccuuggacucacagauauccaccugcugucuccaaaugcaggcgagugguaccacagcuugcucucauuucuuacuaaugacucuuuauaugcagccuacuuuauacuguggugaugauguuaggcaaaaaacaaauccuacuuuuuaucugaguuccaaguuguaaagcagcagcagcuggaagugucaaggccugggaaccaacagugcaaacaguguuguugugccggcucaagacucgguacacuagagacagugccuugaagacgagggccucaguggcugacuuucugcagacagugugaauuaguguggcucagucaguggccauucaguguuuggaacagauuggaaagaugaaaaggccgcucuguggugucaugaaccgacugagaguaaaaacucccggguuuguacugugauccuguccuguugugcacagcagcgcaccauuucuccaucggccugugaagugccaggaaaaugaguuguaugugacaaccagugagacacaucgguggcugcacacagaagaugcuauaguguacuccccaaagccaaacuugcaucaaaaauaccauggucacugaugucugggcuuuccgagucccgacagaacccuuccaccugaagcgugugcucaguggacucgugagacgcacccaaagcugcggugccuacagcuggcguugcucagcaccagggacccagcucgccaugguagcagccacuugcacauuguacaacuaaugagucaaaagcugaacacauugagcuccaccaccaaccucacagaccucucacagcagcugaugacuacuucaagguuucuucaacaacaaaacccagagaggaugcuucuacgacuaguaggacucagaugacacucuccaagaagcccucaaauccugagucagggacuaaaacaguauuuauuuguguauguuuguggcuuuugcaugucauguuguacauguggaggucggaggacaagucaucucucuccuuccaaaugggcuuccagagacccagcucgguccugagacuucguggcaagugcauuaaugugcugagccguugccaguccaucaaaauagauuuuuuuuuaaugcuauaggaauaaacauuucuuacuggaaaaacaaaacaaguugacuguaaugguuucucuuuugauuaaugaagauagguuuaggcuuauuuauaaugauuuaaaaucccugaugcaaaaugacaaucccucuaauaacccuauauuuauuuauuuauuuauuuauuuaacuucucauucauuuguguaugugugcaagggcaugcauauguguguacugugggggggagggcguggauguguacaugagugugcuguggcaugcacacagaggucacagugcaaucugugguagugagcuuucuucuugccccagauuaucaggcuuuaccuccuggcccgugcgguuccuuuuugucagccugauagagaggaggaagaggaggagggaaugagaaggcugagucugagcgagaauaguugauuguccugagcuucuagggugcuauccgcagucagagacugcaggagcaguaggcuucgaggaugagcgucgguaacuacuggaagcugacagugugagugcugguaaaggacacagcugcccagaacgucuacagugagaaggguagagaagcaaaggcagaugaugacagucaacugagcgacacagucacagaagccacgggaaauuagaaugugaaaaaguaauccuaggggcuagaugagaauguaagaaagcugaggccuaggaaagugcuugcccugagagcaugagggccugagguuggacgcugaguaccucccaggaagcuggguacgugacgugaugucccuguggagcugcacacaaguguguuccuagagcugccaggccagauaguccagcacaauuacugaggccuacauccagugagagaccgugugucacuguggaaagugacugaggacaauggggacacccgacauugaccucugcacuagaugcacgcacacacacacacacacacacagugggcacauguauuauguguaccagugggaacauagcacaggcacuuugagcauuuaccccaccccacccauuaaauaauaauaauaaauaaauguaaacuuauuaguuuaaacauuuaauaaaaauuguugcugcuggguaugguggcacacuguuuuaaucccagcauuuaggagucagacgcaaguggaauucugugaguucacggccagccuggucuacagagcuaguuccaggacagcuaaggcuacacagagaaacccuaucuuggaaaacaaagcaaaaaucugucauugcuucuaaauccuuggaaagucuuuaggguucaggcagaccugaggaaagcucuuuuuauuagucaggguuuucuagaggucaagaacugauagaaugacucuacauggaaagggggauuuaccagagugguuuacaggcugugguccacuuaguccaucaauggcugucuacuaacggaaaguccaagaagccaggaguuguucaguccaugacgcuggauagcucagcuguucuuaagaacacagagauauccuugagcacagauguuuuauuuucccugcaugugugcccaggucucuggagaucagaagaagguuacagaugguugugagcggucauguaggcaccaggaaucaaacccaggguccucuggaacagcagccagugcuuuuaaccacugagccuuuuucuccagcccagccuugcguuacauugucagugcucagcaccucggugggcaucuucauucacaucauugaaaaaguugacauucuguguuucuguuugucugacuucaaaaugagucuguuuuuauucucucuagugucucaaugaaauccuggagucagcagaugcaccauuagaagucacugaaggauuuauucaguccauuucccuguccgucccauggggcuccuugcugcaggacaacugugcccuggaagugagaggacuggagauggucuuccggccucgaccucgaguagguagguguuuccuggugcccguuaacccagcuguaagcaagugagcguuggauugaugacuuucaacugggucugugagacuuuucaguugcuaggauacgaggauuuagcacuguaggauguaugugaguaugccuauagaaggguuuucuccuaagucaugcuccagagcacuaauguauacauaauacgugcuuauuuauuucuaguuaucugaagugacuucucucuuuuuggggggugggggugggguggagugggauggggguacggguuguucuagacgggguuucucuguguagcccuagcuguccuggaacucauuuuguagauuaggcuggccuugaacucagaaaucugccugccucugccucucaagggcugggaucaaaggugugcgccaccacugccuggcugugacuucucuuuuaaagauuaaaaauaauagaaagacuauucaaagauucauggagaaauguugggagggcauaggauuagauauuuuuuaaagucaaaauuaaaauuuuuguuauuuuaauucuauguauguagggaggggcuuggguaugugugcacauggccucuguggaggucagaagcaucagauagcccuagaacuagaguuacaggcagcugugagccaucugauguaggugcugggaacagagcucagguccucucuaagaguagcucagcucuuaacucuccagucuccaggaugggguuugacuucaguugguaaaaucugaaacaacugguguugaagaauaaugaucgcuaguaguuauaacacuaaauuugugacucaccacauccauguugguaauaguuauguaagcugggcuuggauaaggugaugugcucucaaccauagaagggaacacagagaaauggguagaaaugguaacucuagauaaaugcuguguacauaugcauaaguuauaauccaaaguauuuccugaaaagcaaaauguaaaugaugcuucguagaaccauagugaucuguuuuguugauguauuuauuuugaggcagucucacagugcagcucaggcugaacuugaacucacucuguagcucaggcuggccuugaaaccaugaucuuccugccucagccucuugaguguuggaauuguaggaguuuuccaccacaacuggaaaaaucugcuauuuaauuguauguguguguguuguguguguguguguucaugaacacugaagccagagagcauccucugguauuguuccuaauacucuguuuaccuuauuuuuugagacagggucugauaagagucuggacucaggcucgccaggcggcuggccagaggccuggggaucugcuugucccugucccucggugcuaggguuaccauguuugaccacauuugggcuugaacucagguccucaugcuuuaaaagcaagaacucuauggacuaaacugucagccuagguuccugauaacuuauuaucacgcuguaucuggccagguuugcuaacacagguuucuggucccugcucucaagaggcugaggcagaaugauuguacauuugaagccaaccuuuaaauaguuagauagcaagauucuaucuuggggcuggagagauggcucagcgguuaagagcacugacugugcuuugagggguccugaguucaauucccagcaaccacaugguggcucacaaccaucugcagugggaucugaugcccucuucuggugugucugaagagagcaaugguguauucauaaacauaaaaugaauaaauaaaucuuuaaaaaaagguuuuuaucucaaacaaagcaaaaaucccccaaacaagaacaaaaaugauaucaccaccaccaccacuacuauugcuauuauuuugagucaggauucccuggcuguccuggaacucaguauguaaccaggcuggccuugugcucacagugguccuccugccucugccugccuaguucagagauuaaaggccugugccuccaguccuggcucuugauucugucuuucaaccauggugggcaaauacgucucucuuucgaaaguugagccuugaaguauuuccucuuuaaaugagcccauuaagaaggcuuuaaguuccgcugaggaaggcagcaguugcaguagagugucaguuuguucugagcacuguaaggaggcucggauuuccucagcaggccagaacugggaaggguucucggggucccugugugcagucgcuccgaggacacucauccaccugccuuuauacugacucugcaccugcugccgccugcugcuucugcugggcccucuucuccugcagacccucuucuccugcagacccucuucuccugcagacccucuucuccugcagacccucuucuccugcagacccucuucuccugcagacccucuucuccugcagacccucuucuccggcagacccucuucuccugcagacccucuucuccugcagacccucuucuccugcagacccucuucuccugcagacccucuucuccugcagacccucuucuccugcagacccucuucuccugcagacccucuucuccugcagacccucuucuccugcagacccucuucuccugcagacccucuucuccugcagacccucuucuccugcagacccucuucuccugcagacccucuaagacuaggcuuuccucauucuuaguguuuuuggcgacaccucccuacucauucuugucagccaucucuuaccucuccuaaugcugauaaacugucuugggugcauacuuauaauugauuucccagcuuuacuguugcuuagcagaccucagcuugcaagccuuagucugccaccguuuuccuuagucagaucuuacugagacacagccaugcugugggcaagugugacagaacacauagcucauaaauccaaaugaauacccacugccugaccauuuacacaggacaguguuggcuggagcauggugcagugugugagugacuauaccuacuagguuuuguugagucaauaaaacuaaaacuugauaaaaauaaaacuugaaauaagaauauguuacagacuuuucccccuguauuuuuguuguuauaaggugauacuuaauguccuauguauuuucuagaauauuuuuacaggcaccaucauaauguugauaaucuaccauaacuauaguauuuuaagcagugauauguauagacuuuugagaaacucucuagguguguuuguacuuugcagcaacuggguccgagccuauguacuggucaagcuucaugaccagcaguaugcagcuggcaaaggagugccuuagccagaaacugacagaugagcaaggagaggcaucccaaccuuucgagggacuggaaaaguuugcagaaaccaucgaaacagguuugcacuaugagcaucuucacagcccagguuuuauguggugguuuggggccuaagacccauucuguuggagggauguucucuggggcuagagagaugggucggugguuaagaacauugguuguucuuccagagaacagguuccauucccagcacccacauggcugaucauaacagccuguaacuccaguuucagaggaucugacaccuucauaaaaacauacauggaagaaaacaccaaugcauaugaaauaaaaauaaaucaauuguuuugaaaaagaauuacuuuuucacuugagaacugaggcuguuuuaaacguugcauucaguuugauuguaugcuuugguucccaggguucuccuuguuuaguuaauuaugccugugggaggaucaggcuagagaucagccuugucccaagugucuguugugauggaacuuggggaugugcuuaugggccacaguguguuuugcauaauacagguucugggugcuuaaaaggaaaccaaucugcucuuuuuauuuuguuaucagacuagcaauuauuucuuuccagagaguggauggugaaguuacagugaucagcacuugcugagaguauuggcggcccaggaguggaggggaggggaggguggggugggaucgggucuuacuugguguaccugugguuuuaccauugacacuugcuuguuugcucuaguacuaagaagagugaaagucacuuuuauagauacuguuuuaagaauugaacaugugccagaaaauucuaaaacuggagcugcacuugaaauccgaguagacagguaagaugauuuuauaucugaaaacuuaaggaccucacucucugacauuacacuugaggaguaauguggaggcugaggugaugcuaaauuaauguauugcagaauuucagagcacagcacuacucucuaaaguaugcucucaucccauacagaaacuguaagcccccagcuagaguguccuuauauccagggcuauguggagcccgccuaagcaguuuucuuaguuaacuugagugcugccauggugacgcucuuauagagucugugcuuugugcacaguagcuaggugagccucgguagugugaaagacugcaggccauggugcucggcuugggcucuucuuuagugcaaauggaugauggugcuguuucuuuugagaauuuugugaggauuauuuuaagguuaaauuuccaaugaugacuuaagucaagaauguugccucuuacaggagcucugacaguguugaaguaguaacuguucaacucuggccauguuuuauggccuccucacagaacaguccauugaagggcacuggagacauggcucaguggcugagagcauuuccugcucuuccagaggaccugaguucagaucccagcacucauguagaccaguucacaauggccucuaacuccagcuccaggagauccaguauucucgucuguucuggggggugggggggcaccugcacauauauauguaacauacacucacaccuauauaccuauacacauaaauaaaaaaaugcauauugaauaucaaagaugcaugacgauauccagcugccuaccucugccuccaagugcugggauuaaaggucugucaccacgccugaugaaacagacuacuacuuuuuuuuuaaaagauuuauuuauugauuauauguaaguacacuauagcugucuucagacacaucagaagagggcaucgaaucucauuaugggugguugugaggcaccaugugguugcugggauuugaacucaggaccuuuggaagagcagucaguuccucuuaaccacugagccgucucuccagccccaacaaacuucuuuugagacagauuguuguguagguucuugugcagcucuugaguuccugcucauccuacuucaaccucccggugcugggcuacaggcacuacuauuauaggcaucgucucaggggcacugccuaugacauuuccuuuuaacuuagaacaacuagguccccaggagucuguccaagugcccucuuguuguaccuuucaggaccguguacugugacgaaacagccgacgaguccucaggagucaaugugcaucagcccacagcuuuugcucauaaauugcugcagcucucuggggugucucuguucugggaugaguuuucugcuucagcaaaaucuucccccguguguucaacugcaccagugguaaggaaaaugaagcauaaucccccagacaggugugggggcguugcucaggcggcagucuggcuuagcaugcauggaguccuaggucccaucacuagcacuugggaggcagagucaggggguuagagauucgagggcauccucaggcagugaguucaaggccacccugaacuauauauauauauaaaaauaugaaacccugacuuaaaaaaaaaacaaaccauauauauauauauauaugugaaacccugacuuaaaaaaaaaaacaaaccaaagcccaacccaauagaacaacucaaaacauaguccugaguuuuagaaguuuuaaauaaagucugucagccaggucugggugucauagaaauuauuaauaauccuggccuaagguuucuauccccucuuugguuauugaguccccagauuaaacacaacucacagacagucuuuauacuuauaauacgccuuaaccagcacaguagcugggcagcugccuagccuucaugcuauuaggauuaccuguccuaucagcaacccugaauuauuacuuucuauguucuaucugagcugcucuuaacuucaguugggcagccccuagggccauguuuuuauggcucagcuaaccuaugguagcuucuccuuccuccuccacauucuucuuccucaugguucucucugcuucaagccuuagaaaccucuaccccaccuaugucucuucugcccagcuauuggcuguugacaucuuuauuuaucaaucacaguuaacugugggcagggucacucagugucuuaccuuugggguaaccagucuugggggccccaaauuagcauuagaauauaguagcauuagaccaacccacuauagugagagugcauacuguaaucccagcauuugagagguugaaacaggaggcuuuccaauuugagggcauuccgggcuacuagugagagacucugucuaggaaaaaagaagcuagggacuguuaaauuuuucugaauacaacauccacuaaugaguugagcaaauccguuaacacaaauauucagcuaguauaucagacacuagccuugaaccccuaaagcucugccagccuggugcuuguuaauggagacaugcuucauguauaucuguagguagaaugagauaagggagcuaauucuaauugucuugauggguuuuggaguccaugugaaaaccaggcuccugggcaugucugugagcagucucuguguacaugauuagaugggcgggcuucccaaaaugugggugaugccauucgaugggcugcucccaggacacagaaaaaggagaaggagagcaagugcagugcucguggugguacagugcugcuuucugacuguggugcugugugaagagcuggccuucugcccgcugccuucccuagcacagugggauggaugccugggccugggccugggcuggagggaacccuuccuuccuuaagucgcuucuuguaaugccacucaacuggacacgucaugcagugcccagccuuucucauucagaagcaccguucccuuccaugacaaaugccuguccuagcgagcauuagcacaagaaccauaccuuucccgucauuaagaggucuucauucuuugcugagcacagcauucuuuuauaaguuacuuuuauaaguacuucuauaauuugccuuuuguuucacaagucaguuuuuuggggagggcucucucucucucucucucucucucuucuucugugugugcacacgcgugugcaugcacuugucuauauguauuuauugagauauagucucucacuuugucaauguguggcucagguuggucucagacuagugauuuccagucucaaccuccugaaugcugggauuacagguguuauuuccacauugguuugauuuucuuacuuacauuguguauuauuugaauaaauaauuguaugcauguauacaugcacacacacacgaacuuguguguacuguauuuauggacauguguguggcgaucugaagacagcugagucaguucucccauggucaugugcucuauaggacuugacucaggcaccagguaggagcaagugcuuuucccacugggccaucuugcuagcucuguucuguuucaguaaaguauuuccauguuuuguuuuuauuucugggugcuauguuaacacgauauugcuucauuuuagcuacaaugcaaggcuuugcccaauguaaugaugcaguuuugccaaauacuucauuuucuuuuguuuuuguuuuggggauuucaagauauuucuuuguguagcuuuggcuguuugggaacucugaucuguaggccagacugaccuugaacucacagcgaccagcugccucuggauuaaagcaugugccaccagcacugggcuaaguguuuauucucaagacgaucuuuauaccucauacccugaauuauuuaugcuaaaguguuuuaaaugguuacuuuccuuuuauucccuuauuauaggaaacugagccaaagcugucaccuagcuggaaccccaaaauuguuuaugagccacacccacaacuaacuagaacguuaccggagaucgcacccucggauccagugcagauuggaaggcuacugggcaggcuggaguugagucucacuuuaaaacagaaugaagugcuuccaggagccaagguuaguauuguuuuguugcuucuaccaaacuugagguauuuagucuauaggauguauggugauugguugccgugggcaagcgagugucuaucuucacugucaguguucugucccgaauuuuccugccuuuuuaugaauuucucucucucuuaagaaguccuuuaucaggucuuucccuuguuggcuucuaagggguuguuaauggagcagauacuguagguaguuagcuguaaaugcugcagggacugcccugcuguggcaacauccuugggaaaccagcucauguaugucuuuggggagcacacgugccauuucuuaaagaaacuuuccugguucucuuuuggcuagacacaguucuuuacauuuguaagcuuugauuuuuaagauguaaagauuuguguaacuauucucuguguugcuuuuagaguucugcauauuaagggacagaggaacacguaccacuuuuguguggugacauuguguuccacuuccagccagucuugaguauuuggagacacaguuauucuugucuguacauuaauguuuuuacaguuacuugaguauuuauguauauuuuguuaaauguaaauaaaugaguauuauauggaaacauuaaguucuggagaucagcguugggcagcauagagcuuggaaaucguaacucagagugaucguaaugggcaccaugccagauuagaacuuuauagucucuuccaguguuccuuaaaccugagucucuaagcuguguguuuaggugucuuucaagaguguaugcucugauaccugagagcguugccucuggggucuguugcaucuuacacauuuaguuucaguggguguuuggggaaaguucuguuugaauuuagaaaaauuuguuaccacauuacagaauugaaaaauucuuaguuauuauuuucaguguucuauauuuucaaaagaaagcagugagugcuuuguucuuugaauuccaaauuaagaauguaccaauaaugaaguauuucuaugacaguuagaaacgaaacaccugauuuuccacucuacuacaacccagagugggauuuaauccaagaaacaaaguuguucaguaacacauuugcccacucugcccugccucacuuauggaugugggcugggugucagcaaacacugaggagugccauggacagccuugcugcggagggguagagccuuugcauuugugucucuuagguucagcucugccugaggagcuguguggucuuugcucuguggaucuguuuguuuccuuguuuguaauacagaaauaguaauaacuagagaguaggggcuggguaauggcucggcgcucaccagacauaaugagacagaugugagggaaaaguguguacagggaacaaggagggaagggcccauuagcacugcuuucugucugggugucagcugugccuuccagccugugugcagaaggcaggcugcagccccacaggcauccuugaggcuggcugugcagccuccaugcggcuuaacugggcuuccagacucugacuaaaucggcucugaggauuugguuguucuggagggugaugagugcuguguucuugcugugcucucuggucuccagaagauguagagacaggcaaggcagacugcccguauggugcuggacuugcucauguggaauaccuuaggcuuuuccuuccugcagcaacguugcaggucuuuaugcucuuuuauugagauuguguggauuaacugugugaggugaagcugcugaagaccaaaggcgaugcuuaucucagcgccauaaccucuccccaguuccugacaaugagcuugugaccuauuuauuuauucucaacuguucuuguguuuuuaaguuggaugucgauggacagauagacuccuuucaucuauuccugucaccgaggcagguacaccuccuucuggauauguuagcagcuauugcuggaccaggcaaguauggcucugcugcgauuauauccuguaauucuugaaacucuuaagagaaaauauagaacauagaugaauuuguauuuuuuugggguaugugacauuaaagguauauuuuaaguagauauccugguuacuuuauuggauuagaucuuuuauauuguauuaugguuuggauuugcauuuagauuauuuguguuacauucauuuuaaaaauuauuuugaccuguaucuuugguuggagaacauugcauuugauauuucauauaccucauauaaccagaaaaaaaccauguaauuuuuguacacaguggguagcacacacauuauuuuuagauacucauauuuucuagagguaagaguguagguucuuggcuacuugcuuaaaacuguugcuuagaccucugguugauaggauagugguuuucugcuaguauggucacauugccauugguauuggauaagugggguuugggaaagaaaugcuuacguaucuaaauaugaauuuaauuuugcuuuccuuuuauauacuuguagaaaauucuagcaaaauagggcuggcuaauaaagacaggaaaaaucgacccaugcagcaggaagaugaguacagaauucagauggaauuaaaccgguauuaucugaggaaagauucccucucuaugggugugucuucugagaagagcuucuaugagacagaaacagcucguacaccuucuagccgugguaagcagcucgggcagucaagacuagaccugcauuuucccuuguguggaauuagacuugauuuggcuucuaagagaaaucacuugcaguggagaacagaagaccuucagugacgacauugguucugguuuguuggcucacaugcacagcugugggcaccaugcuaccauuuucaaggguauagguggucuugaaagugauggcauugucccuaagggagucaguguguaaauuguagauccagacauaaaguuuggggacaccugucaucuuagugugcacucaccugagugugugugugcgcaccugugugcagcggacucccuuaaguaggaagcaugacugaccugucuuguuggucugucacccagccugcuuuauguuauagggguuucagacuguauggacacuguggauguaaguaggaagaagcuguugaaauguaaaauguugaaccaaauaaaaaaauucaagccuacucaaagaaccuguagacaggaguuugauuuguaugauggucagacagucaccagagagaaggcacugaacugccaguagaguccuaacugucucuggucccuccuucucauccaugagaaaccagacugcagugcaguuacacaauuucacuauuuacaguuuggugcuggagacgaaacccagggccccaugugagcugaugccauuugaaaaucugaauuucaacuucucaguugcuauaugacaacuaaaaaucuguuguauugcugcauguuauauaaacccaggaaacacuuuugugacugugugccauugcauguuuacugugcugcuaagggccaugugcaggcauguucuuccuguagcagagcuguacagcugugucucagauaacuggaaggaagguucuguaagugacuaaaugacuugaacgugcgcauugggggauugugucaucaaugacaagguauauuucucuccagaggaagaaguuuucuucuccauggccgacauggacaugucucacagucuguccucucuuccaccccuuggggacccaccacacauggaccuggagcugucgcugacgaguacauacaccaacacacccgcaggguccccgcuaagcgccacugugguauaguauuccuucuuuucuucucagcuuaaaacgcugcugcuaagguccucgccuuuauucauggacuuaaaacuaaucuuuuguagcuucagccaacuuggggagaguuugccgaccacaaagaacagccagucagagggccagcauuccagucugacguggugcacccggcaucuuuacaaaaagcugguuaguuuccacuggaagcuuugaaaauguaaaggagauguauuuugccaguuuucucucccuccuuucagaauagacaucugauaugucucucucucucugucugucugucuaccuaccuuuauguaucuaucuaucugucuuuaucaucuauuuaucaguacuucuuuuccugugcuccugggguguguacccagggcuugcccauggcaagcugcacucuuucuaucacauuccaugugugugucuuucauaaguuuucuuuuagccaaggagagucacaaaguuuaggaaggaaagaauaauuggacaauucauugaaaaauauuuaaaaauaguuacuuauucauuauaucccauuuuuguuuuugagauagggucucauguagcucaggcugccuagcuuuggucucaccugaacuccuccaccuccugaguucuagguuacuaggugugcaccacuaugccugguucucguuacauuuuuuauauauauauuuaaauauauggauauuauggggaaauauacaauagguuuuacaucauugcaauuuuaaacuuucagucaacuaucugauuuguguuguuauauaugugugcacauguguguguguauauauguauauauaugccuguauguuugugugauaugugugcauucaugugugccuauacguguaugguguauguaugugugugugugcgcacaguauauaugcaugugcauacacguguuuauauguguaaccauauugugcacauguguguuuacauacauguuuauguauauuuuuauguauauuuuugugugugaaugugugugugugcuuaugugugcaugcaaugcaagugcauguggcugucacguuggacauaaaaacuugacagugcccagccauugcuccaucauuauacacuagcucgcugaguuguuucuucacugcuucuguauuguuuaaaagaaaguuuuaauuuugauucugcauucccuucccagaauuggguauugaacuuaguauuuugagcaugccgggcagugcuuuuccacuguuuugcacucucgaaccuuauuccucaauauuuaacugaacuaaucucaauggagaguuuggcgugcagauuuuggcuaaucuuguuuuuuuggguuuuuuuuguuuguuuuguuuuuguuuuucucacacaguuuuauaguacaaaacauguguccacacauuuuuccuuagugagguggacucucguacuucagguacaagaauccugcauggcagaugcagcagguagcagucuauuuaagaugccugcugugccucuggcugcucuugccauucugacucauagcuucaugugucucagcucucuccucuaggucugcuucaguggaugaauccagaccugaguuuaucugcaggcuggcucucggcauauucuccgucuccgugcuucacaucgauccuuugucuccagcggaaacgucucugaacgucaacccauugacacgcauggccaccgauuucuucuccuguguagaaaagauggacccagcaauauuuucgacgggagacuuuaagucuuuccgagcagucuuugccgaagcuuguucacacgaucaccuuaggugaacucucaugauuacuaaagcuacuucguaaagaaccaaauacgcgcuuuugcaucuguuugccuuucugcauugguuuuuaauggcuaacagucacuacaguacuacagagaugauccguagggucuccuucaaugguguagugugagaacagcgcagccgcagagcuggguaguuugcagcucccucccuguccuugccaaguuugugugacuacauuuugcucucauccuugccaucacuguucaaauuaugggaugguucuuuuuggcccuggcagugacagaggugauggugguagugaggcugggacugaugagggagagcuugggaaaggcccugcuaggccaugaggugggaguuaccaagccugggccgaguuugcaugcuucaguuucugcugauucuuagagccaugggccuuccuaaugagaccuaauagaugagcuaaucgaaccagcaguauaggguuagcaugcaaaugcuguguguguauauaaaacuuuuauuuuuaugucuauggcuguauguguauggauaguugugagcugccacgugggugcugggguuugaaccuagaucuccuggaauagccuguauuuaaucuuaaucacugagcuagcuuuccagccccaguacuguguauuuuaauauguauggggucuauaaaaagagugauauuuguauaaucucuggacaaauaaaauuuguuuuuggugacaggaucucaugaugcaauguagucuggucucaaccuuugaggcagccaaagccaaccuuggguucaagccagcccucuugcuccugccuccugacgugguagaugugagccagcaugcuugguuuuagguagugcugggggcugaagcagggcuucaugugugcgaggcuggcgcucugcagcugagcugaacccuuagcccuagccugagguuuuuuagguaaguuuucuggagucaaacuuaacaucugaaguaguuuuugacucccauccaaagacagucuauagguuauagaccauagugcugcuucuucuuuuuuuuuuuuaaagauuuauuuaucauauuuaaguacacuguagcugucuucagacacuccagaagagggagucagaucucacuguagauguuugugagccauccaucaugugguugcugggacuugaacucaggaccuucagaggagcagucggugcucuuacccgaugagaccucucuccagcccaggaccauaguacuucuaauaaaaguauaaaaacacuuccccucaguuuuguuagaguucgaaacagcuucugguagaaaauaugaccaaaaaaacugugaaccuaucaacugaaguuuuaaaaaauuagugcaugauuuuuguuccuuggcuuuggagacauucgacucucagaaacaguggucuuccugccuugucuccagacuccugagauuucaguguucacaccacgcccagcuugaacgauguuuuuauuuuuuagauuguuuuaaggagccauuucauacauuuuacaguucugaauuuuuuuuuaaagaaguuauuuuguuuuaagacagagucuuaccuuguaaccuugccuggccuggaacuugguauguacucgacuggccucaaaacuuguagagauccaucugccugugccuccaaagugcuggcauuaaaggcaugugugugccgccgugccugggcagaucugagauauuuuauccacugcaguauaagcuuggaauauggaagaaagaagggcauuguugggcagugcaggcauccugggagguguaccauaguagugcuguuacagaguagcaagugggaagcucaggacguuaggaauauuaauaaugaucacggcuuggacuuguuagaguaguuguuauuaauucuuauaauaauauaucauauaguaauauguaauauuguauacuacuaacauuugcuuguuugugcuguguuguuuaauuuagaagcauguagagacccuuaaaugcuucuuuugugauagguuuauagguacuggcaucaaaguguccuaugagcagagacaaaggucagcuucccggcacuuuagcaccgacauguccguugggcaaauggaguuuuuggagugucuguuuccaacagauugucauucugucccuucucacuacaccgagguaaaugcuggaccaccuuuggagggcuuuuuagauuuguuuugcuuuuuaaaggaauucagugaacaacaauauuuuucuuuaaaaugugccagcaucaugaaguguguuagugcuuuuuuuuuaucuuugagguuauugaaacauuuuaaacuauguuagcaaacauuuuaaaugaaaggagaguuaucugaggaggcagacagguuaugugugggcuguuaguuuauuuuguuuucaaaguguucucuuagggacugaguguuugaacccucgccugcacucugcagaugaggcgcugaguuucacagcacuuggcagcuuggguggcgcuggcugcugugacugcagcaagccugucucaccuacacagcuccuguggucugcaugguugaguucagucuaauaugcuggguuuaggugauugacuucagcuuacuguccuagcugaaacccaucuucauccuugucuuuaagcuucuaacguuccauuccaaagaagggacggaugcccaccuucccguuugucuucagcuucacuauaaacacucagagacuagaggaccccaggugagaggccuguguggccaccacuucucuuguuguuugaccuuuauuuugucaguuuuuaaccuaguuuuaccauuuuauuaauaauuauauugugcuuuuuuuuuaaaaggguaaucaagcaagacuuaguucaguuccucaaaaggcagaauuacaaauuaaauuaaaccccguguguugcgagcuggauaucaguauuguggauagguuaaauuccuugcuucaaccucagaaacucacuaccguggagaugauggccucgcacauguaugcguccuauaacaagcauauuaguuugguaagugugcagaaagugguaccuuaagcacaauuaauuuguaccaaggaccagccucagcuuggagagggguucugagacgaugacagacuauucaagucaaaucauggguccaagcugauggccuguguucugcuugagauggcucccuagacagcucucuguagauagcucuuggcucugaaggcugcucgaccgaucaagacaacguuucacacuguuuucucucuuuucugcucugcuuuagacagcuuuuucuugcuauccuaaaaaacucucugguugacacaucuagcuuuuugcuugagacagcucucucugguugguacaacucacucuacuaguaaaaauuauuacuaaaagcucucuggauagggauagcucauggauuuucugaccaaagccagaaaaguugcuauaaaaaguucuuggauuuuuccaaccaagucagaagaccuguuagagaaauucuaaaaguaauucuuggguuuucccaucaaaaucagaaaguuggaaaaaaguucuaaaagggcuguguuuagcuuuuaaguaauucuugggauuuuuuuuuuccccuccgagacaggguuucucuguguagcccuggcuguccuggaacucacucuguagaccaggcuggccacgaacucagaaaucugccugccucugccucccaagugcugggauuaaaggcgugcgucaccacugccccgccuaauucuuggcaucuuauuagaaagaagauucuaaaagagcucagaaauccuccuaggaaaaguucuugaagagcuuuguacucuucagaguucagauagcucaguucuugcuagagaaauauuccaaaaaggaacugcuguccgccuuaugcuagcucaucucacuggaccaaaaggucaguguuuucauuuacauaucaggucaguuacuuacucuggcuucccucuucaucaucccacaaaucagcaauccaggacuucagccuugggaucuuccuugcaucaccacucccuacaucuuuuuauccccuuccuuaguaucuuucugacacgcuggcucauagugcagcugccucugcucauuuaggccugugaagccccuuauagaacuuauauuucauccuuauguuuuuggauaguuaagaaauucuguauuuucaaacucaugauguuuuaagaguucuuuuccacagccuuaagcgcuguccugaaggucccaguguuuaccauuuggcugacacauuagccacaccuuugccucccagacucaugcugucucugauuaucauggaaucauuaauguuaacugggaggauuccucugaggaccgaccgugaaaauauguacauuauuauauaagcuuuaaacccacagcagccaucaacaucugacauucaugguggcucacacuggcuggcccugucacaagggcaggaaccaugucauucugacccuacaaagagcaugcuggacucagcaaauaugcuuauugggggaauuauuaugagaaagguccuaauacauuaaauugacuauacgagagcaauauuauucauaauaguaaaaauuagauauuuaaaaauuauuuuuaucuaaaaauuguuuuucuucuuuuuacuuuuugagacagguccuuacauauguagaccaggcuggccucagauucgcagaaaucccccuccucugccuccgaggacugacaucaaaggcgugcaccgccauaccuaacauagcaaugacuucuacguuucucucacaguucuaaccuggaacuuuauauuuagucaaggaugauuugaucugccugucucuggcuccugggugcugggauuaaagaugugcacagugccgccugccuggugaucugagcuuuugccuucucucucuaccccacuaugcacugauaauagugaggucaguuguucacuccuaacaggauugcggcgugguaucagcuguaugggaauuccaggcacguggcacucugguuucccuuagauugcuguuagacggaaucuagacaggaaagucacacacagaagaaagguuagacagggagcugacaacauguggcgcaguggggucagauuucuuucuuuggauuuugaaauguccuguaacacacucaaaguuucauuucauaaacaugacccagguggaagggaagaccaggcagcccaggagcgcuguggagagcggggcugacacugcgucacugugucagcccaggagcgcuguggagagcggggcugacacugcgucacugugucagcccaggagcgcuguggagagcggggcugacacugcgucacugugucagcccaggagugcuguggagaguggugcugacacugcgccucacugugucagucagcccaggagugcuguggagagcggggcugacacugcgccacugugucacucuugucgggguccaguaugcaguguggacuuggaacuacacuggggcucgguggcugcaguguuggucuguaggaccaggaccagucccaggcuagcaggcggcuguagugggcagagcagugcagcagugcgugcccgcaggcuagcaggcggcuguagugggcagagcagugcagcaaugcaugcccgcaggcacaguuuugcccuugguuccugguguuggagcagcauuccuuccuuaguuuucauugcuucuuguuguuuaaguugugggccggucucuuacauuugcugacaagcucggguguguugggaugacuacaucaucuccuggaguuccuuaguuuugauuggagauuugagaguggaauuuauguuagaaaaccaaacagggaagagauagauuuaugaaaacucaugguuucuaacuugagagaagcaagggcaccagcuagaagagggagggcuguggaggagagccagugggcgcacagcacaugaagcccaugccgggcugucaugacagggagcuaugugagagggaggacauuuuauggaaaauuggaaaucaacuuuuguuugaauggaugcuuuugaccauugcguauagcagugauuuuuaacuguagacguuagaucugcuucuucguucuagccucauacuuccagaaauaagacucagacucaaaauauauuuacuaacaccuuggccauacacucucaauguagugaaagcuacauucuucucugucuagauuauaauguaaaauaacccauuuauucuaauauacauucugccaccuggcugguuaccugugcucggggaacauguguccgucucaucacaucuucccgggugaauuuuccucaccuggcacucuuccagaauucuuucugccuccuguauaucccaccuauuuccugccuaagccauaggucaucaguuuuauuauugacaggugccacguccauauaggcuaagauauuuacauuuaacccuauagaguuuguuaauaggcuaguuuauaccuuuuccuuauaguuuaugcugagauuugggaggcucaguagugccugucuucauguuuguguacuuuuauaugaagagucagcuguugccaacaggucugaaugggcaguagcuguuacauuugcacuugauugugcuaauaugguaguggguuguuugaacuguggaugcuguggcccguggggagggcaauggcgcacacugaacugcugaguauuccucauccuguuucagcacaaggcuuucacggaaguguuccuagaugacucacacaguccugcaaaccgucggguguccguacaaguugccaccccagcccugcaccugucuguucgcuucccuauuccugaucuaagaucagaccaggaaagaggacccugguuuaagaagucacuucagaaggagacccuucauuuagaauuuacggaucuggaguccaagacagaguucgugggaggauccaccccagaacaaacuaaacuggagcugacuuuucgagagcuaucugguaagacugaacacaccuguuccguguguguucacagagcagacuucauguagaacaccgcuccucacaaccuaaaauggcaaaauugggagcacaguuagagaauagaacaauagccccuucccagaauuguguggagaauuaaaaacaaaacaaaauaaugcaaugcuuguuugcuuuggugaccuucuuaucuucuaucuaggaaugaguguguuagcauuuucugucaucgaauaccacuuacugugugugauagggacuggguagccugggcaccacucugccagaccuguacaugcaggucacagacaugcuguccuuuccagcagcaauuaauugucacugcugaucuguggcugaagaggcugugucucccuagcucacagugguaaaggcaacuaugauaccugaguccucugucacuacaauacagccuuuccggggacaucaugguaaaauaugacacagaucugcugcauucuuguuccagucaccagcucaccucacaccccucagcagucagaguuucccugggcuguucugaucucugaguuugaugaguuuuuguugauacuuaaaugggaauuugccaguggcauucaggaguggauguuuacaugcauucugccaucccugguugcuguuggcugcagcuuucuguuuuacaggaagguuaugaagggcagggagaagccaguguaguaguuagcaugcauauacaaaguacacaucaaaguaugcuuguaucuuuauguuuuuacugcucaguuagcugcauaagcuuaucuuuaucuuuucugccgcacugagacugaauucagaguuuuacaugcuggacaauugcucugucucugagcuguagcucuaagcuguaaacuuuucuucucugaaaaaauaacuggggcuagagagaugacucagugguuaagaggacuugcuguaaaaccucgaagaccuaaguucagauaccaacacccacauaacaagcugagcauggucucaccugugcccaagaguggguagaagguagucccuggggcuugcugccugccagcuuagacaaaaaaagugcaugcuucugccucaaaggaguaagauggcgagaaagagguucccuaauuccucaagugcacaccaggaaaucuuuaccaguacucaguagguagugacuagacauguuuacuauaauuaugcgucucacacaugcaauacuaguaagaauuguaugugaauaaaaacuggcccauuuguuaacauugugccuagcacaggccacauuaaguuaggaccaaugaguaagcacugcagagcugagaaugguguaucuucagcacgugaaacgcacguggcaguaaagccaucuugguuccauagggucguuccaggaggagaagggagggccaucugucaaguucuuccaugugucugguggaguagauggagacaccgcaucgucagaugacuuugacuggccacgguaagcaaauguagggauguaauggaauuuccaaaaaguuacccuuugaguugguaagaauccacugcuaguggccuuccuuucuguuuuuacugcguuauaugucgugaagucuacccgucuguaaguggguuacaguaggcaugggcuuuauacuuauagaucaggcuuaucaaaucgacauguaaucaguguucacuauguaaccugcagaaaguaaacauguugccauuuauacuuauaucuugauuuuucaaauuaucuuugcaaucagaaugguacugaaaauaaacccaccagccaugcauuccauuuuggagagaauagcagccgaggaagaggaagagaaugauggucacuaccaggaggaggaggacggaggggcucauucccugaaagaugucugugaccugaggcggccagccccgucucccuuuuccucucgucgagugauguuugagaaugagcagguaaagagaagcguggcgagcacugcagggaguuacccugcuuggccguggggagaugcuuccccgcuuccucuccaccccauccgccugcccuuccuguuuucuuuugugucccagguugguuuugaacuugugauccucuggcuuucacuucugaguugugugauuccagcuugugcacugcacuuggcuaguuauuuuugaaaggaugucacuugggagguggaggcaggaaguuugcaaguuugagaccagauugggagucauuacaagacccucucguguaaacaacaguaacaucaccagcagcaagaccccaacagcaauaacaacaagaauaaucugugugguuuuuguacuucuuuguaacucuugucaucuaauuuucuugguguauauucucccuaguuaaagguuauguuuuauuuaauugcucacauaguaaauguuauagugauuuuaaaaaugcugccacuauuuuagacauagguugcuucuuuggugugcugucucacauuacacuguuguguuguagauggugaugccgggagacccuguggagaugacggaguuucaggauaaagccaucagcaacucgcacuacgugcuggagcuccuguugcccaacauccaccugacgcugcccaacaaaggcuucuacgagaagcucuauaacaggugcguggagcucccagcacccagccuccagcuccugcuuugcuacuguuuaacaugcaguugaugguguccguggagcugagagucccaacugugucaaaaagagcaccaccaacaccucccaaccugccaaaacaacaagaauaguucauaaauuguuuguauaguuuauaacuccaagauugauugauaacuguguucucugcauguuuguucuccuguguuguggaugugugaaaugcuuaccucacuaaccugugugcugccuguugacugucagcgagcugcugagaagugcuguuuuucaauggugugaagagcauuaggagauuugaauagcaggccaacagccacuggcuagguuucucagguuuuuuuguuuugguuuuuuuuuugagacaggguuucuuuguauagcccuggcuguccuggaacucacuuuguagaccaggcuggccucgaacucagaaaucugccugccucugccucccaaguacugggauuaaaggcgugcaccaccaugccuggcucucagguuuuuuuguaaccaaaaauuuuuaucuaguguauuuaaauacuccaacauaucuaccuaggaaauacggucaccccaguuuguauaucugccucuuggaagauuaagucaugucaguaucaggccuguagggagcucuugagcacccucaggaggcaggcagugcuugcuuagugucaucccuccagcugucacagcuucuccauccccuggucuucagagaccuuugccucugccuggguuuguuuggugucacguagcucuuggugcugaguuuuagggucuccaggucuccccacugaccuguggcuguaagucuuaguggaucaagguucacuuuaguucaguagucaggacaggauuucacauaccaggccacuggaauagagaaagaaaaugguagcuuguuaaguaaggcuuucauuuuguuuuuaaacuacuuauuuaugguauuuagauuuagaguguauauguguauguuuguauuuauguguguuuauauuuguguuugugugugcauguuuguauauguuugguuuugugugucuuugggagcugagucuaaucuugaacaccagcuuuuuuucugcuuggcaguguaacuguggggagaucacuuaagcuuuaggugguggcuucuucaugagucaaugagucugggguagcgagucucccgucuguuaagagugucccuauagcaguuugccaagugaaagcugucaagcaccucagcagucuucuauugucauuuggaagugguuguuuguuuguuugguuguuuguuugguugguuguuuuaaacaagagaaggucucacuguacagcccuggcuggucugaaacuugcuguguagaccaggcuggccugagacugcuucugccucuuaggauugaaggcaugcuucacuauaccugacugagguuuccucuguaguuuguucucucucaccuuuaaaguguucucagcggugugaguagggcguucaguguauugacauggcugacacuaggugacgccuaauuagaguccagucucagauuccuuucucugccauugcuuucccaucaaaagcaugaacugcuguuuuaaagccccuucacaggaucguuuuccauuucugcuugaaaccuuacuucacacaggauccugggaagaggguucuccgucugucugcacugacaaguuucccguucaucuugugcucugugucuaggaucuuuaacgacuugcuucucugggagccaacagcgccuucaccaguggagacacuugaaaacguuuccuauggcaucggacucuccguggccagucagcugaucaauaccuucagcaaagauagcuucagucccuuuaaaucugcaguucacuaugguaauguauuuuuacauugguucugguauaagcaccuuauuucuaagucucagacuuguuuucuauuuuuaugcuauaauuucuuuggaaauuucuauaacuuuccccaugucugugucuaugcugacaagaacucugcugcucaaacguggaaucuuuggagugaucguguacauguuugauauucacuuagaggccccucucccucaugguucuguccuuugugaaaaugcaaaguacuguugugaucauugugagcugcugccuugcuuagcugucagaaccuguaaucguaggucuuuucccugcguagaugaagacaguggaucugaagaagagacuuugcaguauuuuucugcuguugaucccaacuaucguucccguaggaaaaaaaaguuggacucucagaacaagaacucucagagcuuccucucagugcuucugaguaucaaucauggacuaauggcaguguucacugaugugaagguauggcugcgcagucuccuauagugaaguggggugaagcugucuuaguguggggguggggagcaguguuccaggaugccagagcuggaacacagcugcuuucucugcugcucucaggccguguagccucccuguagacacaccugcuaagucugccagugagggcaguaauuguagcuuuuuuggucucguuuuaaaagagggugaagcacaguuauuuguuacagaggacuuauucacauuaugcacacacauuguucaacguuuugucccacuguaucagauggcucaggaaucagacugcuuugugugguguggaagaauuuccugaguuagucagaaugagcaugccaagacacauucuuucugcauuuaaauaaugguugucgggcaugaagcucagugaccaagagccuaccuacuaugugcaacuacuguguguuuuagguucuaucuacaguacugaaauuugaccaaaagaaauaaaaagugacuuguaacccccaccccccauuguuuuguuagcaagagaauggagauccgauggaaaguaagcauggugaauucuggcuagaauucaauagcggcucguucuucugcgugacaaaguaugagggcuuugaggacaagcacuacaucugcuugcauuccagcagccucaggcuguaccacaaagguagggaauugugcaucuuccucuccucuguuuggcgagugaauuuccuaucuguuaaggacaguuuugagaauacaauguugauguaaguuguauucuguugggaguucugguuuuguugucaaaaucauacuuauagauuaaaauuuuuuuguuuugagacaaggucuuacuguauagccaacacugguucuuaacuugagauucuccugccucagccucccaaguucuaggacuguaaguacacacuaccucacaugacuaaaacuuagaaauuuugaguuguugccugaauuacucugugaauaggcacaaagaaaugaaaaucuuguuuuccuaguauuucagaaucuuaguuuauuuuuguuuguuuguuuucugaguuuuugcccucaguuuuaccaacaaucacaaagaaguaggucguugcugccaugcuggccuuuggcccuaugccaccagaaccaugcuggguucuguggggaucuuugcaagcacaaccaccaguagaguaauugauggugugaggcacgaagaaagucuaguucaacacacaucaguagccagugugguucaaacugcagagucugacacugggcaguuuauuugaggcauauuucaguacaacauaauuuggaacagucuccugcuauaacaacccugugugcagugaaacucuucuuaaagugcaugucauuucuuccauggagauggcuuguauagauagaccaucuuaugcagauggugcagaauccccuaccuccaguccuguuuguaagagucuggggaaccagguauggcccuaaggagagcauaggagucaccagaccaugaacugacuccauuuccagccuccugggcagagaacagguuauauaucucuuccuuugaagcgacaacccuguauauuaacauuccuggcuuauuagugguugucugugagcacuaggaccucugugcccccaacaagguucaaagaaaugcagacuuguccuggaaauuauguuagaaaugcucugaaucucagcugucucugauagugagcugcugcaguggguuuucugugccugacucuugggaugggcacaucagggcgcaggugagccagagucgggcauggaugacccugaaucuguugucugaagaguacacaagacaaaaaugagucauguccagaacuauacucucccuaaugucucauuuaauguaugugaacauugccugcuucagauucugaguagcuuggguaaagcauacucagccugcacagagaguuucguugugaguugugaaaguccaaacaauuacggagcuaauuucaagugaucauauugguguuuuuaucucaacgugugucuaggcauaguagauggagccauucucccuacagagacgcgcuugcccuguuccacccgcccacacuggcuggaaccuacaauuuauuccucugaagaagauggccucagccgcacugccucagaugggguugggggagacaauuugaauaugcucucagucgcagugaagauacugucugauaaguccgaguccaacacgaaggugugugccucacacugcuagcuaggcuuauugauuugcuugcucuccaaggugacuguauggguggcaacaccuuuguuuucuuagaaaaauuugaguuggggauucuguggauuaaugugguucuuugugcuguucuguggcgcaggaguuccucguggcuguggggcugaaaggagccacucuacagcacagggugcugcccgcuggacucaguuggcacgagcagguaagagcugucaccugucaaguacuuuaguagcauuuacaagucaugacguccagaaggcaggugacuuuuugcucaaauugcagucccuauagcuucucagugucagcguugcugcuguuagaucagucaggaaaagaagcgcauguagagugcccagccugggagagcagcaguggugcugaguucugaaaaccagagauagaguuuaaaccagaguuaggguuaacaauaugcuuuuuaucugucugccuuccugccuucuuaccuaccuuuaccuaccuaccuaccuacuuauuuuuuccauguuugggacuaagcccagagccucaaacacacugaguguucuacugcccacuagacugcaaagccuugcguuggacccagcagcacaugaaugcagcagacguccaggacauagaguuaaggaagccgaggaugacacucaaguuccuacuuccuuagcucugccuccugaagaaaccagauuuuugaaaaguaaucuucaacaaagacuuuccaagaauuguucugaacaauaugucaauuguaugauugugcauacuuuuauuuucauaagauagggcuuucucccauccugguacuaaguaccagucuaguccuguuuagcuuccaagacuggaggagauugagaguguuuaugguggcaugaccacagacguaagaugggguuucuaaggugucuguggcauucaguuauuggaugugauucuucauuucaaguuccacuuuagccuuguaguuguguuauguaaggggcacaggcugugauaagcacacacacacaguaagacaucagacugggauaagcacacacacauaguaagacaguugcuauagacagguaaaugcaucucuccucuucuuccgcaucccugucaggcacacacuuucacaaugaaucccuucagaacaacaguguuuucuuagaguaucuuaagucacucuguuacguauuuguuaaauguguucuagcaaaauguuauuucuucuaaagcagguaguuaugucuuugugauuauagauuuuaaacuucuugaauauugcugaugaaccuguuuugggauauaacccuccaacuucauuuacaacuuuccauguccaucuuuggagcugugcacuugauuacaggugaguccauuggaacaaagaacaguuuuacuugaaacacacugauuuuagagccaccaagccugauaaccugaguucauuuccugggauccagucauggaagaaaagaaccaacucccccaauuuguccuuugacuuccacacauguaccacacagccauauauacacauauguaaauaaauaaaguauacuaauuuuugaauaaauauucugccugcugugggguuacacaccuccaacuccaauacuuaccaggcuuggggaagaagacagaagaugugaagccaaucugggcuccauagugaaauucugucacaaaaagaauauaccuaacaagcaaagcagagcccucuaacaaucccacaguugaguaguugugguuggaaguguguuggaagaguccugucgcaucaggcugguaaucuguugcuuguuuuugcugccaggccccuucaccugccacuccgaucccuucuuacuguugagacguucagcauuucuagcaguguugcuuuggauaaaucuuccuccacucucagguaccugugaacucacccugcagcagcugcuguucaaaugcaucagcuggagauaccgagcucccuuacccaaacugccccuaacaucagcugaaucuaaaccacuuagucauccuuucucagggaucccucucagggccaugcuccccugcuccucucacugucauguuuccacuuuaggggggaggacggcaccccugagacucucagguggcaauuuaggcccuuugauugguuuccagguaccagauauguguuaucucagaaauggaaaucuuuagacguggguaucauuugaaacaaacaacuggcccaaaagccuauauggccauguguuagcaccuucauguguuuugggucacacagguuugggggugaaguacacugagcaugcguaaugagguguggauggcgcugugcuucugcucagagcuuacguuuucagauguuguuucuugucuuuuccagaaucaucauggacgaggcugcuuugcaccugucagacaagugcaacacggucacuguaaaccugaauagaggugcguuccaaacaaauucuggggccgauuaucgcugcugaacugugugggaauguauuaaagcaauuuuagugugaaguggaguuggaaaggugggcucuuauuagggaacuucuaacagauguugaaauguguaauguuugugacaucuucaguuuucaguuugagguuguaaugugcuaaugguguuagcuauguguuucucuaucaucuaaauaucuauuuaauaugcagucaucucuuguagcuaaaauugugugagguaucagaugaagucacaaugaggugguaggguuaaccugucugcaccacacacacuacagauccugugcguggguugugcaugguguuuaaacagagguuagguuuggauuggagaaauagucuuuaaacuacuacaauaaauauuguauuaaauuuuagauuauguucgugugauggacaugggacuuuuagagcugaccauaaccgcaguaaaaucugauucugauggagaacaggucaguuguaauaaguggaaauuuuuauuucaguccuauucuuaaaagauuuuaaauauaguguauuaggacauauuuuucccacccaauuucagucaaaauauuuggaaacuaggauuaauuuaaauacuuuucaugugacaaaacaaaugaguguauauuucagacuuauuuuauguguaugaauguuuugccuacauguguguaugugcaccauguuagaccccuggaacuggaguuccaggcaguugugagccaucaugugggugcuggggaauugucucugguccuuugcaggagcagcaagugcucagaaugucugaccugcgucuccagcccaugaauguauauuugacuucccgugacccuggagaggacuuggugacucuugucuucaaaaaguguuugucauuucccccugugcccucccagacugcgccccgcuuugaguuacacuguuccagugacgucgugcacaucagaacaugcucagacucaugugcugcgcugaugaaccucauucaguaugucgcaaguuacggggaccuacauggaccucacaaagcagagaugaagccuggagucccacagagaaagcccaagguacggggaaggcacccaucccacgacgucacucagugggaguaccgagucugucuggagggccacucccgagucacccuucucugugagaagccgucuacugcucaugcuuuguuuuagaauauuaaucucagcaggcacaauucucuuuuagacuuuguuuauuaaacaaacugucagaauguugcaggcacuuagauggcagcuacugccgucaucaggaagacuuccuucuccagcagugucugcccuguucucuguguacucuguucagcuucuucuguggagcugccucuccauugcagcccaguaaggagaggcugcaggcuaucaccuagacugcuugaguguuucccugguuagcaggggaaacagcagguauccccgguucacuuccaggucacuguuugcuuaugcccaguguccccuuucugaugucuuuuguucgguuugaauggugcugcacuuauuuuggugauuuuauuuugcaaugcuguucuuugcagccuuuucugugaacagacuccucagucuccucagaaccuauucagauaggucagaguucuguuagcaagggucugaccggcauagugagcuuuguuaggucaaccugcucuuccuuucuguucccccugcuccuguguugugaggugaccaaagauaccccgucuacuaucugcuguucuugaagauauugcccaguuucugaaagauacuuucagcuuguaucuucccauuucagagccguacucgcauuuaaggaguacugccuggguuuaauaaauccaguuaccaaccgguggugaagugguggagcggagccugugcauccccauucagauucccuccuguuuauauuuccacugcacucaggaguccaggaaaggaggcccugaccuacagggcagcaggaggauuugaguggaugacacuuggucagggauaccuggcugcccagcaggguuuuaaggaaccccuccccucugcaggguccugguucucugucugcuccugagcuauauuuauguuuauuuggguuuguugguagcuaaugguaugauaaugauuacacuaaaagcucacugcugggcagacuguaacccaugaguguacgcggugacuguggacugcuccugaugucugcagugcuguggucccaggcagcucgccugcccucugcucugcucuuaggccgugggcucagugguuugccugucuccucuguaaaaaguauuuucagauggagucuuaguuucacugcugugaagagacaccaugaccauggcaacucuacaaaggaaaauguuuaacuggggcuggcauacauuuucagagguucaguccauuaucaucauggcaggaagcacggcagugugcaggcaggcauagugcugaaggacccaagaguuccaugucuuuuuuauuuccuaacuuuauuuuuauuuaauguucauuggugcuugccugcuaaugcuaucugugugaaggugucggauccucuggaacgaguuacagacaggugugagcugccauguaggugcugggaauuuaacucagguccucuaaaagaacagucggggcuccuaacugcugaaccauuucuccagccuugaguucuacaccuuaucugaaggcagcagaaggagaccacauggcauuucuacuccaguaaggccacacuuccuaauagugccauucccuaugggccaagcauucaaacacaggagucuauagggccauaccuauucaagccaccacagaugcguuugguuuuguuugagaaguguuuuacuuuguuuccaggcuggccaugcguaccuggaugccugugguccucuugcagcagccaggaguguggucggcuucaccugcuuuuaacuccgauuucgguuguagguagauuccagcgcucggucaucuucacaugguccagugcuuccugaagcagaucagcagauuuuacgggaccugaugagugaugccauggaggagauugaucugcagcaggccucugccccugucggaccacaggcuaauggugaggagggccuuuccugggagcgcugcuaggguagcagaugccacauuacuuguguucucaucacauuucagugagggacuuaagacucauuuggaucugugggugcacuagcgaucagcucaccugaagaagcagccuguccccugaagaaccaaccgucaggggacagagugacugagaaaugacacagcagacucagaauguggacuggaagucuuagggucccgugaaagcaggcuagcuggcugugacgguggugcagccuggcaagucauaggcuugucuguacuagaauacagaggaagguaggcgugugcgaucugugcaugcccaucucaggaaaguuggauaagcaccagggagcagaugaaugaugagccugauagccacauggagcguguacauacccauagcacccuguauguucuuccgauucgaugggcauaguuaucucuguguuuuguuugcagauagggccucuuuauauauaaauccuggcuuucccagaacuuacugugugggccaggcugaccuggagcucagagaucuccugccuccaccuucugaguguuggaauuaaaggcauauacuacagcaccugguggggaaccuuguuaauucuaaauucuguaaaccuuaauuucaaaauaauacucgaugaacuagugguacuugccuaugaaccuagugcacgggagacagagguagugucaggaacucauggacagcuuuggcuguacauagugaguguaaggccacccugugcucaaugcaucuuaagaagauccaugacauuauaaaauacuaugcaauaaauguuccauucauugaauuuaggguagauuaaaacuaaggcuaugagcuaagcuuccagcuuccuaugcacuuuauaauagcuguggcuaguaggaagggacccugcuugcauauuauagacacauuuucauuaaaauuuggacagugagggagcuggugggcagagcuguuggcaguguucaaugcuuguccaggagucuugagaccaaagcacugacuuaggcguuuuuauauucuuccugacaugucagauuugguuugaaugaauagagaggauggauaacugcuggguagucuaagcucuccuaguacagaguuuugguauguaugguaucauucugaaagcugcaugggaacaaguuuucagcauggguuucuggagcccagguaucagcucggccuucccacgcacagaguccuguagguuuuuugggguggaggucugcuccuuguaaucuuuuuucuuucccuuugcaauuuuacccaaggguuuccaagauugaacucuggacacuuuuccguuucuuccaccuacaagagaauccuggccaagucaaaacgccaguuaaugggagccaaccagagcugaaugccugagcuucucuugcacaggauagcugggaaggaacugucccuuucuugauacugucauucauuuucuuaguagagaacuugaacuugguuaccagucacuuguuugugcuguugagguauuucugugucuugcugagauguuuugggggaguuguucagcccuccaugaaccccagcuucccagagcugugguaagaaguagagaagguuuguuguuauaagaaguauguaaggucacguagaugagggcacucagugcacugcgccugccugugguuaagagaccuuugucgguggcuuagagagggccagauguuucugucuugccaucuagguguccuggaugaaaagucucacacucaggagccgugcuguucagaccucuuccuguucccagaugagaguggaaaugugucccaggaguccagcccugccuauccgucucucacucaccacuugaucagugacgcggugaccggugugaccgcugaaaaugaugacuucuguauucuuuuugcaccaaaaacagucguucagguaauaaacugacaacaguuacaaauuaaguggaccaagggcauuugcagaucuuuugaaucuguaacucuucccacuugaacauuacucccucuuguaaucuacauuacuaccgcuccaacacgugggucagcgaugcuucacgcuugcacaguuucuugcacgauuagugaagugcaguugcuugugucagggcaguguaauuaaaugacaggaagugggcuacagaaugacuaguguaaacuccgcaagaauggauacgucugugaaggcugguugagaugagugcacacacagaacagccuauagcacccucacagugaccgugcucaugggacagguucugagaacucucugguaaaagaaaaugaacagagucacucagaauaagccuagaauuagaaacaugaucauuuaaccaauauguugaaauuugucagguuuugguuuagaaugcaguauaacuguaaacaauaguaauagaaacauacacacacgggcuggagagaugacucagugguuaagagcacugacugcucuucuggagguccugaguucaauucccagcaaccacaugguagcucacaaccaucuguaaugggaucuguuacccucuucuggugucugaagacagcuacaguguacuuacuauauauaauaaauaaaucuuuaaaaaaagaaacauacacaaaaucuguguacuuucauuaucaaauacuaagacccaaauuacaaauuuagaaauuauucauaaggugguuuuuuuuuuuuuuuaauauagaacagguauuuuguuaagacaguaaaguauaguauguuaugauuacugccagaaacuauucccaaguggguguaguggugcgugccuguaaucccaggccucgggagcgaagcaggagaaucacuacgaguucaaggcaccaaucagagcuauaguaugagaguccaugucagagaaaagaauuagcccauuuuacagaccgaaauaaugagggagaauguagccugggggagccccuuagucugugauaugaggagaggguaccacuguugguguguuucaggagaaggaagaagagccagugauaaagaucaugguugacgacgccauugugauaaaagaugacuauuucagucugcccaucacgaggacagacagcagcaaagcgccgcuccacuuucccaucccugccguccgauauguuguuaaagaggucucucugguguggcaucuuuauggaggcaaggacuuugcaacagcuccuccaacuucuccagcuaagaguuacauguaaguucacgugaugaaucaguacaccucuaaaaaaaaaaaaaaccacaggaaauuuaugguuuuuuuuuucccuuaagauuuauuuauuuuuauguguaugaguguuuuaccgggauauaugucugugcacuacaugugcagugcucacagaggccagaagagggcguuggaucccuuggaacuggaguuacagacaguugcuagccaugugguuguugggacuugaacucagguccuuuggaagaucagucauugcucuuaaccacugagccaucuuuccagcucuggaguuuaucuuaaggaugaauaaauucguauucaaauacauuaaaugucauaccuaaaauuggcugugcuucucacguauucacuaaaauguugacuuggauuuucacucaguaagcauuuucaggaacccaucauguguuuguuccagagggacagaaaguugucugacugaauaguguucacaagaugaagugagugugucaggaggcagagcucauguuugcccugagccucuaguagcuaacaggguauggagcagaaccaaguacuuuuauuuuguacacuuuuuucuuacuauuuuaugugugugacugucugucugucagugucugugcaccacaugcaugcuuguuucucuuggaggccagaagaagggagggaguuggguccucuguaacuggagcuauggaugguucaaccaccauguggguucugggagccaagucugcauucucagcaagagcagccauugcucuuagcuucugagccaucucuccauucccagaacuguuggauuaaggaaagcagcauucagucaugggcggcgaggacgaauagaaagcgugugcggggcuccugugucuggguggggcuugugugugggcuggcgugggagcucccuuuccuccugcugcugcugucugagugcucugugcacaccgagcccugcucugcuguugccguggguuuccuagugcgucgcugcccagcaucaugacuugguuugcucuaggucugaauggcaaacaagcuccugcucuaauggugguaaucaaauugcauuuucaacauauccaaaaagaaaagaccccgagccuaaggcauugcaugugguaagcaugugcuagauacacaagcucccuccgagggcucgggcagguaucacaggcagguauuaccaccgguucuggcuaagcgauaugauuugguuuauugugcuguuuguggaacauucuuguaguucucgagugcuuucuuuauuucauuaauuuuucuggugucauuuacuaaauugaauacucuuuuaacagaggguuuuuuuccuuuucuuucuccauuuucaguaguccccacagcucaccgucucaaacaccuacaaggcacgggcgccacacagucugugggggcaaaggaaggaaccaugacuucuugauggaaauacaguuaagcaagguaagaugguguuuguuugaguagccacggucguaggugaucucuuguuacgcccacgcauucgcccuucagccccugccaugcagaguagaaaaguguaaggaucuuguacaagccucaccuuuuuucuuugagaagccugggguguuuuuguuucccggacaccccuggagcagggguucccagacucuccugguggccacugcaagaugagguuucugagcucugcccagcauuugccuuucuugugaagucacuugaagaaccucugcucuauugaagcgucucacugggaaggccugccuuugccuuuggacugcaccuguggaaagcccugugaacaucuggaggccauucacauugauggagcguggccgagaggcucgcagauuuaacuucagaucuaggggauucuauccccucuucugaccucucuaggcacugcaugcacaugaugcauagacaaacucagccacaaaaauagaaauacauaaaaucucauaaaaaaauggauaaagucaaauuuaagugacagucaagauugcuauguuguucucaucuguuaaggugaaguuucagcaugaggucuacccuccguguaagccugagugugaguccagccucuuagaacacccagucuccaggcaggucuucaucgugcaggaccuugaaauucgagaucggcuggcaacaucacagaugaauaaguuuuuauaccuguauugcagcaaagacaugccucguaaagcccauuccaacaugguaagaggccugcaagccccguguucuuaguaguuguagaaaaacauguuuauuuuugucuaacugcaggagaauuggagaggggauaauuaccagaaguggaaaaaaaaaaguggguuaucuuuuuuuaauuugaaaauuccuguuaaauguacuauuucaaguuuuguguuuaagaguuaacugugcaaacugugucccugacuauaacugccagugucucacaccucagguacagagccgcgugagaauggcuagguugcugcuggcccuucuucacacuuagacuuuaaauguuagugagguggcgguggcaggcucugaguugagguggucuuacagagccuggcugguaagcugggccagugcacuggcuuugagaucucagcaagcaccuuggaguuuucauuugcucuugucccccaaagagagccauagaaaauuuucuugcgguuuggacaagcuuuuaaggaagggaggguaaauauaagccucuuucuccuuuaacagauucucacuaucuagcccaggcuggccucaaacucaaaauuuuacaguuuuuuccuuagaugugaauaagauuauuuacuauuuacuuauuuauuguuugaaugagaccaaggucauuaugucacuggggaaaugcccuucucuuuuuuguagcugacaauuaaagcguugcauguacguccggagucuggcaggucaccacaggagugcugcuugagagugucccugaugccucuucgccucaauauugaccagguuugugcagugggcaggucaaugcauucgugagggugaggagcgacuguucccguuggccaucugugugagcagagugaggagugacuguugguuacccugaacucagaaagucauacagcucgaugugaaguuugaaaucuggccuuuuggugagugaaugcuauguacugaggauucuuuccacguggacaccuaacguaggucuacauagaucuuaugaacuuaagacuccuggauagguuaaauguuagaagggauuguguuauacagucuacaagacuuuucuguccuaggcaaaaugacagcuaguaaaugauuaguaaagaagccauaaagcagauuuguggaggguuguaaagaaaguccuuucucauacucagacaagcuucugucagauguccuugggccucugaaugagagaggcaggaacugauguuucaugagcauuacaugggaugauguauggggaacauuucgcuuagcgccuggcaucgcaugcuauuauagagaucaggaauaugaacuuagaugaacauuagcuaaagcaagcagcagcugcagagcauacaugcaauuguaaaauagcaaaagcucuugauacagcuuucauuucuuuggguuuagguaggcauguuuguggauaccauuauucauuugccuaaauaauacugauuuaguauugucacuuaaauaaaauuuggguaaucuguuucaggcaaaugacagguaccucagauaucaagugaaaugcccauauuguaaacagagcaggccagucugagaggaugugccauggauguaagagcacauugggcuuguauauaaugcuugcaagguucugagccagucaaacuuaagauuuguuuuuguuuuuguuuuuuuuuuuauuaugggaauauauuugauaugcauacuuuuacaggucuauuuuuauguuuguuuauauguguguguguguguauuugcacacacaugugugcaagugccuacagaagccagaagagggcuucagauucccuggagauguagcuguaggugcuugugaguugcacagugugggugcugagaucugaacuuggguucucuguaagagcagcaagugcucuuacccacugagccacccuuccagccccuugcuauccauauuguaguuuauucauaugauggcuuccuagaaauauaaugaaauauuuauggggauguugaucuguggauaguccuacaaagagaagacuaagucagagucgucuuuauugcauggccuuaccaaucuuagcaagcucaguuuucuauaauauugacuauaaucccugugcaaagcuauaaagcauaacuacuguaaggaagaaguauuaauguuagcggcaucaguaaaggaaacaaacuggucacauugaggaugaaugaaaaaaguccccugagacuauaaaguaccucagcccugccacagcugucuaaggccccuuccucacuuacacguugaaauaucacaccauaauuguguaggagaccacauaucuauguucucauuucucaugaaaacaaguaaguuaauggguaauaaugcuuggccuagccucuuccauaccaaaacacugcuuccuccuguauugaaaaagcugcauugcuugugcagugaagcgcaugugcauccaaagagcaccuaggccuguagcuaggcaguuaucgccaagcagugcgggacuagguccuguuuguggugcugaggagcguggaggcugcauagcugggcagugaagagguaggcugucagaagcaggacuuccugaccccccucccguauuguugacuggaauccgugugaggaggacagaggguaaagaucucucaggagugcuuccucaucccuacccugcacuagaggcagcccuggcuccaaagaccucugugguagggaagcuaacugagcaggugcacuuaguacagccaugacuacaggcguggacacaggcgugccugugcaggagagagcaagggauggucgggaagaagggauggucaggaaggacuuucuggaggccauggcacuccucuggccuguuuaccaguugcaaggcuacaggggccagggaggggagggugucugugaaggcaccagggcuuuggggccuguguggaggccaugcaggcacucaccaagggcugggagagcccauggaguaguacguacacauuuucuuuaauauugacuuuaauauugauugcuuuugcauaauacugugagggaagaaugaucuuagagaaaacugugagggaaauagaaacuggggucauaugaugucagccugugucauggagugagcauaacauuaaaggaauucugugacucucuaagccugacuguacuguuaaucugcugccacagaaccucagcuaggcauaaauguuuuacagucaaaguuuaacacugaauauagaaccuaagucuuaguguuuaaaugacugugcugaggcauucuuagauaacaaagcaugcagcuguuaggucugcaguggggcuugacauacucuuacagcggagugacugcuccaucggcugaaaugcccuaucuucucuccccaucuugaaauagccauucuucuuuccaucaccucaguuguugucauccuggcugugcucuguaugaguuaaggaaguauguuugcuucuuccucuggacugugucugugagguucaggugucacagguugucacucuacaugggccccagcuuacucccugcugauuugcacuuauuuuuagugcucauaaauaagaccauugugaaauuuguuuauaaguguuuguggacauguuuuucauuucuuuuggguaacuugaauguguaucuauuuuuacacauguauacauacuuguaguauguauauguacaucuaaaaguacauaaaaguuucuaugucuuuguuuggaguuccuugauggcugcugauguuuagccuuuucacauccuuauuagccauugcucuaucuucuuuugugagguauugugauuugcuguuuuuauagugggauguaaauaauaaaaagagcaucauaaaaugccaggguuucuugugucuuccucuucaagaacaacucuauaucuaauacuuucuuuuuuugaacaguguuauaguuaagacaguuacaaaauucaacugucaccaucuagugguaguuaaagaacagcauuuuauacuguuaacauguaaugcugaguaugauacauacauguaauaagcauguacaggguaaauaguaugugcuuguuccuagcaugacauaauaaugaacccucugugaaccugcuccuugccucagaaccagguuguuccauauugguggaccuaucucagaccucugggcaccauauuaccuauaauauugucaucugugucauuuaaauauaauguaaauggaauggcaaguaacuaaguucuuggaaauagugggucagacuuuuucgguguguaucgacaucguggcccuguagcucacgguaauacuguaucuggugcacugcgaauuguuuuauagaguuagagguuuucgguguguaucgacaucguggcccuguagcucacgguaauacuguaucuggugcacugcgaauuguuuuauagaguuagagguuuucgguguguaucgacaccguggcccuguagcucacaguaacacuguaucuggugcacugcgaauuguuuuauagaguuagagguuuucgguguguaccgacaccguggcccuguagcucacgguaauacuguaucugcacugcgaauuguuuuauagaguuagagguuuucgguguguacugacaccguggcccuguagcucacgguaacacuguaucuggugcacugugaauuguuuuauagaguuagagguuuucgguguguaucgacaccguggcccuguagcucacgguaacacuguaucuggugcacugcgaauuguuuuauagaguuagagguuuucgguguguaucgacaccguggcccuguagcucacgguaacacuguaucuggugcacugcgaauuguuuuauagaguuagagguuuucgguguguaucgacaccguggcccuguagcucacgguaacacuguaucuggugcacugcgaauuguuuuauagaguuagagguuuucgguguguaucgacaccguggcccuguagcucacgguaacacuguaucuggagcacuguucuuacacgcguucgcgaccggccaggaaagaaugcaacaaaccggaaucuucugcggcaaagcuuuauugcuuacaucuucaggagccagagagcaagagagcaagagcucuauugcuuacaucuuuaggagccagagcgcaagagcgcuagagugcaagagccagagcaagaaggagaauggugaaaccccgucccuuuuaaggagaaucauccucugccuaggacgugucacuccgauuggcugcagcccaucggccgaguugucgucacggggaaggcagagcacaugggguggagaacuacccuuggcacaugcgcagauuauuuguuuaccacuuagaacacaggaugucagcgccaucuugcaacggcgaaugugagggcggcuccccacagaucccccuuuucuuuuaauaagagcaauaggccacccauauuaaugagaguggagauagaggucaaauccccagugugcaggaaaaggagccguacacauaaccuccuuccaggcuuaucacccagagggguccuggucuggucccgugucguuuuaccuggggagaaggacacuuggacacucaaccuucuugaaagaugacaugucucccuagaauaggcucauauaugccgcagagcccuucuacugcagugcuuagccgugcaacucucucgggcugcugaagcacacucacucuaucccgugcaaugagacuagccucguggggugcaagagcugaauggccagcgaccuauugcuuaagcauagauaaccauauaucaggggaagcaccauguucuagugcugcaagugccugggcaauaaccaccuugucucuccuaguuugggccuuaagcuuacagaccaaccaaagaagcaacacuaauccacagcaaaguguaucuccaaauaauaucaaucccacccauucuuuaacgaaggaaaaugcugaggagauccaauuggguaauccuuuggucagggacagguccaagcgcguggaguugaucugaagucucaauucccgaagggucuguucaaauucagccauccaauucuguaacauauacugagaaagacuuuuugacaaauuagcugcccuaguaaauuucucauacugaauggaaguaaugcacaaugagaggucccccaagcucccgacaaacccugagccagucuuguaaaccuuuguucuuucuuggggcuauggccgcucugcauuccugcguggcuugcucauaaaugagcuauucuaccagaggugcggcuugcuccgaaucugcaaaaauacgcucugcugccucugucauucuggccacaaaaucugagaaugacuccugaggucucuggacgaucuuuguuaguuguccaguggcuucaccugcgagggagagcgccuuccaggcccuaauagccuuuucaucugauucagaacuacuaagaacuggcuccuugagcucaucuagugaugaguauaggcuccuucuccuagagaccuccgcugauugaucuuuuuucuuuucuuuuuccuucuccuucuuuccaaucucuccccagguauucuuaccugaccuaaacuuuuccucggguucaagacccguggaaaggccuguauacuuauuuuguguaccauauuuccucuuugcuccuacucucucuccccgcuuuacuucugauagauugcccugaauuucauccagaauuuucagcccugccuuaaccacuugauaacaugugaaaaggaacaaaaaggcuccuaacacuagagaaaguucaaggccaaacauaccuuguaaagcuauuucccacuuuacuucugauagacugucuugaauuucguuagaauguucaaggccagacguaccuuguaaagcuauuucccacuuuacuucugauagacugucuugaauuucguuagaaaguucaagaccagacuuaccuuguaaaucuauacuuacggguacccuguuccccagcugaagaguucugaauucacgcaguugaauccuucucaacagucuguuuuacgggaacacuucauuaccaccguuccccagcugaggaguucugaauccacgcuggauccuucucaacagucuguuuuacgggaacacuucauuaccaugacccgaaguucugguucuggaaugagggaucuuccuugcgccggugaugguaguuuccgucccggguuuucuugucccaggauuuucucgucccaggucuucucguaccgggucucagcaccaacucuuacccgcguucacuaccggccaggaaagaacgcaacaaaccggaaucuucugcggcaaagcuuuauugcuuacaucuucaggagccagagagcaagagagcaagagcucuauugcuuacaucuuuaggagccagagcgcaagagcgcuagagugcaagagccagagcaagaaggagaauggugaaaccccgucccuuuuaaggagaaucauccucugccuaggacgugucacuccgauuggcugcagcccaucggccgaguugucgucacggggaaggcagagcacaugggguggagaacuacccuuggcacaugcgcagauuauuuguuuaccacuuagaacacaggaugucagcgccaucuugcaacggcgaaugugagggcggcuccccacacacugugaauuguuuuauagaguuagagguuuuguuugagggaggguagugaggauuggguucagacuuucgguuuuguggguuguuuuguuuuuauuauuuuuugagacagaguuucucuguguagcuuagaaacucacucugaacaccaggccugccugcagcucacagagauccaccugcuucugccccugagcacugggauuaaaggcgugugccaucacugcacugauuuuguggagucuuugguuacuguuuuagguuuuuagaggcaggguuucucuguguaucccugguuucuggagcucacgcuguagcccaggcuggccuggaacucagagauccgccugccucugccuucccagugcugggacugaagaugugugccacccccucuagcucgcuuguguguaaguuuggggcaacuggaggacuguugucccagagcuguacacugccuuucguauaugaucucagaaaagacuacagcaagggggugagcuaguuggucuguguuuauuaucuccaugcuaugcuggggcuaacguggagccugcugugucccugaggcuguucuugggcucuugucaguccucugcuucugcugccugccugcuggagguguaagcgucugccgccucaccagcuuuaaauucccacuucgguaucguguucaguaaggaagcuggcuuaagguaacggagugugguuaaagaggaagugagucccauggaguucaguggcacaaggugagcgcacagggugugcacugcucuuagcacugaugccaccacugcuggugcaaagagcaaaaggcacuuugaucuuuaaauccuuuccccacguuuauguuuaguuuuguuucuguucuuguuuugagacaggaccugaguagcuuugcuuauccuggaacgagugauagagaccagguggcuuuccuguggaccagugcucugaguguuggcacuaaaggccuauaauguauacuaccaugcccugcccaggccuagcugguuuuuuguuucucuauuuugcaauguuguaaauguuuucaugguuguaaaaaauaaagggauuauguguguguguguguguguguguguguguguguguagaacaagaaugagugcagcagaggcagagugguagaaaugccaccgacaggugcaaugacugcuuugugaggugaaugacagggacagagaccucagacgccguccugucaguuaaagugacuugucuccauuccaggacgccuuguucuuccucaaggauuucuucacaagucuuucuacagaaguggagcuucuacugacuccagauccagaagguacuugacacacacagucugaggguucugcccuaaguaggaagucacucagaagugaaccuaguaccugaagccacguaguacuuggucagcgcacgccauuguggagugacugcugacugaagagccguggccacccagcaccaccagaggacaggccugcacacugcuaggaaaagcucaaagcucauguuccaagcacaguuuuuugagucaguacacacauguuaauguaacagcuucagggaacucaucagucaagugcagugugcagccucaccagcaucaauugcuauggugcucaacaggagcagagcuaacuugaaaagccccuuguguuuucaguuacaaagucuccuggagcugaugucaccugcaguuugccaaggcauuugaguaccucaaaggagccaaaucuagucguuucuuuuccugggccaaaacaagcuuccccgaaccaucgugccaauucagcggagggugguaauggacuggaggaggacgucucugcugaggaaacuucauuuagugaccagccuguguuuuuuaggugagugcauuuauuuugcuaagaagugaaguucucuugcaguuuuaaagauggcucuggagagaguggguggguugacaagcaugaggugacaucaguguucuuucacguugauguauaaacccggcuguuuguguagcuggcaccacuuaguaacccggaaucugugcuggaagcuccucucugccugcugccccuccccccuucagguccccaugugagugaggguuugcaccucauaaacacagugugccgcccacccuuuugccucuccacuagcugcucuuuucccggugcugagcccucagucugcuccucgcagucccugccaggucuucuuccucaggccgugggcacucugggaagcccaggccccugcucggccccugcucggcugcuguucggcuguguggccagccggccagucuguuccuuccuccuuuccucuuucccuagccuuguugcucaaggcuagaaucuuggcauuauggaaagagaaggaucaaagagaaacugauccccauccccguugucuguaccccucuuucauuccaguuuuuccguuuucccuucuauguugugagagaagaccuugggaguggcccaagugggcauauucagaagauauuuuuaaaaugccguauaguggugauguagaaauaaauccguguaggaaaggcagggaggacggaggacggcagguaugcacucugccuggcugacacuucuccaguaaaguguucccuuuguuagucuccuacagugauucuuuuauguuuaggaaaaauuaaauccuagugacaacuucagaucuuauauuguaguaaucacauauaaauugccaguuuguaaucacaauccugaaagcaagaaauuugacacuuuguauggagacaggucucacuguguggcccaggcuagccucaaacccuaggucuucccugcuuccucucagguagcuggggaugcagacuuguaccauucuugacaaucuaacugaaggaggcagaccuguguagcuuuaccucuuuacuuaggcaaguguugauuuuuuuacuuugugcuagguuauuugaaauguggaaaacaccuuauagauuucauuucuguucuggaagguccagaacccugaggugauaaugagugggagcguagcgucucaguuacuugcuccacgauauguuaauguccagagaguuaggcuggccugcucuguuaacuguuacgguccugaucaucacccaccugcucacugcugacuuuccagugacgccauaggaaucuuccuucuccuucugcaaguggcucuuaccgaauacaugugugacuagcgcucugucuguuaacacguccuaucccauggggaagagaggagcuagaaggcugcuggggcaguagugcuggggugggccucucugagauaguuugcugcuguaaccaagagcauuuacucuguugggcaaaaucauguuucagguucugagcccucaguuugcagucagcuuuuggaaggcagcucauuguauuggcuguauacugauagcucauuggcuguuugcuaucaguccauaguuuuaauuucauccccagcauucucaguguugguauuuugguaucugcccaaaagcauuaauuucagaaauucucaccaaaauuugccaguguauguuauuuucacaaugaugaagaacugaggcucagagagcugugaccguacacacuugcaucccaugugguguuaggcgcaggggccaggccuggcucugcucacauugaacagggauggucuccuugcuuuuucugacuacuuuuuguuuuaagucugaaggucaauuuuaucauuuugaucucuguaugagaauauguaaacaugcuuuccuaugguuaaacauuuaguaaaguuuaguaaaggaaaguuuuuggugacaauauuuaaaugcauuuaaacacaauagagaacauuuaaauaaauacuuaauaaacuaagaaaaggauuuugugacaguaguuaaaaacaagaaaauuuauguuuagucaugauuuuaagacaagggggaacuaaaaggcauccucuuuuauugagagcauacgaugugcuuaugauuuauguuguaguuuuguuuuuauuuuuaaaaaauuugguccaauuucaugaucaguaauuugaauguaaguaacuccuuuuguucccagagaauuuagauucacggcagaaguucccauccggcuugacuaccacggcaagcacgugucgauggaucagguguggagacugcaugcaugcacaguacacaguugucuuuaaaacauuacauugacuuauuguagagggagcgagugugugaggcagggagcacuuauguggaggacggaaugagagcggauucucuccuacacugugcagggcccggggauugagcucaggccgccgggcuuggugccgagcaccugcacuugcuuuuaaaguaaacacuaaguacugggaguggcuuucauacaugucagcaguuagcugauaugauggguugcaccauauaaaauauauuuuucuguaaauguuuuaaguguuucucuucauuaaagaauguugcuuaaacuuucccuagcaacagcuguguuaaauguugagucacuccuuguuuuauggacugauuggccauucuuccuguuuuaggguacauuggcugggauuuugauuggccuggcccaguugaacuguucggagcuaaagcugaaaaggcuuuucuaucggcaugggugaguagacggagcugcugaggcgugaaggugagggcacuaaagcuaguguagagaagagcagaguuucucacaggcaagaugcucauuugugagucuguggcacgcucagcccggagcaucguccugcccagggcugguguuugcuugugacuggaacagagcgguauuccuugaaagugucugcaguucaggauacuuuacgguaacuuacugaaguguaaauuagcuuacucagcaugcaggcacacagauuugguugugauuggucggacucugugcugagccuuggaccauggagggagaagcacaaugggagacaguccugcauguccauauuccaaacuugauaggucgcucuccgccugcugugucuguguuaucuguagcacccaacagucuucugacugacucacacaaagguuaggaagggaaguuaguagcugaucugcauuucucugugagauagaaacacucagccauuuuggagcaucuguauguagcacuuguaauauguaguuucuaaaugggaaaguccugacuuacagauguaccuuuauuucuucuuugcacugacggucauuugcucuaguuugcuagguauugacaaauuguucucauaugcaaucucggaauggcucagugacauuaagaagaaccagcuaccaggaauccugggagguguuggcccuaugcauucacuaguucaauuagguagguugccuugagagucugugugaagaacauuuuucuaugaaaccuaccugcauacuaacgugcacauaaaagcuugccucuaguuucacggucagaaccuccaucagcauuagaccaugugugugugugcgugcgugugugugugcgugugugugugcacguguguacgugcgcaugugcuuuuuaugaugguuuuacauugcaaugaaaauauucucgauauaccugauacagaaauauuaaaauagaguuacccacucucccacccccaacuuuauuuuauuuaacuuuuugaaaugacuauuagaacacguucaaucacacagauggcccagccuguguuucuguugggaagcugggcucuggagaccucggugagaaugagaugaggagccacaggguuagacgcuuucacuuacacuucucauugugguuucugugucuagugcaaggccugaaggacuugguauggcugcccauugagcaauaccggaaggauggccguaucgucagaggcuuccagaggggcgcugcuuccuuugguaccucaacugcaauggcugcccuggaacucacaaacagaaugguccaaaccauacagguacuauuuccuggccugcucaucuggaaagauaagugcccugggcagcaacugggcuacuuuuucaaauggcaccaugaagaugugugaaacguugaggguagacaucacuuguaaugacuuacuaucaugcuuaguuuaguuuuguuuuuugagacaaagucuugcucuauagcccaguauccucaugcuuuugaucuauaaccucccaacugcucaggugugcaccgccacacccugcuuggugcuugguaguuacugagaugucugguacugagcacuucuguaacaguuguaggauacgugcugagucuacaugcauaguuuagacaguaaccauugaaucaucaggggcuuuaucacugagcugugugaaaggguccgcuaaauuuaagaacacguaauggggcaaacaaaaguguuggaaguuacucugugaaguauuaagcaucgcagaguaacaugggcauucuggguaauaagaaggaggggcugaguacgucagcaaaguccagaugccaguuucuagcuuugcaucccuguucacaauagggaaguccuaagcucuuguucugaguguugaagcagaggcacugugugugugugugugugugugugugugugugucucugucugucucuguggggcucucuuuacccccgcaggagagccucucccuccacacuuggggcccagcucucaggcuguuuucuaauccauuucuuccuucugacaaaaugacccaggcagccgcagagacugcauaugacauggugucuccgaguacccuuuccauugagcccaagaaggcaaagagauuuccucaucaccgguuagcccaccagccaguagaccugagggaaggcguggccaaggccuacagcguuguaaaagagguacguagagaggucuguggacaagucaggacugcuugcaugcgcuucuauugucuuguuagguggugaaaucccaugaccaaaagcaacuuggggagguuuugaaaagcauuauuucaguuuacaguuccacauugcaguccaucagugagggaagucagagcagaguucaaaccuggccugaaccuagaggcaggaacugaagcagaggccacagaggaacagugcuuaccacuucagcacggcuggcucagccugcccuuuucuuauauuaaggaucacgugcccagcagugacacuagcacaucagucacuuaagaaaaggcuccauaggcuugccaacuggugggggcauuuucucaguugaugcucucuucccaaaugacuguaacccuaucaaagugacccacaacucagccagcacgccuggcuccccgcagacuucacugacuuuauugcuuuggaggaacccgugggauuggaauguaagcugccagugacagcauggggcucguggguaagacucggagauugccggguagugaauggugggcugcaugcauggugugaaggggaggcugcagacagccaguacucacugcuggguucggugcuuauucgugcuuaccuuagguuugcuuagguagugcuacuuuucaaggaagaccccagcccugccccguucccaggccuucacuguugugaagaugucacagcuuuucuagacagguuuguacaguuagauuauguaaguauuucuaaguagaacacagaaggguuuauauauacguguauccuguaacccaucuuucuuuuuuuuuuuuuuuuuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguugcaccugcaggguugcauaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggauguuuuguucccaaaucuaaggaggggcauaguguccacacuucagucuucauucuucuugaguuucauguguuuagcaaauuauaucuuauaucuuggguauccuagguuuggggcuaauauccacuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcacucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucagguguaacccaucuuucaagguccaccuauagacacauaaugccauuuacauguccucacaguauuuuugucauaggaauagaucacucaucuuuuccugauggugggcauuuaguuucuguuuuguucccugugugacgcugaaacggggaaugucuucuagcugugccugaguucauaugugcaagaaguucccugggguggaauuguugagcaauaguaugggaacccccagguuaguguucgccauuuacuuacuuacuuuucuguuuacuguguggucaguucucugagguccaggcacagcagcaggagcguuguguuucugucuucccacucucuggcgaggcuuggugcucuuuggguaucaggcacuggcuuccuuccuuuugccuccuuacugcuaugacacagagaagcuuguggucauccuauguaggauuugaucccagggucgcacuagguguguuucuaaccauaaucugacaagagucagaagguauagcaguccucauggcacaggaguagccuuugguguccagagaauuggaucugaaguucuuucuuguuuccaucucguaaucccagugccaagguuacagacagccacuugaccccaccuucugugugugcugggacccagauucugguccuucugcuuguguggcuuugauaaagggacuugaggccgaaagcguuuauuuuagcucacaguucagggcagugugccacguuggggaagucaaggcagcaggagcuugaaucagcuggaaauggcuuccgcagucagaagagugcauugcugcugggacguaggcagcuugcuuuccacucuguacaguugaagauucccugcccaggcaguggucucacccacaguaguggugggucuuccuucaccaauucagguaaucaagacaauccccacggagccccucucuaauccugacaguccuuccucgagacucccuucccaggugauuccugacccugccaacucucuccggcuccacaggacuuucugagcacccaccuccauuuaguccuguuggaccugugucuugccugugcugcugcugguuugucugugagcuagccugucagacagacagacagcuagguucuggguuaggaccccaggaugucucuucuggacucaucacugaagcugucacaguggacccacacuucagucucacagauucagugacacaguaaaugacacagauccagaacucuaaaguuugacugcugucacugccggccuguguacacucaaccuaaagcuuagaaguuguggcaaagguggaaugcugcugaagcuguacucaccucagggucucugaauuuucuuuguaagccaauaaaguguucaauuuggccucuuaucuuaauugaauauucuaugguucuuuucuaauacaaggccauuaauugcagccggagcuuucuugugcugcaucagaaguccucccuguaguccucuaucgggcacgugcucaaaaggcccuauugcagaguuguacuuggcuagaggaaagaauugaggcacaaguugcuuuuuaggucaggguguguuucugugggcuuccucgcuugaacuaauugagcuccauuuuuccacacacuaguaugacagagaaaugcugagucauggggaguaccacuuuccugagcgacugggugaggguggcauggugucugcuuguuucuguguuggucuagguggagacauauugguuagcuguacuucaaaguguauagugcgggcaccuuagcuucugaucugagcuuucuuccucuuuucugccuucucaccucugcaggggaucacagacacagcucagaccaucuaugaaacggcggcucgggaacacgagagcagaggggucacuggugcugugggugaaguccugcggcagaucccaccggcaguggucagaccccugauuguagccaccgaggcgacaucaaauguguuagguggcaugagaaaccaaauuagaccagacguucggcaggacgagucgcagaaauggcgccauggggaggacugaucccacagugugacugauugcacuccacacuguguggagcugagggcaggggccuaguggcagcuuccuaggaaacuaguucaauucaugugcccaucucaggaacaaaagcaguucuuaguaaaauaauuuaauaucaaaacaacacacagccaaaaacuugugacauuuuagggccuggcacuugccuuucagaguggcuggugucagucacuagagauuugcugcccuguggaaugcuugcuuucauuaaagugacucuaacuguacuuguuacugacaagagcucauugggaaugaguuuguaaacaguguugagugcuuaaagaaaggggagcacuccugaggcacuggggagcacucuucauaguucugaggaguugauuuuucagcucacagugacagaagccacagggaaagugaagcagcuggggcuccagugucugucagguagcgaaggccucgccucccucaggcaacaugugcuguucugcacuuuaucuucugugagcgugcguuugugucugugugucugugucugugugugugugugugcaucuguaauaugaugcaagguaugcuguguucucuguguuauuuacaagguuauauaaauacgaugugaagugaagaugucucagaguuuuugguaaaggaagguaaccuaguguaaguuucuguauccuaaaugcaagugagaaugugagcucuguggugggcuggggcccgcgcauugcuuauguggccacuguuaaggacuuagugcagcccguuagugucaagggcauuggaagugggcuuuauucuuagaaagauacauaaaaauacucccaaguauguucuagacaacuaauucaaaguaccauuuuuacuugguuaauaauguacauuuugauaacuuguugggaaugaauaaaguauuuuuauuuaaagguaagauuguuguauacguccaugaacauuuguuucucugaaaagcauauuuguugaugcagugcucugauugaccaaaggacauguggagauaccucggagcugauugucacugucacucauuaggaggaggagugugugauuugugccuagagaguagcccagcagaauggaccuggggcuuugcagcgcugcauguucuuacucuugguuuguagacguugguggcucuuggggaugcuggacaccgcagcagcauuugguuugugcgugagaaaggaagucaguuucacccucuaagaacucugaacaaggaaccaggucaaccuugacucacagccacagccacagccccagccccaaccucuagagcugguucaaaaaacaaaaacaaaacaaaauuaaaaaaaaaaaaaacaaaacaaaacccagucuuguagacauuugcauucgcucgauuuccuuuuguugccaggaaacgucaaaagcuaccuuggaguggccacugguggaccucauggaacugcuggcccuucguccuuguuagguggagcccaugucuguuauggcucugaggagacacugcaguuaguaguagcauuuguugccauggcuggcuggccuguuucugccccucuaauggagcaggcaaugugugacagcuguugaauuuggccaggcuuuacccugccccucucuccuccuugguuccauuuaaggucagugugcacgggaguagggauuagugaccccuuugccuggagcagcacacaauucuuccagcuaguuaaauugaugaagccauuauaaaaaggugaccucuccugcuucacucuugccagagcugcugauuuggcccccaggucuuugugcacuguugaggcccugucuguauuugaaugcuucuaaguuacauaucugcugugguuucuuuuaaaaggugucugcucagacuuuggucucgugaugucauacaguguguuggcagugaguguccuuggguugccuugucugcagucaccaagcaaaugacuucacuuggccaagacaccuugucucacucagccccaggguccccucuguaagugaagagguuucuugggacaaggcuugugagaauuucugagcaauuaggucacagugacauguacacaaaaagugcccagauccuccauaccaggcuggugggcaccaucacauggacacuggcuaugccauaccauggcagcugugggauacuccaggucucugcucucagagugacaccuucagggucuggcaccaugcugcaugguugaaucggguugauaguucugacuggagcaggcuguacauacagagcacuccccacagaagucaagggaguuggcuuauuuaugaucacugcgauguucccacccugacuccaucaccaauggcaacagagaccacagcgaugggacugacuuggaaccucuguuuuuuuuuuuuuuuuuuucuucuuguuuagucugagcaggcauagauagacaucauagcaguaggcuuucauuuuaauggacuguuucucuguaccagucugccucaccucugccuguauugaauacggucccucagaucccaggcuucuggggacagugggaaguguuccuucccugccucccuucaaacgccauugggaauguagagguuaaaguccuuuggaaggacugaguaaagacagcaggaugcuccuuucugcagcaggacgggccacuuguaucaaaguaaccaaaugcacguuuguacugaaaaggcugaaaagagaggugauuuguauagcauagugugucgaaaugaagcuuuuuuuuuuuuuuuuuaaaucgggaaauuuuauuuuaguguacaggaaggaccagucacuauucuuguaagaacacuaguaugucacuugccagucuugguguggacauuuucaggguugugcugggcacacuuaaccuuugagagauuccaugggcacaguugcaagucagccugcauggcucggaacuggucuccauuugagacagaaaaggcauccucaugagcugccacgauaggcuucuuugugggggaaaucguugagucuuacuuagcauuucacauuuugaaucucacuaguuccuguagauguagggcucagaggcccgugucagccuucucuggccaacacugggguugggcagccauucacuuaaguccgcaucagagaaaaacugccugugcuccaguuccggggugagcaucuugucggcugcccccucucggggcuccccgcccuucacacaucuuacuccugucucacugcacucugguuggaauugucuagcuguguuuguguagcugcugggcgcacugggcugcucacuuguucguggaguuuuuggguucccacguaaguuuuucugugagucauccuagucucucugcuaagugucccggcuuuccuaaguauggccacucuggauguaaauaagaauacuccucuguacaaguauuuuugugaaaaauguaacuuguuaguguaacuauuuaaaauaugaugacguuaagaauacuugugaaaaaauuaaaauauuaccucuccguuuuugcuuuaaacuuaag

SEQ ID NO: 6813 - RNA, 54441 nt, Mus musculus
ucucgcucggagccucccgcacccaucccacgcucuaccacgaaagcgugagaucaccggggggggggggggggggggggagggggagaagcgccgcuucacgccgagaacuacauuucccgucaggucuugcggcgucgcgcagcgcgcgcgcaggcgcgcgcucggugugcguggcggcgucagcgguucuagaacguugcugugguagcgcucgggcgccauguuaggacgaaggggaaggaggagaagcgcuuaaagcggcggggcacgggugcaggacuggguuggccccggggcugagguaggcugccguccuucccgccucgguggaucaugcccaggacggcagcggucgcgggggggaagugacugggcggugccggcgccggagacgaugccguuguaagugauuggcgugcugagugaggcgcacgccggccgggccccggggguggcggagggggaggggaggcgcacgggcgccccgggccgcggcuuccggccccucgggcgcggggcccccgcaggauccccaagcggaacggcgcccggcgcggacuggcgggccgcggcucccggguuccuuccugucccgguuucaccauggcgccguccagcccccuaguuccccacuuccgcuucccucggagcgggugaggaaccggggccgggagggagcaggccgcgcuggcggcccgggggcagcuuccggaacggcgggcugcggggcggcgccgucccugcuuuguugugacuaggcaaccuggcuucggcgcgcuaccugaucgcucccgcccuugggucacuuguguugugauugcgaguguacgcuuugagcuaauucacuuaggccuucuaaugucgcuaggucuacuuuacacacuugaccgugauuuuucuuuacuuaauuuccccccuccccccuuuucuccuaagaaagauauuuggaaaccgguuguugggauucgaaaguagaugaggguuuuauguuccaacuaaccuaucuuggcgaaaaggcuuuaggucgugcgacugcuuuucuuccaaacaagagaggcaguuuuggacguagccucaaugugacagaucuaggguuguacuuacuaauuuaaaaauggauuucaugcgcuuuucuuucucacacacuagcuugcuagcuuuacucgacccugauguuuaguccagagaccugucagcuguauuucuguagugauaacauuuguugggcuuaauuaaccacaaaguucccuuugacuccuuauucauggaacaaggguaaaggagcacgagaauagaaucuauaaagauguuugguguuuuucagugggguucaaguagaugugagugagugagguguugucacaugaugaccuuguauuagcucauccagacuuuuuucugauacaucagugcuuaaaaaaagauaugguugcacacucuaaagggaaggcuucggauuagaaauguuaucuugugucugggagugaagguaggagggagaguacagguuuccugcaguuuuuauuucagugcacuucugaaaguggaacgguacaaggaggcugcaugagcaccgcacauguccaggucuaugcuugaaguucuucagucuauuuccuuuagguuuaaaaaaauggagccaagacagauggacaugcacaugaccccuuuuuuuuguguguuucaugggauuugaacucuauagccaguuucuuacaagcuguucuaucuccauccagaguguacugggacuuuuaauccagggaaacccaagacugccuggcugaggaggacaggccugccuuccuccucauuacuuuguuucuugagggcucugucccugagcucaccucuccaugggacgccuuguucuucugugugccagcaucacuugccaugauuuuuacuuuugaucuuuugaauugagauuuccuggauaguuuguguuugguauccaguguggguuuuggugugccuguuaaauuuagacaauguaaguugggauugaagcauagacaguucaggugaauggucagaauggacugagucguuacaaaacauucucaaagguauaugguuuguguauaauuacauacauaauuuggaaaaugcugguaccuuuugauugccauaguggugaaacuuagaaaaguuauggaggaagcuaaagcuuuuuaaaauacuugaaauuucugcauucuccauuaacagaguuucucaccucagugcuguaacccugguaauuucuggagggcccuucccacgucuuguuggguguguaacaguaccucugaccugcuuagugguugccaacggcuuuaccccaggaacuucucacaguggcaaacgcacagauguccccagacuuuuccagauguacucugagggacuuuguucgugguuuaagaaccacugcauuaacacaaaguauauaucauuauagacauuuuauucucugugccauaugcuaguguccacaucuuucuuuguaccaguaccagugacuuagcaagugucagaauguuguugaaguuguugguagaacuauuuagugagacuuaagacaguaguucuucuaaguguauaaaggacuuuuacugguaagaaaauggggcagggaacuugccuagagucaaaggugggaguggguggguaggagagugagggggguaugggggacuuuugggauagcauuggaaauguaaaugaagaaaauaccuaauuaaaaaagaaaaggaaauaaggacaaaaaguuuaacacaauuccauucaaauaaaauuauaacuaacauuacaaaaaacaaacaaacaaaaaacccaaaagguagagcuggguccugcucgggaauaugauguggcugugccuuagcauggucugcuggugcauuacugggauccuuuuuacccgguugagagcuuuuguugguucuguaaucucagcucuagaagugggggagaggguuuugaguacaacuuaagcuacaugauaaaaguaaaaucccaucucaaagacaggagacggcaguuuauuagcaaacauuguagguuuuuuaaaauauaaauauauaaaauaauggguuuuguugugauguuuucaugcuuguauaugaguacuacucucauuggcacccuucuccaucucuuguccguuccucuauucuucugccaaggagugacuguuuaccucuuuccccuccuuccuucucucccucuuucuuuguuucugagacagaguuucucuguguaggcuuggcugaccuugaacucaagagaucugccugccucugccuccugaguguucagauuaaaggcgugccccaccacagccuuuugaauugagauuuccuuuuuuuuggagacagggucagggucuugcuaccauucaggcuggcuucucacuugugcuccagacuuuuaaggguggaaugauggcaucucucagcuggguggaaaaauguuugaagcuuaauuccagcuuuagcuaggagguauguggcuaguggaggucugagcaggaauugccugacaggaaugagguccugaguuccaucccuaguaguucaaagaaagaaaaaugcuaguuuuauaaaagucugacccuuaagauugucuuuuuaauaugguguggcauuagaauggagaauauuaguuuugagaagaguacugugugugaguaacuuaaaguaauaacuguguucaugggacuugugauguuucuguugaguauuuaacauugggacacuuaaacucgagaauaagugaggcuguugucagcucacagaaaacaacuuggcaguauuuguuguggccaggaaauaaucggagcuuuaugcaugaagcaugcuuuggugauaccagaaugcuguaggaccuguucauuuuuagaagauauguguaauucagugagcccuuacuuuguaaauuaggaaaaggauaugaugccagguuauauucgugugcaucaaccaaaacaauuuauugaaguagauuugagugcagaagcugauaggggaaucaagccauauuuagcuuagcuggaauugagauuuacagaaauguacuuuauucuuacuacuuaaaggauuuuuuuugaaacuccuguuucauaggaauauuaugcugagggcuucuuguucuguaaacaaguguuucaguucucaacuauaauuuugcaguauaauaaauuuugguggacagaacucauaaaaagguugagcugcucugugcagcccuagagcaggcugaggacugagcugguggguuuguuuguuugcuuguuuguuuguuuucaggguuuuuuuguggcaggguuucucagucuagcccuggcugucuuggaacucacuuuguagaccaggcuggucucgggaacucagaaaucugccugccucugccuccugagugcuggaguuaaagguggggggccaccaugcgcuuaacauugaucaggauggacacaauaugcagaauaguuuuuuuuuguuacacagugauuguauuuucuuuaaggcugcaacuuuaguuacuuuauuucaggcaucuaagagaaacauaacuuaaaaacaaggcacuauugagagcaaaaauggacuaauagaagaaugggguaaagaaaagguauuagauaaucuuuagaaaaauaauuucugaaguggaggacacauguauguguggguaaggugcacacauguacgcucauucuuguggagccagagauuguccuugagugucuuccuuucucgcucuccauuuugcuuuuuaagacagcaaaucugagucuggaguugccgcaguaagcuuccccagcuggccacugugcucuggggucccacuucugccuccuuucccagaaggguugggauuacagauuacagacacuuggagcuggaguuggcuuuuuagaggggugcuagggauuugaacucagaucuucaugaucgugugucaaacacuugacugagacaucuucccagcuccaaguuaaugugggugaauugcuugcugauuaugguuucuggagugccguuuucuuuuaagcauguuuaugagcauguuugauuccuucucccggaacaccuucaucuuuuuuacuuaaagcaaaaauaucuuucuggcuuaauaacaucacuuaaaguuucuuaguucagcagaacauuucauacugggucaaucaacuuuaugcuauccgaacacuuaaauucuuccuucauuugccucuaggcaaguuuuaaaaaucuacuuuucaugaaaacaagaccauuuguuagguuaguucucauuucuuugugccuuuaaauuugguauauucacugugcacaacagcuuuuaacuaauuguacaguaucagauuauaauguacaaagcagugacauagaccguauuaguuucuguccuuguuaguuuuuuguuuauuugauacaagcugaaguuaccaggaaaauaaccucaguugagaagaugaaucauauugccuauaggcaagucuguagggaagucuauaggcuauuuucuugaauaaugauugauaugggagggcccaacccacuggggcggugccauaucugggcagguaguccuggguuguauaagaagucagacugagccgggcggcaguggugguggugcacgccuuuaauccuagcacuuggaaggcagaugcaggcagauuucugagugcuuggccuacagagugaguuccacgacagcuaggacugcacagagaaacccugucucaggggaaaaaaaaaauuaaaaaaaaaaaaaaaaagagaaaucagacugagcaagcuguggagagcaagccaguaggcugguguucucuccaugaccucugcuuuaauuccugacuucaggcuucugcuugaguuccugcccugacuuguucaucauggacccuaaaguguaagcgggaaaaaaacccuuucuuccuccaagcuacuuuuggucacggugguuuauaacauugaauaccaaggcaguuuccuuuaacauugguuaaguugaugcccuugguaguuuuuuuuaaacauuguuuacuugugugucuauggguggagggguugacucuuguauuuaugugaguagugaguguaugccacagugggcaugugaugaucagagaagaaccagugaauucuuugaccuguguguccuguugauuaaauuuaggugaucaggccuuggcgacagguuucuuuacuuauugaacuauuuugccagucugaugcuugauaauuuugaagguacugauuuguagguugauacauagugagcucuggauuccauauuggaauucucauccuaguauuccauauuguguugggaaccauguuugauuuccuaggguuuuuuuuuuuuuaagaugauuuuauuuauaugaauauacugcagcugucuaaaggacacaccagaagaaggcauuggaucccauuacagaugguugugagccaccaugugguugcuggaaauugaacucaggaccucuggaagagcagugagugcucucaaccaaugagccaucucuccagcccgauuuccuaguuguuugcaggggcgguugguugguuaagggcuuguuaugcauugcaggcugguuacaaacuggcauuucucccuugcugagauuacagaaaugugccagcauuccaaacuugucuauguauuuuaaaaauuagcuuuggggcaagcaagugagauugcucagcagauaaaguacauccagguucagucccugggacccaaguaaacauggaaggagcuuaucacugcauagggcuuggguucuccacgugagccgggccaugcucucucagaucuccuauacagaaaauaugaagaacaaaacuuaagcuaggcagugguggcgcacgccuuuaaucccagcacuugggaggcagaggcaggcggauuucugaguuugaggccagccuagucuacagagugaguuccaggacagcuagggcuacacagagaaacccugucucaaaaaaccaaaaaagaaaaaaaagaaaagaaaaaaacuuaaaacaugcuccccccccccuuuccugggcuguucuggaacucaaauaagaucuaguccugaacucacagauccgccugccucucagcuaaaaacauaucuuugaagggcuagggauauguauggcucaguggaggaguucucccagcacuacagagggaaaaaaauuuuaaguuuguuuaguguguggaacauuuacuguaugugagccuguacuuacuauauuacaguaauaggugcaguguaguaauacuguggauuacuacacuggauccuggggucucaguuauuuuuugucuuugggaaaggucuuuguggaucuaggcggcauuagggcaacaauaggaaaugaaugagaucaaaauacauuuuauggaguucucaaagaauuuauuuacuguuauuuuuucuuggaugguguuucacuguauuguccugacuguccuggaacucacuguguaagacagguuugcuuugaacucuuaagaucugccagucuuugcaucuggagugcugggauuaagagcaugugcugcuaccaugcccagcacaugcuguuucuaaaaaagacaagagaaagauuuuaugguugcccaggcuggccuaaaguacuucuugcuucaagugauuuuccugagcagcugggagugcauuaauagaaccuaaauuuuaaaaaguagcuagcuagccgggcgugguggugcacgccuuugaucccagcacuugggaggcagaggcagguggauuucugaguuugaaggccagccuggucuacaaagugaguuccaggacagccagaacuauauagagaaacccugucucgaaaaaacaaaaaacaaaacaaaacaaaaaaaaguagcuuuaguaacugcagaguguauagcuuuuggguugcaggauaugauagaaacaacuuuuggcccagcauuugaagguagagucugccagggugugaagucguggcacaggcuguggcaacauugaaauguugcaguuagcaaacaaugaguauugauauucagcuucccuucuuuguauaaaguaugggaaucugacucuuaggugccaccuagauuuaggguuagucuucacccaguuaaacauuguuggaaauauccuccuuggugcaggaguauguuuccauggugauucuaaauccauucaaauuguuaaugaaguuuaacuaucacauaggccugcauuguauaguguuuucauuuguggaaauugaaagauuugaggaagagaguuuguuacauaccuuuucagaguugucuuucaaauuuggguucuagauugcauccauaagccauuuuauauuuuacauuuuauuuuuacaguuuaaugguuaggcaauagguucuaguuauuucaauuauaauaaauauuuaugguuuuugacaguaguguuuuuagguaguccaggcuggcuuuaaacucugaucucuuuccuaagccucccaaugcugggauuacgggcaugagucaccacaagaaacauuaaauugcacugcuuggaauuaauauucaguacuguuaauugaauguaucuuugguuuuucugaugcacucuaggguccauuaauuuucaagguauccuugcaaaguuggugcaggagucgucccccccccuugaauuuguagcagagggacaguuagagcacccuuagaaguuagagagguggcucagcaguuaagagcacuuguugcucuuguagaagagaacccaaguucaguucccagcacccauguauccacugaaaaaccauuuggaacuccaguugugagguauucaacauucuucugacggccuaggcacacacaugguacacacacaccacacaggcaaaacacauacaguuuuaaauaaauguaacuuuauuaaaacaaacacccuuaagaagacagggaaagugaccuagcguuugauugaacaacuauguucuuuuccuuccucagucaaccuagaauugacaguucgguuuugggcuucaucauacuuuauuuaacccuugggugaaacuuacuauaucauuuguuugacccauggccgcugcugcuuacuagagacuggauggaugacucaucuuuucauaaauuuuuaauauaguggccagguauguuguucuguuuuuguagucucaguacccagcaggcugaggcaggaggauugauuauuacaggccagccugaguuuaaagaggaaaaguagcugcguucuaaggauuuauuuauuuauuuauuuauuuauuuauuuauuuauuuauuuauuuauuauauguaaguacacuguagcugucuucagacacuccagaagagggcaucagaucccauuacggaugguugugagccaccaugugguugcugggauuugaacucaggaccuucagaagagcagucaaggaccuucagaagagcagucaaugcuuuuaaccguugagccaucucaccagccccaagcuguguucuaaauaacugguaugauugacauaaaacaagggacugguuaauuagucaucuuuagaaucugagguuagcccccuguugcuaaguuacuguuuaaugcuaaaacuccuugugaaagucuggaacucaguguauggccuugacaguccucagauacuuguuaaucuuucuaucuuaaccuuguguguucccagauaacagggauaaaccaguauaccuggcugagaauuaaugcuuaaaauauuuguuuuauuauuguuaaucauucugugugugaaaaaggguaugagcauauaaguguuaccauggaggcuagaagacaacaucagaucccccuagcuggaauuagagguaguaaugagcagucuaauauggguauugcugggaacugaacucugguggucuucugcaagagcaacaagugcuuuuaacgagagauaucucuuuagucccccauauuaauauuaaauacauauuacggugccuuugagauguuccuuguuccuuuucugcccagaauucuuuuuacugauuaaaugacguuuaaauauauaggaauuguuuuuguaaauaaguuauuuuguggggcggguuuuuuuuguuuuguuuuguuuuguuuuuuguuuuuuguuuguuuuguuuuuguuuuucaagacaggguuucucuguguagcccuggcuguccuggaacucacuuuguagaccaggcuggccucgaacucagaaauccgccugccucugccucccgagugcugggauuaaaggcaugcgccaccacugccaggcuaaguaaguuauuauuauaauuuauuugauugcuuucaaagacuaggcaucaaguuaagcuucaauuuuaacauagaaugaugguguguuuuugauuggguaauugcuacaaaguuuuaagagagugaguggaucugcuguaggaagagccacaaccuguuccagauuuccaacauuuggagucagggaucuuuguguaaauuguauagcaaaguaacuauuugauaaaauacuacugcagauguguccgccuguauuaagucauuugccucucuccucacacuuccccuucuucauggccguucucuguuguuguaguuaguucuuuuucuugagguguugaaagcagaucucacuguucuggaagucacaucuuuacauuguguguguguguguuggggaagggaguuguuuguuagucaugccacauugugcauguugaaguucaagagagcagcugugggaguucuuuucugucauguugguucuugagagugaauucagguuuucaggcuuggcagcaaaugucuuuauuuuuacuuacggagccaucuugucaccacagguacaaaguuuuaauuagauuuauuuauguguuugcagguacaugugcccuacacauugcuuagaucuacaauucuaaggauugugggaguugguuuaggauccucagguuugguggcaagugcccuuuaccuucugaacuuaucuuguucuuuuuguuuggcuuuaaaaaauacugucucaccaggcagugguggcacacgccuuuaaucccagcacuuggaaggcagaggcaggcggauuucugaguuugaggccagccuagucuacagagugaguuccaggacagccagggcugcacagagaaacccugucucgaaaagccaaaaaaaccccugucucacuuuguagccuagguuagcccucaacuguagguuuucuugccucgaccuuccaaguauuagauuguaguauuguauuacuuucuuuaccuuuuacuguucuuuuaacuagggguauggaacauuccaucaugcucugcuuuuagaagugcauaaaggcacacauuucugcaaaauguuaggugcuguuucccaucucgcaagauagcuuuucuguaguacagcagggcuccaaacucaggaccauucuccugccuuggccucuagaguacugggauucuaagccuagagucaccaugcccaacuuguuauauuuuuuaaaaacuguguuguagauuagguuggcuugaucuaccuggucuuuaaaaaguguugcugaggcucuauauuucagggucagaagcuuugagagauggauggcuagagcugaagcuguuaggcuaaaugccuuuaggaaguugguaucugcuuuuaagguuaacagugccacacuuccgcuuuaaaaggauaaacugagcuuacuucuguugggacauguaagaacagugucccugccuccuaaccucuucuuucuugagacaucuuucuaggcuuugaucugauuuugcaguguagaccaggcuggccuugaacuugccaccugagucucuucagugcuaggauuacagucuacauuuuuauacucacagugcugugcucgcuuuucugucugugccaaauaucuaaggaaaauaaaauucuaaaauucuaaggaggaagucuugauuuugguucucugucucagguucuccuucaugcucagcuggcuacauugcugugggccugagaugaggccgagagcaucaucucaggcccacauauguuagggugaacaugaagcagacuuuauccuuucauguuuuaggggcagaauauagccaggugaccuuaaacuaauacauagcugaggaugaccuugaacuguugcucuuucuaucugcaccccaguguuaggauugcaggcauguaucauaggcccaacaaaggggaguaaugucugaaaaaagguguucuggguggccaggugguuuuagaaugaaagagacucugcugugaacagcucagggacauguauggugugaaccuagcauguaguauucauucuuagaguuucuguucaguuuguccaaaauugagauguauauuucuguuuuguaagaaacugaauaguagcaaaaagaugucuuuuuuguuuguuuguuuuguuuguuuguuuuuuugagacaggguuucucuguguagcccaggcugucuuggaacucacuuuguaaacaaggcuggccucaaacucagaaaucugccugccucugccucccaagugcugggaugaaaggcaugugccaccacugcccagcucgaaaagaugucuuaacgugcuuuuagcacugugugugauuucuuuguguuccuuuugcucucuuuguucuguauucagugucuccugcauacuuguucugucucugagaucucuguauuuaauuacuaauguuaaaugggaagggugaguuuuguuuaaaguauaacaaccguguuucuucuugggucugcacacugcucuugaugccuguguuuccuccauggugucauagcuuccuccuuuguucauucugaagaaucuccuguuucugccacucccgggcuucaucuuccauguucccauaggacugcugggucggauccagcuggcacauuaccuuaucuagcuuuuuuuaaaaaagauuuauuuauuuauuuauuauauguaaguacacuguagcugucuuaagacacaccagaagaaggcaucagaucucguuaugggugguugugagccgccaugugguugcugggauuugaaaucaggaccuuccaaagagcaguuggugcucuuaaccgcugagccaucucuccagcucccuuaucuugcuuuuuauguggguucugaggauugaacucaguucagcagaccuauuaggaaaguacuguacaggcugaaccaucucccggucucuaucuuuauuaugcacguucuuacuugaauuaggaugauuugugugugcuuguauguacauguguguauguuuacauuacagauuuguguuguauaugcuuuuuaauuagacgaugcauguguuuauguauacauguguauauaugcauaacagauacauauugaaguaaauuaaaaaaaacugcauaugauuuaucucaccaucaguuuagcauagagacuaauguagacauaaagcccaccccccaaaaauaggaugaacuauuauuuuuaccccuuuuuuauuccccccccccaagacagggucuuuuguagcccaggcuggccuuauuuaauggaggaguaaccuugaaucuuugauaugccucaguucugagguuguaggcaugcacucaccaccauaucuugcucuagaguaaagaacuuuguguggauuuauaaaucuaaaccuuucuccugcuauacugauaaagugaccuugacaggaacauuccaagcugauagucaaacugaagauuugaaggggggaugggaauggugaagacugggagaacuacagggagugauagcauuuugcuaauaaucaaaccugaacugaaggguaaggaauuuauaacagccaaggugaagaaagcagaagaacauaguuucuuugcuuauacaacacagacagagauggaacaugcuuuaaagucacuaaaaugugauuucagcacgcacuugugaaugugcugaacugaacaaaucuagcuuagacuuacuuuuuuuaaauuuuuuaucuuuuuauuuauuuauuuauuuauuuauuuauuuauuuauuuauuuuugguuuuaugagacaggguuucuuuguguaguccuggcuguccuggaacucacucuguagaccaggauggccucaaacucagagaucugccuaccucugcaccucgccccccuccccccaugcugggauuaaaggcguacaccaccacugcccagcugauaaaucagauucuuauuuauucaagaaauguaaaaguugacacaagacauaaauguguccaggcacagugauuagaagacacacacuagcuuaguggcuccucaguaacagcacagugagcuucugcguagcuuccaucuguguugguguuagaagacagaagcagaguccaguggaucugcacggaaaaguauccugacauuuagugcauaauauuuaucagauguaacucuuucuaaaaaugugucagaaacuuauuaugaauauagcucuuucccuucaaauuggauuugucugugcucuuugccccauuacaaaugucauccauugagucacaugcuaaguuucacuuagagagugagugucuuaugucaaaaaauagcauuuguuuuuccuuucuuaaauaggguuucguaggcaaugcuggaauuacuguacaccaggugcucagcugaaacacauucuuuuuccuguaguguuuaucagggcuuuagaaauaacaguguaaaaggacuuauuauuauuacauuuguaaaaauagguuuauuuucucuacugcacgcuuucugguaguguguugaucugaguuuuugcauuuauucugguguuuaagugauguuaaaguuucuggaggaggagaaauguauugauauauuuuauuucaaaguaucuagggauacauuuugucgggaauguauuuucaaaguagaaauguggaggcauggugacacauaccuauaguucuagcauugugggacugagagagagggcagcauuggccagccuggguugcacugcagcuccugucuaaaaagaaaucccagugugggcaguauggcaaggagcagcugugugacgagagcugucccugcucucguccuguugauuaguuucaaauuguagacuuuuuuggaaguaaagaaaauuuauccaauuccauuuuuaguccaguuacaacgcagggaucacaacaaacgcagccaccacagaggcacuauggcauuaccucuccuaucagcuuagcggcccccaaggagacugacugccuacucacacagaagcucaucgagacgcugaagcccuuugggguuuuugaagaagaagaggaacugcagcgcagguaaggagauagcagugaguggagugcuuugggaugcuuaccguccgaauuuugaggcauuucccacucacucaguaguucagcuuacucuaaaucuuuauacuuguuucacacaagaaugauacucugugaagaacuuguuuucuauagaguccuguugcuauaagugugauuccuuggcagguaagggggaguaaaacaguugugguuagggcuugaacauuguacauuguaggcaagugcucuuaccacagagcuacccuuagcucaaugaaaauuuucuuuugaugggggcuggagauggcucggagauggcgagcacuggcugcucuuacugaggaccuugauucaauuuccaguguccucuucuggccucugcaugcagagugcacaugcugacauacaugcaggaaaacauacauaaauaagacauacaauuaaaaaaaaauuucuggugguucuugguuacaguguaggagaaaaggaaaugcuuuaaccaguuuacaagugccaguguaaaaccacgaguuucugaucucuuauaaacuguaaauugugaugcugggugugguggcccagaccuuuaaucccagcacuggagaagcaaaggugggcauauuccugugauuucaaggcuagccuugauugcacaguuaaguccuauucgaaaacaaacaaacuaauauggcuacaugccuauaauuccagcacuugggaggcagagggaagauuaugaguuauaggccagccugggcuauguaguaaggccauaucucaaaaacaagaaaaguaaaacuucguaaaccacuuauuuauaacuuaauuuguagugaguaauaaccaauugcuuuaucaacaggauuuuaauuuugggaaaauuaaauaaccuggugaaagaauggauucgagaaaucagugaaagcaagguaaggugguaacacagaagccaugcgcugucuucucaguuggcuuuaguugacuggauucagucuuuguggguuguuuguuuuugagauaggguuuugcuguauguuguccuggagcacacuaaauagaucaaacuaaccccagacucacagacguccccuagccuccgccuccugagugcugggacuaaaggagugugcagcacagccagccaggauugaaaugucuucuuccaaugugacauucuuauuuguaaguuuccaaauugcuuguuauuuugaaggaagccaaccgaccaaaccagugaauuuucaaaaacaacaacuccucucugguuacaguauuuuaacaguauuucaaaguugggcccaguaauugugaacuauugcucguucuucuaaggauuacuucagggaaggaguccccugauuaauguggguguggcauugauugucaguuccgccacuuggaaggcuggaggauuaagaauuugaggcuagccugggcuguauuguaagacccaaugccucuaaccaaaaaugaaaguaguuuaaaauguuuauuacauuuuuggaauguuccuguucuggauucaguaucuacuguacuugagaauagaaucuucacugucuuuacaaaaguuguggaaugauuugcuuauuuuuuauuuguucuuauuuaguuuuaaguuuauggguguuuugccuacagauauaucuguguguugcacuguguuucugaugcuugaaaaggucagaaugggggcaucagauccccuggaacugcaguuagauuuucucagcugcaauguggguuguggguacugggaacugaacuuggguuuuucuagaagagcaguuuuagauacucaaaucauuguucuguugugauagucucugaauucaaggcacuuuguacucauucacacagacaaagagcaugguaaagaaaguuuuuagccaggcggugguggcgcacgccuuuaaucccagcacuugggaggcagaggcagguggauuucugaguucaaggcuagccuggucuacaaagugaguuccaggacagccagggcuacauagagaaacccugucucaaaaaaacaacaaaagaaaaaaaaaguuuuuagaguuguauggugucuauuugacccauuugccauauuuaaaaaaguuguauaaauagcaauuuuucuguuguaaugggaaaugcgugcuuaauuuauaugcagcugaaaaacugauagagagccaagggaagaaagaaugacucacaggucaggagaugguaguaucaagggagaaguaaguugcuugguuuuaguaaauugauaauauuccuaaaauaucuuuauauguuuuaagcaucugggugaaaauugaacaacuggggcuggagagauggcucagugguuaaguuuacaugcugcucuucuagaggucuuaguucaauuuccagcaaccacaugguggcucacagccauguguaaugggcauccaaugcccucuucuggugugucugaagacagcgucagugugcucauauaaauaaauuaaauaaauaaguaaaucuuaaaaaaaaaaaauugaacaacuggaacauucuaaauggcagucuuuaugccccacauguaacuuauuaacagauuucuuuugauagaaaaauuggaaaguuuaaugggcugagcaagaaguguccaagcugagguguuuuuacuuuuuaguugguucuagucuuauguugggaacauggauuuauuucuuagaugcuuaaacacccuagucaaguaaacaaagccccaaugguuuauguccugacagaggguuuuaguauguauuuaguauuuauaagguauugagauaggccuugggccuucccaccuggauccagugaugacuuuaccuccaccugccugguucugggaguacaguuguugccaccacuccuggucagaacauugauugauugauugauugauugauugauuauuuagacuccaggccugucuugucuuuugagaaaggguuucauguagccaggcugccuuugggauugcaaggauguauaccacccugcugugggcuaucuauaacugaguagauaauagagagccuguaaggccaaucccagaaccauucauuuuggggcaacacugguucacggacacggacuugugaugagagagggcuguggcugugauuuaucucuaccucugcuguguucuuuuagggucuuuguaguauuguuuugugucaguuucauguuuuugccccuggcucuauuauaguuggaaauuagguaucaugguucguccaccauacuuuuccugggucaagguuacuuaggcuagcuguguuucuuaugccuccauaggugguggugguggugguguuuuuagaucugugaagaguauaauuauaauuuccauggauuacauugaaucuggcgaucacuuuaaguaguauaguuguguugacaguacuauauccaacccaugagccugggaagucauuuuuaguguugcauugaaccaguaucucauagacuaggcugcccucagauuuauaaugauccuuuaaucucaguuuaccaagugcugagauuacaguuuuaugccacugugcccgauuugaacuaauaacucuuuucuuuuuuuuuuuuuuaaaaaaauuauuuauuuauuuuuauauaugugaguacacuguagcugucuucagacacaccagaagagggcagcagaucuuguuacagaugguugugagccaccaugugguugcugggaauuaaacucaggaccucuggaacugcaagagcagucagucucuaguccugaacuaacaacucuuuuuuugguuuuuugagacaggguuucucaguauaacccuggcuguccuggaacucacuuuguagaccaggcuggccucgaacucagaaaucucccugccucugccacccgagugcugggauuaaaggugugugccaagcccgggggaacuaacaacucuuuacuuauuuaaauguuggugguuuuuuuauuuuguuuuuuuguuuucuguuuuguuuuguaaaugagacaucuucuguggaguccaggcuggccuuguacucucaugaucuucauucuugcugagcuuucugagagcuagcauuguaaguauugggucauugugccuggcaaauuagugauuuuugauacaguucuccucucuccuucagguuuaagaaaaauuauuuggcuucacagaaugaauacucauuucucucuuguuugguuuauguucguugaguaaugugguucuguagugaguggcaaguugaugaaaauggagccuuguaagguuuccauccauugaucucacugugcuagccugguagcccaggccugauauagaacccaagucagucuuccugugaauaguuuuggaucucauaauucuuuuuauuucaaacuuacuacauuuuuuacuuuguuuguugguguaugugaggaggaagucagaggacaguuugcuggagucacuuccuucuagcauauauggguucuggaaucuaguuacccagggugucagacuuaguuagcagugcuuuuuuuauacugagugaucuugacaaaccuauuuuuauguauguauguaaguuuguauuguuuuguuuuuuugagauggguuucucuguguaguccuggcuguccuggcacuuguaguuuuagauuggccucuaacucaaagagcuacuucucuucgucggaagugcuaggauuaaaggcaugcaccaccacugccuagcauguacuuauguuuugagauggggguucuuauaggcaggcuggccucaagguuagaauauaaaggugaggaugaccuuggacguggauccuccuuccgccacguccuugguugaggauuacaggugugugccacugucccagguuucuguacagcugaagacuggcuuaggacuugaugcacacucaagggcucugccaccugaacuauaucccugcugcugcugcuuuuuaaaaguacaucacuaacauuuuuauaauuccaguucuuagauaacaaaaaaaaaaaaaccagaaagacccucugcauaaauuaacaaauaacugagaacuuuguuguucugucauuugaauugguuucccugcuuuacuaacaaccauuguuuguuaacagaaucucccacaaucuguaauugaaaauguuggagggaagauuuuuacauuuggaucuuacagacuaggaguccacacgaaagguagguaauacuuugcuuauuuugagcuaguagaauuugcauuucuuuaagauuuugaguuauuaaugacucauaaacgagcuuugguuauuguggacgugaauccuuaagaagcugucuguagcugccaucuguaaugcaguauaguaaguaauacgcucaguuaaccaguggaguaagguguguuuucuguaucuaagcacucugcugguuucuugcauuggaaagugugggcacagagcaaauuccacuguggucuauggacaauucuccauagauuccuucuuucuuucugaagaguaucacuggaugugagaaguaucagagcucuaagaaaguaucgucauuuucuuguccucauuuuuuuuauuguagauagcuuauaaaauacaucuuagcaaauacagaaucaguaugccuguagcuacugaucacauugaauauuuacuuuaaauuuuuuucuucuuuaaaaaaaaauaagaauuuuuuuugucuagauaaagauuuucuuaugccuuuauguauguguaccucauguaugacagguacccauagaaaccagaagagggcauugaauuugcuggauuugaaauuuagaggacuggucugcuagggacuaacccugagugcucuguaagagagccagugagccacuucaccagcuuccaguaaugaugcucuuguucuucauuaucuuuuaaauuucuuaaagcauuuaacuuuuguuuguuuguuuguuuuuuguuuuuuguuuuucugaaacaggguuucucuguguagacuaggcuguccuugaacucagauucaccugccucugcuucagagaugugugugccaccaccaucaccaccaggcuugauuucucuuucacaaacaugagucagagccuuaaagagacaggcagagccaguguguacagcucagguacaggaggucagacuuguaagcaaugaguggccaaggauacauugugaggugugucuucagauagggcuguguacugugccuuggcccacugcugucucugucucauuguuuauauaguaugcuuacucgugauaugugcugugugccucgugcccagucuuguacauugaccugauuccauugacaucucuagugaaguuuuuaguuuuaauacuuugagcagagaagcaccgaacaccauugaaaaagacauaaaggaaaacuguguguguauagugaugaaacaggacgauggaaaguccuggcucaccccuguuuugacuugucauagaguccauuuuaaauacaguaugucugaagaaaaucaugcccauuaguuagcaguaucuuucccuacugguugguuuuuuuuuuuuuuuuuuuuucagggggacaaaguucuagaaagcaugccaauauucugucaaaacaaaucuuauacuguuacugauaagacaggagacaguuuccuuguacugcuguguugugaugauugguuuccuuuuuuuaaggugcugauauugaugcguuguguguugcaccaagacauguugaucgaagugacuuuuucaccucauucuaugauaaauugaaauuacaagaagaagugaaagauuuaagaguauguacauauuggggcaagagaggaagaguuaaaugccauuuagucuuuugagaaauguauuuacugguggaggaaucauuuaauugagccggcaauuuuugccaggcaauuuuaaacacucagcaugcauuugucuuuguauuuuacauaaaacuagaaugauaaaccuguaaacuccuuacagauugggaacagaagcaaacacagugugaacagccacauuuccuuugguagaaauggaggauuuugaaccuccaggcuugggguguuaaagcucacagcuaagaacuuguuuuuguugggaauuaugcuaaauuauggugaaagaauuucagugccguuuuuaaaaguagcaauaguagccacauagcuuaccuguaauucugguacuuggaaaguagaggcaggaggagcgcagguucaggguauuuucagcugugugguugguuugaggccaaccuggucuaauugagacccuggcucaaacuaaguagaagguaguggaagcauuuaacaugggcuuaugguggagcuucaggaacuaaacuuguucacuuccucacaggcuguugaagaggcauuuguaccaguuaucaaacucuguuuugauggaauagagguaaggcccaguccuagugggcagcuuuuugguaugggcuguucuggaucuugguucauuuagauacaauuuugauugccaguaagaauuugugaguugguuaauaccaacaauuuuuuuuccggaaauggguguccauucuuuguagagcguguguauuagguagacucuuuucuaacucuuuaagcggaagugggagcaaaggacuuaggacugaggcuacugcaaaauaguucugugguauuuucuucccaggugaacuuugugucuaguucaggcaauaaguaugcagucuguuuauccaaguagccuuuuuacuuagguuaauuuguauaaauacuuugaagagauaggggcugugugagcagugacauagcguuaaguuguuucauagaguuagugccccgccccgccuagacucuuuggagcacagagucgucgccgcagaacugauucucacuucccuucuguaaucacaaugguguugugaugaccuuguugugaugauaaagcuggagauacugaaagaaugaucgcuagcuguuauuuuuuuaaaauauaguugcaggggcaguuuuuagaauuacuauauaagauaccuaacuuaugaaagguugaaauguugggguuuuuuguuguuguuuuuggguauuuuuugggguuuuugagacaggguuucucuguguagcccuggcuguccuggaacucacucuguagaccagccuggccucaaacucagaaauccgccugccucugccucccgagugcugggauuaaaggcgugcgccaccacgcccggcagaaauguugguuuuaauaaguggccaaaauuguuaaauuugguuaaggauuauauuugcauaguuuugaguuauagacaguguuuaaacauaaagauaucuguaauuaaaauauacggugacuauuuaccuauuguuuuguguuuaaugugaaaauaaaugugugaguuccauucugagcucauugugagugaauuugcucauauuuugcucucuuuaagugugcagccaacuuacagcuccuacagauguuaaaccagagcuuaauuucaguguaugcauucagugucuacuuaagcuaaguagacuuguuagcaguugaaacgauauguacuguuuguugggcucuauuuuauaucaccguucccaugcuuuagccucuguuuaaugugccuguguauacagcaugggcuucuugugagguucuuguagccauugcaaggucaaugagagggcuuuaagaauuuuuuuuaaauagaaaaugccauaaaaguaguuugacagauauggaauguuagauuuuauuuuuguuuuagauugauauuuuguuugcaagauuagcacugcagacuauuccagaagauuuggaccuacgagaugacagucugcuuaaaaaccuagauauaagaugcauaagaagccuuaaugguauguaaaaaagccugcuuccuuuugugaaguugaagggcuuuuggucaaauaguaaauaacaguucuuaaaacauaugcuuuguaaugacgguuuuuguagccaguguaaaugcguaauggauauacuaaaacacucuuuacccuggauagacuacagagccgugucuggcaguugauuugcucacugaugaccuuucacuuuccccgcuauuaaugguauauuacaucuuuaaaaagaccgacauuuauaauguugcuagugaucgaggcuuuacuguauguagcccuuauuaauuugcauuugauaguugcuuuauaaucuuaucagauaaguguaaaggguuuucucuuuuuaaaaauguuaauauagcucauuaccagugcuuugggauaacuauuagaagcguagauggacuaacuccacuccucaggaaagaguuguacguaaggcugaggcugggcaaacugccaggugugguagcugugguuagggauucggcuuggagcaggaaagagcugcuugacuucaugccuucugacuuuuaaugccuuuuaauucacauagucauuccaccaaauaaggcuuuaauuugaggguagucuuagaaaauugaugaugauacuauuguaacaccugaggcuuaauguuguuucucucacucccauuaaucagguugcaggguaaccgaugaaauuuuacaucuaguaccaaacauugacaacuucagguuaacucugagagccaucaaacugugggccaaacgugaguucagaauuuguuggcuagcuuauuaaaaacauugaagcucuucaucaacacuaacuuaaucuuuuugcuuuucccuuaucaacagggcacaacaucuauuccaauauauuagguuuccucggugguguuuccugggcuaugcuaguagcaagaacuugccagcuuuauccaaaugcaauagcaucaacucuuguacauaaauuuuucuugguauuuucuaaaugguauguuuuuagauuauauuacaauaaaauugauuguagacacugaaguuuagucuuauuucugugacauuucuacagcugguuucagauuucaauuuuaguuugugggcugaggggguagugcucagugguagacugcuugccuggcaugcacaaggccuugaguuuagucacuagucccuccaagaaccuaaccaguuuuaguugaagauacagcuaccguguugggaagagacauugugugugaaaaggaaaaccuaacuccuuaguuucuuuuccuuagcucugccaccuacccuccaaauacacucugaacuuagccacuguaauguuuucugccaucugcucuguuacuaggguggguagaacucacacacaccauuccuuucauucugaucacuucuauccagaggcuguuugugauuguguuuuaccuucagccaucauuaacuugguaaaaccuuaaaugugucacuucuauaacaguuuuuaaaaaaaaauauguuaagugacugaaaauaaauggaagucacuggaucuuugagacuuguuagcccaggagagaucuacuaauuaagauacaaauguuuuggauuuaagaaaaguccaagacacugccaauuugaaguaguuacuuugauaccaagaguugggguuuuagucaaguuaaagagauuuaucuuucauauugccagcacuuuccuuucuuaaugugaagaaagacuuguuccuuuguagucacuugguaacagacucuggauuuaauguguagcaacugcucuguccaguauaguugugcugcuuugccuuugucuuggugagugaggugugaucaggucagacacagaaccaugaacauuucuaguaggccagcuugauuuauacuaagcaagagaagcacuuuucauuuuugaucuuuauacccaacugaaguagcauuaauacauuuuauaacauggcuguauuauauaguacucacagaagcauuguccuuguuaaccuucgcaccgugccucuaguuacaagucacuuccauguacccguucaagggacuagugugaagacaggagucuuuucucaaccaggauuagcccaguucaagggugagguggaccuacuagaugucucgagguggugcuuacuguuugaauagugcuuuaucaguucccccgcagagcagaugucugacaugauaaagcuguccugauuugacuucauagagcaauacuguguaaacagaaagcaaugagaggcugugguguauaugccaagugagugaagcaggguugcauucacaaaugcuguauguuuaacagaaacguuuagaugcuaauguccaauagucuuaucaagugcuacaaucuuuuugaacagggaauggccaaauccagugcuauugaaacagccugaagaaugcaaucuuaauuugccugugugggacccaaggguuaguguauuauuuuuuccccuacaaauucacacuauucaauaacaaaagucaccugcauaaaggaggaggccgcccaguucuuacauaugaguggacacacccauauuucacuuguuauagaugaccugcucucuaauuguccuccggugugagaaguguaacgcuguacuguaagccacauuuacuuguacacaguuuauacagaucucacuaacaacuuauuccauauagcacuaucuuguaagucaaaguuguaugggcguuugugcuuuuaaaaaaaaaauaaaaggauacuaaaaaucccuguauauuuuuuuauuugcucuaaguauuuguucaguuggcuuguuuuagaaaguucuugcauaguguuuguaugcagcauauggcuccuaagcaggauugcaguguccgugcuauaauuggaaacucugguuuagguguuugagagaugcagaacugugucaaggaagaucacccacuuuguggaaaguuauagauagcauuuacugcuuagacuuuauaggugucaguaacgcuagcuuuaucacaauagcuuuauuauaauauaaaggaauuaauuggaaucaaaacuauccagguuuuugagaucauaauuuaaaauuuuuuuuauuuauuacaauaucaaagucuuguaauuuuuuuuuuuugacucugccccaagcugugugcuuucaaguuaccugagccucaaggcauuuaagggagaguguaaguaguugccuuuguggggaugaaccacacaguguacagauaguagucacuaaauaaaucguccuauugucucacggcccagagcuguucuuccucuguaauuuugcaggcacucauuuauccugccaaauacagaaaagcaguagauuugcaacacauuuuucuguuuugcuuugcucuugccagcagguccaugcagucagguugcaagguagucauaccuccaucuugggaacagacuguugacuagaucuuucauucuguaaaaaaugucuauaaagcagucucuugacaugcguuuuauuucucaacuccagcuaugaaugaaguaaaauguaaucauugguucaguuuaacaagggguaaaaguccaaguaucugucguauauguacuugaagaaacugauuggcuguuguuguauguagguaaaccccagugauagguaccaucuuaugccuauaauuacaccagcauacccacagcagaacuccacguacaauguguccguuucaacacggauggucaugguugaggaguuuaaacaagguaaguguuucugcuucugcucuacuucauacagaggggucugcccacuguugcugacccagcagucagcuuguugugugauugaauugaauugccagacuggguuugugcauuuauucuugauuauguauuggagaauaacucaacaguguuuaagcaguuuacucugacaguaugcuggagaaugaagcagcacuuaaaaacuuggacguugguucaaggcugugucagagccuucuaacaucagagcugaugccauuucgucuuccuggguuacaaaagggauauacagacuuuuuauacuccuuggaaaagaacuuggagugugguuggggccaaagcucugccuuugagaagauccuugacuuugggucccaauuaauuguaaauuuaaaggcugugcaccaucuucagcucuaauuugauuacucuuguguuccauccacacaaggaagguuuuuaaugggaaacacuucuuggccauuuagagauagcaguaacuugauuuuaaaagucagaaaagaaacauuauauggggaacuuuaauucuucagguaacuacuauguuucacuuugagccuuccugugcgcaugacauuuuacuaauaauggcacuuuacaagaaaugugguucucaaaaaauuuucaguguuugugaaauauguguaagaauguacucuaagguuuuaaaguaaaacuuccauuugcuaauguuuaggaauguagugaauguaugugguauguuuaagauucuagauugcuagguugaaacauacaaauauucuaauauguuuuuaauuuaggucuugcuaucacagaugaaauuuugcugaguaaggcagagugguccaaacuuuuugaagcuccaaacuucuuucagaaguacaaguauguauuuuaaggcaugucagccauguugcucuuaaguagugguuuaacaguggcauuugugguauuuccucuugccagauucgugaacaagucucucuccagugucuguagaauuuucuuuauuguuaaaaagggcuuagaguuuuuaguaaacugguguuucccuucaucaguacaggguguuagccucacacuuuaguugcuugacuuacuagcaguccuacuaugugucagccgccucaguucuucuaggucugucacugaugaccaggauacugucugcaccucagcaggcuugugagugcuucaaaaguuaggguucucucucaagacauuucuacauuuaauccugagagcuugcugggauaguuuagaccaugcacagaccuagugaaacgucggcguuuggcugaauacagguuuucaaucauuaguagcacauuucccccuucaaaaauaugucugcaaauaguuuucuaauaauuuaaguggguaucauuuuuauuaaugucuuuuaauuuaaugcuuuaauaccuuagaggugaaaaagccacaugauuugugcuguguuggaaauguaaguuacaauaaaucuuaaaaaaagaacaagaaccaaauauggacucgagccuuauuugcccuggccugaaaauuaagcaaagucccacuuaaauuuuugcuuuaaugcuugagacuuuccugaccauuuuuauguguuuuguuacaauaauuuaagcaaaacuauuuuauacuuuucccacauuaaaaguaagaaugaugaccuucaugcugucucuguguuuuguuucuguaucuugcauggaaugcagugaugagucaguuugccuguuguguucccgggcacuguguugucagaggcggagcagcgugcugcuguggugcucguggucacgccuagcucuagacugucacucucaucggcacaucauucuguuucuuuaaugcugaggagauaacugaugaccauuagcaaucauacuugccaacacuugaaaaauaccacacuugagacauagugaaaccaaaaagauuaaggccucagcagguagaucccagcuuuucucaguugccagucucaaacugucuuuuccugucucacauucguaauuacaagagcuggagaaagaugcaguucugcuuccuuagcuugggcuugagggaaggugaaugcuagcaugaccacagcaugcuuuacacuccagcgcugcuaggacugugagaggcacacccugcugggucuucacaccugagauugcuguagcaccgggaaggucuuggcuggcaagaggguuaguaauacuuucccugacaccugauaaccagugcagucauccuuuuuaaaaacuacgaagaggaggcuguagcaacagguuuguuucacaaaaauuuaaauucaaguacccuggagaauauaagaucuaacugcucugcacgcaugcccuucaaaacacagugaggacugcacuggguuugcaaagcaggugauuggagcagcuuaaacagcgagucuccaugugaaacaccaguuacauuguaaccugaagguggcauucuuaguuuguuguaaucaagaccuagaagaauugaggcugcugacacacugauuggcuuugugugaagcaugcccggaaaaguguuaccuuuucuuaggguuuuaaauuguguaaaauaccugcuauucuuggaagagagggggaccauaggagagauuucauuuaccuuaaauguguaaacucauccauuuucaaacaguggggugggaguuugccugaagaaaagaauggcauuguauuguuaauuuuuaaaguuuuaaaaaauaaucuuuguauuuuaauaaucguaguuuguuaaguaacaauaaaccacaggcauuaggaaaugugacugguggucaucuuaggcauuauguuucacuaggaccagggaggaguacacuaggaaagcaaguguaaaaauguguaaaaacuagccuuacaacugcucagacacagguaaucucaccacaugggagggaggcaaagguaggagaaccaagauuucaaggucagccugagcgauguagcaaggucaaaaucaguuuggaauauaugagcauccccuucccccaacaaaaccagcagcagcacaccuuuagugaacuguaauucuugcuuaugaauuuaaagagaauuauaaggauuuuaacuaagagauagguuuuucuuucagugcuugguaucugagcugucaucuacccagguaaaguacugagaugaaauggccaagaaaccuacuuacagaaugcuuuuuugguaaauaacuauaacaacuuaaguauuuuuaggacuuuuuauuaggaaaacacucuacuagaugagguaugcucuuagccuaagaacaguuuuacauaaauuuuaauuaauuuaauuuauaucuauaucuauaugagaucuuaggggaaagguaauaaccaugggauuagcccuagauuuuucuuggagacacuugagcugguuggugccuggcaggcgugacgaggcucacaguuuggggauuauuacaguguagucuagagaugcaucugcccuggaggaguccugagaucauuggagauuggauaccagcucugguguuuuuaacaugcagaguuugggacuagaaguacacucagcaguuaggaacacuggucguucuuccagaagaccugggauccauuuccagaacccacguggcugcuccauuccgacuguaacuccaguuuuaggggauccaucgcacuucuguggcuuuugugggcacuugugugcagaaauaugcagacaaaauacccacacauauaaaaguaaaauacauaaaaaugcagauuuuaaaagaaaacuaauuggagauuuuugguuucuuggagaaaucacugcuuucuacuguauuaaaauauuuacagcuuuuaaaaaaauaauuaauuuuauaucaaguuuauuaaaauauagcuacauauaaguuuaucccauaaaucuuaagagauauucauagguaaagugucuaaguauacagagaagacacuuuguuccccuccauugggauguucugaauagucaaguugaacaccaugccuuugaauugccaacaaaauucuguuaaaauggauuguauguuuuuguauuuauaaacaaaauauuguggugcaucacuuaaucaugcugaagaucuagguguucaauaagaguauuuucaggggagugagggggaaaacagcuuuauuguugaugggucuggggaugcuggccugcaaucccggcacaugggagauggaggcaggaggaucaagugccugugcagcuugaguaauaaguccacuuaacuguacugagguagaauuggaaaagcugugcugugcugugcugugcaaacuuaggcagcuugacacuugggaggcugcgugcgugagugcgugcgugcgugcgugcgugcgugcgugcgugcgugcgugcgugcgugcuccgauagcugcuacaccuugagagcgcuugcgucuccucucucuuuccauaaugaggucaccucuuuuaaugccucagugacccagaaaugugauuaagcaugucaggaguuugcuugauuugugugacuccuccucuguguacaaaaugcaugaacuuugagugcuuuuaugugacucuugaguguuuguauuuggcuuguuugaacuaaugcugaccaaaugggaaaggaagaacucauuucuguggcuguagacaacauggcuccaaagcugggcauauauccuauuucuguagucccaccucaauuuugugucuugagcuuuuaggguuuuuuuguuuuuuuuuuuuuucucuacuuuaauuuaguuaauuuuugacaguaccuuuccacaaagauaaacgccauucucuuauccagguggcgugcacuuucuauagcuguguguagaguugcaaagaugaguagaguuuguagaugggcuuacucugguaguugugucugguucucaaagcuuguuuguuuuugacuagcaacauuacuuggaaggugugaaagaacagaagguucucagacuuuucagacuagguuauucuggcaccuuccugucuaguauccacuagauaaucaugucaguuugcuuuugagguaaagcugcuuauguaaaacucagcuugcaguauuuggaaaagguacauacagagugauuuguuuuguuauuuaagaaaaaauugucuaguaauuuaguuguaauugcuuucaaaaguccuaagaauaguuacuugcccauggugauauuuuuugaaguauaaacuuggaauuuuaaaugugguuuaaguugugaguagaaaucacuuauuuaacucucaggacagucuuaacugcagggaguccauugcaaugguuuauaccauuucuuugggugagguggcugauaaauaccauaugauauuacuggagaccugauguucuuuguuuguuuguuuguuuuuugagacaggguuucucuguauagcccuggcuguccuggaacucacuuuguagaccaggcuggccuugaacucagaaauccgccugccucugccucccgaguguugggauuagaggcgugcgccaccaccgcccagcagaccugauguucuugauguuauuuuugaagucaacuuuuguaguguguauauuaaugaucauuuuugugucaagagcccuguuuuuugguucccaugaaaacauuuuucuuuugauaaauuauuuuccaugagugucuuuuuuaauuuucuugguagaacacuccguuggaguguugagcaauuuaccauguaaugauuuuucaaccuugaaaauucaucuacucuuuugguaauuauucauaguuuguuuaagaaaauccaacuggccaauagugaaaccauggaguuuagcuuacaugauuuuaugugcacacuugauugggaacuccuuguugaaucaguguuggucuauaagugugaggaaccuuauuacauuaugguuauaagauccagcacaaagcacauaaauaaaguaaauagcauguugucuuuaucuucaaaggcauuauauuguacuucuagcaagugcgcccacggaaaagcagcgucuggaauggugaguagucaggaggguucccugaaaugacucaaauagacagcgcagcacaccggugugcgaggcugcuggcuuacugcgcuacagagaccagggcccgcuuccugacgguguuuauuguugcuuagcuuagcuugccucaaguauuucucagaaccgcucuguuuggauaaaguucauuguuuuuucauccaguucaucauucuuuuugguggauccuaacuaagucucacaguuuuaugucuggggggauggccuugguguauauaguuuacauagagacaauauuuauauuacccccuuuacaugaaaacuugguuugcauaugaauuuucauagagucucauaaauauuaaugacauuugucuagggugggcuugguggaaucaaaaauccgcauccugguuggaagcuuggagaagaaugaguuuauuacacuggcucaugugaauccccagucauuuccagcccccaaagaaaguccugacagguaagcauguuucccauugaguccccaccuacccucucaccucccguguagacauguucagggccacuucgacguuacuuuugagacagguuguagcccagacuggccuggaacuucugggcuuacagccauaugcaaccauuuccuucuggagaagacuauaucuggcuuugcuuuuugcugaugauguaucugccacuuacuguuuauuuucugauauaacuuucaucaggaaguguagugugccuuaguuucucaguauucucugguuuaccaaauuuggguagaucuuaaguuuuuuccuauuagcauuuauaucaguguuuucccucaucagaaacauugaaucauuucuugagaagaauuagcacugaaguagauuuagugauaguccuugauaaugaagucucuguuaucugauuagauguugauguucuguguaucuguccuaaucugacuuggaguauuucuaacaucccuucaguuguauacaauaguuguaggcuguuccaugcagagaccgcugaauggggaguaggcuccccugguuguugagggucugagaaguuagcuaacgcuuuucuuguugcucugacauugggaauuuagaacaauaugagcuauaaacuuugaagcaaggaugaggaaguagaggcugaggcucacuugaguugcucuugaguuugaguauucuagugaaagagaucgcauauuuuuccuuugaucauuuaaaagaauuaguuggauuucauuugugagauagggucuuguauauagcccauccuggccucaaacugguaauccuccugccucagccuccaaagugcuggguugcaggcacuuuuuaaccacagagagcuauuuagaaguacagaauugguauuuuugagacagggucauacuauugaacucuggcuauccggaaauucccucuuuggaccaggcugaccuacagcucacugaggucaccugccucugccuccugagugucgggagugaaaguacagccuuuauauauagaaauuaacauauguaacacuuccaaaaagcaguaugcucuuuacagccuuuauauauauaaaaaaaaauauguguguguguguguguguguguguguggugugugacacuuuuccacaagcauuauacuccccccaccccaccauccauuuaccauuuggaacacaguuaacaaauauuagugccaugaauacuuuggacaaucaauacaaacacagaaaauguaaggcuguuguuuaggaaguaaguuuguaucgucguggccuaggugacaggaaugggagggcagucauauucugauggcaggaacuuguuuacuuacacauuugaauuacuuuccccacauaccucgccuaggcugucaacucaucaacagccuugcucuccugaauccuaauggccugugguaauguucuuuacagggaagaauuucgcacaaugugggugauuggguuaguguuuaaaaaaacugaaaacucugaaaaucucagugucgaccucaccuaugauauccagucuuucacagacacagguaugucuuuauuugaauaaugagcucguugauguuccuugauguacaguuaguagugcuuuucauauuaauugaguaccgaacaguaaucauuagaguaagcuucgugcauuuaguaauguuuaauauaaauaacuucuauguugaucuaggucuuaaaguuaggugggaccuucuauaauaugauuugucuguaauuugagacaaacagccuauuucagucaucuugaagcuuagagacugaaguggacauuuugguaacuuagagacauuuaacugauggugaagauggggccaggggaguauugucagcucaugcaguccgggacaguuagaccugugcguuggaugaacuugaauucuuagguaaaggugagagguuuuaguugaaagcuuuaaagucauagaaugaguugucaaaaucuuugugauuuguguguagauguacacagcaauucaaggaauuugugagccuuacagggaugccugugugcuguccuaaagcacuaguucuauuuaaaacauccuccagaucacacuuuaaaacaggcuaauuaauuagcauuuuuacuuuucucacugaguuuuccucuaugaaaauugauuuaauuaacauuuuauaaagauuuaaucuacuuaacugaaaagagggguaauggagacaauuuauuuaaaagucacuuugacaccaguaaauugcagugaggagagagguaauacucucuuuucugcuguuuugcuuucuggaguuugguuccaccaaacccauugcucuccugcucugacccgcuugggaagugaugaaccuuuuuuccagcaaugccacaguguacacgcugucagucacugaguagucugcaugugugaaauagugugugaaaggccacuggcugggagggugugaaagcugaugaaggaaggcacaggcagacagaacugauugguacucacugaaagaaagcagcagacacauucccagacaggggacugugguacugagaagccaaaguccuuuugauacuguuaagggggaaguuacuugguucugucaugggacuccugucaaggcccaucugagagacagacagaccucuucuuacuuaguagaauuuacaauguaaguaaaacacuggcuagauucagauugguuguuuguaugagguacccuggucguuaagguuugugagacaccauacgucuaaugucaaauggucaugcuuacgugacuguccacuucaugcagaaggaaaggccaaguucugcuuguaauuugugguacaucaucuuccuuccuuauaauauuacuguucauugucuguauauuuugggacuagaaagguaauaaaguuagaggguguuuccagcacagcuuguuaauuauauagcaguuugcaagcaagacuuguuacuuagacacaauggauacaagccaaacauccauugcuacuuaggauuaggguuuucuuuuaaaaauauuuuaugaggauuuauucuauguguauggguauuuuguauacauguauauauaugcacuguguguauuccuggugccuacaaagaucagaagagggugucuaagccccugaaaguggaguccuggaugguuauggguugaugcugaguagguacugagaacuggcaagccaucucucuagcaccagaguguuuucuagccgagucuuaacagcaaucuuaggaaagcucuuuguuaggaauuuagaggucuaugggucuaaccuugaccauggccucuucucucuuggcuucugugguuccuggucagggugugugguuuuugggguuuuuuuuucuuccugaaauacuguuggacucaguuacugucagcuuacuuugcacuaaagucauuugggguuuggcguaggguuuuguuuuguagcuuagauuguucuaggacuggcucuguggcuuaaguucuguuugauggcagcucaguguccugucuuaguccuuggucacuugacagucuaucuuauucuguccucuccacuggauucugcagcuugcuugugcuuuuuccugcuguguuuccagcugcuacaaugguuuuauaguugugcaaccaauauuuuuguauggauugacugaaucccccccccucgcacaccuuuuguuuuuuuaaauguagcccagccugcccuuggacuuacuaugaagguuaagauuacauucaacuuauucucugcuuucaugacuaauuguugggguuuuacagguguuguaccauauaaccucacuuaaauauucccauuuugagguacugugaucuaaauauuuuguacuuacugauagcaucuucuuuuugagccauaauuuauuuuuucauaauagaaaauauagaaagaauuaagagaguuuuucauggaaaauacuuuucuaugguuuugguuuuuguggguuuuuuuguuuguuuuuuguuuuauguauuauguagcucucgcuguccuagaacucacuauguaaauauggcuggcccugaacucacaaggaucugucugccucugccuccauaguuuggggauuaaagguaugugccacacaccaugucuucauauauauaaagugugugugaaagugugucuguggggguacagguguucauggaaaggugcuauauccccgggaguuggaguuccaggcaauugugagcuggguuguguuauucagacucaggucuucugcacaaacagcacuuucucuuaacagccaagagccuccagucguucuuggcuugugaggugucuucagguguggcuccuuacugugugagcagcagguggugucuuccaggauuaaagucuuagacuuuguggaugauggaaagacagauguacagaguucuuugaauucuguuauuuccucaacaguuauucuugcuuuuuauuagcacauggaaaguuagugugcuaaaggaucgaaugugcauuugcucuuuguuacauacgugacuugccuacuauuggauugcauccgacuagggacaggcggugggaaagguucccacuuacauuacuuuucuucuagacgaauuuagaucugcccuuauguaacuauuucuguucuuuguaacaaugucugcuuguauaguuuauaggcaagcaauaaacagcaaaauguuugaguuggauaugaagauugcagcaaugcaugugaagagaaagcaacuccaucagcugcugccuagucacgugcuucagaagaggaagaagguaagccaaaaaggaacuugauggugccaccaauacagugcuuuguauaagugccagcugauguuucagaacucccgucccuuuagggaugggugcuauuaacugaggacagcaucugacagacuugucagcuugugagagaccguguucucauugucagcuugugagaccuuguucucagcacuguguuuguguccuugucucaugacuggaaagagguuaaugugacacucaacgcccugaguuuguauagccauauucucucagaaagaaaaacaccuuuaaacuuucacacaagugucuauucuucuaaaagaacaaaguugucauuacauguucaaacaauacuuuaaagagggacagugucuucuuauuuacuguaggagaauagguauauuucuaaaaauuaagagugggcucuugagaugauucagcaggugguccgcuggugaccugaguccaaucccucagaccugcaggauagaagugaccccugcaauuauucucugaccuccacagccuuguuggguguguauguguguccugucaccccccuucuuucugauuguacaagggacuggagagguagccuaguugguagaguauuuggcuagcaugcaccugggguuaacccuuagcacuucauaaaauaggcaugaugauacaugccugugaucccaggacuuggaaaggugauggcagagggguuagaagucagggucauccucugauacauacaggaucuaugauagcgcccccccccccauauacacacacaaaagaaaauuuguuacuaugcccugcauuguagcaaaccccuguauucucaccaguuggugggagauuggaggaauugcaaggugagggugguuuaaacuguauauaccagauucuaggccagccugggcuacaugguauacuuuguacaguaauugcaaaguaguuacaaaggacauugcucucacugguuaccagagguaaaguagugucuuguucugauguuuauaucuugaauaacagaauauuuuaaccuucuuauauugaaugcauuggugcauagaaacagugacuuggacuugugcccggcagauaguaaauaaauaaucaaguuaucugaaauuaaugccaagaucaguuacagcuuagggguggguagguacagagauaucuggacaugauaguuucaggugacaaucuugucagcuaagucugauuguaacucacgcuggcuccugauugcuggaguuaauuagcuacauguguucauuccugauaaggaaguugcucgaguagacgccauaucgccuuuguuggcuuucagcacuccugaggcccaaacuuagcucccugcuaagccuguguaaccauugcagccacaggaccgucugauaggaauguguuaaaauuauagcaguagcugucgguaguugcgcaugccuuuaaucccagcacuugggaagcagaggcagguggguuucugaguucgaggccagccuggucuauaaagugaguuccaggacagucagggcuacacagagaaaccuugucucaaaacaaaacaaaacaaaacaaacccuagagcauugcaguguuaaguuuuccauaguuaaaacucagaaucacgggugucaaaaguggaugccaauaggcugcgcucuuuuuguucuggcaguaugcguuuuaagaacucaugauaacagcuauuaccgguuucuagaaccaugaauuuuuaucagcuuuuaaagucuuacuauuaaauaaccaugugacuaauuguuauacagcucuaguuggguuuuccuguucauuuuuuuuauacuuucagucuauguuucccuaaaaauaaacuguaggaaucuacuguccacaguuugaucauccaacagaguaacugaucacaucuguaucuguguacacagacuauugauuggguagacugucacucaguucagauguucucagugagacaccaguuuuugacuuugcuuugugcuuacaguaguuugauccuaucuacuucuguuugaaauaauuuuuauugcuguucauuuuauuuucuacugugaaaauaggacucugaagcugggguaaagccaacagcuugcagcuccuucgcuguuuguaucuguaucuguacccccuccacagugggaacugaagcgaggccagucugcacugcucacguccaugucgccugugcccccucuaaaagagcagaguggccaguauagaucucuugcuuucaaagaucuuugcgcauaaaauaguaaugguuagaaauaaaugauuuuuuguuuguuuguggccuagguauguauuccaagcuggccuaaagaucaauacacaacccugguugggccucaaauucagaauccuccugucucagccugcugaaugucagaauuaaaugugggugccaccaugugugguaaugccuuuuacuuaacauaauuucuauguucguugugggauaacuaaagauuuguacauuacauuggguauggcauaugccuguaauuccaacuacaugggaggaaauugggagguugaggcaggaggauugccugagccaaggaauuaaggcagaugugggcaacaugugaccuugucuuuuuugaggcaggguuccucuguagcucuggcugaccuggcacuucuucuguaaaccaggcuauccaugaacucagagauccuccugccucugccucugccucugccucugccucugccucugccucugccucugccucugccucugccucugccucugccucugccucugccucugccucugccucugccucugccucugccucugccucugccucugccucugccugagggaugggauuaaaagugugcucuauuaugccuagccuugugacaaaauaaaaauauuguuucuguaauaaaaauaggaaaaacaacacacuguugugguucugacaaagguggcugucauucuccugcuuacugagacuuugcaccaaugcaccaggguuuauaguuuucugauagaaguuucauguaugcucauauuucaauuugaaauuuuaccguguaaaucagcacaaguaguguucacuucucauuacuuuucauaucagauacauaguuaagucuagagguacaaagucuuggcuuuuuguaguuauggcaugaagggauuuuuuuuaacuccuuuaugagugcuuuucaauagaaaucauaaauuuuauaaauuugaguaccuaaagacuuauaaauuaaacuuuucuugguugcagcauucaacagaaggagucaaguuaacagcucugaaugacagcagccuugacuugucuauggacagugauaacagcaugucugugccuucacccaccagugcuaugaagaccaguccauugaauaguucuggcagcucccagggguaaggaaagggagggaggcaggggagaggaaccauuuguuuguuaaacacaguagaggcuucucugcuuacauacagucuuauuuuauucuaacuuaucuuuuucuaaauuuauuuuuguuaguauuaguuaugcaagcugauaaauuucauuggagcuuaugaaguaucuggucauagucacccugucuugucuccaccccuuguccaucucuuaacucuugacuuuuuuuaguaccaguuuuaauucuuaguuuauggacagaaauuuuuaguuuugccccugcugucaaugauguuucauuuuggggaccagaauaccuccauuuaugagugauguugguguuuccaucuguccaggcuuacuuagagacagacaggaggacugagcacccugaugugcuaauccccaugacugugggaacuguuacugugguagagagggcacaugcuugcugcacuaggugguuuuagauaaagggaacauuuuuucccccucagaagaauuuacuguuuuaaaacaugcaaagcauuuuaagaauugcuaaaaaggaucuauaacccauaaaauuagaacaugauagguugcguuugcauucagaguuuauagcuugguacugucuggcacuuucuguuagguuuuaccacaacaccuuaauuucagggggucuuauuggcaguuaugauggcuauacugauugccauuaguaaguugacauggaaacacugaccuguauauucugugcauucucacuggcgggucaaauauucaucuuacuggucauauuuaaaguacagaacagcuacaucaguuuugucagcuaugguuuuuauaugauguucacaucauaggauguuuguguuuguguugcucuauguauuuuauaugcuuuuuauugucuguuuuucgagacagaguuacucuguguagcccuggcuauccucgaacucuguagaccaagcuggccucgaacucagaaauccgccuaccucugccucccaagugcuggauaaaggugugugccaccacugcccggcuuauaugcuuuuuaauuguuauggaagcaugggaaguuagacccgaagaaacuguagcacauguuacuaacauuuaauuguuacuuugauuaucuuuaacauauaauccacccugccccuucuuuucuauccuucucuuucuguuuccuguuuuagcagaaacaguccugcuccagcugugaccgcagcaucugugaccagcauccaggcuucugagguuucuguaccgcaagcaaauuccagugaaagcccaggggguaagaaguuggccuggccacuauugugagcccuugcaugauaacugguuuuauaccuuauuuuagaaaaggggguuuguugauuaaguuguuguggauucagguuuuuguuuuguuuuguuuuguuuucaggaccacuguauagcccuggcaguccuggaacucacucuauagaacaggcuggccuugaacucagaaauccaccugccucugccucccaagugcugggauaaaaggcuaagaggccugugccaccacugcuugguggauucaguuuuuagugcuuuuuaaaaauauuuuaaugaauuguauuuguuuguguguguagugcucucagaguuuggaggagggcaucagaggcccuggaguuagaguucacagaugguugcuaaccgaauguaggagcuaggagcaguucuuaaucucagagccaucucucuccagccccuuuuguuuuguuuuuaagguagaguuuuaggcucaaaccuccugauccucuugcugccccacccacccuuguguucugggguuacaggugugcacuuggugcuugucauuuaauagcaguuuagugcuugcauauaaaguuauucaugaaguaaguuaggaaggaaggaaguuauaacuugauguuuguaaugaucuuaauuuguguguucuuaucuuucuguuuagguccaucgagcgaaagcauuccucaaacugccacacagccagccauuucuccaccaccaaagccuacagucuccagaguugucuccucaacacgacugguaaacccaucgccuagaccuucaggaaacacagcaacaaaagucccuaauccuauaguaggagucaagagaacguccucacccaauaaagaagaaaguccuaagaaaaccaaaacagaagagguaaaugugcauacuuacauacaugaaacgauacaggcauggcggccuggcgucgccugcuccugaaucuaguaggggauacucaggaagaccuggggcaucugcagugcuucacugcagaugugcuucacugcaaaugugcuucacugcagaugugcuucacugcagaugugcuucacugcagaugugcguguuucugccucuccugcucugggcagcuucugcauccaguaguagucuggaaaacacaguucauauccuuacuauucuuuuuuucuuuuuaaagauuuauuuuauguaugagugcucuaucugcauguauaccugugugccagaagagggcauuagaucccauuacagaugguugugagccaccaugugguugcugggaauugagcucaggaccucuguaagagcagccaguucucuuaaucgcugagccaucucuccagccccaucccccaacuuacucuucuuuagugacuuucauuuguacugauuuuuuuauggcucuuuggagaauguuuugccuuuaacuccauuuuauacuguaauugguaucagagggugacuuagcacucacuugcugacugcuaggaauuccugggagggaacuuagaguuuccgccaccucuaagcuauagcccuaguccucaggcuuuacucuugcgaugcacaaauugcaaaggcagauuaguuuaggaccucuuaaguuucaggaaucuugcuguguguuuaacgguggcugucaaaucaacauugagauacaagcaguguuagcaaugugcugagccuuguguuucagggugugaguggucccugggugugccacacaugcacuccugcugcuacacugcccucugcccuuuuaaugucagccuccaugccccagggucuagcuguggaguuaucucauguuugcuuaaguagaggugccaaucccugaccaccuauuuugcgaugaauucugcucuagaauuuguuauuuaagaacuuucuauauaucagaaaaaagaacacaaguuucucuuggguauucauuacacuuugaucaguauuggugaaaucucucuaaucagacagucuuguuuagauugauuuuauagauaaucuacaacuaauggaguaacauuuuguuauucaugaugcuaaacuacaaugaaaauagaacauauuucacccauccagauagguucugaaaauugagaauugaguuuugcaguguaguccuuuuuuuuuuugguucuuauuuugugagaggugcuagggauguaaugcagacagagccuuguguauuuauuaugcuuuaaaucuagguuccucuuccugcuucugcuuccuuaguucuagaauuacaguugugagccacugugucugacagaauguagacuucuuuuuaccuucauaucuguaagacuuaaggcuagacuuugauuucucuaucugaucuccuuaugauaaggugcucucugagugauuagugaugaguguccuggcacauggcaugucacuggagauagugauacuuauauucgugggucuagaacaguccuuggacuauaaaagacuuauggucuguggaaggcacaagauaaccgugucaacaaaaacagcccauugaugccuuaauguuuacacuguauagcuacaguucuaaugagcucagccacucucuuugccccuuccauucaaccuuuuuguuuguuaagcuaagguaaggucuuuaaguuuggccuagaccugaacugacuauaugaacucaugaugugguccagaccagcuucaagcuuguggucucucugucuacuacucacuuaccucccugagccccgugaguacuaggguuaugggcacgguccuccaguccucguuucuucuacuuaugucacuaagugcuuuuagaacaagauccacuugguguuauuguuauucccugguauuucacuggauuuuuaagaucacaucuaugaaagaauaugaauaagcuuagauuagccuacuugauaauagggccccuguucucacuuuucaaauacccucuuguuuaaacaugggaucaaacaaauauaagaugccagguuaaaguaacuuggugucuuuuaaauauccuuuaaaguacaggcuuccuucuuuuuucuuuucuagaaugucacugacuccuuaaagccagcuaguccaaucauaggacuuucuaaaguauaggggaggguguugcugaugugugggcugauugcacacgugcucaaugucucuugcagucacaaaacuaaacuuagucaaagguacuaaaccuggccucucgugauauugacuuggauacguguguucugguacaacccccuuaaguggaucauuuguucuguugauauauugaacaugacuacacauguuguauuuccagaacucagggcaaggaacuaggagaccagcgugagccuaauagugaggagcaaacagaaacuccaaucacgugcauacaggaagguuuuagaugcugggagugguucaguucagcuuaguguacauuguaucuuagagaaaacaguuuguuguauaauauuauauggcuaaauuaaauacauauguacuuuaaaaguuuucuuuucaauuucucuguauguuauacuaauugaacuugaguucauuuugcuuaggugaaguacuaagcccuuaaaacuuuuguauauggaaaauuaaauauguggagaaguaacaggugcacugucagguggcugugaccuggucucagcagagaccugaacagcguguucccuuuacaugucugcucucccguuucuucagauauacaugaguauuugaaugugugucuacaaauaaggacauacaucagccuauauauaucacagugggaccaguaauccuaaagugugaccuuuaguauuuguuuagugacaacaaauguuugcuuuuaauuuguuucugagaaacaaggccauuauuaaaauuagucuuuaguaaauuguuuacuuuuaauuuuaaaguuaccuguaguuucuuugcuuuuuaaauauguauuuaaaauauuagagacuaaguagauacuguugucugugaagugcuugcauaaggacuaguaacauguaaaaagccagacaugguggcacaugcuugggcuucuaguacaggagguagacuuuccuaagggagagaaaaaaaaccaagguagauagcucacguggaacggccucugacguuaaccucuggcuuccaugugcacacauauacacuucccaccugcacaaacccacaaauaaaugaauuuuaaguucucuaaguuaauaaacccaagagaauagugcuagcgugguuuuuaggacccaagaagaccauaggcccugaguucguguaggaugcuaaugcuuugccaagaaaagcuguguguguccgugugcgugaguguaucugggguagcugugcuugagaaaguaaaaauaauacucuguauaaaauguccuaguccuuucugugcuaacaggcacgucugcuuccuuccuggagagccugcuguuccacguucuuagggaacucuccucuccucagaaaaacugcuucaggagcuuuuugguuuggggaauguacuuuaugugauggggauuacaaaacaauuuuuaucauguuuaaaauucuuuagugcuuauuaaagcuaaguuaaauuauuuaaucucaaaaagccccuuuagaagagacucugaacuauuuuacuuccucuuuauaguuuugaaaacuuuauaaauuaaagcguuaauuggcagauaaucuaaauuucauuuuggagaauaaagcuuuuuuuuuuaaaaacaggaugaaacaagugaagaugcuaacugucuugcuuugaguggacaugauaaaacagagacaaagguauacuaacuuagccuuuagaaugugcacggguagacgugcagguguguggagauagaugccuguccuuguggugcugagucaacuggagugugugggguucucucucacuguuuuuaagaagccucuugguuuuuuuaauguuaauuaaugccuaagucugaugggaguagagcaguguaaaacaggaacuuagaguucagagaaaagguaagaugguggugugcgugugggacuuaugugucaguaguaaggguugggagacauggggugagaaggggagggugcugcucugagcagagguaagauaaccuuugaagcagugauugccuaggcuggccgugaaacucuaaccucacuguugggucuagcaguagggcuggguuagaaaaacuguuugagaaggcuuuggcuugagcggguugggcagugaggaggacucugguucccuccaaccuaaggacugagaaugacuucaucuuagaaagugagaugaguaugccaaaggcuuaacuuucccaacuuagccaaauucccaccaagaauacuguaguaagucuccuuaugaugucuuucaagcugugcauguauacauauacaccagugccuuuacuuuugauuuauaacgcacuuugcagaccgagaaaaauagguuuauguuauauaaucugcauauugacuguauuggaauuuuuuuuaaucacaccuuacuaguuacuuauugucagcaacuguuuccauuaaaaacaauuugcaccuucccacugcagcauuggaguauuguaaauaucugccauucagcucugcuuauuuaauacauuuuuaagaacuugauacauauuccaaacagucccugugaaagacuccacuucucccauucuuguuaacccugugcaguuuguagggaaagcagugaugguuccuguguucacaguuuagaaauaugcuuuuaccuguaucuuccucugcuuguguguuuucuguaugcgagugaagcugcuguggggugacacaguugucgcucuguugucugcucacuaauuggggcauugauuauuggacagaggagggcaguagauagagaccauaagaaaaggacaauuuacagcuguuugcuacuuuaauuacuuuaauguggggcaguuuuugugccucugaauaguuuuuauuuacuaauguuaugcauuucccccacauaguuaaggacauucuuugguuuuauguuuugugaauuauuaucuagguaacauuuucuaaagugccugugcauaccuuuaauuaguacuuguuaaaacauccaaguuagagcaauuugggaacugugagauacuuuggucaugcccuacaauuuguaucugaaauggagcaauagauuauaacagggcuggaugacuugugauauaauguagguacaucuuucucuacccuccuguugcuaguuugucuucuuuauuagccaccacacccauuuaugcucuuugauuuuuuuuuuuuuuuucuuuuuuaaaaaagugucucuuccccucuccccauccuuuguuucccaggaacaaguugaucuggagacaagugcgguucaaucagaaacuguuccggcaucggcuucucuguuggccucucagguacuaaguguaaaacaagcauggagaguuugcucagugguuuugauauuagagugguauauugauuucaaaugaaggcucaugcuagacuauuaaauuuuuguuuguggaaguaguuaaagucuguaaguuuucuguaguuuaaaguuaaaggcaggcagacuauugauuuggagccauugcucugagcugguaggaagcucugucgagcucugacuugugacauacauuggccccucaaacugguggggcugagacuauccugagcucuggugaggcgccggcaaagggaauggaggcagcuguaggucuucccuuacaccgcagaucguucagauccucacuguugugugugaugacauaaauguuuauuuauaggucaaaggcugagagugaaacaaagaacaaacaguguuccggaccugugugcaaggcucagagagauuuucauuguauuuauucauucacuauggugcuuagcuuaagugcuccugaacugccuuuggcucccugauauuuuuaauuuuuaagauguguuucuuuuucaguuuaguuuuuaguauugauuuuauuuaguuauucuguagacagucaauaacuccuuagaguaauugacuagcguuaguguuggcugggacaguuccauaugcacacaagcagucuugucuugcuaauucacaaaccuucaccuucuuuauuuuucuucuugaauccuuuuaaacuuaaaccaaaguguaggucaaacguugacccaaaaaucagugucuccucauagcauguacuaacuagauuaccugaggcgcugagcuagcugccagccguguacucaccuguggcuuagagucucagugcuugugggaaacacacucugccauacucugccaacaccaguguucuacucaguuucucaaaguuguuugucuguaugcuuucccucagccucaguagccaagaggucaucgaaugaggagugugcuuguguuccuccaccacauguuucccacucugcugcacugauugauuacgugccugcagccauggcgccccagugggguuggcuuugaaaguguuuuuuugaguagaguuuuuuuauucaguugugaaaggauuuauaaaccagucagaccaccccaguuacgcuguuuuuagagaauguaucuuguguccugugauugagggagggccuuuauugcggaggguagugucuaaauacagcagggccacguauuugagguaaucacagauaauugggagcagcuucaguuucgcuucagaauaauccuugguugaaggccacaggaaggaguagauuggcuuugacuuaacuguugcugaagcuggcugagacuaaugugagacuaauaaaugcucucaacuucuaugccuguguggaaacgucucaugaaacauuuuaugauucaucucuguauuuuggaauauuaaagaugccuuguaauaaaauuugugauacaauuuuuuuuaauucccuaaaaguugaguuaaauuauuguucaguuauauaguuaauuuuauaauuuagagugucagaaaauaacugcuaaaugcuagcugugugucucaggugaauguaagugcuuccuccacacgagggcacuccgacaccacuucuuguuagagcaguuaguaugguaaacugggcccaacaguaauuaaguguuauuuuauuaauaauaucuuucucucucuuguucuuuauuuugugaaauauauuuuuaagauuucuauuugaaguuacaaaauaauuuuugguaaauccugaaaauguuauuauuugaaaaugucugcaagucuaguuauguuuauuugcgcugcauauuuuccauuuaaaauugauuuuucuuuuuaaauuugccucauaauaaagcugcauccuuuccuaggaguaaggcggugggacacgcaucccauuuuaagucacagugcuuuaaacugugguguguuguuugcuuucauucucagaaaacauccaguacagaccuuucugauaucccugcucucccugcaaauccuauuccuguuaucaagaauucaauaaaacugagacugaaucgguaaaaccaccucaggguccauaaacaguaucugccaacucaacccguugucuccagaugcuuaaacaaaggaaagaaagaaagaaaggaaaagaggagauuggagggacaagacuagaccugacugacaguggguuuagcuguuugguggccucccugccuugggcucaugagcacuugaucagaaguccagguuaguaugcgaagccaggagugcuauuauuacuguguuagcgacagcugcauuaacuacucagaaaaauuacugccuuuaagaaggaaacaaaacaaaacccucgagcuauguuuguauccauaacugacauccggaucgcgccucugugugcugcauuguuuggaaaacugcaauacaagcuggcagaagaacuccucauucugaugaugcacuuuuauguauuuuuuuuuaauuagaaaguagaacuaauuuuagauuuucagcuuaauggauuuucaauuuuuuuuccccaaagaauuuucuuuacaauuagucuuuaaauuggauacguugugcauugguguaccauucugucccagaaagggcaggaggacaccgagcucagcccaguccuuacgggcagcuguagcccuuagggugaauugucaaugcuaagguauacuuuggacacugaaagaagaauuaggcgauacuugguuuugaugagguuaugauuaagcaguauauauuccuuuuauuuauagaguuguuuuauagugcauacaaaucagcauucggccaacaaguguggucuuugagcuuucgcaagcucuguucuuuugccuucagucuguuagucuucagaaagacagugcucccccacccccuuuuauuuuauuuuuugccuuucuuuuuuccccuuugcuuguaugcacaagguaaggcuuauuucacagaaaccagaaugccaguauuuuccuaagccaugacauguaaccuugacccuguggcugcgugacacagacacuaacuuuggucccauggcuagaacuugagagugacugaagccauaccugugaagcauccccggaggcggcccuuugaucucugcgaggacuuuuguacacuccacacaacuccuguuccugucuuagacaaauugauuuucauuuuuaaaagugggcaaaaggcauuuucuuccagauuuuuaaacuaauuuuuauuuuuaaccaguuuaucaaaauuugucagugaauuuuacauacaaaaacauuuuaaaaaucauuucuaguaagcacuugacauuuagucagcuuuccacuuuugaauuuuuuuuuuuguucuaucaaaaauuagaaaucuucuuuaaagacaaugauuucucauaauuaaguagcagaauucucguccaucuugugacaucugacgggugccagauguugauaaaguuacucuuuguuaaucuggguaaaacagaccuguagcagcagaucuuuguaugagcaugguuuuugaauccuucauuucgcugcauucuaucacacguuugugcauuuucauguuacacugcaauuacuuaaacucuccccuguccuuccaaauuaauuuccaaaguuggaguauagucuuuccccugaagcuaugcauuaauuaaggcuuucuuuaccacuuacauuguuuauauacaguguucuacucuccaccucuugcucugcagucaccuugcccuuccucccaccauuugaguaaagaagacgguccgcuaacaggugacauguacuggugucuguguguguagcuucagaguuagauugacaucaccaggcacagauuuagucuugucguuuuguuuacacauuggggaaaaauucaguuuaauaaacguuccauguaacugcauccaaguuucaccaggcuggagacguggaucuuuucuguguagugacuuuuuacuucuaguuuccauaaccuggagaucagacuguugcuuucgcaugauguaaguagugucucaugacuggaguuugcuuuguuuuauaguaucuguacuccuuguauuuuucaagagcuauuuuguaaacagaugauguauuucuccauugaaaacacaauaaaaaaaaaaacagcacaaaucccau

SEQ ID NO: 6814 - RNA, 10486 nt, Mus musculus
cagucuucugcuagcagccuucaggugaagauggcgaacucucagcuccugcugcaccaugccugccuggaugcugccauguucccgccuuaaugauaauggacugaaccucugaaccuguaagucagccccaacuaaauguuguccuuguaagaguugccuugggcuggguaugguggggcacgccuuuaaucccagcacucuggaggcagaggcaggcgguuuucugaguuugaggccagccuggucuacaaagugaguuccaggacagccagggcuauacagagaaacccugucucagagaaaaaaaaaaaaaaaaagaguugccuuggucauggugucugcucacagcaguaaacccugacuaagccaccaaagaagacaaucagaauuugagcugacauaguaggaugucaacaacacggcaagcacaggcuccguccggucccagcugguucugguucuggcuguggacagauccaccuuuuggagucucacagagguuuucaaggcuagaaugauaagugugugaaauagcaggcacaauguucgcacaguaggugcuuugugaaugccuuccccucaaguguguuugguuuucuaggugacuguaugggcugguguugugugucaacugugacacaagcuggaguugucacagaaaggagccucccuugaggaaaugccuccaugagauccagcuguaaggcauuuacauuguggguggugccaucccugggcugguagucuuggauucuauaagaaagcaagcugagcaagccaggggaagcaagccaguaagaaacaucccuccgccgggcgugguggggcacgccuuuaaucccaguacuugggaggcagaggcaggcggauuucugaguuugaggccagccuggucuacagagugaguuccaggacagucagggcuacacagggaaacccugucuugaaaaaucaaaaaaaaaaaaaaaagucauugugugggaaucauuuguuacacaccaccaguacaaacugacugauacaaagacagaccagaucugagcagggagaagcagcuucuaugccccagacaggcagaugaaggguggauuuccaaagcucugugaaucccaagaaggacccuggccuggugcuugaacagaguggguggcccaaggguuggggauggagucacuggaccagagaaagcagcacagcugcccaggccuugaccacccaggucagguuuaggaucuuguccuagauuuagugucuuuuuaacuuaacuaauuacuuaacuaauuaauaauuaacaucccugcacaguuuccccuuccuucucugcucccauacuccuccaaccuccccccacauccacuccuccucccuuuugcuucagaacuggggaggccucccauggguaucaaccauccuuggugcauccuuuccuauugaggccagacaaggcagcagcccaguuaggggaaagggucccagagggaggcaacagagucagagacaucuccuacuccugcuguuaggagucccacaugaagaccaagcuacacaacuguuacauaugcgcagaaggcuuagguccgucccaugcauacucucugguuugugguucagucucugugaaccccuaugggcccagguuaguugauucuguggguuuucuugugguguccuugaccccucaugcuccuacaauccuuuuuucccccucuucugcaggacccccccaagcuucaccuaaugcuuggcugugguuuccuguuuucauucauugcugggugaagccucucugaugaugaugugcuagacucuugucuggggucccuggugcaggcauggccuccaggaaagcaggugaagucaugggguucacugccauuugagaguuuccuacagcagcagcagcagcagcagcaacaacaacaacaacaacguccucaaccugugacuuucuugcuuagaagcucuguuagucuccauggccccaagaugagauccaagacucugaacacaucccccaggacuugacuuagacaguguucucuugcugacuacacaaugaccacccugcucuuauaaaggaaagcaucuaauggggggcuugcuuacagugucagagugugcguccaucaucaucaugacagggagugugggggcagagcagaaggucuggagcaguagcugagagcuuugcauuccaauccauaggcggcaagcagaaagaggggagggagagagaggagggagagaggagagaagagagagaggagagacagagaaaaagagacugggucuggugugggcuuuugagacuucaaaacccaacccuaaugacacacuuccucuaacaaggucacaccuccuaauccuucccaaacaguuccaccaacugaugaccaagcaucuaaucaucuaagccuaugagccuguggggccauucucaauucaaaccaccucagggacugcgcucacuugucugaaaguuaggccauguguguacuguucauccggugaguguuucucagacuccaucucaccucagcucucaaguggcgugcgccuuuaaucccagcacuugggaggcagaggcaggcggauuucugaguucgaggccagccuggucuacaaagugaguuccaggacagccagggcuauacagagaaacccugucuugaaaaaacaaacaaacaaacaaacaaacaaacaaacaaacaaacaaacaacaaacaacaaaauagaccccaccaucaucauccaaagcuguuguguaggcugacugcuucacuugccuccucuacccacucuccacucacuauucaaggcauccacuaaaacaccgucagcucacaucgcccguugaggcaauacugucucacaugcaaugagauccaagugucuuaccagguaagguaguuaguguguauucaccacauccaugcacaccucaugccuuucuuacagcaggaccauggaaaggauucuuuguccucucgcccccuaggaaggugggugucuuaaaaguucuguugugaagaggcaccaugaccaaggcaacucuuauaaaggagacuauuucauugaggauggcuuacagguuaagagguuuagucacuguggcaagccccaccauuauuguccugagugcacacagacagacagguugcuggagaaggagccgaggguucuacaucuggauuggcagggaguaggaaggagugagccacugggccugccuugagcuucugaaacuucaaagcccacccuagugacacacuuucucuaacaaggccacaccuuacuccaacaaagccguguacccuaauccuuucuaauagcgccguucccuaugagccugugggggccauuuucacucaaaccacugcagugggcuugugaccaugacagaaaagagauuccuucugaggcuacauucugacaggugacuaagcuucuacuuggcuuucuugagacacucuugaaacuggccacuggccuguaacagcuuaagccaccaaugaaguggaccacaggacucuggccacagccaaagcgagacauaugagccagccuucuuggaagaaaacccuccauucugggccaagugcccagcugaagugauagugggaugaugagugaacagcuuauagccaaagaagccugcaggagggagagagaagaggaggggguggcaugggacagcgacaucaccuauguccucacugugugccuggcagcuugaacacaagaugcuccucugaugagggaaaccaaagcucugauaacaaacaagacacaucuuuuaucuguggccacucggcuaguacagcaacuaccagagacagcagagagaugcucauguguggggcagcaugagaccuacccucucuuccuuccuucacagccauggguccugcacugucuugcuagugaggaagacuacuggucaaccuucuacucuugggcucauggauucuuucuuccuggguguuauacuaggcaggccguaaggaaaaggauacugugugaugaucuggggccugugaggauacuggucaggaguaggucagcuaugcccagcuucaccaugcacccaagacuuuacuguggucagggugaccuuggucaaucuuauuuaucuaucuauuuacuuuacagcccgacugaaguuuccccuccuuccucucugcccaguccuucuccccugucccccuaacauccacuccuccucuuguucucuucagaaaaggagaggccucucauagcuaccaagauaugccagcucugacaucgaguugcaguaaaacuaggcacacucuccuauugaggcuacccagaacaggcaaagggucccagaggcaggccggcaacagagucagagacaauccuugccccugcuguuaggagucccacuugaagagcagcucuuggucauuauuuugugggccuugccuuuguggauuuuuuucagauccuucucuuaccuaaggaacauuguugagcugaaagccuccgucacagggcuuccagucacaucgaaugggcuugacggcccuauagccuggccuguggauuucucuucuggaaagaaguguuccaguguccugugaaguguggagggaccacccaccccagauccccucgucccugcaguucccaggaguucacuaggcauuuauuauuauuauuauuauuauuauuauuauuauuauuauuuauuuuuuuauugaucuggccuuuucuggaaauggugagaaagaccacccaggcucuggcaugcccucuaagcuccuaucccagcugggcccagagacacuaagagacugacuuaggagaguucucgaagccucauuccccuacugcccguggggaagagagacccugcaggccgcuuccaugcucaccccagcucccaacaggcugucucaggcgagcacaggcuuucaacuauaacuguucuguuggauuuguacuuuguguguguuggguuccaaccaggacaaggggcugaggugccuguuuaacauaccaaaguggaccuggccuccagguucucccagcaucccucagucccuaccuguuacagggcaaggcuggcagccccacccucugcccugaacucuccucucuggggggcggggcugggcuuccccucucccagaaggaagcuccacccuccauaacccguguucaguccccacuucucucugcaucugcucucucgcugugugcacacacucuuccucuuccucuuccucuuccccucugucucccuccgcauggcgacuucccuggccuuguuccuugggaccagugaacccaccacagagcggcuuccccaguaaaccugcuuuuauaugcuuucauuuggcuugagcuggcucacuuccccagcggagaauaacuuaccagcauggcucuuugcuucuccggguucccaggauugaccaccucaucucucuacugugguggccaaagccugccuuuugcugccuacaccuuccugucccccuucaacccccacccgcauggucucauguaugucaugcuagcuucacacuugcuaugcagcugaggacugaaucucugagccuccucccuccaccaccugagugcggggugccgccacgcccaguuugugcggugcuggcgauugaacccagggcgggaugguuggcguuaaugucaagaagcauuuccugugggaggagccucaugcuugccuggccuucccucgugcugcugaauggauucacccuguggcugcggaugccuccggcgcuaugagacccagcauuuccaggcuuccaucgcggacagggccagugaccuguccuuccaggguuuuggcgcccaguugggagugguggggcacucauccucagggaccaaguaaaaaacugggcucucggccucuuccgugugaucagcaguuguuacuguuuccacuugaaccgauccaauauauuauuuuaauguguaugcauucaugacauugguucugcuccucuagagaagccuggcaaauacacagggcuucaugcaugcuaggcaaauacuguaccaaccaaacccagcuccagcccucacaagcucccucuguggaucccgcuguuugccagccccaaagaccgcuuagccgacgcuaugaccuucguuccugucucccuagacggcgcguuccugauucuuuuugaagggcuugucuccagcucugauugucacgucugcuggucccuggauacccucccaugauuaagagagaagaugagaacacuggaagaaagaggaagccuuucaguuccugggaaggauguacacacuaacacuuaucucuguaagauggcuuaguggccaucugguuguucucuugggacaccaaaagaucagaaccuguaauuguuuguccuggacaguucccuccaaagaggaucggcugauccacugaggagcaggacacucagguguuggggaggaggugagagaugccagaaggcugccaggauccugagcugaggguaaauggagggcugggacuccccaggcugcuccugcagacuccucucacaacacucauuuuaaagcagggucuccgcucuagguugcugaccauccacuggacuuaauuuucacggcaaagcaaaccccacuggaucuucuacugagguggggggggggggcgcaguuucacacuugaauuggaggggaggguggggguaguugauaagauuaugacaaccuguccugguuuuccuggggcuguaccugcugugguuccuagaguccugccuccccagaaagccagcuagcauccaguuggacuguuucacucccacucacaaguccccaccucacuuguccucagcucucuaauggccuugcugauucuggcucucaugccuuuccugugugcaugugugugcauaugugugcguguguguuucucucuuugugugucuauguguuucugugugugugucuauguguuuguguaugccugugggugucugugugugcauguacgugugugcacaugugucuguguguuucugugugucuguguauguauguauaugcguuugugugugugugcauuuauguauaggaaugucucugugucuuuguguguauguauguguauguguacauguauauguguaugugugcaugcauguguguguggguagggguaucuguguaucuguucguguuugugugugucugucuguguguaugugugucaggguguuggggugugugucugugccugugugucuguguauacaugcauauuugugugcauaugucuuugugagugagugugugugugugugugugugugugugguguaguggagguacacuggcacugcuggcaccugaaauuucuguguuugccucuuggguugguaacugugguucuguuaccaucaucccguggcuguuggcacucaguuuuauuuuugaacggaccaaaccucugcccuguguguuuuuccuuacuuccuuuccugugucuuagguuuuuuugagauacaguuucucccuguagcucuggcuguucuagaacuugcucuguagaccaggcuggccucaaacuuauagcaauccaccugccucugcacugggguuaaaggcauacaccaccacugccuggcccuuuccugugucuuaagggggacugacuguauucaaugcauggcacuucugugggcuugggacuccaugccuaguucuccuaugugugagcgacugagugccaauucaagggcucuggcucccuaagucucucuucccucccucuggauccucacaguggcuaccccgcugcuucucgguguugaguuuacuguggagggaucugcaggcuuucccucuugugagccaccugccuuuccuaucuccaucuuaggaggaacucauuuuguccucaauguucugugccaggaguggacaaugauucaagguucaugguugucguggaacacagucucccgagccaaacagccacuaucuucauugggccagcugcgcgagugugcaaguguccgucacaucuggaugguugacuguugacaucgcucauaggaggagggcuugggggagggucauuggacgcucaccugagaaacugcccgcuccucucagccaucuguaugcaauucuacccuaauugcauguggccuugggucucgggagaggugcuaagggaaguuaauugaaaggggggacucaaucucuucugcuaggaagccaucauccaugcugguuaaagacuuugcagugcagcggcauuugggucauccacuuccugucagugaccccccucccaugguacguaagcaaacccaaggaacacguuuaguuucccaggguaaaguuguacuucaguuugucacugggguagaugucucugucucccagagaaggaauucucacaacaauggcuaggaacuguuacaugcauuuuguuguuguuguuguuaaaaaucuguauaaaaaguuauccacuaaaguggugacguggacuugugauccagccucaggaggcagaggcgcagaggcaaagauucaaguucaaaguagucuggguggcaaagggagccuuuuuuuuuuuuuuuuuuagaaagcuauugugggccuggcaagauaacucaguggguaagagcacugacugcucuuccgaagguucugaguucaaaucccagcaaccacaugguggcucacaaccaccuguaaugaaaucugacacccuguucuggugugucuggagcgaguggggcugacuggagcgagcagagguccuaaaaauucaauucccacugggccgugguggcacaggcuuuuaaucccagcauuugggaggcagaggcagguggguuucugaguucaaagccagcuuggucuacagagugaguuccaggacagccagggcuacacagaaaaaccuugucugaaaaaacaaaaacaaaacaaaaaaacaaaaaauucaauacaguguacccauauacauuaaauaaauaaauaaauaaaucuuuaaaaaauaaaaacauaaaggccgaauacucucuauccccucucauauuacucuuuuuuuuuuuaaagcuauuaagcuauuguggcuagaaagguggcugcucuugcagaggaccuggguucaagucucaucacucacauagcugcucaguuaucuguaacucacuccaguuguaguuguaggggaucuggcgcccucuucuggucucucuggguacugcauucucagccacacagacauaccugcaggcaaaacacccauccacaaaaaaauagaaacuuuuaaaauuaaaacuuaaauuuuuauuuaaaaaaauaccugcuaagagaaaacuugucugggguacauuccuuccuaugggggugggguucagauggcuccccaguauggugagccccaagaacucuccguugacuuauagggucucuucugccauuguuuccaacggguuguuagagauuaggccagaaggguugucaugugugcugauggaggguggggguauccaaggggccuacagagaggggugggggucgggaaagagccaggucaggcugauauugccgugcucauuuuaacuucaacauauaggaggcagaagcaggaggcucucagaguucgaggcuagcauggucuacgcguaacaaguuccaggccagccagggcuaccgaauagagauccugucucaaaaccacaacagcaaagugaguacggacugaucuaggcaagcggauacccagugcccucaggccgugagccguguucagcagguacccguugccuccgagaaaacgugggcgugaaugaagaagaggugggcgugguggaucuggaaggaggauucucaggacguguguuggcugagugcauggguccaagcccccguauguucugugcugggcggaacagucugagcuuuaagacccacaggguaugugggucauacaaccccuagcugcccuagacuuugggggauguaucucucauguacccugucaugugcccugucaugugcccugucucaugcccuagacuuugggggauguaucucucaugugcccugucaggaaaccucuuggucucaggcuccugugagucacgugauccauggaccaugaguggacuggaggacgaagacugguuauuucaagcucauuggacccagccuggggaagaguaggagguagggucuagaaugggcagugugcaggcuaagcaguggagucuggacccuguggguccugccagguaucugcaggcagaccguggacuuguguaucuacagagauaacagcugccccccucgaucuguccccugucauacuauuaaccuuuaucauucaaggucauauucguccuucuauguccuaccgaggagcuuuugaaaggcaaguuccaucuuggcaugucuggcacacaguagguucuuaauaaacaugucuaucaaaugga

SEQ ID NO: 6815 - RNA, 10486 nt, Mus musculus
uccauuugauagacauguuuauuaagaaccuacugugugccagacaugccaagauggaacuugccuuucaaaagcuccucgguaggacauagaaggacgaauaugaccuugaaugauaaagguuaauaguaugacaggggacagaucgaggggggcagcuguuaucucuguagauacacaaguccacggucugccugcagauaccuggcaggacccacaggguccagacuccacugcuuagccugcacacugcccauucuagacccuaccuccuacucuuccccaggcuggguccaaugagcuugaaauaaccagucuucguccuccaguccacucaugguccauggaucacgugacucacaggagccugagaccaagagguuuccugacagggcacaugagagauacaucccccaaagucuagggcaugagacagggcacaugacagggcacaugacaggguacaugagagauacaucccccaaagucuagggcagcuagggguuguaugacccacauacccugugggucuuaaagcucagacuguuccgcccagcacagaacauacgggggcuuggacccaugcacucagccaacacacguccugagaauccuccuuccagauccaccacgcccaccucuucuucauucacgcccacguuuucucggaggcaacggguaccugcugaacacggcucacggccugagggcacuggguauccgcuugccuagaucaguccguacucacuuugcuguugugguuuugagacaggaucucuauucgguagcccuggcuggccuggaacuuguuacgcguagaccaugcuagccucgaacucugagagccuccugcuucugccuccuauauguugaaguuaaaaugagcacggcaauaucagccugaccuggcucuuucccgacccccaccccucucuguaggccccuuggauacccccacccuccaucagcacacaugacaacccuucuggccuaaucucuaacaacccguuggaaacaauggcagaagagacccuauaagucaacggagaguucuuggggcucaccauacuggggagccaucugaaccccacccccauaggaaggaauguaccccagacaaguuuucucuuagcagguauuuuuuuaaauaaaaauuuaaguuuuaauuuuaaaaguuucuauuuuuuuguggauggguguuuugccugcagguaugucuguguggcugagaaugcaguacccagagagaccagaagagggcgccagauccccuacaacuacaacuggagugaguuacagauaacugagcagcuaugugagugaugagacuugaacccagguccucugcaagagcagccaccuuucuagccacaauagcuuaauagcuuuaaaaaaaaaaagaguaauaugagaggggauagagaguauucggccuuuauguuuuuauuuuuuaaagauuuauuuauuuauuuauuuaauguauauggguacacuguauugaauuuuuuguuuuuuuguuuuguuuuuguuuuuucagacaagguuuuucuguguagcccuggcuguccuggaacucacucuguagaccaagcuggcuuugaacucagaaacccaccugccucugccucccaaaugcugggauuaaaagccugugccaccacggcccagugggaauugaauuuuuaggaccucugcucgcuccagucagccccacucgcuccagacacaccagaacagggugucagauuucauuacaggugguugugagccaccaugugguugcugggauuugaacucagaaccuucggaagagcagucagugcucuuacccacugaguuaucuugccaggcccacaauagcuuucuaaaaaaaaaaaaaaaaaaggcucccuuugccacccagacuacuuugaacuugaaucuuugccucugcgccucugccuccugaggcuggaucacaaguccacgucaccacuuuaguggauaacuuuuuauacagauuuuuaacaacaacaacaacaaaaugcauguaacaguuccuagccauuguugugagaauuccuucucugggagacagagacaucuaccccagugacaaacugaaguacaacuuuacccugggaaacuaaacguguuccuuggguuugcuuacguaccaugggaggggggucacugacaggaaguggaugacccaaaugccgcugcacugcaaagucuuuaaccagcauggaugauggcuuccuagcagaagagauugaguccccccuuucaauuaacuucccuuagcaccucucccgagacccaaggccacaugcaauuaggguagaauugcauacagauggcugagaggagcgggcaguuucucaggugagcguccaaugacccucccccaagcccuccuccuaugagcgaugucaacagucaaccauccagaugugacggacacuugcacacucgcgcagcuggcccaaugaagauaguggcuguuuggcucgggagacuguguuccacgacaaccaugaaccuugaaucauuguccacuccuggcacagaacauugaggacaaaaugaguuccuccuaagauggagauaggaaaggcagguggcucacaagagggaaagccugcagaucccuccacaguaaacucaacaccgagaagcagcgggguagccacugugaggauccagagggagggaagagagacuuagggagccagagcccuugaauuggcacucagucgcucacacauaggagaacuaggcauggagucccaagcccacagaagugccaugcauugaauacagucagucccccuuaagacacaggaaagggccaggcaguggugguguaugccuuuaaccccagugcagaggcagguggauugcuauaaguuugaggccagccuggucuacagagcaaguucuagaacagccagagcuacagggagaaacuguaucucaaaaaaaccuaagacacaggaaaggaaguaaggaaaaacacacagggcagagguuugguccguucaaaaauaaaacugagugccaacagccacgggaugaugguaacagaaccacaguuaccaacccaagaggcaaacacagaaauuucaggugccagcagugccaguguaccuccacuacaccacacacacacacacacacacacacacucacucacaaagacauaugcacacaaauaugcauguauacacagacacacaggcacagacacacaccccaacacccugacacacauacacacagacagacacacacaaacacgaacagauacacagauaccccuacccacacacacaugcaugcacacauacacauauacauguacacauacacauacauacacacaaagacacagagacauuccuauacauaaaugcacacacacacaaacgcauauacauacauacacagacacacagaaacacacagacacaugugcacacacguacaugcacacacagacacccacaggcauacacaaacacauagacacacacacagaaacacauagacacacaaagagagaaacacacacgcacacauaugcacacacaugcacacaggaaaggcaugagagccagaaucagcaaggccauuagagagcugaggacaagugagguggggacuugugagugggagugaaacaguccaacuggaugcuagcuggcuuucuggggaggcaggacucuaggaaccacagcagguacagccccaggaaaaccaggacagguugucauaaucuuaucaacuacccccacccuccccuccaauucaagugugaaacugcgccccccccccccaccucaguagaagauccagugggguuugcuuugccgugaaaauuaaguccaguggauggucagcaaccuagagcggagacccugcuuuaaaaugaguguugugagaggagucugcaggagcagccuggggagucccagcccuccauuuacccucagcucaggauccuggcagccuucuggcaucucucaccuccuccccaacaccugaguguccugcuccucaguggaucagccgauccucuuuggagggaacuguccaggacaaacaauuacagguucugaucuuuuggugucccaagagaacaaccagauggccacuaagccaucuuacagagauaaguguuaguguguacauccuucccaggaacugaaaggcuuccucuuucuuccaguguucucaucuucucucuuaaucaugggaggguauccagggaccagcagacgugacaaucagagcuggagacaagcccuucaaaaagaaucaggaacgcgccgucuagggagacaggaacgaaggucauagcgucggcuaagcggucuuuggggcuggcaaacagcgggauccacagagggagcuugugagggcuggagcuggguuugguugguacaguauuugccuagcaugcaugaagcccuguguauuugccaggcuucucuagaggagcagaaccaaugucaugaaugcauacacauuaaaauaauauauuggaucgguucaaguggaaacaguaacaacugcugaucacacggaagaggccgagagcccaguuuuuuacuuggucccugaggaugagugccccaccacucccaacugggcgccaaaacccuggaaggacaggucacuggcccuguccgcgauggaagccuggaaaugcugggucucauagcgccggaggcauccgcagccacagggugaauccauucagcagcacgagggaaggccaggcaagcaugaggcuccucccacaggaaaugcuucuugacauuaacgccaaccaucccgcccuggguucaaucgccagcaccgcacaaacugggcguggcggcaccccgcacucaggugguggagggaggaggcucagagauucaguccucagcugcauagcaagugugaagcuagcaugacauacaugagaccaugcggguggggguugaagggggacaggaagguguaggcagcaaaaggcaggcuuuggccaccacaguagagagaugagguggucaauccugggaacccggagaagcaaagagccaugcugguaaguuauucuccgcuggggaagugagccagcucaagccaaaugaaagcauauaaaagcagguuuacuggggaagccgcucugugguggguucacuggucccaaggaacaaggccagggaagucgccaugcggagggagacagaggggaagaggaagaggaagaggaagagugugugcacacagcgagagagcagaugcagagagaaguggggacugaacacggguuauggaggguggagcuuccuucugggagaggggaagcccagccccgccccccagagaggagaguucagggcagaggguggggcugccagccuugcccuguaacagguagggacugagggaugcugggagaaccuggaggccagguccacuuugguauguuaaacaggcaccucagccccuuguccugguuggaacccaacacacacaaaguacaaauccaacagaacaguuauaguugaaagccugugcucgccugagacagccuguugggagcuggggugagcauggaagcggccugcagggucucucuuccccacgggcaguaggggaaugaggcuucgagaacucuccuaagucagucucuuagugucucugggcccagcugggauaggagcuuagagggcaugccagagccuggguggucuuucucaccauuuccagaaaaggccagaucaauaaaaaaauaaauaauaauaauaauaauaauaauaauaauaauaauaauaaaugccuagugaacuccugggaacugcagggacgaggggaucugggguggguggucccuccacacuucacaggacacuggaacacuucuuuccagaagagaaauccacaggccaggcuauagggccgucaagcccauucgaugugacuggaagcccugugacggaggcuuucagcucaacaauguuccuuagguaagagaaggaucugaaaaaaauccacaaaggcaaggcccacaaaauaaugaccaagagcugcucuucaagugggacuccuaacagcaggggcaaggauugucucugacucuguugccggccugccucugggacccuuugccuguucuggguagccucaauaggagagugugccuaguuuuacugcaacucgaugucagagcuggcauaucuugguagcuaugagaggccucuccuuuucugaagagaacaagaggaggaguggauguuagggggacaggggagaaggacugggcagagaggaaggaggggaaacuucagucgggcuguaaaguaaauagauagauaaauaagauugaccaaggucacccugaccacaguaaagucuugggugcauggugaagcugggcauagcugaccuacuccugaccaguauccucacaggccccagaucaucacacaguauccuuuuccuuacggccugccuaguauaacacccaggaagaaagaauccaugagcccaagaguagaagguugaccaguagucuuccucacuagcaagacagugcaggacccauggcugugaaggaaggaagagaggguaggucucaugcugccccacacaugagcaucucucugcugucucugguaguugcuguacuagccgaguggccacagauaaaagaugugucuuguuuguuaucagagcuuugguuucccucaucagaggagcaucuuguguucaagcugccaggcacacagugaggacauaggugaugucgcugucccaugccacccccuccucuucucucucccuccugcaggcuucuuuggcuauaagcuguucacucaucaucccacuaucacuucagcugggcacuuggcccagaauggaggguuuucuuccaagaaggcuggcucauaugucucgcuuuggcuguggccagaguccugugguccacuucauugguggcuuaagcuguuacaggccaguggccaguuucaagagugucucaagaaagccaaguagaagcuuagucaccugucagaauguagccucagaaggaaucucuuuucugucauggucacaagcccacugcagugguuugagugaaaauggcccccacaggcucauagggaacggcgcuauuagaaaggauuaggguacacggcuuuguuggaguaagguguggccuuguuagagaaagugugucacuagggugggcuuugaaguuucagaagcucaaggcaggcccaguggcucacuccuuccuacucccugccaauccagauguagaacccucggcuccuucuccagcaaccugucugucugugugcacucaggacaauaaugguggggcuugccacagugacuaaaccucuuaaccuguaagccauccucaaugaaauagucuccuuuauaagaguugccuuggucauggugccucuucacaacagaacuuuuaagacacccaccuuccuagggggcgagaggacaaagaauccuuuccaugguccugcuguaagaaaggcaugaggugugcauggauguggugaauacacacuaacuaccuuaccugguaagacacuuggaucucauugcaugugagacaguauugccucaacgggcgaugugagcugacgguguuuuaguggaugccuugaauagugaguggagaguggguagaggaggcaagugaagcagucagccuacacaacagcuuuggaugaugaugguggggucuauuuuguuguuuguuguuuguuuguuuguuuguuuguuuguuuguuuguuuguuuguuuuuucaagacaggguuucucuguauagcccuggcuguccuggaacucacuuuguagaccaggcuggccucgaacucagaaauccgccugccucugccucccaagugcugggauuaaaggcgcacgccacuugagagcugaggugagauggagucugagaaacacucaccggaugaacaguacacacauggccuaacuuucagacaagugagcgcagucccugaggugguuugaauugagaauggccccacaggcucauaggcuuagaugauuagaugcuuggucaucaguugguggaacuguuugggaaggauuaggaggugugaccuuguuagaggaagugugucauuaggguuggguuuugaagucucaaaagcccacaccagacccagucucuuuuucucugucucuccucucucucuucucuccucucucccuccucucucucccuccccucuuucugcuugccgccuauggauuggaaugcaaagcucucagcuacugcuccagaccuucugcucugcccccacacucccugucaugaugaugauggacgcacacucugacacuguaagcaagccccccauuagaugcuuuccuuuauaagagcaggguggucauuguguagucagcaagagaacacugucuaagucaaguccugggggauguguucagagucuuggaucucaucuuggggccauggagacuaacagagcuucuaagcaagaaagucacagguugaggacguuguuguuguuguuguugcugcugcugcugcugcugcuguaggaaacucucaaauggcagugaaccccaugacuucaccugcuuuccuggaggccaugccugcaccagggaccccagacaagagucuagcacaucaucaucagagaggcuucacccagcaaugaaugaaaacaggaaaccacagccaagcauuaggugaagcuuggggggguccugcagaagagggggaaaaaaggauuguaggagcaugaggggucaaggacaccacaagaaaacccacagaaucaacuaaccugggcccauagggguucacagagacugaaccacaaaccagagaguaugcaugggacggaccuaagccuucugcgcauauguaacaguuguguagcuuggucuucaugugggacuccuaacagcaggaguaggagaugucucugacucuguugccucccucugggacccuuuccccuaacugggcugcugccuugucuggccucaauaggaaaggaugcaccaaggaugguugauacccaugggaggccuccccaguucugaagcaaaagggaggaggaguggauguggggggagguuggaggaguaugggagcagagaaggaaggggaaacugugcagggauguuaauuauuaauuaguuaaguaauuaguuaaguuaaaaagacacuaaaucuaggacaagauccuaaaccugaccuggguggucaaggccugggcagcugugcugcuuucucugguccagugacuccauccccaacccuugggccacccacucuguucaagcaccaggccaggguccuucuugggauucacagagcuuuggaaauccacccuucaucugccugucuggggcauagaagcugcuucucccugcucagaucuggucugucuuuguaucagucaguuuguacuggugguguguaacaaaugauucccacacaaugacuuuuuuuuuuuuuuuugauuuuucaagacaggguuucccuguguagcccugacuguccuggaacucacucuguagaccaggcuggccucaaacucagaaauccgccugccucugccucccaaguacugggauuaaaggcgugccccaccacgcccggcggagggauguuucuuacuggcuugcuuccccuggcuugcucagcuugcuuucuuauagaauccaagacuaccagcccagggauggcaccacccacaauguaaaugccuuacagcuggaucucauggaggcauuuccucaagggaggcuccuuucugugacaacuccagcuugugucacaguugacacacaacaccagcccauacagucaccuagaaaaccaaacacacuugaggggaaggcauucacaaagcaccuacugugcgaacauugugccugcuauuucacacacuuaucauucuagccuugaaaaccucugugagacuccaaaagguggaucuguccacagccagaaccagaaccagcugggaccggacggagccugugcuugccguguuguugacauccuacuaugucagcucaaauucugauugucuucuuugguggcuuagucaggguuuacugcugugagcagacaccaugaccaaggcaacucuuuuuuuuuuuuuuuuucucugagacaggguuucucuguauagcccuggcuguccuggaacucacuuuguagaccaggcuggccucaaacucagaaaaccgccugccucugccuccagagugcugggauuaaaggcgugccccaccauacccagcccaaggcaacucuuacaaggacaacauuuaguuggggcugacuuacagguucagagguucaguccauuaucauuaaggcgggaacauggcagcauccaggcaggcauggugcagcaggagcugagaguucgccaucuucaccugaaggcugcuagcagaagacug

SEQ ID NO: 6816 - RNA, 1354 nt, Mus musculus
ugccuuggcuccagcagugaggaauccacaacaucacagucaccccguguguguugacaagucccuugcagaaggagcuuguguggaaaggacaugcagacagcuacagcuguugucacuaaugcucuguagaucaaguccagggaccaauggcuucauuccacagcaacgaugggcacagcagugucggagcaaacuguucagagcgaggcaccgcuuguuuccuaaacacggcagcucuaugaggcaggggccuugcacacuuuuccagacuugggaaaaauuagaucaauaaaaucuuuaaaagaacuccucaggagacgguggcagcagcagcuaagauggaaaaggcauauggaauccugacaccgacugcuuuggguaucucugaaaaggagagaaccggggcugggguacuuaacugagccaucuuucauuuuaauaauagccuuuauggacugcaguaagaaggcaucaaaguucauuaaauguaaugggcugauccugccagggacaaggaagggagacagucauucugagggguuggccuuugaaacacuucaauuucgaucgucgguguuccgguucacaaggcuggggucagcccguggaugaacacugugcaggagagagaagggcccugggucagauggcaugggcuggguggggaugggaguuccaggaagaucaagaucauggccaagaaucuggauuuugugguuguguuagcucuuucucuuauugcgguggugaaguaccccaacagaggcaauuuaaggaagggacguuuuauuuuggcucacaguuugagagcauaguccaucaugguggggagucaggguagcagaaguguguugggguuguccucgugcucugugcuuucagaugcugaucucugcgcccccagauccaguuacagccaggacacggagcaucaucgucgugaauauuguauugugaauaagaaucuccucuaucgguguggagugaagacaaugcuccccaguuaucucugauugauaauaaaaggcugaacagccgaggacugggcagaggagauagaaagacugcacugccgaucccagccaggcguccccggaagaaggaauucaccacaagaagagggccaggagaagaagggccccaagguggaaaaagaagauggucgccugagguugggcaggaggaggagucaccaagggaguucugcaugaggacggacagcuacaacagagccagccaagaagagacugaauacaaguaacuuggggugugugcugcgaaguagcuagauaguauggagaguuaggacuaucugcucaguuauugugcuuaaagcuuguugccuaagucu

SEQ ID NO: 6817 - RNA, 1007 nt, Mus musculus
agaaaaagaaacauuuuaauuauuuaauagggcaugaaaaagaauuccaaaguguuucuacagaggcaaucccgauggguauaauuuugguccccaaauuuuauucuuauucuuugaagaugauggccugaacuucucauuucauuggauuaaaggaauugaaauucucuggaggggaguggauggaggaugugcuaauuuagagaucagcaggagaggcuguaccagcacagggagguauuaaggggagaugaggugucccaaagaagagaugcaggaauuaagaugcagaaaaauacaucuuuggacaacccuugggucuuuauaaauaaaucaucaugacacuucccaucucggugguguuuuauaauugauggguccuugcccacuuucauucucaucagcuucucaucuugagaguucuacaauuccugguuaacagagaaggaaaccgaggcucagaaaacaacaucaagucgccuuuacagcuagcacaacugcuccauguuaagggggcagcuccuugucauuguguggcuccagcccuuucugacagaucaucccuuccaucauacauccuggaaaccaaggguaagagugggcaagugaaaugugaacuuaagggugucuuuggaaaguuggucggaugguguuuugcuggggcaaacgagugaagaaguguuuuccugagguggacacaggggaaggaacauuuggcugaagcagacacagaagagaugauguucuacuaaaacaagcacaugagaggacaugugaugaacgagucuuugcuaaugacacacauauauuggucugccuuacauuguguaguugagcugcguuugcugggacuccauaaagacaaacacaccgaaaaugcuucuguuggugugcugcagcuucuggccacgugcacagacucgggcugauuggaagagugaugucagcuaagauagacucuugugcugacucaagacacaugcugaggcaagacccauggaggacac

SEQ ID NO: 6818 - RNA, 27475 nt, Mus musculus
aaacgguaguuucagaacugauuuuauucgggcaacugacugaaggauucucauuuguaaccaagauggaauucacaguauguuguuacauucacgcuuaaaaaauaucucucuauguacaagacuuugcaaagagauguaaacauacauuguuuuccaaguacacaccuccuuucuccauggagggaaggagacagccacccgucaaggcagccccccagaugacaauagaggacagaguuacaagcuaaguggggagucaccucaccuacuaggggccacagagagaagccacagaauggaagaacaacagccagacugcagacaggaggacauggauaccaaaaguuaguucucaggaaaauuaggcacugauuucuagaggguuagucacuccuuacugaagcuauuaacugagccaauguggcuacuuaacaucuucacuaguauuaaaguagccccgugcaggacacagacggcagcggggacuggaugugaucacaccacagcaggcacugcccagggcacacaguucaugccagggcccagcccucccacacugcaacugucuagcauauacaaggcgcccugcugccgcccccucagucuauucuucaaguugguuggaaaacaauucuuaaaacaaaggggggggcgccccguuaucucauccaggccgcccgcccuagccccccaacagguggcauaccagguggggggaugggugggggaacagggggcugucccccaggggggacagcuggagguggguagcuggcugguggcaaacccaagccuggaggagggugaggagggacugcaugaguugggggcaggcgugggggugggggugggaaauugggguuguagguagggggagggggaggguagccugggguagggggaggaauggugggugggggaaaggaggcuggggguggaggaacaggagguggagguggguuggggggauagacaugggggugguagguuaggugagcaggugggccguaggcugggggcagggcaccauaggaggggcccuccgucuucaucauggacugcaggcucugauagcccucuccugacauguaggagcuggugguggacauccccgucauguagcuggaggguggcgggggugguggccgauguggcaauggugggggcuggugcacaggggccgggugggcuggagggggaaucuggacuuuggggagaucacuuguuuccacaggaccaguugcuucagccucaccuaaggcaggggcgaggggaggcuuccggucuguagaaaaagagaugucagugcucagccagaugaaugauacagcugcuagcccaacuguuuuggaguaggaagcucugguaccaagaggaccaagcagcuuuuagguacucccgggaggcuaaguauucaugggcacuggaugaagugcugcugccucccaaggccauguuauaguagagugagcaauggcuaccaccucuguggcccaauaagucuagaggccauuaguuccugccugugacccauccaacaggccuuuuauacugucccccgugaggcuggguccucucuccccaacgacugaauacaaagcacaagcaggcucgucccaguucaccucuccuagcacaaacagguggggcuuuugaccagucuccacucccaaagccugagccugucacaugagagagaugacaaaagucaaauagaaaccagcacuccacaaauguggccuuucugucuauuuuacuaaaaggaggaagauccagcccacugucguuucagaugcaagggaggagcagcagcacuccugaggccuguguccacaacagaccgcagaucugcccauggcucguaaccauagguucuacuucccccaaaccucauuguaggcuuuggcuugugaacccccuaccccuaaccacuaucacacaugcacucaaacacuguguccugggcuggagaaacggcucagggguuaaggagcccucguugcucuagcagaggauccaggucccagcacauccagugggaaccaggcuuguugugcugcacagacacacaagcaagcaaagcaccuuacacauaaaguguccugucacaaggcuguuccaaaggaacaccaaucacaggagcaaaccugcucgcuacagaugcuuccuaaaggaaagggagguagugaagagcauugcuagcuccucaaggagcccugugugaaagacugcugcuggauccuaacugggcaggugggccauggacagugaagggaccugcccaagcacuagagagcagccacaccauugcuuuucacauggccuagaaaugaugccugcuauaccuuguucucaccaagugcaaggcaaacugaauuuuggcuuggcaacagaccugccagagggccucgacccacccuucucccccaacagauggucagaugcaccugcaaagaaucugcuucaagucuggggcagacaaaugcccgcuggucccagagcuaagugagacauaugcaucaaagcauaacccuucaagugcucugugucacuccucgaccaccugggcuguaaauaugcuuauccagcuuuaagaaaaugacuccuggaucaggugccuggauaggaggugccuaccugugaccccaagaaucugagaaacugacaaaggaggauaaugauucaagacaagccuaggcuacauugcaagaaaacaaaaaaccaaccaaccaacccacccacccacccacccacaccccugaguuuccauaauccuuagaucugcucauccaguucccagaguauuugcccuuguacugugcuggggcaggugucucaccucugugucugcugcugccacacaagguccccaaugucccuuaagcccaacaguugacuuuaguguuucuuuaggucauagcacucugcuucucucuaccacugacgaauccucuaaucuuaaaaagacaacucccacagaaucccagggacccugucugaggaagaacccacagccuagcucacucaucucuuugcuaccacaucuuccuacagaagagcaaugguugccaggcaacacuuucucaaaccaggcccuucugggcugaucugguacugccuaugcccugggcuguucugcagccaacugagcagggauucuuguguucuacagggcagggacaaaaccugagguaccuauaguagcuucugagcacaggcaggaacaacuuguugacuuuuuagggcucccuacaugugccacaucccacccaagccaagcacagcacuguggaccacucugagaugcugugccuuuuaaacuggggacuugggauugugcuccacguagaacacauuacuucuaucuucacagaacucaagcuucugugacuguauguggacaaacaaagcuacucagaagcuguuugcuacagggaugcucuccagagcuggaacuagucaugcgcaccaaccaccugucaguccacccaacugucagagagucagggcccucaacaccucagcucuccugagccggugucugaagaggaagacagcaaagaaagcugucugggaagucucccagugucauguacugcugagaacucuauacacuuuacauuacccuccagggacucugaacaauugcccacucuucaugacacaccauaaagacauccugccaacaggaagcaggugagaggcugcagccuaagagcaacucuguucaggucuggauaagcacuucucagcugccaguguuucuccaaaguucauucaccccaugcaagucaguauuucuggaugcagcuggucagggugugcugacccggcagcuuuacuccaucuacgcauuccuagucugugacacuagcaguuucuaaggcuccuugcuacagcacucugcagaagccuccagucaucccugcaguagacagccccaaaggcccuggcaaacagugucagcaggcacauaccuggaggugggugugcuggaggcaauggugggugaguagccucaaguuugggaauuuuagguggugguggugguucuaaaaggaaaggggauuaaagucacuuauaaucaaauaacugaaccauacagcaguucuuuggagaaaagaacagacaugagcaagucaucgcaggagaagaggagcagagccaccacggucgcucucauccuguaagaguuacagcacacugagcacagggucccaauggaggagcuagagaaaggacccaaggagcugaaggguuuuacagccccauaggagggacaacaauaugaaccaaccagaccccccagagcucccagggacuaaaccaccaaccaaaaaguacacauggagggacgcauggcucuagccgcauauauagcagaggauggccuugugggauaucagugagaggagaggccccuggucuugugaaggcuugaugccccaguauaggggaaugucagggccaggaagcgggaguggguguguuggugagcaggggaagagggguugggauagggggcuuuuugaaggggaaaugagcaaaggggauaaaauuugaaaagaaaguaaagaaaauaucuaauuaaaaaacaaaacaaaccaaaaaaaccccaaaacaacaaaacaaaagaguuacagcacagcuccaacaccucgucaacagccaaggucagccaacugcuuugucagcauacagccacucugucacaaguccuucaccacuuggaugggcaguggggcucagaaugcagacaagcccuguacugcaguaccaugucagcagcccccuggugcuuacaagacaauccuuauuuccagcuggcagucuguuagcagugcauuaacuggacgaggagaucuggaggcacgggaguagagggaagaacucgcagguuggguagcaccaaugcaggugcagacagcggcccagcagaugccgucccaccauucccacaggaagggcaguccccagaccuuaagcaggcaggcagcucauggcugaccuugagcuccacccuguuuguuucuguccugcauccuuagagcagcauggcucuggcccuucuccugguuuccuucucacacuuucacaggucuccaacacuggcuaaauucaggcccagauagcccuucaccccauccuuucccuccuccgcccaggacucucugugguacaggcgcacgguuuccuuagcuuuagacgcgguaucacuauguagcccaggauggccuugagcucagagcccuccagacaccaccuucagagggcugggauaaagggcucagcuggcacaaauaacuacacuuccaggccccagcucucuccuagaaccacagccccaacuacacacugcaccccuggacccucaaagucagugucuuucuugaucucaucuccccaacucuguuaucuggcaucauucccaccuuccucuucccacagucaggacaacuaaagcugucuccaacgacagcugcugcacagcugcguuucuagccgucaagggcaaaugugcaggcuauacuaucucauuuaacacaacacaccaacacuauuucaacauguacucaauauaaaaucuuaugcacaacucuauauucucucuucccgcacuugggaggcagagguggguagaccucugagaucuaggcuagccuggucuacauagugaguuccaggccagguagagcuaccuagugagauccugucucaaaacaaaacaaaaagcaaaagcagaaguaaccaacaaaagccuggagaaucuggugauucugugcacagucccuaggauacaggccaagggcuggccuggccucuugugacaagcuguauagcacagggagcucccacaucuauagagcaucuggccugauggccacugccaagguguccagcaacuuuccaucccuaaccauuuaucccagucaguauucuacugucaggaaccugacugcaaauaagcucauuuugucauuuaccugcacgaaagccaucaacagcugccaaaaauuauacacaguccaauucuccaugugaccuagucucugacccaucuuaggaccacaaacccauacugugaacccuuugugagagaacauccuucuacacuaaugagaccccacugccugucuggcccuacucucuguucuuugcucuccguaucuuuccaucucagugcucuggcugcucaagggcagguucuuccuucaaggucacuguggggcagcuucucugucucacagaaccacaccugcucaucuugacuacaaacccuacgugacauggaucacagcccacacugcuccuauacacucaaugccugcuacucaagccaaaguucauucacccauacugaaugcaacauucucccagacaggcuaagaaaaaucacacgacaguuuuaugaauaauucagugggaccuucaaauaagcaacagaaacaagugaagaugcacugugacuuucuagagcucaggagaccgacacaggcaaauggaugguucucauuuccuguucuggaguccuucaaauucuacuuccugcuuauucccaguauuaaagcauauuaagaaacuugugaaaaaacaaaacccaccaacauuaaaaagugcuuuggcauucuuaaguagcuaagaugugaggcagcaacuuaugcucucuggcugcccacaggcgagucucuggcccuucaugcuugucuucugggauggacuucauuuaucucucccgauaaacagccuugcaaaaguccccucaugacuacacaugcacagguauuucuaagcacacauuuuuacugccaggaaugucucaauuuacugacaccuuuugucaaaauacaaucuaaaaauaggcagucuggugaggagcagagacaacggcagccuugcuggcagacaaaagguagucaugggcucugaaguuaaggcugaucugcaucugaaaguuugcagagccagguaaaguugaagacccgcuuaccuguagcuuuguucucuuccuugggagaaaccaccuguuacgaaagaaagcacagcuguaaggggaacugggcgggcaugggugaaggagacagugacagcgucagagcgugacacccuacaaaaggcacaccguggcuccuaggaggucacuucugcucccucccaucuucuccgagccuucaggcccuccgugcaugugaagccugggagcucuggaacaaauggcuuccuccccggcucagacugcuacggugcagaagauggugcuccaucaccaucucuacaaggacuccgggaaaugcacaagacccggucccaacaggggucagagaccacuguggugagagagguggggggcugcagcagaagggcacuguccuccuagcuaacuuccuggcuccuggaugcagucugacuaaacuuucguggguuuaccucuuacuuuggguguccauacacgcccuuaacauagugcuagcaucgaagugcaaugcuaccaaauguaaggcacucacucaccacggcgcgcuuggccugucggggaggacugggcugaggggaugguuucuugggcuguugugcuugcugcuguugcugcugggcugacugcugcgaguccuucuguggaggcugggcugcuucugagccuugagaugguugggacuguggccccuggggcacuugugguguaggcugaagagaugggggcugcugcagcugaugaggggugugaugaggcaucuguuguuucccuugugaguaaagguccaggauuugguggcagaugucuaaaugacagcaacacgacauuuaccacaaaucaacauuuuaaaccaaauuuuaccuaaugaagaaaauaaccaccucugagucuuccaaaaacuaaucgacagcaauugaauuuugaacuuuuaacauuuugaacauucaccccauuuuugcugugaauaaagcugggcucuauuuucaguucaguaagcuccaugagcagacaaaggaaaaucauauuagauuaagaugcuacugaaaaaucaagacagcagcugcucugggaaaguucacucuuaagacuuuccacagggaaaaucaacuaaacaccaacauucuuaaaaggaagcucggcacaccagguaccuuccagaacgucaacagggacaucuugaacgaacugcucccaccaucuccuauacauggguuuggagguccacucuuguauuucaaauuugcacaaacgucccgcaagauacauuacugcgacagcuaugaucucugguucccacugcagugacaggguggugcagagacuggaucaacaggaaaagaaaaugacuguauuguaauagcuaacauucaugaccaaaacaauacacagaaauuagaugucacauuuagcaacuagucaguuugcuuaauuaucuacaagaaccaaacauauuacauauuaaaaaaggaaguuuuuaagugcucaaaugagcugcuguaagccacgguuacugacuugcuuuuaaaagacagaacugcacacauuucagaaccugcugcacaaugugacagagcagagcgugcuguguccucuuucuaacugcggagaacccagacagugcugucugcagaugagcccgcaugguugcucaagccaucuauaagucagacugcgaugcuucucugcagcccauggaguacaacugugagcaacuccugucacuggcucacuaaggacauuuaaagcucugaaaucaucacaagaaacaaacggcccugagccguccagcgucugcucauuacagucuucauuucccccucacaucacaugaaagcaacagaagagaaaacccauguggaaaagcagaugaccuggagucagcucugggcaaaucgguuuuuucuccuuagagaugagagguuuggacuaaauuguccauauacaugugagucauuuaaaacaucaauucaagcaacaucugaacauaccugucauuuacaaauguccaugccauuugaaccaacuucugaauuuuguuuuuaucaccuagaaaugggggugggggagggcaaauuaauggaaauaguggaaaaaaaauucacaagugagaaguaguuacuaaaaccugcagagcaaagaguuuuuguauagaaaaugacgucaaacgccacgcagaggcucacauccuaccucuuggcacucuuuacauggccuacacugaaccaccauuuaugggaaacguggcuccaaggcuaauuuuauuagucuauuuaaaauccugacucauuucccugucuucuaucacuuggcaacaggaugacagaaccugcuucugcauaaaggaaaagcgguaacagcuccauugcugcacuguggaagugagccauggccugggcacacaauacacagaacuguuuuccucuuuugagaaacacaauccaaguucugucauaugaaaagacuggcuucuagaauggcaaguuuuuauggaacaauugggauguggcucucagaggcagagcacuugcuagacaaaggaaaaaguccuggcuucuuccauccccagcacuacaaacaacaguguaaucccuccuaccccugccucauuaccuuugagcugcuuugcauauuugagcaggaacugguacggaugcucuacuuguaagucaaacuuuauggucugcaguaagauccucuccaacaccaugacuucuuccugugaagagcaaguguuggaagaacugaacaugaacacaggucucucucugccugcuuucuuaguucuacuuuagcagauguccuuugcuccuucccaccuccauucagucuguuacaugagcacacaguaguaaucuaaaccgcccagaaacagcuacacaaacuagucagagacaaccuuaaaaaaaaagcaagcagaaaaacccuuuagaggcauuauuaugguaaauacauaagucaccuuugaaaaccagccccuuacauuuaucgaguacguguuuguguacacaugacuugagucuguguccucaaguguaugucaguuuggaggucagaggacaagcacauggcucugguucuguguacccacguuuauacagguuuauacagguuuauauagguuuauauagguuuauacagguuuuagggggugaguuuagaucccuaaacuugcacaauaagcagcacuuuuauuuggaaaguuugaggcagggucucacuccagcucaggcugaccuggcucucacuauguagccaggcuggucucaaacguuuaucucuuccaucaggcucccauuguaggugugauccucucugacagcucggccauagaucauuaaaaaaacgcaaccccccaggacuuuccacuggaugccagcaugagaggaaacaagugguuucacaccucaggagcuacacugugcgcacaggcuuucucauuuccaagacucagucauuccuaaauaggcugacuagggaucuaugugaaaugccaccuuaacucuuccuuuguucaccaagcuuucuccuguugugucacuauccaagggagaguuccaggaggcucuucuaacauuaaagaauuugcugugaacauucugcucaaguauuuucagcuuugaaggguuucagguguucugcuuucuacaagacucauucuuccagagucuuacugcugugcagucuccauucuucaugcucuacucagccagugccccacacaggcacuuccugaagcugacugauggugccuagcauuuacagguaccgugagaggaagcuugucuggcagaugcaaaggcucuguaaagggcugaaacuucccaccacuaacuagcccacaacuacacgaacucuggggagaagagacagguaugugccucucacccuggagcacuaugccacgggacgagaagauccuuuuguuuucaggauuccccaucacauggcaaaccugccauucucuacccuagcuucccaguguuuucucaagcaagcuuccuaauauuacaggaacuuacacacuggaguaagaccuccuuuucuugcccauuagcaucaucaaugccuauuaucagcagcaucagcacugcuucuaaauguagaaaucaucuuuaccaaguaugccaauggcuuccaggccaugguccuauaaucuaacagagagccccagguccacucucccuauguguuucagauauucaaucaaugagguaauuacagguuucccugcaaacaccauucuuuggggaagcuuugucugugccucuggguagauugcucucacagcaucuucaaauguaccacagcucaugauuagauaaaugauuuugggauuaaaaucuagccugccaguacauuguaaaaccuacuacagcaaagacaacacccuguuuugcaaaguguuuuaugucuagugcuuaagauaaagauugaaacaagcauccuacugaauaggggaaaaguuagcauggcugggaaaaccaguuaaaaggaagcucauacagucucccagcucacccuuucauuugucuggaauacauacacugccaaaacaccugcuuuaauugugcccagggaaaaugucuuccaugacaucuucgucuucugaucugggugcuucccuuugccucucccucgcacgugaccucugggagacggugcauggcugcacugcucacuuggcagcacugcuccugcuuaagguguuguuuauguaaagggagcuccccuaaggcgcccagaacuguaaacacagccgcucaugcaccuccccuaacccagcucagcuacagggucacaagcucuggggccaaggcuuggcugaagcagagggcggcaugacuggucaaaucagggacauaaaaucucauuccguagaaaccagauaaccaugcacagagaaaacauuauucaugggcacauucuuuaaaaauaaaguugcauuucugaugcuuguuaauguaaguuucaauuagguucaaaugauuauaaacaagguuauaucuauaucuaucuacacacacacacacacacacacacacacacacacacacacacacacacacuaaauucaggaucagaauggcccacggcaacaacccuuacaagcauuagugucaagucauaaccacaaaaugcagcugaguguucgggguccuuguuccuuugggaaagagaagacagucgcuaugagauggcucaguggugagggugaguguaacuggccucugcacaugcucuguggcacacaccugacccucacccaacccuaauaaauccacacaacuuggaaaaaacuccaugaauggugucaagcauugaaacuccagccuuguuggaaggaggauuuugaguuucucguguaauauuaauuuguccuuuauugaacaaguauuaugaaugucuuugaggagacagacagucacugccugcacacgccuacuugagcuucggaggggaaaagguuaucuacaugauuauuugguaaaaaucuauauaaugaacaaaaaguuaaacucaaagugccaagugaaagaaaacaaucuaaaauggcuacuuguauggcuccugcucugucauuaugaaaaugggagcaacaguagagucaauaguuguuagccaguaaaagggaaggcaggccaaaccagcagagcacagaggguuuucaggaucaagcaaguauauaguaccauguuaugaugcauaucuaucacgguuguccaaacccacagaguguauaaccauugcuugaaccuugaauacuagaucggguagugaggaugugucaacucuaacagcaguuccacucugucaaugccgacaguagcagaagcuggaugcugugcggaaggggagcguaauaacucuugguacauucuccauuuggcugugaggcuaaaacugauguaaagaacaggaaagucuuuggcuggccacugcggcccacgccuguaauuccagcacugcaggugcuggagccggaagacccgggccuuaagaucacgcaugacucuaauuaaaaaacaaaaccaaaacacuuugagaaaaaguaauuccaaguaacggcaacgucgugaaggugauuggcaagugcugcgaggguuaaacaggggcacuaggugagggugaggguggagguagaggaaaacugccacuuaucccagaaguguauaguuauuguaacaucauuuacugacacuggcagggcuaggaaaagauaagacaaagagcuugaccagugccagucugugaagagcugaaauugucacaaacacgauuccugccagauucuuuuuuuuuuugguuuuucgggacaggguuucucuguguagcccuagcuggccucgaacucagaaauccgccugccucugccucccaaguacugggauuaaaggcgugugccaccacugcugcccggcuuccuuccagauucuuuuuuuuuuuuuuuuggauauggaauuuuuuuaaaaauuaauuaggcauuuucuucauuuacauuuccaaugcuaccccauaagucccccaaacgcccgcccccccgacucccacuucuuggcccuggcguuucccuguacuggggcauauaaaguuugaauguccaaugggccucucuuuccagugauggccgacuaggccaucuucugauacauaugcagcuagagacacgagcuccgggguacugguuagaucauaauguuguuccaccuauaggguugcagaucccuucagcuccuugggugcuuucucuagcuccuuccagauucauaagaagcaaagccauaggguggucagauggcucagcagguuacgguuccugcuucuaagccugaccaccuggcuuugaaccccaguacucuagcauggauggagagaaccgacucucucaagcugucucccgaccucuacaggcacucaugugaaacaaauacaaaaugaacaaggaagcaagugcaauagugcgcguccugagccagggacaacagcugagaacuggagucggcucaauucaaggacgcacugccauucucucagugcuguccagcacaccaggaggaccucgccuuacaaagccagggaggcuuuuccguaaggcucccucuuaggaagccaagaacaagcaggcacaguagcuagagcccucacuagcacuccaggugguaagaucugaagacaggaagcuacaguucuuaccuuugggucaucuccaaacuggccgaacuggacaucauuuaauaaacuacgagccguuuugaugauaucuuuacacuuuuuuggcguuuccucuacuuucccagccagaaaaagacaacaagcuccugucaccuagaggaagaauaaaugcucuuuacugguuagcagaguccacggggacaacacaggaacgucuuguuugaccuuuacaguuagcagaccucagucucccauccuuaguucacugcaaauauccuaacacucuaaaagccugagaccgcguacaucccuaaagaugaguggcuuuguaaagcaguuacaauucagccaucagguugugggugcaugugcuucaucagcauagcacucgccuagugacccccggccugcaacacaaagaaguaaagugauuuuuccaagauaacugccauaaaacaaagaaaagagccaaaggacugauguccuggggucaauuuccuccuccugcucugcaaacagcaaguucaaucugucagucuacacuugcuguccuuccugcugugaucuaauguguacacccccacucugcuccccaauuuacauacugaaaccaaucccuagaagggaaggacuacuauccuucuaagagaggccuggaggagccugcagcaaggaggcacauuuccuaugaagaaugggcucuuagcaaacacuucggcuaguaguaccuugaacuucccacuuccagcacugagaggaauuaugucucuguuauaaauuacuuagucuaaaguuuucuguuacagcaagaaaggaacaagccagaguccuuccaguugcuucugggucccuuuaaaucgacauagcacgcuugucauacaauuccaauugcaaaggauguuacucuuccacuggcuaaagacacugacacuccuccuuaagaaccucacaggcuggggcuggagacagcgguuaagagcacugacugcucuuccagaggucccaaguucaauucccagcaaccacaugguggcucauaaccaucuauaaugggauccacugcccucuucugcugugucugaagacaguggcaguguauuuauuuauauaaauaaaauaaacaauucuuaaaaaaaaaaaaagacccuuucaagccaucaagaaaaacagguauucgaggcuuacccagguauuaaaggucugacucagcucaccuuuccgcgcaggggcuuuaaaaaaaaggcuuuuauuuuacauguaucaguauuuugccugcaugucuguauguacaacgcaugcaugcaggugcccuugaggccagaagagggaguccuacuuccugaaccuggaauuacagugcugggaauggaaauggggucguccauaagaacggcaugugcuccuagcaagcagaguggaguuccugccuggcuggucacuaugccuccuucugcuucugcccaucucagccccugagcacugggaacucagcugucuccuggcacucucucccuugccugggcugcuucccagauauaauuaacacuccccuuggguaucacagcccugucuguacaacucaguuauggccuuacuuaaacucaaguauuauguugggaaagaaaaaaacuauauagauguaaauggcuagaaaucaugugcuuagcuaguucagaaaagcaaaauuaaaacaaacaaacaaaaacaaaaaaacaaaaaaaaaaaaaacccaaaaaacccagacaucaaaaaaccagccaccuaguaauuguuauauaauguacaauaagaguguuguccaugcugacccucaaaaaaaggauuucaacaagguuaauuagaaacgacacaauucaaaaugaaaucauaaaagcaagcacuuucuggaaaagaagaaaagccccacuggcuauuaucuccaguaaguggacagaacagcacgucaaaauuuacuuacguaucuugggaauuguuugaaggaauggaacauauaaaaucggugaaaauaaaugauuccaguugccagggugucauagugucugucguucugguuaaggcuuuagcuagaaauggcuacaaauauguucuuagcuaauucagaaaggcaacaaaaacagacaacaucaacaaaaccagccauccaguaaacaggaaucuuaggauaccuauaucuagugucagagugaguacugccaaacuugaucuguaucaccccugagacaggguuucuccuuguagccuuggcuguccuggaacucauucuauaaacuaccaggcuucaaacucaagagacuggccugcaucugccuccugagugcuaggauuaaaggugugggcacugccaccacccaccucagcuugagcccugaucucaauagggcuggcuuucucuccagguggcuauuggucaauaacugaacauauacauuuaaaugauaaaucaacagacaggacuaucccugaauagccaauuagauaacuucuaccuuacgaucugugcgaaugcaaacagaagacugcaugcuugucgacaguagcuaaucuaauucuuggugauggaguuuauucacaacaaaucccagagauucaggauacaaccccaaacgugugcccacaucaaagaugaagcgagcccccucucggcgguaccgggccucaguggcuggaucgaguccuucaaguugugagggugugugcgcuagguccuucuuaucccaguaccaacaugguuuugugugguccagguuugcugacgugacugaagggcuugaguuuucuuuguucuccuucauuuauugaaguaucuuguucuuccccagugggacucuggaauguuguaauccuaagagaaagaaaagaugcaaaauuguaaaggagccgcauuacuaacagugcuaauuauaaaucaucacaaccacagcgcacggcugaugcaggacucauucccuacacgcuacugacugcuccuuagaagcccaggguacccgcuccaagcccaugugauacacaucccagucaacuccaguacugacaagcugagcucaucugagcaagugaggguagcauuccacaucagggagucuacagggucaaaaggaaacacaauuuuggaggaagcuuaaguacacucuacucccugccugccuuuccucggugacaugcggccucugcugcugcuuuccaucccauucugaggacagccuggaccccacguuaagucaugcucccacaccacccaccucuaccauuaacaccuccuggucagacuucccaguuuuuacuguacuuguuuuugcuuaugaaugucacaggaugauuuaacucacaccuacaaaaaucucuggccuguggggaguggaaugaaagugguccaugaggaaacaucuccucuagaucuuuuuuguuucuuucccacucagcccuagguugacagaaaauagaagccagguguuucccaaggccaccacaagucaaugccuuguaaagugaccgagaagcaacauuucuacccuggcugcagaagaguuccaaaggaggugguggaaucaggcagucaagugggcaaaaacccaguuucaggcccaggccaggggccuaccaucuugucuagucuagaggccuaccuucuucagggcuggucucauuucugguggaaaagcccacauguggagcagagcauucugcuccuggcaccugaugguucuaaagggaaucuaauccuucccccagcaggaacaauuuagcagcuggagacuacaucagcuugacuucauaauuuacauguuaaugugagacugacagcugacuuagcaacauagcuaagaaaacuccagaaaccauucuauucaaacacccuucucaccuccuggccuggcagauauccaaguuuaacaauuuacugcaggcaaggcugggagaagcuaguggucuccaaagcugcuugucugaguacagaaugguacaacuaucaaagagaggaagggcacauguauucgcucuuugaaacuuagcaauuccaccccuaggaaccuuuaaagacaccauuccaaacaugcaaauauaugcacaaaauuauucauggcaggcucauuuacaaggacaacucacaaacauuaaaaagaaaaccagggauugagaccugucucaguggguaagaucacuagcagcucuuccagaggacugggguuaaagucccagcacucacauagugguucacaaucgccuaauuccgguuccagguauccaaagcacucuuuuggucucuuugggcacaaaaugcauguguacagacauauauguaggcgaccacuuauauacaaauacaaaaaagauuuuauuuuguuuuuauuauuauuuauauuauuauuaaaauauuuuuauuuuauuuuauuuaaaaaaaagauccacauguacugauaauagcugcucaaaugcagagcucuaagaacucgcagcuauccacgguaugauuggguguaggacugaagccguauaguuguauccuuguccuucacagguaccaauaccugaccaugccuuuacacgauuugaaggccaggcacacuggcucacuccuuuagugccagcacucaggaggcagagguuuucuguaaauuugaggccagccugggcuacacagugaguucuaggacuacauagugagaucuuuucucaaaaaaacaaaacuaaaaguauaaaaggaaaaauaagacacaugauuugggcuccuuaaaaauuaucacaagaaaacaaaugucaggagagcgcacagugaacagugcagccugcaagccuggaguagaugcugcuuuuaucaagcuaucaaagaaaaucucaacauuuagggaaauucaaaaugcagacugcauauagaggagauaagggagaauuacuguuguuucuuagggacaagaaauuuuuacuauauuauaaucacagggacacacaaccaaagcacuucagaagaagugcuaugcaacauacuuaagcuuugguugaaacacaaacacaugugaacaaggcaaaagccagcuuuguuuagugcccgucagagguaagcaaguagucauggcacucucucugacacaacgcuaagucaggugaauacuuaagggccaggacuccucacacuacacuggaauccuugaguagccaagagcaccuguauguaugugcagugguuuacaucaaaccauuuaaauggaaucaacauacaaagggaagagcgcaguacuggugaccaucaagaagugaggcgccgagagacacugccagccaggcacugccuaccuccaagcuugccacauuccucuccugggcaucauccccaaagagagccacaggguugccugauccuuuaguuuugccuuuaggacuucacagacuagccaagggaagggaggguaaggggggaggggaagagagggagaagaaaagggaggaggagagagagggagaggagggaggagagaaagaaggaggaaggaaggagagagggagggagagggacgagugugggagaaauugaucaacauggaaaggaagcacuuucucuaaggaggaaggaaaggaaagcuggacaagggggcggggggagaagcagcuccuaaaagaggaucuuggggcagcuccacaccuuaagcccaggcuggcccaggacacacaauccuccuguuucagccuuccaagugcugggauuacaacuguccaccaccauagcuuacaucauuuuuucucuuuuuuuuccuucuagggucucucuacacaacccugguuaucuugaaacuuacuauguagaacagaccaguauagucuccaacucauagagaucuaccucucugccucccaaguguugggacuauagguaugcacccccauauaccuggcuuuuuuuguuuaaaauuuuaaauaucuuauauuacuuuauuauauauuuuaaauuuaauuucaaaguuuacuuguguaugugugaggagugaggguggugucugaguuagaguugguuggcuaugaagcuaugauccagucacaguucaaaauuuuguaguaaccaagucacaugcuuucuuagucucagaauuuaucacuaagaauuucagguuaauagagccaaagagacugacucugccuaagacacuccguuuccucaaucuauacacuacuuugugucuguaaaugcaacaaggcuuugcagagcacuuuugucaagacaggucuucuucaucuuauagcagcugagucuguaagcauggccaucuuuuauuaagcuacaguuugccagcaugagcauauucucucugccucuaaacuguggagcuaagggugucacuuauugguacaaugguuguuuaguaugucauggaccuagaguacacuuuuagcacugcaaagaaaaagaaaaucucagggucaccuagcaugcuacuuauuuuugcuacauacuuuguguucauuuauuaaccugagaagcacaauucuuuuaaagauuuuaaacuaugugucucugugugagcauaugcaggcaccaguagaggccagaggcuggagcugacaggugguugugagccaccugaguuugggugcuaggaaccaaacuugaauacuguucaagagaagcaagcaccuuuucucuuuuaaugacuacauuccauagaaaguucuucuuggggagggggauggguguuuuguuugccuguaugucuguguaccaugugcaugccugguacccuuggaggccacaagugggugucagaucugcagcaauuagaguuacagacauuugugagccaccauaugggugcuaagaauugaauauggguccucugaagagcagccacugagccaucucuccagcucccaguauacagucuuagccaucucuccagcucccaguauacagucuuaguuuuugacgcauuauucuaacagaaagaaccaugguucuuagauacguuuucucugauucaaauaucaaucagaauaaggacaagacuacaaccacauagcuuaccucugaagaucuuucuucaggccaacaucaaccugccaaucaacaaggcuagguuaguaauaugaacaaaaaucaagugaacugcauccuaucuaggacacauauacggcuugaaaucuaaauguccuuauguucagcaucccucuauuuauaguggaauaaacucugguguaugcacauaugaggcuguggucucuugcguggcauacacagaggccagaggacgccauaagcacaucuuccucaagcuuacuuuuugagauaggguuucucacggaaccuggagaaaggucagcaggguaggcugggcggccagugaugcaauaggauccuccugccuuguagcacugcaguuagaggugcgccaugagguccagcuauuuauaugggugcuagggaucucaacucuggucuuugugcuuguauaaaaaaugcuuuauccacagagcugucucuccaguccuguuuuuuuauauguauuuuuagaaagauuuuuuuucauuuauaugugccuauguaaaucacauguauauaggugccaguagugaggaguggauuaucuguggcugggauuacggguuuucagaaacugccugucauguguguucaggaacaaaacucaugugcacugaaagaacagcaaguacucuuagcuaccaagccaucucuccagcccugguucuacccuuuaucaacaagaaugcaaucuguaucacuuagcuuuuuucuaucagaaguuggaucauuaaucaguucuuacaucaaagagauagcugaucuauacuuuaagaagauucuagacagggauuggccucuaucacaguccuccaucguuaacuguauuuguaguacuucucaaaagcucucaacaguuacgugacauugaaauuacucugcaacauaaaugcuauguaauguaucugcucuuaagaauacgaauuagacuuaaccuaacuagcuauuguuuaagaaauuccuacaaaaaaaggaaacaccuaaaaccaauuuuauuuaucgugggcaauuuuugacuugccaucgauuauuuagcaaacagauuuugacaacacuaacagcuucucucucucucucuugguuucugggacacugcuucucuauguagccucggcuguucuggaacuugaucuguauaccaggauggccuucaauucagacagaucugcaugccccugaccccaaguguucuaauuaaagaugugagccaccacuaccacccaacugacacuaacaauuuuaaucaaaauguuuaucaacauuacuauuucucaacuauuaucauucauucagcaauaguuuacuaagugccauauaauguucuagguauugaggcuugaaaucacuacacuuucauggaaucacucauaaaaaaaaaguuaaagacacccacaacugcaaaaugcuggccaauuauucuuuaaacaacauauaucaagauaccaccugugugagguuugucuuuaaaaccuaaaaggccagucuuuagcuaagacucauggcacaugacuuuuuaauuuuaaguccagcauucuggaggcagaggcaggaagauaucuuugcgcuggaggccagccuaguuuacagagagagcuacacaccagccaggguuacguaggaagacagccagucugugauaacugauuuuaaacacugagugacuuauggaaagcuguguuuuauugguaguccaaaguuaagaacaccaccaagaauacauuaggcagguuaaacugcuuaaacguuuucagauuaacauauacauguuauuucucaacuuaauaaagaucaguuccccuaacaccgaggcaaacaagcacucaggagaggaugacgucuggguaagaacgagucuuaucgaggaagucccuuuucauuccugguccuaccugaguuccgugguucaagagucacggaacacuuuccaaagccucaauccuacuuaacagagggauccacaagccgugggugaccgggucggucugaggcagggucugugcguguaagccccgccacccuuuuauuccucggcuaggaaucccccaaaccgcaaccacuuuccucugcgaggucagcuuccaguuccaggcauuagcggcgcaccccagaggacccgacccugucccgaagcucccucgccgccaaccccgcgucgccugcuaauuucaacgugcaucagggauuccaaggagggcgguggaauccgggaagccggacucuuccguagaacccaggcagcuggaaaauacccuccucggaccaccaggagcgcagacggugggcggcgcugcccgcggccagcuagauacucaccccucgccucaggcaaaacccucagcgacgucucuccuuccugacagcagccaucuuggagguggaaugucggggaacuacgucauuucccugcgucucgggacguuaagaagcggccggagggggcggcgaaagucaggugccugucaaccaauuagaagaaaguaaagcuaaaaaaaagaaaaaaaguaacaagucaacagucgccgcuccgccuacccugcggccuuguggacugcggcccguagggggaggggaaacacucgcacacacccucccaucgccccacccccuuggcgaaagggaguucgggagcaaccgaaccuguuaacggaacuucggcccggaggcggagccagggcucccgucguucaaucacagcgcgagaucuaaccaaucgagucuucggauacggcuccgccccgguugcugauguccaauggcugaucagcacccuggcuggcgggcggaugggcggcggggcggagccgcgccgaggcguguuaggugcgggccaaugaacggcggcggcggcccgugggcggggcccaggggcgggcggagccggguugggccuaggcggcggggcugucucuggcugccguccagccccucccguccggccgccgccgccaccgccgccgccgccgccuggggguugguugaggcggacgguggggucccggccggaguguggcgccgccgcugcgcgaagacgaagcgggcaggugagugcggacggcaagcacccgcgugcggcccgcgggcugaggggacgggguuccaccgcuccuuaaggaggugaggccgagcgugcggacuccgagguccggugcucggccgcgaccgaguucucagggccugggaggcugugggcuccgaggcccggcaggcccggucccugaggggacuggcgagcgucugcagcuucccucuuccaccgggacgggggcaggcggcagguucagggcgcggccugggcgcggccugggcgccgcccucggguacggccggggcccggagugcgcgcggggcgcugggacugcgugcggcgggcugcagccuugguuuccuuccuccgguggcaggcgcacgcggcuuggggccgaggccccucugcagcucucuguugcccacggggagcccggcccccgcgccuuguccuccacugcccgcucgcaaaggcgggcguagaaaauaggucagguuucuucccacgcgccccuggccgagguccacacgcgacgagcgcgcugcgagagagaagcgguccgugcucucggaguuugccauuccgauuuucaacucuuccuucuugcggcugcagccugggcaugcgacucugccucuucuccccgccugccacucuuggagaaggagcugauuagugacgugcgccacuggcugccgaggggccucacccccuccgcgucgugucgggagaggacguuggugcguuucuggaggggugcacgcguaaagaugacucgggacaugcuguaauccauuucuaaacgaaaacgguguuguuaccgaaguaaacacauuugaacaggauguugacagccaucuugccuuugcagacccuuagaagauugagguuuuacugauagauguaacagaacugcauccaggaaggcugaggcagggaauccggaguuucaggccugccagagcuacauagggagacccuuucaaaaaacacacaaaaacuaaaaccagacuuggacacugaaaguguggguuuuucauaugugauacuguucccauuucccuuucaaaggcgaugcugaggguguuuuuaaaaugaguuuuaaacagugauagucuuggggaguuuuaagugaacgcacccuuaaaauacagcaguauaaaaggacauuuccuccccaaguuaaaaaguuugucuagacucacuggaaccuacaguguguauguaggcuccuaccuguagaggcucacuuuauagaugggucucuggggcgccaugauugauauuuugguggaauuccagccauuugggaaggaguuuuucuagggcuuaagaaaacaguuugcaaaaccaaguucugaaaagcuacagaaaaaaagaacaucuuacugggacucuaaacaaccuuggucuuuauugccccuaccuucuuuuuaccgugcguuccuuucucuuuugagauauuacuaauaucuggauaugcaacucuaguucccuuggagggaaguaguugcuauuucucccuccuuuuucacugugcaaacaucucaguggagcuaugcuggacuugaagauccaaacauugugcugauguggguucuagcaaugaggguuucuguuccuuuucuguuuauaaauguccaguaaaauucucacugaaaugcuguuagcugggccuuguggcauagcuaacauuagcccuugcuacucaggggccugaggcaggaggaucuuagguuuaaagcuagccuagacugugugagagacccugacuggcuggggaucuagcucaguguuagaguguuugcuuauugugugagaaggccugaauuccaucuucaguacaaacauaucauugucauugacuaucuuuuuuaugugaugcauauuuaggccaaauuuaaagaugauuaaaccauuucuuuagaagccaugugauuauaagacaaugaggaggcaauauucaguuuuuuauuguuauuguuccauaggucaaccacuagaaaacuguuucuauguucagcacuguggugaacagucaguaaccuaaaucuugaucaccuaaaagagaauguuaaagaugacugugcucaacauaguugcaccaggaacacauagaguagguuugcuuguaguaaaucuaggagaguccccaguccacagagguuguccuuauccccacccuuaacugcuucagaccuuauaugcaguggggaaguauuugcaucuaacuugcacacuaaccucucucaagguuugaguugucuguauauugcuuccaguacuuauuacaaugucucugccaugcaaauaguugucacauuguguccuucagggaguagucaccagaagagcuuuguauuauauguucaguaguggugaacuuugucuguccccuuaccuauuuccaccugcugguggcugaaucugcaauggaacauuggacugauugaugcugugaggauggaauguuuguaaaacugugagugaaauacacuauggccccugcaagcagggcgagcgaggcuuuccaaguuucugaacuguuuuacuuacagagucugucucaguuugacucagaaguagcugcuagaaauggaacuguguuuguuguguguaguuugcuggaaaguucccaucuugagaaagugguggccugcuauuggcuacugagccuggugauuuuccuggagcagacgaauuucaguguguuuccucuuagagcaaaguccugggaauggaggcaagcuguguuguucuaaagaagcagaggaaccauuuguuacaauuagauuauuuuaacacaacagugaauauauuguucugcugcaaagagcagcuguggccagguauuugcuuuuucaauuagcucaugauuuucacuauuauguuuggacucacuuucuguuagaggaggauauuuggaauugcuguguggccuuuuacuucuacuauaaugagacuaauucguucugguuuguauucaccacuugagauuauuaauuauaguaaaggucucuuauuuuucaggguuucugguuugcaccuuugcuacuuuauuucacaaaauugauuucuuccauugguuuucguuuuaucucuuccuuauccuuaagauuggaguuauuaaucauuuagaaauaaaaauauuaauucuacaguaauuucucucuugguuaaacauucuaacaaccuuuugauucuuuaaauuuuuugauuaaaaaauuaguguguguguuguguguguguuaaguauguauuccuggucucaugaagguca

SEQ ID NO: 6819 - RNA, 870 nt, Mus musculus
cuugcgagguucacggcugucuuucaaugacauuaucuuuaaaacaggaucagaugucuaucccucaccccauaccacagagauuaaacggcauaggcagagcaguccauuugggguuuguagguaaauuccucuagugcuuccuugcuggccuagagagagagcggggaucaggagcugcuucaggaaaguggugacauggcccaguggcaggucaaaagaccuggaccacacucaacgcccuugugaaaaaaagaucauggagauaaggagaugguggaggggagaccacagcacucuaggguguccuguucaucuugccauggguucuacuaagccaacacuuggugcaucccaagagagccagaggguguggugaacccacucaccucucuccccauccuggaaguccacccagaugugcccacugcuaucccugccucacccagagcaauagaagaauuccugcaacggggcagugcuuacuuuuaggguacuccccauuuguugggcccagcauagcaaaggagauggacaggaccagggaggaggaaggagccaauccuggggcuguuugcuggcagaaggcuccucuuuuuccuugggaaacugcccaaaauggccuggccugagaaagucugugguagagugucugcucauaccuccagugaggcgucucugggggugaccucaugucuggacugaguuugcaucaggcggucugccugccaaggcuguaguguggucucccugaagcggguguccugggagagugugggagcgccaucaucacugccaccaaucgcaaggagccuuaccuacggguuucugucagugaucguucacgacgcacagcugucucguggagac

SEQ ID NO: 6820 - RNA, 5934 nt, Mus musculus
aaagccuggcuacaaagcuuuuccccuagcagcugguucagcaggccuucccagucagccaagcacaaggcuccccucugcugcagcaacgggcccugccuuagggucccaaugucccccuguguccuuuagaucucaguuucuccuuugguuauacgagggguguacugauguucugggaaucuggcccguccugggacaggguguucagugggaaugggauggggauggcacacauugcuacuggucuugggcucuccugauuuuccacaccaucuucuugcgugucuucuguagguccucaaagagucucugaggcuguacccgccagcguggggcaccuuucgccugcuggaggaggagaccuugauugauggggucagagucccuggcaauacuccucuccuggugcguggggcccucaggugggcuggccuguuuguccccaagguggucaaucugggucucaggucagggaagccaugugccucuuacgauuacuacacucaaucuccuggcugccuuguguuuuuuugccucagucucccugugaccccaucaggcccucuucucccuucacacauccagccaaggcuuagucacuucccuggggcuccaaauggcaagagggagacaugggauauucuuggauuuaauuuuuccccauuuuauuccuguggugugugugugugguauaugcaugugugugggcacggugcucauauguaguguguguguguguguguguguguguguguguguguauguguguguguguguauguguguguguguauguguguguauauguguguguguguauguguguguguauauguguguguguauguguguguguauguguguguauauauguauguguauguguauguauguguguguauguguguguauauguguguauauguguguguauauguguguauauguguauguauguguguguauguguguguguauguguguguauauauguauguguauguguauguauguguguguauguguguguauauguguguguauauguguguauauguguauguauguguguguauguguguguguauguguguguguauauguguguguauauguguguauauguguauguauguguguguguauguguguguauauguguguguauauguguauguauguguguguguauguguguguguauguguguguguauagugugcauguguuugggcauggagucaaucuucaaguaaacccaaagccugcagaugugaccggucucucugaucaccuugcucugggguuuugucucugccuccuaaggcuagaguuguagcaggcauucuaagugggcucuggaggagucaccauugccccagucuuugcucccucccgaauuuucuuagcucucuuuccccccccuuuuuuaaaaaauuuauuuauuauaucuuaaguacacuguagcugacuucagacacaccagaagagggcaucagauuucauuacgggugguugugagccaccaugugguugcugggauuugaacucgggaccucuggaagagcagucagugcucuuaaccgcuaagccaucucuuuagcccugcucuccucccucuuuaccacccuuccucccucugcccuggaccuguugcauccaacuggacugugugugguuuacucacccacucacugggucguuggccucucuggcucacccuugcacaauagugggugaugggaaccagagucaguccauuuuugugcacggaacagugcucagcaaauaccccaguccaugugugcacgggacagugcucagcaaauaccccaguccaugugugcacagggcagugcucagcaaauaccccaguccaugugugcacgggacagugcucagcaaauaccccaguccaugugugcacggggcagugcucagcaaauaccccaguccaugugugcacagggcagugcucagcaaauaccccaguccaugugugcacgggacagugcucagcaaauaccccaguccaugugugcacggggcagugcucagcaaauaccccaauccaugguagauccccuggcuccucacccaugcccagcguccccacuuguguucacagcucagcuucuggcuguugcucucacagggacaugaggugggcaggcccagcauggccagugcccauagcccaguuagggggcacauugcuuuuccagggcuggggacauaggccuugaagacccagggcauaggagguguagcagcucccucaggaggauccuuggggucaggugaaggagguggggccccagcuucccuagcuucugcccugaaggcugaagcgagccuguggugaaggaggggccagccuccagcugccaggaggaagguaccucucagcacccggucucagucaguggccacuuaguugcugggugacuucagguaagauuccgagccccguugucucaucuguaaagcaggggucacuguggcugcuacggggcugugcaggcagagaauggcacggcauggcacacacugauggcaguggacauagcauaguguccccucucuuccucuuugagguuuuccaggggggcuauggaaugcuacaccuaucuaauagguagaaaggugcuguguuccaggucaccccugggggggcugcaguggguugggaggugcaaggggaacagccugagaaccagagacagcagcucuuuugcccggcaguucagcaccuacgucauggggagaauggacaccuacuuugaagacccauugacuuucaacccugaccgcuucggcccuggagcgcccaaguaagucccucauugagcugcugugauggggucuguggaugaagcaucaucaaucacggaggccucuggacugagcuacccacacccacaggccgucuagagccccaggagggggcuguggccgccaucacagcucagagccagcagcucacuugcucucuuaaguucccuuuccauugcugggauaaaaacucugacaauguuggcuuuaucagggggaaagggcuuggcuuagcucaccauuuaaggaugcaguccgucccuggugaagucacagaaguggaggcagagaggacagggcauggcuaugccaguccuuaccucaccucuccaucuuacccagggcauugcccaagaugccuugccuaaagauccggccacucacagugggcggggcuucccacucaauacugugaccaagauaauggucuccagguaugccuccucccggcuucuggaugcugccaaguugaugaucaauaguaacugucucaccugcccgaggggcagagcucagcaguuuucugaagaugguucugccccugggcccaggcuggucaugggaggggacagugguguggacaccccacuccuuguacugacccugacggaccucucuccugcaggccacgguucacuuacuuucccuuuucccugggccaccgguccugcaucggccaacaguuugcucagguaggggcuguguugcuuggagcuuccaagaaaugacuacagagugggggccgggcuggggugccugagagggugaggguggggguggaggugggggcugggcaugccugacaggagaacaagaaggaagagucugcaucugugccucuccaccgccucucucucucucucuguccccccuucaucaugucuucacugcccccuccucccccuucucuccuccuccuucccuccacacuccuccccaacagauggaggugaaaguugucauggccaagcugcuucagaggaucgaguuccggcuagugccugggcagcgcuuugggcugcaagagcaggcuacgcucaagccauuggaccccgugcugugcacccugaggccccggggcuggcagccugcacccccacccccacccugcugagcccuggguaaggucagacuccuuggaccagggccucauuggcccccauuacugcccauggccacccaccggcaccccugacccuucugccaccuuccacgauggcuccuggcgagcccuguccccucgccugcuucacacccucagugcuuccugucaucgcuggcuuuucagcucuuucuggugggcccugccugacucccagcuaucaccacaacuaccaucgucucucccaaaccuccgaacuucugcacuggccacacccucaaaagagacacccuaacucuugcucacucccuaaacucuucaagugacaugucccccaggaagcccuguuugcuucucacagccaggccagggucucuccucugugcuccuaccucuaacacacugaccacacuguauugugaauguuugcucaugugaccagcugcccugccaggcugugagggccacagggcagggucugugugcacuuugccucugaggccccuauugcucacuagggucuggaacagagucgaugcccaauaaacguguguugacugcaugaauguacggccacccaggccccgacccuucccuuucuucagggugcagggugggaugauaaggcugaucccagggggcugggacagcucuagacgcugccugcuuacagaugguccuggaggugccagacggccucuagcagaaaccaguuuccuaugcuuagacucucugcagcgggguggcaugcggcucuggcauuacaggaaggguccuggcauugagagcuugauuugagguguguguguguguguguguguguguguguguguguguguguguguguguguguguguaugugugugugguugaccuuggcaccuauaacugccucaugccugcccugugggcacuguguuguacacaaugaccuagucagaagguagagggagcccugggaggcugugugcucuggggccaguccaggagucauggucccagcuccuccuuccccacugggagccugagucagaaacaaacuucucuaccucagcaaggccccuucuccacaccaggggagggguagaacugugacaaccuucaggauacauugucucccuuggucuugagcagucuugaauuuccuaaggaauggaugacaucaaagcuuagggaaggaggugauuugcucugcacagccggggccuagggugcagcuagggacaggggagcuugugccuugguuccuggccugucccugccccagcccagguugucuuguacaaguucuuuggucacagcuacugggcaggaguuugggggugccucuggagcuacaggcuggguuccuguuguacucccuccugucucucucuggugggcuagccaggcuuggccuguguuuuacaggcaaagccaccccugacuugucagugcccguagcagcccuuuuccauagccacuuggcaggacacugucucccauguuguccucagcccuguccugcuucugcccugcucugauuccacccccaccccaacccaaggcaccucugaagcucaccagcuaucuucccuaugcaugugggccuccaguuucugccacugcugggccugaucccacaggagagagcccccccccccccagcacccacacagaagggcugagggucauugccucugugcugucagggcacaaccuggccuauggaggacuggcuucuuucagaaauguccaguugcccauguuagcauucgguggcuuggacugguaauggcugagccugggccuucaccuccuuccagucuuaaguccccccaggggacaggacacggaaaagucaaggucacagucgugauggaauuaggacucacucacggaccuucauaccugguggccggucacugcaggccugagucggagcucugugcuggaaccuaaagaucggagagagggagagggcaggaggacccucggccagcuccuggaggguug

SEQ ID NO: 6821 - RNA, 27183 nt, Mus musculus
auuaaagagcuuaacauuagcgcuuuuuauuguauuguauagagccauguuacacaugcuuggugcuucaaacugaguuauguuuuucuggaugcgaagccaucugaugcuugaugcggaugcuuuaaauacuauaauauuucugugucuaugaucuaugagcuaaggaaaaaccaaggacaauuccagaacagcaaagaacacuuaagagauguacaugacacacaaugcagaguccuugagccagggccuaugggaguucccagaaaaugaaaacacaacuuuucuugccauuuguagacaucaaggguuuuaacaguugcuggcauuauaaagaagaggugacuccgguaacgauaccuucuuugcucccucaugcuauggauguagacaccacguggcuccgggcagggaggcggaccaaccagcacagcugcacauccccaguacuguuccucggggugccugagugucuuuagucaucaaaucugccacucugaaaugcggagcacagugcugcucacuagcccccccuugauggucuccagagugcuggcuaggcacaccuuggaaggugcaccccgccugugaccuacugccgacacucaaugaccaaugccuuaagcugcucacaucugccacccacccuuuccuaugaagucuacaugcugucccagcuggggaaugaccuuccuggcacgguacugaccaacuaugcccaaagaugccggguagccuguuagccacacagcuacccucuccugcucagugcaacuuacucaccugaagggccuguauuaagccaucugaggcaccugagcuuacccugagaggaguuaacaagcuguggggaaagcucgcuguuuuggagaccuaaccuaccuggucaaugcugcuggcacgugauuugaagcauggaguagcuuuuguucugaucagaguuaaauguugcaagcaagcacaucugcuuuggaguucugagucccuucccuguccucagcuagaguguaucugccagguccugggccugggcucuagaagaggucacauuaacaacaaagggcugcaaagucagaugcggccucuuauggccagagauucaaacagucugugcuagaaaaggagcuagcuucugcagccaguagggcugcuagggcaaugccucugaguaguuagucacggauggcaucuaucuacuggcaacucugcucaucucuguucugauccugaagucccuguucuuccuguaggcuagaagucaagagaauaaaaacccaccgcaccgcagacuggcuaaaucaugucaauucggagcacagaggaaaggaaguaguagucaaaucccugucuauuguggggaguggguaaacuuagggggcaagacuuccugggccauagacauacacucuagucagugauuugagggcuguaccacaggugaguccugccgaguggaaagguggggugggugccaagccaugccagcaccauaucccuggagcaccacacacuucaccgacaguuggcucucaucuaugugaagacacaagcuaaaacugccuagaaacaugggccgucuuugcacacaccaucucuucaagaggucuuacaugcccaccaacuuagcaaaccaagcagcauucagaagaaccuguguguggaaaccaaaugggggaugggggaaaagucuugguuuuccucagcuccucuggcaaaguacacacaucgcacaggcccagcacagcgugagcucagcaucucugcgggaaauaaaugucacucuggagcgacagcucuguauagauacuaugcccccaaccucacuaccaaagaggggcaaauaucaaauuuaaaaauagaaaauaauaucuuauuggguguaaacuuauccucuggaguuuuuacauuacauuugcuaaaaacaugcauuuauuucugcucagauguaagaaaauaugucuaucaguauuacuuacaaaucagauuuuaagugucuagacaagggacucacuguuagaacaucauuucaaauuaguaaauuacaucuauaacaaaacuauaaauucuaacaagcaaaauggguuuaagccaaagccaaugagaagcagcuuucuucuggccacugacgugacaggucccuacacugcuguccuaagugaggacccgcacaccaugcugucuuugaacucccaacagaaguuaacugcacacugagaagacaaugccaacacagaaagggugaagaugaugaccgcugcuccacucagacagaaagggacagaagagauggccaagcaucucccaaggaaucaaggcacagaggaugggugaggccucgcucuauacgugggccugacucucaggguggcuggcaggcuuuuccacagcacacuucugcucugcuguggagccgugggcaagggucuugaggugccagggccaggcuugaagguagcacaauauugggcgagggagggcaacauggcucuggccuccgacugcagggcauuugggaaagcuuaaccugaugguagggagcgaaggccugggggagacacauggguacuuggcucugauggggccccuuuagucuuacccccuccugacugccaggcacagcaaagccugcccuccagcacacagcugggucugcugcugagcucagucccaucaacugcucacuggaucagauucuggacgaauaaaacaaaugucccaaguuacaacuuccauguaugguucagaaggcacuucaaaauuccagagccacggggccacuguuuccaggucaccaguccuccuggcgaggccauaagaaauugggcuaaguguucgagcggcugcucucccggccucuuugugacugaaccugguacuuguuugucauuuuaccuuggagucaagcauucagcacagaaagacagacaguuagguuugcauuuugaauaaaugagauuuugauguaucacggcaguuuauaaaauaguuaacaagucugguauuugacccuagguaaguaaaaguucaaaaauuauacauugaagaggucacacaugacaagucaaguacucacugaguacaacuuucuaauaaucucaucgccuugccgcucugcacuuaagugugucuacaagcaaacagcuacuggcacucaauugcuacaucugacagcaucuaauaaggacugcacugagauuuccuguuggacaacccauggagccaccgccguugaaggcagccugagugaugaugagaaagaaggcaggcccauccucccuuggcgcacccacugccagucagugccuucccuucagaaagcaucaggcccaugcaaacgucucacucccacacgcaccgggauaucaagggcaauccugccagccaugggucgucuguguacucugagguaguucccuagcucggggugccuccugccugcucucgggauucagggcacguaggaaaugcuaguguccaugcacggaccucaucacagucacugucacugagugcaaaauaaaggaaacucaaguugcuuuauuugcuuccaauuucugggaggcucaagaauucuaaguauucuggacaacagaagaaaauaaggcugugcuuacagagcucuuucugccguaaucuuucuuuaggaucgcuauuuuauuguugcccuuucuguuacacggauguacacaucagauguuaaaagguacaauacauucuacaacugagcaccacuuucuguaacugaacaggcaaagaaauuacacugaacaucagcaucuggcaguauuuuuuggggaaaaaaaagugacuaaaauggguuuaaauugauuaacacuauuaaaucacaucuaauauuugauucuacaugauucaauacagcuauacgauacaauuauacaaaauguguuaacaucaaagaauacaaccaaaauuaagauagcaaacaaaaccuauauaacuuuuuuuuuguacaggaaaaauacuuuugaaguaugcauguaacugcccauucuuuuaaagaaaaucuaccgcaagcaaaguuaucaaccuccagaaaaucacacagcauuacuaagcauauccccaaaaaguguacaauaugcacacuuggaaaauacaaaauuaaaaaaauuguaagcaacaggugagcuucauauuuauaagaaugugaaaagaagucccauuuuuagcacuguuguauaaagaauugucuuuugaugcgaaguucaugaauuguccuccuguugggaccacacuuuacaaaaacaccuuguuuuugaaacgagauuacagagcaagauauagcaucuuagcaaugucaucuuauuaaaguauuuuuuaaauuuuuacuacuuuaucaaaacaugucccuuaaguguguaggauucauuuuuaaaauucuuccuagaaauaauauacaaaggagaggcauauuuauucccaaucacacuccugaagaggcuucccgggucgagaaggucuucucucuucuuuucacugguuguuuuuggcuuuagcguguguuaagaugugagauuucagguuaguugacugagcaaacuucuuauuacaaccgucgaaggggcacacauagggccugucuccgguauggauucgcacaugugugcgcaaauugaaguccagugaaaagcgcuucccgcagccuucgaaugugcacugucaaggaaaaaccagacaucaacccacuuggcaaacgggaccagaaucaggggcggucaauggcucacugcuuggaaggaaaaccacuguacuagacuagacuguacuagagugagugugucuccuuccuccucuggagacccuucugagcgugauuuagaacugacacacagggaucucugacacuaugaacacaugguuagcucuuacaaaaacagaaggguuguacuaagugcaaauuuaaggccugaguauuuucagagacacuccagaaaguagaauaaauacagaugauuuaagauauuuagugaugccaacugucacagacucacuugauuuuucuauaagcagcaccaaguguccccuggagauguagccaacagugcuuaugagcacucucucaguaauucaacacacuacucacuaccaaacauacaaucucugagucucuguaaacaugcuaggaauuuagugcgggguucucucacucacauuacccuguuucucccgacagauacucccauccccuaguauguaacaccugcagucacaugcaguaaguaaccaggaacccaagcagaccuucagagagcuauggaagugggagugggaauaagaugcccccacaggcgccccaugguacuugauaucaccacccugcccagcacccuagcuuucaguguggggaacagguacuggcucuaccugaaagggcuuuucuccaguaugaaccagcuggugucguuuuagcuuugagcucucaacgaacgcuuugccacacucugcacagacguggacucugggaccgugggugugcagaugcuuucucauagcagaguuaucccugaacaucuuugugcagcccuuaaaacagagagagaagcuuagugguucacaaugcaaacugagaaaggacccaaucacugcacagccuuuacugauguuuagagcaaaacaaccuccccagcacccccuuuaacuuuacuuagcauuacagaacauuaagcuauuuaagacauaaauaaaaaaauuaaaaaaucagacagcugaaaagaaggccuuauucuuauuuuguauugcaaacccgugcuuuacagaugaggaaacugaggcuuagagauguacugaaguagacuugcccaaggucacacuacuaguaguagccagccaagcugggaguagaacccagcaucccggcuuccagcuacaccacagccgccucacccagcuacagcccccagaugaaguaacagaagcacugagaaauaaacggaguuaaaaugacgguaguccaccacuaccuuuggugggccccguauucugugcugcaacaaugggcugucauucuccaucgccuacuguucccucuucucucuuugccucuuuccccuucuugacagagaaagaagcaagagggucuccaaggaauggcaacuacagaagaaauuuauuuggugagacaccaggaaaaggaagaggcaggcaaagcgauaccagugcgggggaggcagauggauguguggugcccgagagcagcauguccucaacaauuucuucugcaguuguugcccaugauggagugaguggggaaauggugagacagcaugacagaaggacagcacaggucaccacuagacagcuucacaggcaaaagggagggaggggaaagccaguuuuccaccuugaccucuaacuucagcucccauuuacacagagcagcacagagaccccggcacgcauggcauaacgguuuucaaaugcguccuaauugugguuuagauaacagccacaugcauuccauaccuccacaccauaagcaucuacaagcaguacagagacuggggugcacagccuuuauaucaaguauauuuacucugcaacugcuauuuuuggaaauucuuuauuccauucuugguuucuucugccuuguuucucagcauccacaucuuuuccccguucaaucugaaagcugaccaccacccuuagcaccucaaaauacuuuugagccaccccuuuuuacuuuaaaaaaccagcugcauuugaaaacaguuaugcacccuucuaguagcacaauuaacagaguaaaaagaaaacugagggaaauuaccaagucuuuauuuagucuauucuaacaauauccaaaguaauuuccaaguuucaguuauaagcuuagagucucauaaagacuuguggguuaaguacaacccaaggucuuaagacuugacuuguuaaugguccaaaaagaaauaguccuaacacaguacagucaauauacaggaguaagaacacuggccccuauagcagccccauuuaacauaucuuaaguguccuuuacuaacaaacaaaaugaagaccguguuuauaaucccaaagcccuaauugcuuacuuuguuucaguuacaaaaguggaacucaaagggcacacuccuuauauacacccugucugcagccugagcagaggucuaaccacacuccccucgcauuacuuacuuuaugagggcaagcuauuguucuuggagcaucaucuucuuuaauuuuucuuggcuucauucuuauugaaaaaaaaagagagagagaaagagagagagagagagagaaagagacagauuuguaggagugggucacacucaguaagcauaaaucaaaucgucccugagguuuucccuuguagcaccaacacuaagcuccugguguuccccuucuacaacggagaaaggaccaagcugcccagacugcucaacugcgagcucucuucuagcuucuaaguaaaagugcuggugcuuggaaagccugccucgcucgcugccucuggcaaagcugguauggcuuggaacugcaccaccagcaccauuaucauauaugacucaaacaccuccucgucccacuuaccccuguuaaauaaaaacuaacaaccccacaaagaucaucagcccugacaacugcacauuaauuauuuuguugggguaaggcaacaaaaaucagcugcucaaaaauauauaacaucuuaaaaaaacacaguaacaaacaaccacacacauacaaaaugggcccacaucauacagacacaaaccaucuuugggaaauauuaauuuuggaaguacacauuauacuuuuauacagagucauuuauacccauguaauaaaaacucucaaaggaaaccacaaacgggcacuggcuacuacuacuggcugauggacaggcagaauugccuuguuuguuuuuuucaagacaggguuucucuguguagcccuggcugccuuuaaacucccucuuucaaccaggcuguccuugaacucaaagagaucugcaggccuccacuucccaagugcugggaucaaacaggugcacugacacugagcggaaggcaucuccugcugguguuuuggugguuagagggagaugacaguuuuuauaggauguuucauuuuacuuuguuuuugagacaggguuuugucaccaccgcuaguuuuauuucugguuguagcuugucaacugagaaccagucuaucuucuacuuccuccagcaaccuuggucuuucugaaagauuucuuuccuagcauuccuuacaaacuugcguaugaucaaggagcaagaaaacugugcucuagaaaacuaugauuuaauuuaauuuaauuucaaaaacaucuuuguagcccuaguuggacugccucacacuccugcaugaagcuugcuggcuaaacuguaacuaagccaauggucccucuuagcaacaauguaccaaaaaugacuuaugacaucucucaguagguuacucuguccacccaaacccaggacagaguaucuggauccuccuuacacugccaagcuagcaaccucccaugucuaaaaacagggagaacuucuacaaugccugaugaccaaucucuucccaauuccaacccugcagacacacuuuagauuacuaguauuccaguuagcaagcauuacuuaagugucugcuguuuacagguuuuuaacgagccuguuguucucaaaagccugucucuacuuauaauucauacuagucucuuacaugucagugaguuugaaguuugggguucaguucagaguagcaggaagcaacuggugcuacugcaccaccuagaggucagaucagcaugaaucagcagcaauucaugaaugcuucuauuucuuucaaaucuuuuuccucccucccgaagacaguguuucuaugugacauugcccuggccauccuggaacuugcucuguagaccaggcugcccuggcacucagagagccuccuguccugucucucugccucaugagugcugggauuaaaagcauaugccaccacugcucagcuuucuuuccagucuuaauaagaugucuuugaaauagguucuuaccauauaccccauacuagcccugaacuugcgaucuuauuuccauaugcuaagugcuggugacagaucuauguggccacucccaaacuaguuaucauuuuagaaauugugugcuaauauucaguauuaauuuuagaacgaaaauuuaccaggcauuugggcaaaccuaagacuucaucaauggaagacacaacuguccauaacaagauuggcucuucucucagaagcuacgcaaaagaaaaaugaaggggucauucccaccccaccccagcaucaagaaacacugcuugcguuucucucauugacugggauacuuuacagacccagacacgaugaggacaaaugacaagauggauauaugacuuggaguugacuucuacuaucuuuaugaccuugagcaaaucacuaacuucucagccucgguuucuuacucuguaagcaggcacgacccuucuuuuaucagagcugcaaggaguccaagacagcacaccagaccccugagcaaugaguuacuaucaucacuggucauaugguuagaaaugaaacucauccuuuugcuucuuugaucuuugagagaggguccaaaccaaguaucgcagauuggccaggagccugacaaccguguggcucggccucuggcaugauaaggaagaacuguaagcgccaacuaccuaccacacucaauaaacugaauucauucuuuaaaauuguauuauuuaugcuuaacaacccguaagguucugauauucuaaauuaucuuucaaccaaaaaacccuaagauacugaaaggaaaaagacaagcauaaagccacccucaacagcuuuuuacucuacuugcuacucaguuuuauuaaacuggagggcauguugaaagacacgcugcuuaaacugacauuaccuccaacucauccugucacauguggaaggagcaccaccacaaagacugaacuccacaagucacaucugcagcaucuucccaacaguuuuagcagagcccuggauguagcaaagaugagucuucuggcaguaagcuaggaaguacaagucuccccaguacaauaaacuuagaaccaggauguaggaccucagcugcugagacaguccauuaucacucagcuaucaucugccagcaucaaggucucauuauggagcccaggguggccuugaacuggcaauccuucugccucggccucucaagugcuggaauuacagguaguuguucacuuaccacacccagcagccuacaggauaucacaguccagcuuuaaggaaauauacaauaaagaacugccuagcuaaaauuaggagacauaaauuacucaccaggcccuagucucugaacacaguuuuucaaaaacagacaacucaguaaaauacccccaccuccccucuguggucccaccucaaaacucagaacccuuguuuucagggguggugucaggucaagacaggcuuucacugugucuagcuauccuggaaaccccucagaagaccaggcuggccucaaacucacagggaaccucuguccccugacagcuggaauuacuggcaugagccaccaccaccugauauuauuauuauuauuuuuugagacagcacucauguaucccagguccagcuucaaacacacuaugcagcuaagguugacuaugugccucuccugagcacuacuggauagacacacagcacuugacuuacauguaagccuaggguuuccugcauacaagacaagcacuucugaaaaccaagcaauccgacccuccagcuuuaaagacagaacuuccaaauaaaauucauuacuuuuuuuucuuuuuaaacuuaugucuauguuaagcagucuaaacagaggguggcaguuuaagacauucuugucuucaagucuaggccagcacacccauacugccaaggauagaacagagagaaacauaugaacucucaggcauaagcuaagaccucggggcucaagcguugcucuucaaucacaggacaaagucaggccugaauaagcuuugccauaacugguagagaucauauggucugauccacaacagugaaacauggugccucuacuugauauuuuauugugggaaucccagucaaaggccccugaagaccccacuccaagacaauacagucucacaauauggagauuugaaaacagcaaggcauacagguucuggcauuucucuaccaccaauaaaguccauguaggucaacaugaucuuuaagggaucuaauucuacaugggacuggaguccaauccucaacaccuuggugccacacuucccuauuuuuacauucuaacaaacugagcaagauaacacccaauucuaacauagaaugagaguccucagagcugauuguaaaaggaaagaccaugugggcugggcuccaguucagcagcacugccaaacaugcacaaggcucugggcuccaaaaagacuugucacagugaauguuccucuucaaacauugcugcacugucuucucaucacuugccguggccauggcauucaugacaucauucucuguaaguggccuucucccugguuucuuuauccuuggugcucugagauaucaucggggcagggagagucaaaacaaugccaagagccaucacaucugaguuguccugcucacaaccuguagcuucccucucucuuuagucuuuuccaguccucuaucugccacugcaccagugcugcaauguguaacagagauucucuuuuucgcucuccugguugguguuccagaagguucuucaucgguagccaggcugccucaccuccccaagucucuacuucaaauaauucucuucugccuucucugcuuccucuuacucuccaaacacaaggguuuccccaaaacuccccaucuuagaacuucuauaagaucuugauuuuagcaugacuuccuucuaacuucuuccuaaaaacaucaagucuauaugaguuuaugauguaaucagguggauauugguggccuuuugucuuccuuaaccagacacacaaaaaacauucuuuaccucuugucaucucuaaugucuacucuaucuacccuacucuucuagcuugagccuucuauuugaagcuuucucccguacacaaagggaucgacccaucuuggauucugcuauaaaguaauccucuccaacuaacaaaacucuuccucccuacucacgucucuagcagcugcucuccacaaaaaguccacacaucuuuugccagcauucauggaccuaaauaaccggauucaaauuuaccuugauuacauucauuuucuuuaagcaccccaauucccagcauaacuguacaucauuuguauuuucuguagaaaaugugcacgcccugaaacacggaagccuguuucuuauuuaucaaaacacuagguucaagccagguauggaguuacacaccuauacucccaggacuugggagguugaggcaagauuuugagaucaaggucauagugggcuacagugagacugucuuaaaacucuaggcucaucaaggcguacaucagccaccaacaugucuacaacauacugcagacaucacuacccaucucuguguccuuauccaauucuaagcagcaaggaagagccgguuaacuuuagggauuugauucaguaugcccccaaaacauaccuccugccaaacugguagguacauuacaaauguaaucuccguuuguagcuuuuggggggggggugcuuaauacaucauucacauaauuguaccugaaauauaacuggaacauaacaaaaucuggagaacaguguuauuaacagacacacuguugcuaagccaugacaaaugaaacaaauggcucugcuccaccucaggcaaggaaggcagacgauacacuauuagcaauuccaccuuauugaagauguuacauuuuuguacaccuccuacccccaccauguccucauaaaaaaugaccacaacacuaaaaacuaauauaaacagcagagacuucuauaggaccccagccuauuucaggcaaaacaaauacacagguaucaauaaaugcagguauugacugcucagaacagaucucagccugggaggccacagaagucccaccagucagcuuaacaccaggagcuacuacacucaucacaccaaaucaugaaccgcugaaaauuccuucugugguuaaaguguccagauuaaaccuggacacauuguaacaaagagauacaaaggugaugugacacucccaggcaacaccagcuguagaaccagagagcaucugccucaucucacaaucugcaaacaucuaaaaugcugcccuucacacaucaacagcacagcuaucaccaaaaccguuugcuuuuguuuucagaguugucccuagagaaagaauauaaaccaccacugucaugugggaacaacaaaauacagcuggaaagauucaggcacuuccuagucuagaaagaaagguucuugcaacuuaccuggcaaauucugccaguugcuuagggucugagaggucaaugccagguaucccuccaggagggaguuucuugccugucauauauucagaauaaucaggaggugaguucucuccaaugaucugcucuucaaccacuguuucauggucaauaucuuuuuuuucaucugaaacacaugagauugaucaucuuaacuauauaaacacauugaguaaaauaaaagcuuuucaguggaauccucauaaguaacuauuuauggcuccuacuuuuaauucucaaccauuuacuguguguccucaauccuuuggaacuccuaagucacccaaaccuucaaagucaagagcagcagaccuuccuucacauuaguggucaguuagccuagcagaagcagcuagcucucucugaguguacugucauacauucuccagguuuaccccugucuaacuggcuucucucaguuugccuuuuacccauuucacaaacuaguacaugaaaggaguaagagcauucuucuuccaaggcaugcaaucaccacaagucacuccaagaggaaagcaaaggagacacaaaaccaaacgccucucuaaucuuccaucacuguauuuuuaagaacaaguuuuauuuuguuuaagaacauuuuauuugaggggcaguggugcugcacacuuuuaauccuaauacucgggagucagaggcaggcagaucucuguguucaagaccaaccugaacacaaaccuggucuacaaagcaaguucuauggcagccaggacuacaaagagaaaccugucucaaaaaaccaaaaccaaaccaaacccauucacuuuauuuuuauugcguggccugugcaugugagugugggugccaaggccgaggacaccuggggagguuccuucccuucauacuccccagcugcugggccucacucccuuccucccucuauucuucuuuacuuuggucuauauuaggcuagccucaaucuccugccuccaccucccaaguacugugaucacaggugugaaacagcuuuauucuagaauauaauguaaaucuacauuaggacucugacguaaguaacaguagguccagguccauuuuacccaguguuuauauacagcaucacuuucaucguuacacacuccccaccaagugagggaauuaccacacacucugauuuuacagagaagaaauucaggugugcaaaaauuaagcaauuuaucuggggcuaacuauuaaguuguagauauaaacuuaaaaaaaaguuauuuuguaaacaaaaauucagggacccaagggcaagauguacaugaagauagaggacaacucagacugccuuccuuccuguacauaugaccuagcagggagcucagguuuuucaguuuaccuauugagcccaucuugcugacaaccuggcaaacccuccaccccuuaagaaaaggacauaccaaaaaugaaacauuuccaggcacuaauugcgcacgccuuuaaucccagcacucgggaggcagaggcaggcggauuucugaguccaaggcuagccuggucuauggagugaguuccaagacagccagggcuacacagagaaacccugucgaaacaccaccaccaccaaaaccaaaaccaagagagagagagagagagagagagagagagagagaaagaaagauuuuuauuuauugguuguaaacaagcacaagugucucuuaggaaguaggaagaccacaacaauaggaagaccacaacaauacauccaugcacugauaaagauacauuucuauggauggaugagcagguguaaaaaggcugacuggcuguaucaauuaaaacaucaacugggacuccacacuggcacauacaaguucacagccugcucuguaccuauuagcaacguuagucucucaccauacaguagcacaccaaaaccuaaccuuacagagacacaaauguagcagggaagcuacauuuccgcuccacuuuccccagccccaacacucugaauggagcucaguggaucaaguguucaucuagcaugagcccugaguucagucuucaguaccacacagccugcaucugaugccacaaguauauaaaucagaaccugggagguguuugggggagggaguucaaggucauucaacuacaaagcaaauuuggagccagccagggaauacaccagugagaacucucagccuaaacuaacucuuguauuaguuccaagugaagauagaugccugucacuggugacaguggccagaaacaauacagacucuacccucagggagcacacuuacuucuagagagggaaguuaaaugacgaaaacacuucuaucgagucacaccuccagcccagagaacacugguuuuuguuuuuuguuuuuugagacucaguucuuacuauacucaagaguauaauaaagaacccaaaagaaaggcuggggagggagcuggugagcuggccggugguuaagagcaccaacugcucuucugaagguuccauccuaaaguucaaaucccagcaaccacaugguggcucacaaccauccauaacgagaucugaugcccucuucuggaaugucugaacagcuacagugcacucacauauaauacauaaaucaaucaaucaaucaaucaaucaaucuaagaaaagaaagaaaaagaagaggaaagaaaagaaaaaagaaaggaaaggaaaggaaaggaaaggaaaggaaaggaaaggaaaggaaaggaaagaaaagaaaagaaaaggaaaaaaauagaaaggccggggaaacaggaauaaaaugcuuguucuacaagucugaguuuguucuccagcacccauguaaaaacaaaggcaggguagcauguggaaccccagcucuggggaagcagaaaagaugacgauuccuggggcucaccugaaaugggucuaacauacuugcugagauccaagucccaguucaaggcugucaagaaucaaggugggacuaggugggguggaacauaccuuuuaucccagcacucaagaggcagaugaagaucaagcugugagucuggggccagccuggucuacauaugagacuuuguuuuaaacucaaagcagugauuaaggagcuggagagcugccgcucagagguuacuaaccuguacucuugcagaggaccuggaguugaguuccacccccaauggcucacaaucaccugcuaacuccagcucccccacaucagaugcccucuuuuggacccagcugacaccugcgccuacguugugcguacauaccugcauguaaaaacuaagaaucuuuuuaaaaaagugccccacuucuauaaacagaagguuuuuuuguuuuguuuuguuuuuaaacaauccuuuccacuuccucagggguccuguauggcuacuuuucugaugcaaggucagguggaucugauuggcucuaacagagcauaaacccacaaaaacugucauugccuggcccuucagacacuugaccuacaugauaagauuuuauucagagaaaagaggauuaaagugauacauuuucuacuugcaaagggaauaauuucugagaaauaugauuuaguaccaaacgaauaaauuuccagaagauccuuacaaaacugaagauuucguuuagaggacuaaaccaguuuguuaaccaguuacauuucuuggaggaugguggugucacuugcugaguuagccaaguggggaagagaugaugagaaggggguaggggaagaaaucuagcuucucuuugcuuugagauguccaugccggcugucagaagcaaggacagggaauaaaaaggaaucuacacuggagagaauagugccagucauuggcacacagacuucauuuauagccacagaaacaaagaacacacccacugaaaauggagaaggguccuagagccacccccuaauuccaacaauggaaaaacaaaaauuugcaaaggagaucaaacagcuaggaagggcgaaagacacaguggaagccuaaagcaggagugcauggccuguauugccuuauggccuguacuacaucuuaugcugugaaccgaaguugggucuucugccagagcaguaagugcuccuaauugcuaagcugccaucucuccagucccuuguucugucccuuaccacccccacccccaucagacucuuauuaugcgguccaugcuggccugcucuauauuccuccagcccccaccuugaagugcuaggauugguuacagggacacacacacacacacacacacacacacacacacaucacauacaaccuuuugcauuggcuauuauuacagucuucuaaucucauaauacugaaaaccaaaguacgaaaaaauguaagcugaucuacuuugaaugucaaauacaauguugauuucugcaaacgacaacaggugauagcguacacaaaccaaugcaaauuauguucaggaaguaaaugaacuaaugcugguuuaaaaauuaaugcacaagauuaagaggacauguccaaucuuuugagaccaacuuacaaauguguuaggccaguucacugcaauaguaggauauauauauauauauauauauguauauauauauauauauaguccucaggcugaaggucgggcaugccuauuagugguucauugcuugagucuccuuuuuuagacaaaguuggcaugggaccagaugugacaggguaauagaccacagccuauuuggaaaggcuaagacccuaagacacugacugaaaaggaaugcaguggcaagagugccuuguugagaauggcaggcuaaaacugcccguccuguauuucuacaccaacauuauggccagauacagaugacccagaacuaccagagcagagcuaagcgcccaagauacagcuguggaagaaaccaaguccagccaacagcaucugggagggggaggcugagccauucauccacauuccacacucccuguacaugauacuacuccaaaaucagaaagcuauguagacuagucccuccugaugguauucaauccccuuaccaaggaugaccuuuccagucugaugagaaguaaaccaagggacugaaaacaaccucuaguuacuaaguccucacuaaaaccauuacacccaaaggcugagagcucucaaggucuaccagucaaaagggaguuucuucuacccaauguguaccaaccaaacaggcuuucucacaguucuuuuuuggugccugauauagggcauguaauaaacuuuccucucccugccucuucucaugaucauuucuccuccaacacuagaaugaaaucuauuucccaaggccuuugguucuuacaauacauccaccacucauagcuuuuuaguuucuucacccauuaaaaaauaagaaccuacuuuacaagauugguagcauguuaaaaugcuaaucauucuaucuggaaugugaugggaguugaauacaaaauauuuuugggagggagagacaagaguuucacuauguagcucuggcugucuuggaacucaguagaccaggguuguccuugaacgcaccaagaucccucugccucccaagugcugcugggauuaaaggugugugccacuauucucagcacagauucuggcuucucuuuuccucccuccugauuaaggccucagauuuuggggaugagcacauuuugcaccguguaacagaucugacaggcaucugcagucaaaugugcauacccaguagacuccuccaaugguggcuuauaguccuggagaucaguuauagucacuaugaggauuuucccucuugaggcuggggguuggggguaaggggcuaccacauuccuuggcucaugaccccuacacaaucacaauucauaacggcuugcuuccuaaucaccuccuggcugaggcuccucucccucugacuccuucaagugauuacaaggacacuggugugauuauauuuagggcccaucuagauaauccaagauccucucccugccucucaagggccuuaauaagagguauaaauaaagcaacaauaagauuccaggaauuauacuuggugauauuuuucagcacagcacaacauacucacauaaagacuuuaagcugaagauuuaacauauggaacccuuaguuccaucccagaacaaccucuaccacaaucaccaaaccuucaaguacaauuucaaagguaaaacuuucacucacaugcaaccucacucucaaauuauuguauuuuacagaaucuaaaucuuuccuucaguuuguaccucugaagccagaacaucaaucaacaaccuaaugaaaugagguauucuccaccaggcuuaaugguucuaaagaaugcugagcucaacagucauagcaagucuaucaagaagauggaagagcagggcaugguggcugacaccuuugauccuaggcagagacaggaggauaucucaguucaaggcuagcauugucugcagagcaaguuccaggacagccagagaaacccugucuugaaaaacaaaaacaaaaacaaaaacaaaaaagaugggaaaucagaaaacuucaacuagagaauauuucaaguuuuacacuuuuuagacaucacuagcagauccaagauccaaugacaacauucuggcagaaacaagguuuuccuuuuuaauuuguguacauguguuuguccugggagaacagugccaugucacuggaauggaagucagaggagaauaacucugaggagucaacccuuaccuucaaccuucaguggaacugaauacagcuuaccagacuugcaucauuaggcagaaagugccuucugcccaaagccaucuggucugcccuaacacaacgugaagacuauagacaugacuauauugaggacuccccuucauguaagacagcuuuuccuguacaguacuggggucaaauccaaggccugagcucauacuugacaagcaacugacuccuuggcuauaaccugcguggggcaccacucauucuucuuaaauauuuacuuccacuuuauguugucagugugagugccuguacaugcauauacaaugcccuugggaccagaagaaagcaacagaucucuggaacuuggguuaaaaguuacagaucuauuaguacuaggaauugaacccaugucuucugcaagagcacgcaguguuaacugcuacacccaucuucucaaacuccauuuuucuuuccuuuugaaauaaaauuaggggcuguuaaacguuuauuauugacuuaaaacagauuuagaggagaaaguaaaagaaaugcuuagaaaaaggcuuauuauauacagcaagacacgaauauggguuucucaaaauauuuuuuuuccuucuuaaaaaaggcaggcuucuuggggcccagagagauggcucaguauuaaaggaaagcacuuguguccaaggccaacaacuugaguuggaucccuggaacugacaugguagaaagaaccaacuucuaaaagcuguccucugaacuccacaugcacaugauccuccugucauaaggcuacccaugcuaaagucauagucaaagcccacuuucuuaguuuuuucaucuugguauuaagucaggacaguguaauuuccauuuucaucuucacugccaggaaggaagcucauuaagaguugacuccaaugauucugcuucuauuuucuccauuuacauauucaccuacucauguaagcauccuccuaucucuauaggccauugugguuucauuuugaucaagagacaucaucuacagcacugacacacacacacacacacacacacauacacacacagaaauggcaguguucccuagucaggaacaacuugcccacaaagaaacuacacuuaacaucucccuaccauuuccuaguaacuuaauaaaacuaauguuuuuaauauccaaauccuguuuuagguauccaauuuuaaaaguaguuuuggauggauguguguaggaaacagcacccagaaagcugacaaaggaauacuaccugaauauaaaugaggccagucugagcuaccuaucucacaaguacugcucaucugggaggggagggaagggacugggaggggggacggaggagaugguuugguaaguaagacucaaguucagaguucagcucccauguuaaauucaaagcugggagaggggugagaagaaacaggacauacaacauccuuauuugaccucuccaagcccucguacacagcacaacacacacacacacacacagaggggggggggacuguaaaguauuuuuucugauaaaacuauaaacuguaaggcacguuucugauaaaacuauaaagguucuacuuuuuuuuaacucuuccuauuucaauaauucuuauucaaagcaggagcaagaauagagucaucugaacaagaggagggguuaagccgggcgugguggcgcauaucuuuaaucccagcacuugggaggcagaggcaggcggaucucugaguucaaggccagccuggucuacagagggaguuccaggacagccagggcuacacagagaaacccugucucaaaaaaccaaaaaucgaaaaacaaaaaacaaacaaaaaauuuaugauuguggucuaucuaccuugugauuacagacuuuaccacagaacugaaaauggccaucacugacaagccuugaguuuuucugaauguguagaauaaggaaaaauguaacaaugugguuuuauuucaacuuuuuucuagugucacauguuuuuacucaauugaccacacaucagguuuaacaggggauaauuaaagccaccuaaguuucucucaaagcuggaugcuuacaguaugugauuuccuuuauuauuaguuauauaaaaauaaauucacucauaugauucugauaacuauuuccaagaaauacagcucugucaauaaugaaaggaaaaccuaaacaucaauuugaaaauagcuacaaauauucaaaacacuggcaaacuguuaaguauugaaaauguuuaggcuuuaauuuuauccacaaaaguaauuauauuauggguuaucauucagccacaaaaaaauggauuaacaugcuaauccagauacaaaagggcaaauauuuucugauucuuuaugcauagugucugggauaggagaacugggauagacuagugggaagaggaggacugagaagugacugcucauaggucugugacgccaagauagugauaugauuauaauaccaauuugggacacaauguuagacccuuacuuccaaaaacaaaacaaaacauaaaguggcagguugugguggcacaccccuuuaaucccagcacugggagagccaggggcugguagaucucugugaguuugagaccagcccagucuauguaagugaguucaaggccuacauggaaagauaaggucucaaaaagcaaacaaaccaaaaaagaaccgauaaucauucauuguguguaagauucuuaagcgauuguaaugucccaucuugcaugaaacuccuuuaagcaggaaaauaacucaaaauagauucaggaagucccugaaacugaucagacucucuagguuccuccuuaccagaauaaacaauaaaaacugagacuucaacagaaggaagcugagcuacaaagacuuucagaccagacuaucauccuggaagagguuuagaccaacugaggcaaagggcacuaugcuucucguuuucagccugugagccucaccugugcuaggugggcuuugguaacgaaugucuuugagucauuucugcuccuguaagugaccccuaacuuauaggccuaaaaguaacccaauuaaacucauugguucaccagguugaacuuugguggcuaagcauauuuuaaucuguuguggguucccuaucugaggugaguaaacuugucuugcaucuccccaggagaaaucuugucacauaccaucauugcagcaucucauaaacuaccaacuaugaaaaacaagaaggggaaaaagaagcaggcuucuaagucuauaaugguuacaguacuuugcuacuguuucauucaaacuaugacccccacacagaaugcugucacuguucagaggacaacaagcacaaaaacaaagagaccuacaaacccaaguaucugguuucuacaaauuucuacuaaaaugugcuagcaacaacaaaccuccuagagagguacaaauaacuagugucuuaagaugacucaacauuguugcugugcuaugcugucuucuaucuuuuauuuuauacucaggaaacagagacaggcugagcucuucaggccagccuggucuguagcuugaguuccaggacagucaggaacauaggaaaacccugucuggaaaaacaacaaaaaacuacccacauauacuaucuuuauaagaacugcuaaguuugaggcuuauguaaaucuguggcauccuaguuuaauuaaucuaaugcacuaauuuaauaaacuuauauauacuguggaguugcaacucaagccugggaucaagugaagucuauuccuaccacagcaacauacaagacacauuuacacuuaacuuagcuaaucuguuuauauuucuucacuuauugcagucuuaauuuaguucugaagauuaaauuauuugcagaaucugaacuugagacacacauaguuaguugaccacaccacuuagcuucuuuuugguaauaagugcaagccacaaaggcaaggaagauggaucauuuaccacaagacauuucugaggaaauaggccaucccuugcucuugacaucaaauauugauaagcaccauuuuugcagacuacucaguaacacacuagacaauuaaggguuugaagaaauagcuaccaaaaugcccccaagcugcucuacgugcccuuguaagcaagcagccagucacacaaguaaagacuaaaugccaacuaaauugucaauuaacccaccuuagccaggcccuucacuuucuccccugaacuaaacauacacgauucaucaacaccacacuugacgaaguguuuuucugucuagaaaagcaaacuaacaacuugguaagaucuaaugucaaacaucugaaucaagcuauuuuauaacguaaguuuuuuauauaguuaaugaacucgguacuccaaaugugguaaauucauccaaaguucgaaaccugcuuuccuuaauuucacucuuauuaaaagugaaaaaaacaagcuuuuaaagaucucagcaugcaaacuaccguuagcaaccaaaaaaauguguugaaggcacuggauaacuuuuagggacuggcuaguuacauagcauacagcuccugauaaccuaccgugcagauaauaaccagggauucauucagcgaggaacagcgcccugagcacuuccuauuagauuucuauaggacgcucuucuccuuccugaaccacagacccaucaagcuuacgucacuuggauacuaccauagauuagcuuuucaucuauuucacucguuucccaaaauuuuaacauuuuaauaaacuacacaucaaggcucaaguuaugcuuucaaauucaucaaauuuaaucacuagggcuacaugaacuagguauggugagauuauucugucuaguaguaguuucuuaacaauaaagcugacuagcuuguuaacacaguacuaggauaaagugaacagucaacaacagccuuuccagggcucuaccuugaguuuacucaugcggggaaggaacucuucggugcccuacacaggcuuccugacuuucgcuaaaaggcguauuaaaucaguaaaacaaauuauccacuuuuuuuauucuuuucgugggggaaaacaagaccagagauacugauaacuaagcgauuuuuauuaguuuguuggcaaauauccuaagcuguguaaaccagcccagucugucugcauagggcccacgacuuaaaaaacaaaauucacaacgcguaaaggccgcugaaaugcuguggcucuuccuuccccuaacucccguucuaggucgaucaggcgaggagcgcguuggcagcgcgggugacagguuccaacggccgccgaacccgcacacgagcgcccuacgugccacccaagucccgccccgcagcggcgacggccugggccagcgugaccgcggggcagcugcggcggggcuaugcgccgcccgcuccgggaagggcuucggggagacgcuucgcguccgagggggccgagcugagcggagccgagcggggcggggccccgacagcccccgggggacggcgggggagcggcgcgcguccgcccugcgccacggcccugucaacgcccggcgggugguccggcgcggggcggcgcccucaaccggccccgccgcacguccguuggcucgggcguggaggggcgcuggccccucccuccccgcccgccgccccagcccgcuuccgcucgcacaaacuacgccauugcggccuagccgggcgccgccccucccccgcgccgccaucuucgcggcccgccgcccccgccaucuuuuggggccgccauacuugcccgggcggagaagauggcggcgcccaucacacacauaaaacauggcuucccuucaaaacaaaaacaucccgagcggcggcgcgccgccugcacucacccgaggaccacauggugaccgagaacucgcccuccagggucuugaucugcaccugcuucugcucccacuucuuauuccccgggucggcgccgccgccgcccgccgcgccggccccgccgcccagguaacucuucuugccgcucuucuugccgccgcccuucuucacgcgaccgccgcccgacgaggccccgccgccgcucuugccggccgccgccacggugaccagcgucugcucuauguagucgucgucgccgccggccggcgcgggcaccgggaugaggaucugguccucgaagccguccucggcgcgcagcccguccgagucguccccgccgaccaccuccucgcgcgucugcaccaggaucaccuccuggugguggugcacuugggucgggucguccgucaccagcggcugcagcgcgaucaugggcgggugguggugguggugguggugguggugauggugguggccggcgugcccguggccgcccccgccgccgccguggucgccgccgccgccguccucgucgucgucguccuccuccuccuccucgcccaccaccguggucucgauggucuccaccgggauggucuccaccucgaucucaugcagcuccacgaucucggccggcaucuccgagccguccguggcgauguagagggugucgcccgaggccauggcugagggcuccgccgccacggccgccgcggcaggcggccucggcuccugggcugcgggagggagggcgggcgggcgaggaggcggccggccguggggaaggaaggcagagggaggaaggcagcgggcgggcggggggagagggggcgggcggcgggggaaggggcgggcgcggcggccgcggggcuuccccgccucccgagaucggugcgccccgcgcuggcucgcucgcucgcucggccgcugccuguccugcuuccccgccugccuucgccucgccucggcugccugcccuggcuguggccgcgccuccucccgcccuccgggccggcguuacgcugcccccugccuccugcgccuccgccuccuuccacacaaauaccaacuccucaaccccgagcccagaucucgccgccgccgccgccgccacacucugcuccggcucg

SEQ ID NO: 6822 - RNA, 3960 nt, Mus musculus
caguacggccggccaggcaugguggcacacaccaucagucccagcacucacagggcagaagaagguagaucucugccgcagccuagucuguucucagcucugccucaauaaacaaaccggcacucccggaagcugagggagaaggaaacucaagcauggaaacugccugcucagcccgacgcucagauagaggagcaucuucuacaguaacugaccacagcuucacugaucaugacuguaaagaaguaccacaggacucugcuucugcagcaacgugcuggugagaaacacagaaaaaggaaauaggaaagccugcaagcuuucaccuaaugaaggggaucaaagacuaacaaacucccaaacaccaaaaccaaaagcccaaacuuccaaucuacccaaccugagcucccugcagugugcaagugggugagguagggguggguggggcugagaugcagcacuguugugaguggagcugucugggaccauaugguaagcuaaccugcgugcguccugcuucucccaagcucaccuugcucuugaucugcuuggccgugucagugaggaagauggaggaguuggggucacuggcacucaucuuggucugagcgcccugcagggcagggaagaaggucgagugcagcagggcagguuuaggauggccgauccugggggccacgucccuugucauucugaaguacggauccuggucaauggcacacgggaugaggcacuggauaucuguccugucucggaagaucuucgggaaagaguugcugaacgauggcgcggccuggacagcaggaaaacugaucuucccugaaagaggggagacacucgugugugcugggccgaccuacugcucuggggaaugaauccaguuaaggcagucagcaaugguuuuccuccccccuggaaaaacuaaagaaggccacaaaacacagaaaaggagguaaagccuagcccucuccaagucccaucuucauggcgauggucggugugcucagcuguguccacaccaugcauggcuguggaacauauucuccuucaauguaucaggcugucauggccaccagugucaccacaguggucauucccaggagcucgcuacucuucacaacuccauagcaaggcaccuccuuccuucuuacaaaugugaauuuaggcucaggguguuucuguggacagugcacagcaugggaugcaccgagugaggacugaagucggcgccaggcaggcagggcagugacucuucacaagacaccgcuccuggacugcucaccucaacuguggaucacccugauggcaggacuccagugucacguaugucucaagagcaugaagaucacgcuucacuugcugggaaugaaucugacugagcuauccaagaggaggggaggggacaggagcaggcaagcacagacaacagaggccucucucaagucucaaagagaugauggccuacaaaggccaacgcauuggaaugacagagacacguagaggacauaaccaugguuuacaguuggcaaauacuguauguaucagugugugugugagaccgugggaggacaguacagagggguaggaggggccugcaguuagucaaaauccuucucucucucucucucuguauguauguauguauguaucuauccauccaucuaucucagaacucauuauauagaucaggcuggccucaaaaucagagaucugcccacuuggcuuugggugcuaggauuaaaggagucuaucaccauacccagcuaaagauucuuagaacuggagaaccuggggcccagcgaacacucccacgagagagcagcugauacaccuguccucccaucacucuccugggcccuaccaagcucuguagugauuggggucacaccagcacauuggagaauuccagucagucuuaugucugucugucugagucugguggaauacccaccucuggauguuuuauaugaagugcuagcaucucaggucucugagcaggcgcguuaccagagacacuugggcugggcaugaggcucagugguagcauuugcuauaugcaugaaucuauccuuggaaugcacgccuaucugcacacaccauguacguuagcccacuagcucaggcucuggcguugccgcacugugcuggcuagcuuccucugagcucugccugcugcccucggagggguccucuuaccgaugcagucacuguccguaaagccgaaaaugccuuucacuugguugaaggugacgugcuucugaaucuucaccacguuccuguagaagcccgggcucugccugcagagacaagcagagacacacccgagaugaaaggcagcggggcuaaagcugggcagcagagaggcgcggugccagaaacacacuggguaccacacguguccaggccccggauaacaggaacauacggagaggucaucuguaggccuacaacuacagcagccccgccucuagccagugcugggaagagcuguggaagggucagaacagagguaggcacagagggcagagcugacagaacguccacaucucagcaugcugugugcaucucacacaagaagccccacaacugucugcugacaugacagugugugggaagacacaugugcccagcuggaaugcucuggaaccgaugggugcggcagagggugugcccugugcaggugcuccuggaguggugcucuguucuuuggucagggcuggcaccaugcucagccacaggauggaccauacuguuuggugugagggucauggacaugaugcuuagauccguggcagcuguucugacaccagaggaacagcaggcugcaacagagcauggaaaugagcagaauccagagugcugccuucuuuuuuaguuuuauuuaugagugcacugccugcauguauguauguauguguaccauguacaugcugagugacuacagaauccagaagccucugagacaugucccuagcccccaccucugguggcaccuuagacuggacuuguugacagcacugcuuucuucagccuaguccuuugcuaggcacuggaaacacagaaaggggggaaguguggacugaaugcagggucuggcaggagcuaugcuagaggcugaugaaguggaaacuuaacauucuuuguaaaguugguuagaugguguuuugcuggggcaaacacaugaaggaauguuucguuaaaguggacacaaguggagcgcuaaggcagacuggugaaggagguuucacugaagcagacacaggagaaaggauguucugcuaaagcaagcacguggaaggacaugcgaugaauucuuugcuaaugccaggcauguauugguuugucuuuugguuugucuuauaucucauaguugagcugcguuugucagauuccauacagagaaacagaacaaagacuucuggugguaugcugcaguuucuugccacuucccaggacucgggcgauuagaugcacaugcugaggcgaugcacugggggacaugugauauuuggaggguauaaguaaaacucaacggagugaaagaaacagagcuugccuuggugguacagcugggcaacgcuuguagguuucaagucuucacugaucuuugcuuuccugagagaggcauagcugagaacgucuucugguguuccugcaggcugaggccugacugucucugcuaggucgacucacugcuguugcuaucccgacucuaccaaacugcacugcugguguaucugugaaguguuugccaguggaucgagcugucgaugcugaccugugaacugaacugcugguuuccaggcaacacagaugggaguugcuccaaagaaccuuccuaaacagguccacuuccccuguauccuuucuucuccaguacuucuggugggugguggguaacaagggagguuaaaggcuuuaaguaccaucauuaaaaauaggauuugaaaaaaauuaaag

SEQ ID NO: 6823 - RNA, 3960 nt, Mus musculus
cuuuaauuuuuuucaaauccuauuuuuaaugaugguacuuaaagccuuuaaccucccuuguuacccaccacccaccagaaguacuggagaagaaaggauacaggggaaguggaccuguuuaggaagguucuuuggagcaacucccaucuguguugccuggaaaccagcaguucaguucacaggucagcaucgacagcucgauccacuggcaaacacuucacagauacaccagcagugcaguuugguagagucgggauagcaacagcagugagucgaccuagcagagacagucaggccucagccugcaggaacaccagaagacguucucagcuaugccucucucaggaaagcaaagaucagugaagacuugaaaccuacaagcguugcccagcuguaccaccaaggcaagcucuguuucuuucacuccguugaguuuuacuuauacccuccaaauaucacaugucccccagugcaucgccucagcaugugcaucuaaucgcccgaguccugggaaguggcaagaaacugcagcauaccaccagaagucuuuguucuguuucucuguauggaaucugacaaacgcagcucaacuaugagauauaagacaaaccaaaagacaaaccaauacaugccuggcauuagcaaagaauucaucgcauguccuuccacgugcuugcuuuagcagaacauccuuucuccugugucugcuucagugaaaccuccuucaccagucugccuuagcgcuccacuuguguccacuuuaacgaaacauuccuucauguguuugccccagcaaaacaccaucuaaccaacuuuacaaagaauguuaaguuuccacuucaucagccucuagcauagcuccugccagacccugcauucaguccacacuuccccccuuucuguguuuccagugccuagcaaaggacuaggcugaagaaagcagugcugucaacaaguccagucuaaggugccaccagaggugggggcuagggacaugucucagaggcuucuggauucuguagucacucagcauguacaugguacacauacauacauacaugcaggcagugcacucauaaauaaaacuaaaaaagaaggcagcacucuggauucugcucauuuccaugcucuguugcagccugcuguuccucuggugucagaacagcugccacggaucuaagcaucauguccaugacccucacaccaaacaguaugguccauccuguggcugagcauggugccagcccugaccaaagaacagagcaccacuccaggagcaccugcacagggcacacccucugccgcacccaucgguuccagagcauuccagcugggcacaugugucuucccacacacugucaugucagcagacaguuguggggcuucuugugugagaugcacacagcaugcugagauguggacguucugucagcucugcccucugugccuaccucuguucugacccuuccacagcucuucccagcacuggcuagaggcggggcugcuguaguuguaggccuacagaugaccucuccguauguuccuguuauccggggccuggacacgugugguacccaguguguuucuggcaccgcgccucucugcugcccagcuuuagccccgcugccuuucaucucgggugugucucugcuugucucugcaggcagagcccgggcuucuacaggaacguggugaagauucagaagcacgucaccuucaaccaagugaaaggcauuuucggcuuuacggacagugacugcaucgguaagaggaccccuccgagggcagcaggcagagcucagaggaagcuagccagcacagugcggcaacgccagagccugagcuagugggcuaacguacauggugugugcagauaggcgugcauuccaaggauagauucaugcauauagcaaaugcuaccacugagccucaugcccagcccaagugucucugguaacgcgccugcucagagaccugagaugcuagcacuucauauaaaacauccagagguggguauuccaccagacucagacagacagacauaagacugacuggaauucuccaaugugcuggugugaccccaaucacuacagagcuugguagggcccaggagagugaugggaggacagguguaucagcugcucucucgugggaguguucgcugggccccagguucuccaguucuaagaaucuuuagcuggguauggugauagacuccuuuaauccuagcacccaaagccaagugggcagaucucugauuuugaggccagccugaucuauauaaugaguucugagauagauggauggauagauacauacauacauacauacagagagagagagagagaaggauuuugacuaacugcaggccccuccuaccccucuguacuguccucccacggucucacacacacacugauacauacaguauuugccaacuguaaaccaugguuauguccucuacgugucucugucauuccaaugcguuggccuuuguaggccaucaucucuuugagacuugagagaggccucuguugucugugcuugccugcuccuguccccuccccuccucuuggauagcucagucagauucauucccagcaagugaagcgugaucuucaugcucuugagacauacgugacacuggaguccugccaucagggugauccacaguugaggugagcaguccaggagcggugucuugugaagagucacugcccugccugccuggcgccgacuucaguccucacucggugcaucccaugcugugcacuguccacagaaacacccugagccuaaauucacauuuguaagaaggaaggaggugccuugcuauggaguugugaagaguagcgagcuccugggaaugaccacuguggugacacugguggccaugacagccugauacauugaaggagaauauguuccacagccaugcaugguguggacacagcugagcacaccgaccaucgccaugaagaugggacuuggagagggcuaggcuuuaccuccuuuucuguguuuuguggccuucuuuaguuuuuccaggggggaggaaaaccauugcugacugccuuaacuggauucauuccccagagcaguaggucggcccagcacacacgagugucuccccucuuucagggaagaucaguuuuccugcuguccaggccgcgccaucguucagcaacucuuucccgaagaucuuccgagacaggacagauauccagugccucaucccgugugccauugaccaggauccguacuucagaaugacaagggacguggcccccaggaucggccauccuaaaccugcccugcugcacucgaccuucuucccugcccugcagggcgcucagaccaagaugagugccagugaccccaacuccuccaucuuccucacugacacggccaagcagaucaagagcaaggugagcuugggagaagcaggacgcacgcagguuagcuuaccauauggucccagacagcuccacucacaacagugcugcaucucagccccacccaccccuaccucacccacuugcacacugcagggagcucagguuggguagauuggaaguuugggcuuuugguuuugguguuugggaguuuguuagucuuugauccccuucauuaggugaaagcuugcaggcuuuccuauuuccuuuuucuguguuucucaccagcacguugcugcagaagcagaguccugugguacuucuuuacagucaugaucagugaagcuguggucaguuacuguagaagaugcuccucuaucugagcgucgggcugagcaggcaguuuccaugcuugaguuuccuucucccucagcuuccgggagugccgguuuguuuauugaggcagagcugagaacagacuaggcugcggcagagaucuaccuucuucugcccugugagugcugggacugauggugugugccaccaugccuggccggccguacug

SEQ ID NO: 6824 - RNA, 650 nt, Mus musculus
aaacucccacaagggcaaguuugggaaucuugggugugccuauacucccaguaggacugagagcuccaggccaucccagaaaacuuaagacucugcguuggcauagcaacaacaacaacaguucuaggccagcuagggcuauacaguaagacaaugucucuauaaaacaaaccaaaacccccaaacccaagacaguauuuuaaaaucauaacaucaucaagcuagccaacagaucugggauaucgugcauacuaagucccaggagaaagcucugccuguggcucaggacucugcaaguaggccaggcaggguggugcacacagcuaggucagaacacuaugagcaauauuagcgucuucaacagccagccacugcccaccucagugugugacuggacaacuuugugacuauaaggggauguuuguggaauguucuaagugaccaccagagcuguuaccagccccaagccacgagugccaucagacagcaccugaggcuuacggcagagaucagccuagguuccccucagucauagcuuucuuuuguucugaaguuguuaucacacuggaacaccaagguauuucaggaaugaaucucuaucugggcgauggucacucauauuuggcuccagaauaaauaucuuauucucu

SEQ ID NO: 6825 - RNA, 650 nt, Mus musculus
agagaauaagauauuuauucuggagccaaauaugagugaccaucgcccagauagagauucauuccugaaauaccuugguguuccagugugauaacaacuucagaacaaaagaaagcuaugacugaggggaaccuaggcugaucucugccguaagccucaggugcugucugauggcacucguggcuuggggcugguaacagcucugguggucacuuagaacauuccacaaacauccccuuauagucacaaaguuguccagucacacacugaggugggcaguggcuggcuguugaagacgcuaauauugcucauaguguucugaccuagcugugugcaccacccugccuggccuacuugcagaguccugagccacaggcagagcuuucuccugggacuuaguaugcacgauaucccagaucuguuggcuagcuugaugauguuaugauuuuaaaauacugucuuggguuuggggguuuugguuuguuuuauagagacauugucuuacuguauagcccuagcuggccuagaacuguuguuguuguugcuaugccaacgcagagucuuaaguuuucugggauggccuggagcucucaguccuacugggaguauaggcacacccaagauucccaaacuugcccuugugggaguuu

SEQ ID NO: 6826 - RNA, 2014 nt, Mus musculus
gggcagucagaacaaggaagccucagcuuccuuuccuguuuaggcagaccugaggucuuggcugugcaaacagagagggggggcagguacuuggguucuuaguacugcuuagagguacuacgcuaggcuacauaccauccugaaaaccgcaaacuaucuuuaucucucugcacauacauguaggcuuguauguacacacacacacacacacacacacacacacuggauucacaguugcuuucaagucccaugucauccuaagccucacaguugaaccucuacugacccagcucuagcccaggagaaaccacuauagcguugguugccguaucguauugagaccacaaccuggcuuuuugagggucccaaggaggcaagaaucaccuuacagguugcccuugcagauacaucuguugagcuuagugaguuccaagacuugauaccagccuccagcucugggugauccaccauauggccagcuaggccuuuccccugggauucuccaagggaggcuacuaacuuuagaaggaaaugggggcuggaagcaaucuggaauagguugaaccucacagugugacacccugccuucucucuuggcaaagguccaaaguuaaagcucaagaagugcuuagaaaccaauggauucuaaccacucaacagccuguuuccucauuucaagagccucugucaucuuugucaccaacuagaccacagggagucccaagaaagaggcaucaaggaagggcaguagggaauuugccuagcuaucaccuccugaaagggacaccgcugucacaagaacgcucuagcaauacugacauucccaggacagcgaggcuccucugccucagcuaucccuagcuccucuggcccuugcugcucuuccugcccacacgggaucccaggacucuuucccaggggugagaggacagacguuacgacacggcucugucauugccaaaguacacacucaacugugcaaucaaauuaaaaggaaauguaaaaggaaauguaguuuuaagcaagcucacaguucuguguuaggccacgcucacagcuauccccuacugcacaaagcucauggacuugguuggguuggacacugcuagucuuaggcagaagccccaaggagaccaagguauccuacauucacccauuagcuauacuacaaucccugagaugucugugagagccuucuuuuccugccaaggaacagugugaaaggacaaucuggucuuagcagccaguccucugucaccuuggucucccugccucccccaucaucuucuuccuuccucuucccacacaccacacccuucugucaccucauuucaugaggugggagagaagaguuguauaaugccccuugucccuuccugacuuucccagcggggcuccuccaugcagaucuacucaagguucucugaaggacagcccaggcuccagcuguggaaacagccauaagugggccugggucugugccugcugggugggguguaugugaggcccugugggaacccuagagcagucuuucagggacaucucuagucgggaaggcagaggguuuugcuuggaucucuuggcugaccacguggccauacguucaacacuccaggaugccuguuccuggagccagacagaaaaugaguuagggcugcaaacaggaucugaguggcccccugcucuggagaggccccuccauguaaacagaacgaguuucugggaaacguacagaaggccaggcugucgggaaaggacguggcccacauuccugauguucccacccaggcaagagcgccaguuuuucaugggcaucccagcccccaacccagcucucccugucagcuaaaugacaauuucccacuuguugacuuggccuugcagagaaguggggaggggggcacucauccacccccagaggcugggcuugagagcugucuauuugagaucuaggcagagguaccuagagggaagcccaggcacaguaagggcacaguuagcuuuccugcuggcu

SEQ ID NO: 6827 - RNA, 31058 nt, Mus musculus
gagaacaaucaccaguugggguuauuuccccccaguuucugucuacaaaucgcccuuccauccacaacuagggcucauguagggaaaaaucaccagcgaccacaggguguuggucauggcggccaggggcacugcggcagauuuuuuuuuccuucguucuuugcugcagucugggugcggcuacagcaauuugucauagaaucuggggggcucauuuuuccggccaaucacuuuuagagaaaugagcgcauugcagcagaaugcgcugacgucaaagaccaccccuucugcgccuuuauauaaaccccacccagccagccccuagcacagaagacgaagagcuggaauagagcucgccucggcucugcuggccuuggcugcagcucuuccagaaacccggggcgcccacagaagaaucucuuaccuggugagugguuagccauccuuugccugaaaggaugugcaaaaaugaagacgacaucacuaucuggcuucggcuccguccuccuggacaugccgaaaggccagugcuggggaccuucucccaaagccagccccuuagccugguccccagcauccaacacgaaauucugcaaggaaaagaauccucaggcacauuuuucucgcggguguggggggguccgguccacuagggcuuuuuuucucacuagugugggcagcgcgguagagacccugauuaagaaaagcagcaauaaugagauauuccgcccccaaauccaguguauuuuuguuucuggggucuaaaaaccugguuuugguggcugaaagccccccuuagaaucgcauuaauggugagagacauggcggcgaugcaucaucccgcaagccccauaaaaugggggggggguaccugaaaaggggggucucgagccaucuuuuucuccuagccagguucucggcggaacgugggcguaagauuuagagguucauguugaccagcaauucugaauccagauacucggguuuaguauagaccuaaccucgggcaaaauauagugggaaaaaaaauguaaccauuacuagccguuuccugacgcagcuacuuuaacagcggaaagagagggcgucaaaggcaaaucuagccggagacccccagaucacagagaaggcugcggaaccggggggcaaaggcagaauagauguggggggugggcuaggguagaaaaaaccccacguccuugcgucucauaggaaggaaaagauaaaaugcagaaaaggggguguguggagguguggggggugaucugagugcuggaaauuuggaggcaggguucuuuuuggcauugcgcaugauggcugcggcuagauucugacguguugaaggcuuuugacuuuugguaaaucaccuuuugccguuuccuuuguccccgugaagcccccccuggccgcccccuccucauucugggcuggcuggcugagggggggggcagccugagggcugcgacguggcagguuucuagaauguucuauugauggccgcaagagggcgcugguggcacugcggaauuuuggggggcgggguggggagggaagaggagguggccuuuguucuccugcaggagggggucgggagcgagauggguugcgggaccauggguucauuuaccuauggggaaauguuaguagauaccuggauucacuaaggugcgcuugcaggacuuacaauaggucagagauggcgucaucugcaguggcugugugauuuagggugucauggacgcagauuaauuuauuuucagugauuuguguuuucuggggucuuagaaagguguggcuuuuugaggaagaauugcaaaaaauauuaauuaauuaggcgucauccauaagggucuugagaguugacguggcaaagggggggcaagguuuugaggagaaggguguuaauuggguggggggaggcaggguggucugccuuuauuuugucauauagcugaagaccucaaaaaugaguguucuguauuaagaauugagucuuuaaauuuuaauuaugcuuaauuggauuuacuaauggugggugggggcagcguccugcuuuuacuuaucaggaguagaauuguggucugggggcagccccuuacugcagggucucuuuggugcaaggcggcuccuggaugccugugugugugcugcgucaugucuggaaaauggcucaggcagaggcgaugggggugcauagcgacccuuaaagauggcugaugugggcucugccccccccccccaagccugaaaccuguugggcgcccuccccccuccuacgucagucuagcucuagcagcugcguccuggcgccugugggggugccucaggugguugggcuauuggagucuuagugagugcgggccgcgcgcccccuagcggucucuaugugcaaaugguucuuggccugccagacuagcgcuagaguugcgcaugcgcacacagcuaacacuugugaccugucaaucaauucaucuguaccccucccauugcuguccuccccucccauuucuccuccuacuucuccucccauuucuacuuucccucuucccccucccauuucuguuuucccuccuccccccucccauuucuucucccuccucccccucccauuucuucucccuccucccccucccauuucuccucucccucuuuccccucccacuuuucuccccuaucuucccccucccauuuuuccucacuucuucccuccucccacuucuccucccuccucccuccuccuuucucccccccacccacuucccucauuccucuuaccccucccuuccuccuccuuucuccucccgccccuacccauuucccucauuccucuuaccccucccuucucuuccuucccuccaccccaucccugcuucucuucccugaucccucccaccccucccucuuuccccccaagccuuccccucccuucucuccucuuucacuugcccccucccucucuaugcuguuccugggcuggccguuagaggucaucaaggugguuucuaacaacccccucccauauccuaggcucucucuucagggaugacaucaucggcucacaccagucuuccaggaccaccuucuggaugccaaggcugcugcucgaguaccugcugugcaccucuaccuccugguaccccagccacucccucaaguugccugcauguuauauggccugugagcucuccugcccauugcacauucaucacccccagacccauuagccauuaaagacaacuuaaaauguuaaauaauuagcugaaauuauaauuaguuauaauuaauuagcuuacauuguaauuaauaccuauaccugggcauuuaauaaauucucuaaccuuugguuauuuguagagccaaggagcacggauuccaggaacccacuaccauacagagcaacuccuuguggaccccccugggaucaggacagcgagggacaagcgacaaagaggaucaucaguggccagcuaguuucucugggguucaaaccuugaaccagugcccuagugagggggcacuggccauggcccuugaccuuugcucugcuugugucuugagucugagcccuuuccuguacaucugugcucguguucaucugcuagugaacuggagugcugcccuccccgaggagggucgucccuugugacugaucaugcuguccuaacaauguccugagcaaaagggucccuuugggaaccucucaggagggggacccgggucaggggcgaccagcaucuugcuggcaacuccguggguggggugggguggggugcuuccuucuggaaugagcacguggcugaccccccaaggcauguccccucccccuccuccacccaccuucucggagaugucccuuuugggguaguggggacauuaggagcaaccuccuaggguuguugugagaauuaaaugaacugcagcagccugaggcagggcugggcagagaccucagcacauguuuguugaaagguuugcagguggaucuaguccucccguucauggcucaugugucucaaccauucucucgcagacuccugcagccccuaugcccagggcucuccuugcgccagguaggggcucuuuagacaacaggauguccgggagacuuugaguaaggacacgagugugcggucauuuccagggcacuuucuacauaaugugaccauguuauuccugucauucaugugucaaaggggguagccuagugucuagagaggaggggugaauuggcauugauuuuuauuuuuauuuuuuauuuuuucaugauuuuuaaagagguaggugggaaagagaacugggagagcccggacucacucaugagauugaacuuaaauucacacggaggacacuuggacucuugccacauuagguaagagaaggggucaaaguuggacacgggugccauuguggcgaccccugaugguccaguccccuguccuccaccuaaaguucuucgauccauaccaaacauuucacaaugggaaauccuagcuucccaaggguggucuuggggagcugcugggggugggggugggguggcccaagucugguagcaugugcugagaucaccucuuagggauggugugaccuuaaacaagucauuuagcuuccagguuucaguuccuuucacaccuaaauaggcauuucaaaaaaaaaaaaaaaaaaaaggagaaauaaagagagaaaaaguggaggguggggggagguggggggugggggguggggggaaagccagguugucuaccccacagagcgcuucugaagaccaaacuacauaacucacaagaaagugccuuguaaaucgcccggaaauugcaaaaaaaaaauccuuaauuagccaaugaggcugucccuacugcccagcggccagcccuagucucucacaacagugagcacccaguaggugcugggugucuuuguguucaacaaauaauuuccagaauucaaacaaacaaacaaacaaacaaacaacauucauucaacaaacauuuucugagacacugaccaugugcccagugcaccaggcuauggcugagguacaaagacaaugagaacagucucuuuuuggaggcuaauuaguacucucauuucuaccagcacuuucuuuggccuuuuaaaccaaccauuuuuguccagacaagaccaaaaaaaaaaaaaaaacaaaaacaaaaaacaaaacaaaacaaaaaacccaaaaaaacaaaaaacaaaacaacuggguugcuuuagggaagcccggcuuggaguggacaaugguguccaggccccugaaaggggcugauuggauuaugaggcaaauggaggcagaaggagcacgcaggagacaaaugcagugggcggagacccgcucugaguuaaucaggcugauugaagggaccuuuucugucuugccgaguggcccgggggggcucucacuagugcacugcugugugcacauggagacuggagcuacccuggucccucucuggcaacuguucauucauuugaugcucacaacucccuguccugacccagggccggccugccaucacgcagggaagcagaggucgccaagcgguuuccgacggggcccccccacauaacguuagccucgcggucucuucgguuuuagcagcaguggacaugaaccuguuuccagccugcauccuccaguuccucucgggacuccuggcuccacugugcucaccuggagccccgccagcccgccucccccuguccuccuuccucgccacuccagugucugucuuuccuucacagccccggcuucucgaggccugucuacacucgcugcuuuccuuccucaccuccaauuuccccuccaacccacugcuuccugacucgcucuucuccaucgaacggcucucgcucagguaaagacuuuucuguagcuugacccuuggcacaaugccagcucuggcuggacacaaggacacacgcaucuccuccauuccugcugcuccauugguuucacggcucugguucccuucuauuuccaacauuacuggcuucacggacacagcucuucuuacuuucccugggagcuuacauuccuagccccucucaguuucccaaaccugccuugugccacccagcugccaaggccaccuagagcacucugggccggguggucuggguucaggucuuagggaaagcucuuaaagcugggaccacgguguaggucagcucuuccaggauaccuuggcuaagacaggguuaauaggcuucacuuggaaggccaggugagcuuccaucagguaagacacugacuccuuagcugagggacuggaagagaaauuaauuagauauuccugagcaaaugcaauuugggacacaaguuuucucaaaguuagguucccacagagaagaccaaagagcaggggcaggggguggggguggggcugaagggguguacaagcaugacagacaguaaaggcaaagaaaggggauuaggaaccacuaagaccuccccagaccucaccuagcaaaagcuuuccuucuaggcuagccugugagaagaaccagaaggaagcuuuuaaguugauuacccagugacacaucccaggaagucuccguaucacauagccccauugaaggguuuugaguuccucuccugagguuuaaccucugcaccccuugccccuucccuaaugccuccccagacuggugauuaagucccgaugguacaggaggggucagaagggucuuaaggaaugauuggcucacuggacagagccaccccuaccccccccccagcuauguuuuuuuuuuucuuuuuuccaauucuauucuacuuuuugcccuuucuccuuaaugaacacagggcuaaucuugggccuuguggaaggaggaggcugcagcacuaguuaaugaggaagcugcugagcuccaaucgucaucucauaaggagcccucuuugucugcgaaggaaaaacacugauuaucauaaugagcugagcugguggcugagggguagggggccuuggguucuuaaggcacacuuuaaugucaguguuguagauuucccuccccccauugaaugggguugcauguugaagguagcuuugcuucaaggaacuuuaagagcuccacacugcccagccauuccuugucaccuagacuccugccaaguuccccagucucaccccagcaaucaacaagcccggugaaggggacucccuccucccacccccuuuccucaguggguccacuacagcaccaccccugugcuggacuugaagguaggguacuaggauagagcgaaggucuaggagaguagaagccacacacaaggcucccugcccacagugcagucaguuauagagacuucacugucugcagggucccuugucucaaguaucuaucaauaauauuuauauugagauaauaggucccugaagccacuucugauauucacaaguccuaggucaccgguucuccaaacuuagcagcagccuugagcaauucaaacaagauccccccccagccccccaccccuucugccaccagcucagcugcccuugauggcaggaagcuucuaaguaggauuccagguaacuacuuccugaagcacaguuugcucuccccccccccaccccaccccccaguccacuucccgggacucucaagggugcuugugugcauccgaggguauaaaaguccccuuccccuuuccguccaggcauccaggguggcuucagaguaguuggcccacaggcccagagcauucuggguacucaacaucuaugggaucaaucaggacauauuggggaguuacagagaugaagccaaggagggggagggaggaggcaggaaaagcacugcccccccccaacucuucugagaacaaccuuuucugccuuuacugcccauuccccuccauucucugucucagccucccucuguuugucucccucccucucccaauuggaucuggccccuguuggggugccccuaggccaccccuuccucuucugggugucccagcaccaacccgguaaauaguggggcucaguaagaguaugugggaugauguacggugggacaggcggacgaauggacgggcucaacugccacaucugggcagcuaagggucaggggguguggggggcucaagggaugugggaucaguagcaaccugcccuaggcucagcccccuuugagggguccuaugguugcgcccugcauucguccgcgcguuuacucugucauccacaguugauccuaacugagcgugcccaugguccuggcccugggcuuggcaccugccaccuagcuugucccuugauggccucugcuucccagggagggcaagcugggggguugucugggagccagagcacuggucucuggcuccauagagggcauucagagggcauggggugggccugguuugccugcccugccuucacgcagaccugcccacccccagggccuugccccccucucugccucccuccccauucauggcugaguacgggcuacuugccccccccccccgccuccccaaacucaccucaguugccaacagccuccuggugccuguuggaccaucccuugcugguucuucauuuccugugggccuaguuuccaggggcugagugaccagggucuuaaaacagguuuaaggcuuggcuugcuggcccuggagaucccgucgccgucuucgucgaacucgaaauccuagccaucguccuucccugguggguguuuaccacacuucccaccaccuuguccuugagaguccauggccccgcccuccuaggccccuugcugaccauuugguguuguuuugggggcuacuauccaggccugucgcgucuuccugugccauuugcuguugugcucagguuccacgagcugcccaucuccacagaagagcaggugaggccgcugccugucuucaugcgugugaguacagguggcuuuucuuuuuaggguguucugcuuuguaggaauucuaauuuuuugccuuuccucaaagcuggcauugcccaccggccaugccggcugaagaaaagaagacugaggaccccaggaugcccagcgcgaggaccccaggaagcccagcgcgaggacuccacccacgacgcccagcgcgaggacuucacgcacaacacguugcaacccuccuggauuagggugagucacuugcgccgguaaacacaacuuuguuagaauccacuaacauuacaucuucacuuuagaaguuguacagggggagggugcaccuuaccaagcgccgcacacucgccuggacgcugccuggagcugagagaaagacuguugccacgagacagcacgcgugggagucccuccuggacccugucuagcagggaccagagacgguagguggggguagggcacauguacacucccagaaauagccagggcaagaaacacaguaggcacacaacauagucaacccgacugacuauguucgugauaugaagaauccacaggcccuuggcuuugucccaugcagagauguggacaugggugguuauccauccacccuugguggggagacauuucuccccaccagccaugguggcgcuguuuacucagaauuucagccuugccuacguggggcuuugacuaaugagaugcuguuuguuuuuuuuaugugagcuugucuuugcuuuccuuacuccugacauugcuuugagacagggaauaugcuggagaagacacagaagacuccaucacacuuccaucgcuuguuuuugaaccacaaagaaugguucacuuacucaagacauauuuguagagccacugaaggguuguguguuguguugggguggguaggaccgaaacauaggguugaagggucaggugaggagggcagcuagccaucaagguggcuuaaagaggaggguccuccugcuuugccccacaugggguggugggagacauuggagcaauuugacuggguccaggucugaccuuggccuaguugcuauccuuuuuaacaccuugaccuccaugccccugucucaagauuccucccaacuugucacccugcuuggaggaggccuugccuuucccauggagcagcuuccaugauauucucauuaaaugagauuuuguagaugcuccuauagcgcucagccuuucucccucuggaguggaaaugggaugggauccuauuacuaaacaaccuaauucacaaaggggccaugcaccuaggccuggcguuugccugccuguuuuuuuguuuuuuguuuuuuuuuuuuuuuuuccucucuagagggcccaguaggcuguagagaggaggggugugugccuagggcaccagaaggcucugucuugugacauuuacuccguagcuggcauuuacugagcaaccugcaaacacagugacguggcuagcgaggagggcugggggguggggggggaagcuuugcucagggcaggauacaggcucccaggggcaucgaaucccgagcuuagacaaagccacugccuggguagucugagucgagugagccaagggcuugcagcucugagcuuguucauuagggucaagcccagaacuugggagguaggcugagccaagugguuaggcuagguuaagaugaugcgaacagacccaaccaugagacaauaugcccacuuauccuagaguacuccuacacucugcagccggccccaccuaccuucccaggauucaaggacaggcuuuacaugaagguacauuuugagugacugacauuucagggacuguggaagcuaaaucucgggcagauagauuugguagauuuugugugacauuaguuuaaagaacaaggaagcauacuagguucucaauuaauauacaauccaccaaccucucggacuggguuuaggaacugcagaggggauacuacuccugagaaucaauagaaaugauagcuuucuggaaaauucuuuuugaugcuuuggagacugccagagggugauaaaaaggguggaaaugaggccuggaaugucaagagaacaggcacagggaccuugccaccuggugggaagaugggaggucauuugccaugguaauaggcacuuagcuccccaaaguucuuuccacuugguucuucaugaggagggcagacugggggacaagauaguggcuucuugugggagagagccuguccaucuaucucaggagugggcaggcaagggaggccagagcuaagcugagguuacucauggagggggcugccuuugcuucuacauucccuccugcaagcugcuggcugcaguuuucagggccccugauuugugugauucaaaccccaaauguauucaaaaguacauuucucuaaaugaugucaaaaccuggcaagacuuuggggcagcaggacgcauauguuucuuauuccuucauuuacaugaaguaacuuacauuuuuuuuuuuccuuuaugagcaaucugacuucuuagaaugaaaaaaaaauucuaccgaucuuuuaacaagcugguuagugaagaguaaggggugucacacaaaggggguguggagggagguaaauuaaggcccucaaagguuacagagcaguggacagugaagggcaauaaagaagccaugcuggaggaacugggugggggcagcugucuggggagcccuuucuucucuagggacuggaauuuaacaggcuggaaacgagucccaagagcuacccccucuucugcagccuugagcccccaucccucucagagaaaaggaggaaaggaagauucaggccgccauuccuaguuagagaagauggaaauuucuaugagagcugggucuuucugagugagacuccauaaggcacaggggucucugaaagagagaggcacugggugggugguggggaccccugaauaaagccuagcugcucguggacaccuuggucucuagaagguuucugaggaaagggguauuucagggugaaguugccuuuguggcauagaaaaauuaguccaguaggaguuagggacacuuuaggaaggagucucugaugguguuuccuucuggguaccuagaaacacagcaacagggcuacagagcagagcagcauuaggagaggggaccugggucuccaucucugaugcaaguaucugguguguccugguuuugucuggcccuggggccagugucuggggccccgccucuuccuuugggaccugguggcuuuagccaggcuucucaggcauuguccauguuuguuuucucaucuuccuucauccccaaguccagggugugugugugcgugcgugcgugcgucugugcgugcaugcauguguguguguggugugugggugugugcgugugugugcgcgagcaugugugugaagggcaggugucaagugacggaggccaguaguccccaucccuccagcucaagcaggaugugugugggagaggaauuaauuaaggugagagcagggguggaggguacgguacaaucuugacuuucuuaauugcucucuaguuucuuugggcuuaagagaaaauugcagauggugaggucuucccuccccgagccugggaguggggccccagagccuggcuccccaccaccuugacuuggccuucucuucucucagugaauagggucuuuggcuagggcuuaaggaggagacucuuagccugggagcuccgaggcccgcugcagcuggaaacaaaggcucaagcagaaaggaaugugggggagccccgcggagcacagccaccuggggauaauugggagagcuagcuucgaugaguuucccagguccugugaauggcuccugucaauggaaggugcccuuucuucagaugaaaggaagaaaacucaauuaccuacucgacaugguguguguguguucccagggugcuguguggggcuccugccucuguguguguguguguguguguguguguguguguguguguguguguguugcaccuaggagcagaccccuuugguauaauccccaauguugucacugucugacccuggggacucuucagcuuguccuucccagggcuuagauuuguguaagucucuugggauagagcgauaggauuaacuauaggcaagaaugugaucacauugggcccaaagcccaaaagaugcuuuagagacagaauggggccaagggauaguccagaaugaagaguuaggggaaagaggacugugggaggggccaaagagugagcacaugucuuuucuggccaccagggaccacagcuguguggcuuuuuuuuuuuuuuuuuuuuuuuuuuuugccuuccagcauguucucugggucauucuguauguggcuagguagcugguccuccaggguuaggaaacugggggugggagggcugguggugauggcaggggucugaaauuaaaguaggguaugacaaguauguaagguuagggacauagagcagaaaaagcagagugaccccccccccccaccccgaccagggguuaucccacuacugcccuagacugucccaaggcaaaaagucccugcuaggagaaaaaguccugguuaucagucaaaguugguguuuuugugacuguuucugagccucaguuuaccugucuguaaaucggccuaaucagaccagagccuuucuguaaucagacacaguccuuguuuaaccagagaagggcacgcagagguccauaacuggacacuguggaccuccacuagcuuucugguaggucacccuauugcuccuuagaaacugucagguagucagcggacagagcccagaauggguacuuagguccaggauagacagcugucuggagcugccuuccacugucugaacccagcccugccuauggaugugaccucagccucugccugcagcccucggggucauccuuucuccauccuuaagaugaggaguacaaauuuguagucaucugagaccucuggaauuugagucuguaagugcugggucuuuggcacaccaggcgccuuggcagccuuguuucuauugcuauugucccucugcuuuggaggugagggggcuggagauuccagagggucagaguguccagcuggugcagcccugggugagggcugcugauuguagguuccugagugacaaguguggucagggggucucagagcucagcuaguucaucacugacagcuuuuagaaaucacaggucuucguggaagccguugcugccccuugugcuauggcaaagguauuacuuauuacagggaauuauucaaacaucccauaggccaggcuggaaaacccuuuuugggccagagagcaucccuuguguaaaaaaacuagacccauauuuucccugccaggaggaugugucccaggggugcuauccagaaggggucauugugcacccauuggucaagaggcauccugacccacucagggaagaauuucuaguugaagccaccaagguagcaacuuguaaaaacagugagugguacccacucaccgccacccccuuguguacucuucccugggccucagcaugguaaucaggaacgcacagaccuuuucugucagucugugcccgucauuaccgugguggaccgcagcuuuuguuuugugaccuugguugcuacaauaccuacgagcugaaaugaggaaucaaaaaauugccagcuucaauuagacuggcagacuguguucuuaaggcugcuucagccuuucuauccauuaaggguaaacauguaccaaauagguccuaauucucucuaauugccuacuccugaagcaaagaggugaaauuccaggaagaggcauauauaaacauccucugaaacccgaccaacgaaaauuagagggcugaugggggcccggugcauagaaggggacaugguuucaaaagaugucccaauuaccgcucccauuuucauaaaugggcccguaauguccagggccugggucucaacaaagguacaggaaaugagcucugcaaagagcuuccauuugucaggggaacuugcaagaggguaguauuuucucaacagguaggaagugggaaaggcugaucauuugcguaacugcagacucgauuucuugaaaucaacauuuuaguaaaaauaguccuuugacguuuuuuuccucuguuggaaacaucagugagauauuuguacccaaaacaagaucaguuagguccugugugccuccggaagagagaaacuuuuaaaaagauuaucucaggaugcagaguuagauguucuuauccuggugagcugugggggcugcauugacuacgcccacccuuguuuuguauucguagcaugagcucaggacauggauuuacaaggucuuccaucaaacguuugugacagugguuccugcggacucuauaaaaucuuguuuuuuccuuuggcugcagugagucaucucugcagcuuuucugacauuuguuaagauuccaaccccgcacugcguuauuaauacaucacgcagaucuggagcugguacaugcagcuuuuaaaccaaggcacgacuuugccaggguuacgugcuagcguagcagccuggggucugcaugccgaguucauuaaggacagucaggcgcgccuaggguccacaggggccuggaggagaggcaggaaaaaacccagaugcccugggcugcuucugauuaccucccugccauuaaaaacaaaauaggggaaaacaggaguggacgagugaaagcccccagcucagguuccugcaaagaaacagcagcgucuuuggucuugcuguguguucuuggucuggagucacccagagaccaugguugugaugaguggccaccauagccuucaggggucauggggagagggguauucacuaugcaguuagguaguucugagcuauaagaugaccgagugcuugggucacccacaucuucugguuguccugugaacacuuauuuuuaagauacagaaucaagcaguuggguuugggaacacaggccagagaagggauuugcaggaggcuuggaaauaagagguguguccuaacugugaccuggaaggguuuggggguaccucagucagagagcuaccuggcaauggaggguauagguggagaaaccugucuguagaggaugaaguaaggauaggguagagagucucuggagagccagcagggcagguaucuggcagccugcgcuagguguuuuucaggucccgugguucugugcaucccagucuauaacauccuagagcccaucacacuaaagucccccucauugucuaucucucaggaguguccccagccucccauuaauuccucugggucuccuguuucccugcaugucacuuaaagggguuuauucuccugcucccauccugacccucacuuccagacacagcagacucuccucuuugccaccuaguuugaccauaaccagaugcuaauaacacauuuuaaaaaucaacucauuuaaaacauguuuuugaacagucauuuuauuuuauuuucuucucaagcaguuugaguuuguagaacaaucagggcagugacuauggggguuggggauguagcuccaugcuugccuagcagguaagaagccuuaggguccaguccccagcaccaaaaucaaacucauaggcaguggugcauguaugccugucaucacagcacuugggagguaaggcaagagggccagaagcucagcuuuagucucuaugacauagcagauuugaggccaguccgggcuacagaagagccuauuucaaaaguaaaauuaaaauaaaaaaguauacagaaacgcccuugccccuucauuggcacgucguauacacauagcucauuuauuguccugccauaguacgauccugacgcaugguuaguagaauggaguccaugcuaggaggcugccacuacauuguacuuuuugugggccuugguaguugucuagugaugugagucucacaguuuuaccucauguuugagauaaacccuggacuuguaaagacuugguauacugguguucuguugggucuguuacacuccugugauaugguuagcacagaagugacugcacggguaccguagggagucaccugucauccuuuguguggguauguauguguguguguguguucaaugguuauuuaagacacugcccacugaaaacccuaugguuguagcauagcccacauccuggaauccugaccucuguuguguggcccucuggccagcuuggcccaugcugagucuugcuggcccacugacuuguccagggcacaaccugugcccuaccuucaggauguucucagagcucuuguucucagggcuacccacauagguaucaguuugcauuuuauaguuacagaaucucuaaagcuuagcuuacacuuagcagcccuuagcccaccaugcaggcuaauaccaaggcuuuugguacaugccccauccccucuuagguagcugguaggggugagcauggaaugagugcguuaucuccguggauuucaaauuuguugaacuugagagucccugcuuuaagccauacuugugacuuucauaggugcuuuuagccauacuugcugccuucuuugccagcccccuccugguacuugcuuuccugggugggauucuaucccgugacugcaagcuuucugauuuuuagccaaagccaucaucuggaauccugcgugggacccuggacacacggacacagacaccugcccccaggacccuccaacuguaaaucguaaguggcuagagaacagagagcauacguaauggcugauuggguggggguuccaaguacccugucaggcgagcugcagucugugcagauggaggcgggcaggggggugggggguguugcccagugagccaagucgaggguugacccggugcuuguguuguaagaugggagccuccauccgccuaguguugucucugucucaaaagaauucuauaggcugcuucaagugugggaccccaaaagaauuucuucuuuuucacuuuuccaaaugaaugggccuuucauugcggacucucccucuggcucuuguacugacuaggauuggaagcgcccuugugagcuggggccuucaaagggcugaggagaaaaugcaggccgagagaccagcuucucaaauaggcuucaagccuccaugaccugagcucacccccuggaaaugucuggaaaacauaaugggcagguuuucugucuucaaaguuuccaucaaaaccucuucaaguucuuuauuguuuaggacugagacacuuggggacaguaauggggacuuucuuuuguaucugucuugaaaggccaaaauauuuuuauauugcuguagacaaagccaccuauuuacaaauggacucuuguuccgucguuucccaccaggaagaccguacuauguuugugucucuauguauucuggggucuugaaacagguuucucauggggauggccauucacuagagcccagaggggcagaaggggaagugucuacccugccaagggggucuggggaaggaggggggcuagucucagauuugcuccuuguaugucuaggguaaacccugggagaaucuggugguaaaagaacauaugcuguguuugccccacaucugccauuuguguguguuucugggcuacggguuugcacacuuuggugguuaacauggugggaggaaguaagaagggccaagagggcacgggugcucugguuuuccugcugggaggcuguuucacugguguguguuacaucacauaaugcauguuuagcugggugagugacaacaguaugaagggacagagaaacaaauagguguagaaagagagucacagagcacacagucaccauucugugcccaggcguucauuaaauguucaauagaaugcugagcucugauagacagagcgggccauggacacacugguauugggucaucauggaccuaaggaguuuuuuuaauugaagaaggaaucuuacauaacagaagaaagaauaagaagagcugucaaaacgagcucugagguuuuugaagccccuuaauauaaacagacagacaauggcgugaucaggaaagggagaaaacaaacaaacaaacaaacaagaugcuuacagaaauacgagaggacgugugagcaugcaaagagaacccagcuagguuaguaucggggugcugguggaucguuaauccugucuggguaccccagcuccaaggggaugagaggcagcaagugagaggacacauaggaaacuguaacaagacagaggcgagcagauggggagcuucagcggaguguuaagcuaggcuucgcaaucugaccacuuaacucucccagcaaagaaaagaaaggcuuaaauacuaaaaagaaggaaagcuggaagaaaggaugguagaugugaaaggcauagaggauagaaagcaauagggaguggagugcaggugcuguggagagacgcuugcaggugacucaauucaccagccugugcagcugagaaagacagccagugacaaaggagaagaagaaagguaacaauacacucacaaauagguagaugaauguagcuggaagacggggccuggcuagggacgggaugagaggcugugucagcagacugguuaauucccaucugugcuucugagauggacaaugacccacccgaccaagagaccuuucaggcaucaauaugucagggagggcuucaauggggcaauggaggcgaggcccauuaauagcagauuaugauguauccaauuaggugcaccugcccucuggaagugcagaaaccaguauugaaauggaaagaaagacugaauggaaguccgagaguacaaaugaauggaugggaaaaaagauuugcauucgcucuuagggggagggugcugcugagccccagggucaucugaucucccggagaauaaaagggcgagggagugauagagaguaacaauaagauggagaagaaaugaaaaggaguacagagagaauaaguggggacaaugaagucuaggagcgcggcuuguuuaacacaagucauccauauuaauucaaaauugaggcccugggaugggaugggcuguguccaagggaugaagcuguugccuagcaugugccaaguucuggguuccaucuccgccuggcaagacaaacacaggaaacaaaauuauagcccagagguuguaaauguuguuuuugaugguuuugggacaaagagcuagaucgguuggaagauagagaaauaggaagaggugggaaagaguuagaugagcacaagaggaagcagcaguucuuaagauaaguguuuaaauauggugaaugcguagcucuugggugugucaagaugaaaauaacgaaaagaaacaaguuuagggaugacggcacagggaugagcggaagcggugacuuuaguuaaucaccguggccaacucaagcccugucagggauuuaaaaaaagguacaaaggcgauaaaggaagacacaugcaauacggaagagagagacaggacagacagacacagcgaaaaggcugaggacaugccugagagggucgcgaagggaugagagagagaacagcgagaauucugcuuaauucaaaaccgggcuccugagauagcuaaauaucuccugagcccaaacaccagcacaggagauuaaauaacaaaagagcugcaggcagacccaaguggagaaggcuugggacccucagaucaggcuucaacuaaaucugugcaccugagguccauaaauaaaagaauaaauauugaaauaaaggagugacagaaaggaugaaugagcacacaugacugaauuagaaauggaaauggcuagagcagccaguaaggaguggcccaugggacuucugcucaucuuauucugggcaccugaggucccuucgugagaagaugcagggagaagaggggaagggaaaggcaugagagcaaaugaaagagaggcgaggagaggaaaugagaaaguggcagagaggggaagcgaucggugggugccucggaagaggaauguccacgaggauuaauaacgaggcucucauuaauccuaaagaucgaugagguaauccagacccagguucuuaaggggaaggagaauggagagaauuaaaaaaaaaagacgcaaaaaaaggagagaaagauaauaaaacaagcaacaugaugaauggguaauuaagagaggcugucuggacagaaauaguaaugaguucccaugcauaguccuuaaauagauaaauacauuauaccuuucaaagaaugcgugaaaaaucgaagaacaccauggcccccaaacaaggcugcaccuuccauugcuguaauaaaauacaugcagcggagagccauaaauaacggaaaauacuuaaauguaaaaggugaccagacagagggagaagauugcaagcccagauacacgagggagggaggcgauguuugcuuugcauguguaauacaauuauguucacaggaaauuaauagauuuaaaaaaaaaauccaaacuaagacugggagaaaaaacaaggaagagagggaagcgagaucugagagauggggcugagacucccgggguaggcucagcaugguuuugacuauucugcacauccggacuuagaaaagugaguuugucagggcaggaagagaaaggugaaaucuggagcgggcagagcugggcagauggauagaaaaggaauggaaacuacacagguugugugugugugugggggggggaagugggggcucuaagaucugagguuaggcuuguuuaaagcugagccauuguuguccccagaggaaucaaaucuuacugcuuuugugaaggaagagaggauggcaacgauauugcaggaaaagagggaaggggguaggcaaggaggcagggaggaacuuucaugugcuauucgcugacugggauugguaauagauagcucuuggcccaccacaagcugcuuccacacagccuaacugacugggagcagcuauggaucaccauggccauguuuugcuugcagggggccauuucacugucugucacaucuucaguccauagacacaucccugcacagugcccuuuccauagacguggauaggagggaagggcucaggccuggggcuguggagaugauugcaugaauagggggcgcuaugcccaguggguaccuugucuccucucugggaaaggaucucuucugauccugaugggaaggggcuuagccagccaaagggcagggauaggaggcuuugucugcugccugcuggcuaccaucuugagugugacuuacaccagggugcagacaaagugagcuugaccuggaagccuagaggcccaagaggcccgggugaagcaaguaucucugagaucaagccuacccuucagcucagagaguggaccccugccuaggcucccacacaugauccuaggucccagauaugccaccccuggagcccguuucaaggcccaucuuccagaauguuuaaaccuguguauguaaccaguaaaaugggaguuuguacuguguauugaaucugucuucuuauuggccucugugggcugcugggggagaccuggagaguuguuuauucuagugucccccacccccugggacucuuugcuuuugcccaguuuucuuucucuguuguggauaagauuuuguagaguuguguguuguaugcuuguguuugaccauuaaaaaaaaaaaaaaagucacagcccuccuugauuucucaauuccuauugggggugcuaaauuccaaaccaaaccaauccaaaccagauucaugucaagugcccaacaggaggauaauagcuuggcuggaucaagggagcaugugcagacccaagaacagaguggacagaugggcuauaccgcaagggggcuuugagagcugagugcaggcuaaguagagagaagguauggaagguuggggaggguggggcugcugcuaccugaguugcugagggucugagacaccagcaaggaggaggggccccuggaagaagcguuuugagaugacugaagauggaagaugggcgcucccuacgcuucuagcuucaagguuuuuaguguacgccagccgccuccgaucguggaagacacagccuaaccuugucagaagccaccuucugugcccccagcaccacgugucugggccacgugagcaacgccacgugggccugacguggagcuggggccgcaggggucugauggccuccuguuucagaaucuggggcguuuaucauccuugggacaacugcugaccuggcuccggaagauuguccacacaagucugagugacggagugagaugagggggcggguggagaugcucagaagaaaacagccuuugcaugggguucauuuccagcuguuuagagagucagccaaggugacaaggugggguuggaugcggagaagaaugcugggacuacaugugggcuacagcugugaagucagugacauggggcagcauggggaugggucucuaggugggccuugucucaacauucaugccagaagauuggaagggguaccauggguuacugugggucagugggaccuuggaaggaacaagggcuuggguaggugacuuugccaugucaccuugggaucuaguuguuuugagucuuugacucuuaaucugaucuugaauaacaaaugucucuaguucugggguucugagagucugugguaggauucccuaggauucguguggggagggcggucugcaugugcucccaaguuggugucccagcccuucugccugcucagggcugucuuagacauauuugcuuuuccuuucaacaucauaaaagaaggcaaauuuugucuuuugauugacacucauaugcaaaccacaacauccuuucucugauaauacugggaccuacagcucuccucggcuccccccgcuauuugagcccaccuuuggggcagguaggccaaaggcccugguguuuucugaggugaaguuguuaauguaaagauguguaacucagagcagggggaagaaacacacccucaacucugcuuccccgugcuccaucuuccuuucugccuuccaaauucuuaugaacaccguuuuuuuuuuuaaauuuuuuuccauuuaaugagcauccuuuuuuuuuuuuuuaaagcuccauugguggugcuuacuuuucuguugguguuuugugucuguugcaaugagcaucuugcuguccacguuuucguugcuccauggucucucucaccugcuugaguuccauugaauggcuaugacauaaugaucuacccaucuuacuguugcugaugcaugaucaucuccuguccuguuuuuuuuuuuuauuuuacauuaccgaugacaccauaacuaauggcuuugcacaaccagcuuucccagcaucccuagcgcccccuacaucuagcucuucccaugguuccuuucuuuucuccuugcuuccuucugcuagacugugagcccacucagggcaaggagcuuguggaacugcgcucuguauuucuuguaggaugucuaugaauguugacugcguguguguguguguguguguaugugugugugugugugugugugugugugcgugugugcgugugugcacgugugcgugugugcgugugugcaugugugcgugugcguguguguguguguaaggguggacagguaugagugauggagugauugaaagauuggcagacagaugagaggcuagaugaauggaugagugaaugaaugaaugaaugagugagugaauuaauggauggguauauucucugguugagcuucuuggaugaaaggguaauguuugaauggcuguugguugauugaagaaagccuacaguauuuuaucuugucugauaauguauuagcauuuaagcugauguauuaguauuuaaggugucugcugacuuuccucaccucucuguuaaaaaaugcuuuuguguguguaaaacuuguucuaauuacuaaugaaggcugaauacuuuucacccauguuuguuaacaaauuguaucuuaucuucugugaacuguuuguccaaguccaguggcucauggcucuuucaggcucuugguugaggguguccuuagacuaggcaauggccuuucacagauaucuacagaaugaugugagaggcucagcugacuucuagcucggcauuagaauuuacuuacccugggaaacagggaggcugauaucuugcaccagcagguagaaaacacuuuuaggcuugugucuggguucaccaugcauuucuagcuugugagcccugaccugugcucuguaccucuugugguguggcaguccuccaccuuguccuccugagugauagacuacauauaugccucuccccuguucugggguguagucucugaggccaugucuuagaggaacuggcuucuuagugcucugucuagacauccccuuagcucuagucuucccaugcaccucaguggcagguguggucuuaauuuagggaaugaaugagaaauucaguucaggacugaugugacccucagguuaguucuaggagcaaggccauuuuauggucucggcucuucccaaccuccucacagggcaguuauagccaucuggguaggguguguguuccgggagagcucauccugccauccagaacucccucccacacucuauuauagcacuuagcgugucugccuguguucagcccucucaccccaugcuuaucuggacauugaagcuuggaaagccaguggugacuucaacugacuuuuaauucauccacccauccaucuggcuauccaucuagccaucugucagucaauccauccauccauccauccauccauucauccauccauccaugcauacacacauugggccuccaucacuugaccuggugcuuugggccucucucccucuccugaaagcaaaccccuucaccuugggcaagcugugugauaccaugggcuguggucaugaagcaaggcccccauucacagccuccuccuccuccuccuaggucacggcucugagcacgucccagcuggaccccuaucaccacagcuuuuucuccauaaggcuucucacaccucacacccuccuccugugauccaggagggccagauucccagagugcccuggggcuggcccuucccaccauccgcggagcugccuccccaggcuucacacugccuggugcauggucccugucaugagcuuggccuucaccuuugcagcuuccuccaccagauggcagugguugugacucgugugcccauuccuucgcaccuucauucauucauucucuuacagccagcaagcaucucuuuaaaaaaaaaaaaauuagcuagugcuauacuagagccggcucacaagcacccauugcaccacuguccuuugaaagaaaagauggggacauuuguaaagaagcuguguuuguguggccaauaagaggagcuccuugauuucaauucaaacuucaggucugaguucuauugccagcuugauugcucucuccaauuuuguuccucacaaaacuagguugauuaguaaucagcaaacuguguucccugggugcucagaaaucauagcccagauccuuaagaggcccaaauggggaguggacuaagcacgaagcagcugccucuggcugcgagcaggcuuucaaggcugugagacacucuguucuucuaugaggaugaucugagagccguucuggccacuuuggagcucagcuaaugcuuggcuccuuuuuagagaaaauugcaggagauggaugcucguacaagugacaaggaucaugucccaauguccuuucugaauaauccauucgcagacccaggcgagcaaggcacauggcacuuugcaaaccccuguguguuucaggaggacccaugcuaggggaggccuccuuucagcuuucugcugugaaggggaagagacgcagggcucuucugaguucuccucccacuagacgcaguaggggcggcaaggccagaaccuggagcuggacaaauugugugauggaucuugccucagggcuguugugaggauugguauaacuggacacuucugacugugacccuaaaaggcaguguaugugucccugggggugugccagagcauuggaaacccuagcccuggaguggggguggccuugcuuggguauaauggggaauacuuuguaucuguuaaauuuguauauuuuccuauagagacuuuaacaccacgggauaggggacucuuuagauaguaccugugcccuccgccccccucggacacauccacaccuaccucuaggagagguugggguugucuuuagcucucugacugaggaccaagccucugacucagaacuguauauggcaccuaguuacaucccuuuccaaaaggcucuucccaggggagcacucggcccgaucuggcagaccccauugucccuuucccaauguccucucucccacuaacagcaucaggccaaacugccugagaucuggugccuaccacagugccuggccagggguagggcuucagugaccuucuguuguauuuguguagguagaugaguagcuaacaauuguaacagguccuaggggcagauguguauggucucauucagugguuuguaauggagaauguaucugaacccauaucaagccaucucucuuccuuaacauguuaagcagccacugcuguccuggguuguuuugcaccuugccuuguugucuuucaugcuaaguaaaaaaaaguccugcuuucugcugagagucuguuucuucuggaacucaccuaggugugaucuggcagggcugcuaagcugugucucugccccucugacccguagucuucuucucucucaggugugcgucacuggcaagccuaccucacaggguuguugugagggcuaagggcugaucggcuguaacagugugauguccaugcuggcugucaccagggauggugccaugaugggguuggcuugaaaucacaaccuauaccguuauuaguggucacugaauaaagagucucacuguggacacugagguuguauauccagccgucgaugugguauucgaggcuggcugugugguccuggcuaaaucuggugugguucauucaugcauguuagcgucuaagucccucuguggugcccuggccuucccuuccuuuccaucaugguggcuggugcugcugguugugugaaggccaaagcuggcugggccacuaugcuuuggggcauuaggagggguggugucuguugguagaugcuucuucaagcuuguguuucuguguauguggugugugcauaucugcccccugggacagugccaagaaccaagggucaauagaggggcuuccaaauuaugacauccuugaauuuuuucuuacugcucucucacuuuuagcugguaggucuggguggcuguucuccuccccgcucccccuuucuuccccugccaggagaugagaaaaauuagcuuucucuacaccaaauucugcuuuggacugagcuuagguuuacacacuuuacuguuguccucagcauggucccauucuauggaugggcagacugagaaccagggacaauagucauguuaugugugaauaacucuuuccacuccaccaaauaaaaccucagcaagcccagugucuuaggcucaccccugccugauccuggcaugcacucagaauggucucccuucugcuuugugucccacuauccaccuaguauuuuccuggcaggguaaggcauggagggaggagcaaggaggcuguguccucccaggucucccagucccggagugucccaguccaugucugucugagauucacauuucccacgaggcucuuuccaugauguuggauuccauccccaguccucguccugugaaucugggcgagcagccuuccacuuuuccacucuuguuccaaguccacgccaagaagcccccccacccacugcacagaagcccagccuccgcucaguuccuuguguuacucuggcuuucaaagcccuggugucucagcccuagaugcucuuaaacccuugguguugucacuguguccucgggcucaggaccccguguuuucauuguucccucuggcugccaugucuuucccuaucauacuccauuaccaaaaucccgacucugccucccucaggcugugucugugacugcuacaguucauccugucuuugacaacuucuuggaaccuuugcuucugugcucuggggucuugugguaggcacaugugggucaggucauuugcucagguaauuuugacucugugucuaggugccuggucucagaugggccuuuggccccuugugggccagguuuuugggugacucuuagguagcuuaugucucuuggaaguaaagaaagggaagccaggggccuggcaaaaagggaaugcuuagauugugacuaagcucuaggcuugcuccaacucaaugucacccugccucuugaaguagugggcaccuaauacuugcuccaugaugaaguagggaaggcuaagugaauguggauaggccggugacuaggaggucuuuaaggacuuuccccaggaucuagucagcuacaggacacccuuccugguagaaacacugcuuuggagauauuauguccagaauaaaacuuucugagagcuaaaauguccucauugacauuuugaccugagugauccugaaaaggaguuguuuggcaguucccaaauucuaagguggacuuggcugugcccauaucaucaccgaggccccucucucugggugaaaggagauuauuucgcccccaaagccuuuguucccaccauuggugacaaucagcacugacuuagaaguuaccugugagauuuggguacagccucaagcaccuggcagacuggggagauuggaccccuugaauucuucuuuucuacagagugcuccguaggcacaugggugggggagggguucccagggucuuacccauuugggcaucagaccuguuuuuguuuuuuguuuuucuuccaacugaaccuugagcagcuugccugaaucauccccagccuuaguuucucuuccuguacaaagggugucauuagugacugcccaucauaugguggcucaugagaaucaaggucugaguucuggucauccuugucccuuguggaacgugugguggccuuggcuguuugccauauccuagaaauagucaaaccaaccugguuugauugggggauucagugagguuuuuuuugugugugugugaaaacgaguguuuuguugcuugguaugcaggugcucaugucugcuaacccauacugacuguuguggaggugggcccuggguacagauguaccuuaguuucugaaacuucagguccaugugagacucggacagaguggagggcaggaggguagcaccuacccagcucuggagcgacauagaaagccuugcuuucaaauguuaggauucagcaguuuugaugggaggcucugagauacaagaccaggaagacuauuaagaacaccccucuaggagggcaaggccaaagucuuuggaaaaccaccaagguuuaauagacugugaauuggcuagaagucuugggggugguaugagaaagauggaaaauccuagaauagguuuuuauuuauuggaaaagucaggagcugguguguagguguugccccacccccauggcuguccagaaguugggccuucuacauagcucaggcuuucugagcacagggcuggguugcccccuccaguuccuacccugccuagugcaugaaaacucuuuaucugccauggggauggggagcagauggcuucaucugcagcugugucucucucagccucuacagccacggggacgccuugcacauuuccugugggacaugcuggacccaagacucuggacccuggccuccccuugaguagagagacccaccuacugacugaugaacugcgcugacccuggggucaggcauguggccuugaucccuacccauggacccugagacuugggggggugggagaaaggcuguugugucuucacuguugagucuacaucugugaaaugggcucagguuccuaccucacagggcuguugugaggcagccgcaaugugcuuagaagcauggggccuaguggcucauggugcuuucaauaaauuucuuguuuuaacuaaagcag

SEQ ID NO: 6828 - RNA, 5415 nt, Mus musculus
ggcugguucugggacgcugauaguuggcuaguucuuuagcacagaugauguugcugguugaugaaguuguggcccuucacaaguggguuccccuuggguuaggaguagcaagagggugugcuggaucugagcgaagcuggccgaggcacaagggaaaaugacagugacuugguguguuuucagucaaguucaucaucugagucugauagcucuucuagccuugccuguucccuggcuggggaaggcagcgccauucuggaggccauggccaggaaucgugugagggccugggccaccugaucucugcuaagcagaguaaggcggccaucggugcccaggguguagaguagccgguuguugaggaaaucuaggaccucuggguccaaaagauuucguggucugaaggugaccgcuuccuggucgccaaacagguccucuugcacgucguuguccugcgcguccugcgaggugucuugcaggccgucaugcaggccacacugacgguaacguugcaggucgucuugcagggcuucucgcaagacgacaucuucauccccaacgacgugcaguuccaaguaccggugcugguaagggucaggaaagacgucauccucaggguugacucugaccccaaagaacucacacagggucaaccagaacccaggggugaagcgcaucccccguggaggcugggaaugcagagcauuccgaugccagcaccuugggcccaggaaaagcucagccagcucucgagcugggaggguguuggcacccacuagagggggcaucuggcugagcaacugagcgauggcuguggccaugccacuacucgcaaugagggucgaguccaggaugagucggagugugugccggugcugaggccuggccacuuccaaauuaggggcaggcacuggggagaggggcugccuugcucucaacaucaccaggacagcugccacacccaggagacucuuccaguagagcaggccacggaagaaguuuaggacaacggcccggaucugggccacacugaagugagccaguaagccauugaggauaugguccaucgggauggcagccaguagcucccgcaccaugcugggcaccuccucaucuucuuccuccucauccucuucuuccucaucuuccuccuccucuucuuccuccucuuccuccuccuccucuucuuccuccucuucuuccuccucuuccucuuccuccuccucuuccuccucauccucuucuuccuccucuuccuccucuccuucuuccuccuccucucccuccuccuccccuucuucuucuucaccaucuuccuccuccuccccuucuucuucuucaccaucuuccuccuccuccccuucuucuucuucaccaucuuccuccuccuccccuucuucuucuucaucaucuuccuccuccuccucuucuucuucaccaucuuccuccuccuccccuucuucuucuucaccaucuuccuccuccuccccuucuucuucuucaccaucuuccuccuccucuucuucaucauccucuuuauccucagucucagaggaucugucaaaguaccuuagauuugcccuaauggacauaagcagcagugggcgcagaaaccuugcucugaagccucucugguuccaacaucugcggaagagugcuugugugucaccuucagcuggcaucuccauaacaccaaaauugaagugugagaagaagaagacccaaugcccggggagaaguacggugagccugucauuauucagagaggcuagauccucuguguugagaaggaucaugaugggcuccucgguguucuccagguagcggcaccacaccaugaaggcagcccggauuggaaggauccucaucuccacucgaggguacuccaccuccauuguagagaggggucuugaauagaaagcacagguagauuucuugccaguuucgucgucgguuuggaccagggaggcagacaggaaugacccagugaugucuguuuccaaguagaauggguucugaggcuuagggugauagagaacgggcgacuugcggaaagcccucuucagggauuccaaggccuccugcuccucuucuccccaguaguagggcucugaacucagcaguugucucacuaggggugcugcgaugacagcgaaguucuccacgaaguggcgauagggauagacaaggucaaucacacuuugaagacaccuccugcugccagggacagggcaccccacgaugagguucauaagguucuuguucaguuucaccccuuugggggauauguugaagcccaagauuucagcggucuggcgauggaacugaguuuuguccagugaacaguagauguugugauaccgaaagcggaccaggacuuggcggacaugcugggaguguuccuccuggcucauugaguagaccaggaccucucugccauggcaaaucacaaacaacccuaggaugucuuuuaggaugaagugaacaauguuguucccuucgucagaguaugaguucauugugaagggccgguagcaucucaucuggugaaggccgaaaccgaacgaugcucuccaagugucuuccgugugugugaccgugugccucaucucacuuuccuuaaucccaagcagcuccaguuuugugaaccaugccgcuccauguagcuggucgaauagcucugguaccaucugcguguagucuugucugucagucagcaugucauacaguauccaguauuccucuugcucccuggcuuucucuugcugccuggcuuucucuugcauccuggcgcucacagguuccaaagucucucgggccccagacucguaaaagacgccgcuuugaucacugucuccagccugcugaagcucagagggcucugauucagaaagaucaucggauccgucugagcuuggcuggucggaagucucaucaucugccucccucggguuaaacacgucggccaggucugaguauguguguggcaauccgggcaguaggcuuaugcuguaugucucuagugcgaugcaugguggagguggggugaagcaauuccgcagacaguagggagaguggaagguacaccggccucucauccagucgacuucaggggcauggguucggagccacuucaugccuaagacgauggagaaguugggcgaagguaagaugucaaauucgauguacucauaaugcuucugguggacacauaccaggggcucggugcacagccagacggguucauugccaauugggaugccauccacaccuuggauuaucuguggauaaggcuucucauagaguuccacauaguguuccugggcaaaccucucauccauguaguucccuucugcuccugaguccaccagggcccgcacugcgacacugugguagggguccacucucaccaagagcaguaagaagaggugaucgcgaucaaugucuggguggaacucauugggcagccagcugcuuacccuccacuucucuggggcgggagcauccauccaggcuacgcuucuugggcgcgacucagguggcagccugaguaaugcucuucucucugccagcuuuucuucaaguugcaggacaaguacaaucagguugucuagggaauucggcugagggauccggaacagauagugccugaucucuucguugagccccuggcacaggugggccugcaggacuucaucuggccagccuaagguggguaucagaccccggaacucauugauguaaucggccgcacagcgguuccccugccugauguugaacauggcgucuuccgccacacgcagggucugccgauacucaaacuuuucugacauggccuccaggaaggcugagaaguuguuuaucacugggcuguucugcucuacgaggucguuggcccauuccaaggcuaggucagucagguggcggaugacgaauuucacccgcagcucaucauuguauagcauacuuggguaguucugcauugucaucuggcagagcacgacaaacucaugguagucucugcgaucuccagagaagggccugagggagggcaggcgaccuucguugauagccugcaucaugagccuuucugccacucucuguuguucuuuuaggucuugcauccggaggaacagcgagaugacguuccccaugguggccacgacuucuucuggagaguucuugggcugaccuuccucuucaccaccuuccucuuccuccucuuccucgucaucucccaggucaguaucaucuuggucugacugggucucggaugaguugauuguuucauccaugcuauaaucggaugccucacugagugguuccgacccuuccugguuugaaauaucacuugacugguuugaacugucgcuugacuccugguucgaauuaucgcuuaacuccugguuugaauuaucacuuaacuccggguuugaaucauagcuugacuccuuuugugaaccaucgcuggacuccugguuugaaccaccgcuugacuccagguuggaaacaucgcucgacucuggguuugaaccaaagcucgacucaugguuugaaccauuacuuaauucgugguuugaaccaucacucgacuccugguucgaaccaucaucacuugauuccuccaugucuugggguagaucguuagaugaugccucacaggggucgcuggauggcuccuccacuucccggaguagaucaguggguagcucuugcauuuccugguaggggccacuggauggcuccuccacuucccggaguagaucaguggguagcucuugcauuuccugguaggggccacuggauggcuccuccacuucccggaguagaucaguggguagcucuugcauuuccugguaggggccacuggauggcuccuccacuucccggaguagaucaguggguagcucuugcauuuccugguaggggccacuggauggcuccuccacuucccggaguagaucaguggguagcucuugcauuuccuggugggggccacuggauggcuccuccacuucuuggaguagaucagugggcagcucuugcauuuccuggugggggccacuggauggcuccuccacuucuuggaguagauuagugggcagcucuugcauuuccuugagggggccacuggguggcuccuuuucuuccugggcugggccacuaucugagcccgccugggccucaaccugggccucaaccugggcuucagccugagccuccgccugggccuccaccugggucuccgccugggccuccgccugggccccugccugggcccccgccugggcuccacugcugccuggugucucuucaacgguguuggaugagcccucggaggacuccauuuguuuugaugauggauucuuaagcuccaucaucgucucaaaugagucuucagaggguucuaucaug

SEQ ID NO: 6829 - RNA, 5415 nt, Mus musculus
caugauagaacccucugaagacucauuugagacgaugauggagcuuaagaauccaucaucaaaacaaauggaguccuccgagggcucauccaacaccguugaagagacaccaggcagcaguggagcccaggcgggggcccaggcaggggcccaggcggaggcccaggcggagacccagguggaggcccaggcggaggcucaggcugaagcccagguugaggcccagguugaggcccaggcgggcucagauaguggcccagcccaggaagaaaaggagccacccaguggcccccucaaggaaaugcaagagcugcccacuaaucuacuccaagaaguggaggagccauccaguggcccccaccaggaaaugcaagagcugcccacugaucuacuccaagaaguggaggagccauccaguggcccccaccaggaaaugcaagagcuacccacugaucuacuccgggaaguggaggagccauccaguggccccuaccaggaaaugcaagagcuacccacugaucuacuccgggaaguggaggagccauccaguggccccuaccaggaaaugcaagagcuacccacugaucuacuccgggaaguggaggagccauccaguggccccuaccaggaaaugcaagagcuacccacugaucuacuccgggaaguggaggagccauccaguggccccuaccaggaaaugcaagagcuacccacugaucuacuccgggaaguggaggagccauccagcgaccccugugaggcaucaucuaacgaucuaccccaagacauggaggaaucaagugaugaugguucgaaccaggagucgagugaugguucaaaccacgaauuaaguaaugguucaaaccaugagucgagcuuugguucaaacccagagucgagcgauguuuccaaccuggagucaagcggugguucaaaccaggaguccagcgaugguucacaaaaggagucaagcuaugauucaaacccggaguuaagugauaauucaaaccaggaguuaagcgauaauucgaaccaggagucaagcgacaguucaaaccagucaagugauauuucaaaccaggaagggucggaaccacucagugaggcauccgauuauagcauggaugaaacaaucaacucauccgagacccagucagaccaagaugauacugaccugggagaugacgaggaagaggaggaagaggaagguggugaagaggaaggucagcccaagaacucuccagaagaagucguggccaccauggggaacgucaucucgcuguuccuccggaugcaagaccuaaaagaacaacagagaguggcagaaaggcucaugaugcaggcuaucaacgaaggucgccugcccucccucaggcccuucucuggagaucgcagagacuaccaugaguuugucgugcucugccagaugacaaugcagaacuacccaaguaugcuauacaaugaugagcugcgggugaaauucgucauccgccaccugacugaccuagccuuggaaugggccaacgaccucguagagcagaacagcccagugauaaacaacuucucagccuuccuggaggccaugucagaaaaguuugaguaucggcagacccugcguguggcggaagacgccauguucaacaucaggcaggggaaccgcugugcggccgauuacaucaaugaguuccggggucugauacccaccuuaggcuggccagaugaaguccugcaggcccaccugugccaggggcucaacgaagagaucaggcacuaucuguuccggaucccucagccgaauucccuagacaaccugauuguacuuguccugcaacuugaagaaaagcuggcagagagaagagcauuacucaggcugccaccugagucgcgcccaagaagcguagccuggauggaugcucccgccccagagaaguggaggguaagcagcuggcugcccaaugaguuccacccagacauugaucgcgaucaccucuucuuacugcucuuggugagaguggaccccuaccacagugucgcagugcgggcccugguggacucaggagcagaagggaacuacauggaugagagguuugcccaggaacacuauguggaacucuaugagaagccuuauccacagauaauccaagguguggauggcaucccaauuggcaaugaacccgucuggcugugcaccgagccccugguauguguccaccagaagcauuaugaguacaucgaauuugacaucuuaccuucgcccaacuucuccaucgucuuaggcaugaaguggcuccgaacccaugccccugaagucgacuggaugagaggccgguguaccuuccacucucccuacugucugcggaauugcuucaccccaccuccaccaugcaucgcacuagagacauacagcauaagccuacugcccggauugccacacacauacucagaccuggccgacguguuuaacccgagggaggcagaugaugagacuuccgaccagccaagcucagacggauccgaugaucuuucugaaucagagcccucugagcuucagcaggcuggagacagugaucaaagcggcgucuuuuacgagucuggggcccgagagacuuuggaaccugugagcgccaggaugcaagagaaagccaggcagcaagagaaagccagggagcaagaggaauacuggauacuguaugacaugcugacugacagacaagacuacacgcagaugguaccagagcuauucgaccagcuacauggagcggcaugguucacaaaacuggagcugcuugggauuaaggaaagugagaugaggcacacggucacacacacggaagacacuuggagagcaucguucgguuucggccuucaccagaugagaugcuaccggcccuucacaaugaacucauacucugacgaagggaacaacauuguucacuucauccuaaaagacauccuaggguuguuugugauuugccauggcagagagguccuggucuacucaaugagccaggaggaacacucccagcauguccgccaaguccugguccgcuuucgguaucacaacaucuacuguucacuggacaaaacucaguuccaucgccagaccgcugaaaucuugggcuucaacauaucccccaaaggggugaaacugaacaagaaccuuaugaaccucaucguggggugcccugucccuggcagcaggaggugucuucaaagugugauugaccuugucuaucccuaucgccacuucguggagaacuucgcugucaucgcagcaccccuagugagacaacugcugaguucagagcccuacuacuggggagaagaggagcaggaggccuuggaaucccugaagagggcuuuccgcaagucgcccguucucuaucacccuaagccucagaacccauucuacuuggaaacagacaucacugggucauuccugucugccucccugguccaaaccgacgacgaaacuggcaagaaaucuaccugugcuuucuauucaagaccccucucuacaauggagguggaguacccucgaguggagaugaggauccuuccaauccgggcugccuucaugguguggugccgcuaccuggagaacaccgaggagcccaucaugauccuucucaacacagaggaucuagccucucugaauaaugacaggcucaccguacuucuccccgggcauugggucuucuucuucucacacuucaauuuugguguuauggagaugccagcugaaggugacacacaagcacucuuccgcagauguuggaaccagagaggcuucagagcaagguuucugcgcccacugcugcuuauguccauuagggcaaaucuaagguacuuugacagauccucugagacugaggauaaagaggaugaugaagaagaggaggaggaagauggugaagaagaagaaggggaggaggaggaagauggugaagaagaagaaggggaggaggaggaagauggugaagaagaagaggaggaggaggaagaugaugaagaagaagaaggggaggaggaggaagauggugaagaagaagaaggggaggaggaggaagauggugaagaagaagaaggggaggaggaggaagauggugaagaagaagaaggggaggaggagggagaggaggaggaagaaggagaggaggaagaggaggaagaagaggaugaggaggaagaggaggaggaagaggaagaggaggaagaagaggaggaagaagaggaggaggaggaagaggaggaagaagaggaggaggaagaugaggaagaagaggaugaggaggaagaagaugaggaggugcccagcauggugcgggagcuacuggcugccaucccgauggaccauauccucaauggcuuacuggcucacuucaguguggcccagauccgggccguuguccuaaacuucuuccguggccugcucuacuggaagagucuccuggguguggcagcuguccuggugauguugagagcaaggcagccccucuccccagugccugccccuaauuuggaaguggccaggccucagcaccggcacacacuccgacucauccuggacucgacccucauugcgaguaguggcauggccacagccaucgcucaguugcucagccagaugcccccucuagugggugccaacacccucccagcucgagagcuggcugagcuuuuccugggcccaaggugcuggcaucggaaugcucugcauucccagccuccacgggggaugcgcuucaccccuggguucugguugacccugugugaguucuuuggggucagagucaacccugaggaugacgucuuuccugacccuuaccagcaccgguacuuggaacugcacgucguuggggaugaagaugucgucuugcgagaagcccugcaagacgaccugcaacguuaccgucaguguggccugcaugacggccugcaagacaccucgcaggacgcgcaggacaacgacgugcaagaggaccuguuuggcgaccaggaagcggucaccuucagaccacgaaaucuuuuggacccagagguccuagauuuccucaacaaccggcuacucuacacccugggcaccgauggccgccuuacucugcuuagcagagaucagguggcccaggcccucacacgauuccuggccauggccuccagaauggcgcugccuuccccagccagggaacaggcaaggcuagaagagcuaucagacucagaugaugaacuugacugaaaacacaccaagucacugucauuuucccuugugccucggccagcuucgcucagauccagcacacccucuugcuacuccuaacccaaggggaacccacuugugaagggccacaacuucaucaaccagcaacaucaucugugcuaaagaacuagccaacuaucagcgucccagaaccagcc

SEQ ID NO: 6830 - RNA, 3153 nt, Mus musculus
cagaggguucuaucaugucgucgguuggaaaggagugugcucugaagacugguaagauugugauguguguggucagagaccgcaacuguggagaccaaaaccuagggacagagggauaaaagacaggagaaaauguagcaauuuagguucucaagauggcagggucagauucuaucucaaggacaaagcagaugccaaguuacuagaaucagagagaaaauggagaaauuccuccugcauucaguucagccuccuuuucugguuacuuggggcaccuccaggggaaagaccgucacccccugaccugccuuccaggcggagucugacuaccccaccugccuacuuccucuaguggaaugagaaauucacagcccauaaauuuuguggagcaacuggccuggagcguccucuguggcgagcuagcaccuggcagggcacacuucuggcccgcuuugcccuggccagguucccuucccauuuguagucacccaaaagucauaaaggucacaucucaaugccacucaaagcggcugcuggcaggcuugguggucuagagccagcccagugagcuugguuggaggcgggaaucugcagggagaugccugcuauuucacaaacuggggaaagaggagaaauugggcacuuggccacuauccugccaguugggucaacagccaaaaauagcucuuauuuccuccucuaggcuccaagccgaaauaagugagagagagccauggcuuuugguuuuaauuuugcuccccauaaauguuuauaaaaugccuacuaugugcugaaaacaugcacuuucauggcuucauccuaggucacacuuugugcauaugcaggauaagaggggggugggggagggauaguaucauuucucuuguucgguuugaucucuguccaaagccacguuuucuccagcucugagcugagucggagcuuucuaaacacccuuucccgggcuuucaaaaaaacuguucucccaggauugccuggucugcagggcuccugcagcuuuaaacaucuggccucaauucugcucaugcaaacauuucugcacgucucacaaaugcuaucuuuccaaguuucuccucugcuucggcaggagcaggguuuucguucucaaaagugcccccccccccuuuucugucacuguugauuucgucugguacagggguauaucuaacagagguaugaaguugggugaaagggggggcaugggaccuuugaaaucugauuguuccguaauuuuugaaaaucuagccauggaggguuuagugcacggaaauugaauuuaaagggauguauugguuugcaaaacaaauuaagcuaguuauucaauagcucagccauauagcuauugucuuuaugaauucugcaccuucuguuacuucucaauuuucuuuuuuaaggucacugggcugaccuauccaaaaacagaaacacacacacauacacacacaaaaccaaauaaacagaaaucucccauguugucauucauguaaaacucccguuggccauccuccaaaccuugcagcaggaugcuuuugggucugcaguuucucagaauuagacaucuccuuguuagcaugacacuuaaauucgaucaugcaaccccucugauuaaagccucucacuguuuauuuacugucggcaauauuaaauccaaaccuuuuauauaaacaugucugacauguaaacuuaccaaaaaaaaaaaaaaaaaaaaaaaaaaacuccuggcugaaauugaaaggccuuagcauaauguccacguugggcuucucauuccuagaacuggagaucacagguccugagccugcuguacagaccaucagcucagaaacaugcacagcauauuacauaaaucaacuuauuuccucuuucaggaaaagucgucuauuauuaaaauauaaaauuugacuaauucauccccaaguucaucugcgggacauaaaaaucucagcaggucuccaccuaaaaauugcucaugguuucaauuuuuaaauuugcagcaauccgauuuuaaagcuaaaugauacccguucuaaauaaaaugccuauacuuaaaauauuacagacaaauuugaucauguaagggauuagauauuucugcuuuccagcccucaaccaaaaaucucuuguccuaaaaauuuuaauaugccuggauaucagaauaaaccuuuaguugagauaaacaauuuucaucuuaugauuuuccuauuuaacgcacacauauucacauacacagacauuucuuuucuuuaccaugaaguuccaguugcuuagcauaaauuauuuuuaaaccaugugauuuaaucaacauaaucaauacaaaaacccacaguuucacaggccacaauaaaacaucuuugacaaaguccaaagcuauuguaugguaacaaaugucgagcuuccugcaacaugcauguacuuauguucugcuuaacgccucacaaagucucugccucaccuauggagaccaagucuuaaaguaugaucauaaagccauacguuucucagcagacugagacuauccaacaugcaaagcucaugauaucacucuccuaaaaaucucaucguggcuggcauccaaauucuucagcauggcaugagaggacuccucacaccccucaccaccgugucgaaccugacacgcuauguaaaugucauucaaccucucaucuggaggucaccccauuucucugcacaaaaagaaaaaagucccacuggaugcccugguacugagggggccaguggacagucacccacgcaguaaacagcacaccaaauccacauaccuuagcauaaaaacacgcuucaacaucaucagauuccuuugaacacaaaacucuucaccauuucacuccuuaaaauccuuccuuggccaaacuccaagcaucccgcagcaccccccgcccccaugcaaaaggaucagaaaugauaucucaccccucacucaggaugcaauagugccuucaguuugcacaugggucaaaucuccuaaauauauuacaguguccacucccuucucugcugaauucacaggcuguaaggagucacucccagauuuaaaacguugcaaaguuucuauguagcaugaagcuccaaauucuuaacagacaguacaggaucuuaucaugucacguacca

SEQ ID NO: 6831 - RNA, 1383 nt, Mus musculus
uuuuuuuuuuuuuuuuuuuuugucauugcuccacugcccuggccuucuggugguauggauggacauggagcacuagaacagggguaauugugccaggacaauaagggacacaaauuauguuauuuacuuauuuuguuuuucacaaaugucagggucaagaugugcccuugguggguggagcccuaggguccuuguugcaucuccuaguggagaagaguaguuuuuggucccucuuccuauucagcuugcuggaugggcuaagccauacccucaucggggcuucuuaaaaggagcuugggucuaaugcugugguuccagugccacuggagucugcagggcuacccacuggucuugcccauuccacccuggcuugggcauuugagaggagagagccuuuaucuuucuuuucugcauagccacauuguucuccuuacucuguagucuggauaaaaagccuccaucaucaggccuucaucccuaugguggggcaacuaagcucuuuugaagggagaauccaaugacucaggauagagagugaaucaaaguaaguugaugggcauuucuugcacuauacccucagcuuguugcauccggaggcagagcugugcccuugacccagcagccuuguguccuggcuccuucauguuuaacuggaagcaugggggucagcucggucacucucccagaauaacuguggagggguggggggagaguaugccacucugggaggggcuguggggcugugcaggagcaccaacccccccuucuucuuuggguugcccaguugcauagccaaucagcugcuccugagccuaaacuuuccuuucaaggcaugugggcagagaugagccuuggauggagaugcagccugcgcagcugcuagccccgcuggggccuugacuuugcacauggccuucucuuccuaccccucaguuuccccuuggcuuucuuacuuucuucuggcaacagcauggcccaaagaaacagguggcgcucagggacuccuguucccccuugguucuaauacccgcaccuagaaauuaggcuccuacuuucauuuaaauccaagucuucuaauccaagcaaugguugaaaauuuacagguugucuaauccuugccuugaaucuacagcuccugccuggcucuggcaaauucuucucuaugccugguacucuuuuaacaacguggucgcaccuuaaugccugcaggcauagggcugacaguacuuguaucuuagagauggugacuucaggucaggaagaacucauucuaagcucugugagagguacagcucuagggccagggauagaggguagccagcccuauaacucucucuuugcccauuuagaaugggaagaggguauucccuuuguaaacuguga

SEQ ID NO: 6832 - RNA, 57779 nt, Mus musculus
uauggcucacugccccucagggggcagggggcuggugauuccugagggagcccugcccccuuccagggugaauuuuccuaagucaccauggagaaccagcagcccagaaucagugcccugccaggcagguaagcccaucucucuuguacuuuguucuuuuaaggguaaggggcuuccuagaggaguggaggucacacagccuuaauaagcuggcauccuugucucucuguguguaacuaaggaagacuuaguuaccugcagagaggaugcugaucaucaugaugccccugauggggacuagaggcacagggagagcagaauaaugcccuuuuaggagggagaagaucuuagaacccuaacuauagcuacuaacccccucgguaagaucagggaagcaaugccccgguaaaucugaaauagaaaagcgacaauaccugguggagagggagaguccuugccccuugcaaagguggcuguuugaggaucuuaauccucuggacucauuuauaaggccuucucaggauuuuggaauucagaggaaaacaaaggaaaagagccaaacaggaaagcagcguugggaaaguugcccccucccuguccccccacccucccacccagggugggugguguuuuccugaggcaacuuuagcuuuuuuauggggaugucuucaggcuguuucgaccuggaaguaacccuaaacugcagggcaagcacagggaguguccaucugaauauugcuuuuuauuuuuuuaaaaaaaucauauacauuauauaugucauaaaaauauuuugcauuugugaaauccuugccuguuccccaaggucuucgcagguacaggagcccacuccacaaaucgugugggcuaaagagcugaaccucaagugauuacagaccagccauaaaggcaacacagugcuuaaugcuccucagguuuuauuuuccccugccuaaagucauggcaggagacuagucugcauuucuucagagaagacaguuacccaguaaaugaaacagcagcuuugcaacggcagaaaaagguggaugagucuucagacugcugaguuuagaaaggguuaauuuuuuuuuugguucugagggucucugagcaucaagugcuucucugaagacguggguguaaucauauuaucuuugucacacacucagcccuaugcgcagucugagauccugacagccccugacagcugcagagggacucacuagcuaggucugaagcucaggaugcaagccagacuugggguaccuugaagagaaaggggucuucugaggaguccagugugcagugcgcuacuuggaugauuuagugaugcugaugccaggacccucugcguuagacccugaagguacacaguaauaguguggguugcucaagagucaagcugucagggcacguagcauggccucggcucguuaccagcaagcaggcugcacaguugagacacauaccacuucuguguuuauuucucuagaggaccguguccccugugccagcaucuaucucaagucacauuccccuggaguucccauuccauacagcuaauccccuagaacacgggccagcgcauuagcuuucugggccucuuaaggaccaaagaggaaaauguucccccauggguacauugcagacguugagggucggauuggaagugaaaucacagccuaggcucacaccugcuagcugcaugucacugacaggcugagcggacugcggcgucagcgcagaagcacagaaaauaaaaauuaaauuuaaaaaaaaaaaaaaaggaagagaaaaaaauauaaaccuugacuccccuuuugagucccuuugugcugagaauuuguuuugggcacccacaacuuuaaucgaauuuguuuuuugauuauucccuuugcuuguuuauuuguuuguuuguuuguuguuuggccaguaaaauccuccaaaagaauaaacaacaaccauaacaaagagccauuaaaaaaaaaaccccaugcaaaauauuuauuguaauuguacagcaaaaguacugcuaauuaauuuggugguugguaaaaguccaugugguuguaggacugagccccucccucaucuauagcccccuccucaauuuagcugcugugguccuccugggcuccugcauuuuucuguacauuugcacaccucuauaaacacaccuuuccagagucccugacuuuuuuucuuucgugcggaggcuguuucagagcuagcguucuuccuuuagcauuuuguaucagcuuguuuuccuccccuccagaauugcuuggccauaacaaagauccauugccuuucugaugacacccagcaccucggauucuguauacacgggaggugauuuaagcaucuuacugccacccugaaaucugggguccuuuauccuggcagguguaaguaauugcugagugccuuggaucuggggagagagcucccgagcccuuaugacauuauuacaaaugaauauaugaaugcauacguuagcggaaugaaaggcacugugccucggaccaacgaugggaaacugucuuggaacaaaagaucaugauuaaucugguccauuguaaaauccagacguccauuaaaagacaauagguuugcgcauuucccucuuuuuaagagcuguuuaauauuccgguguacguaugcaacacccuguucuguuauugaaaaugccagcuguccuguucccuuccuggagagugcgugcagauagaagccuggugaacauccuucucaucagggcaggucaggguuccuguuuguucaauaugguauuuaaaaaauaaaaccauaaauacauccauaaaaguguucucugcaaggaucagcgaggagggcacaccacacacacccacauuuuaauuaaugugauccagcucaacugauggccgauuaaagagagcuaagcuguuuucauuuuaugccauugcugauggcaccacagagaacauucugguagcuagccuggugaacacaucccucuguuuaucccagccccuuagcggugggcuagcugaguaaaugguuugcacagauuuguuuucacugagaaaucuuucuaaaauaccaguuugcucccguguagccuucuagcccuuucgcugacuucccagagcuucugggauuaaguccaaggggaaaggaaaaaagccugauacaaaaguccgguguucaacggcuuguacccuccuaauacuccccaccccacgccuuuccccccacuggacacacugugcuuaagcugaagaauaagcuugacacccaucuccugauagcacccccauaguuaggcgugugccccacccuguguccaaaauuucccaguccauggucuugaacugcaaugccuugcuuauaggauuuccuauucuaaggcuauucccccuguccccccuccccgcccaguguaauuaacaaaaugggucagagguuaaucaccauguucuuuugccccuuccagaagacccuuuuguguuuucccgacacuuacuucggagaccgccccucuaagcagagggccaugucgccugcugcguguugcuggugagucugcauaucgccguaauacuacacauggaaugacacacuccugugcacacaccuguacacacaugcaccucauaguugugauuaauuuuacaaugugacuauaaucucucagcuugcuccuugcccucucgucccaggauacaggauagggaaagagcugugacaaaucaguuauaaaacauacaggucugagaguggacauuugugucuuugagucggccuugccucuagggucaaaggacguggcauguguguguagggugagauggcgucgguacccuuuccuuuuuagugugggaguaggcuugucaaucauaaguagccaucuuaacucccauccagauacugcauggucucuagcuguguguccuuagguagcccaggagugucucuguguuuugguuccuuccuuucauuuuucuuuaaaaauccagaaucucucacacaggcccauugagaugucucugagaaaaauaacucauauaagucaucuggcauaggaacacaggcaggguacucaguaaaauccaagcuucccuagcccagcccaacccagccuggcccagcccggcgcgacccgacccagcccagcccagccagguaccacccauucccucccucuucaaggcagcucugccuuuucagagaacaugacugacagacgcaaaacaaaaagccuccaggaugaauaacgcccccggcuccccuacccaagcccugaccccuuuuagacccucccaagguaccccuguucuuccucaaacgccugggggucggcccagcuacccuacugcuuuuaauuggguuccccuguaauuugguagggagugaaucuuauuuucauauaaauaaauaaaagaaaucagauugcgcacaggaagcauuuagaggcucuuauuucacugccuucagcaugaaugacucccgagaaauaguggggguggucuccagaugacccccagaaagcuuagcugcucagugguacagaaacgccuggccugacucacuaagccgucugugugcugugcguucaggggaagugcaacuugccugucgccccuuacacagaagggacccuccuuguuugccugcacaaaggcgccucucucucucucucuucaauguuuucuuucuucacuggucaggcagaugguuccuccaugugcgacccugccacagaaacccauuucucaacucccucaagccuguauuucauccccugccuugagcaacaggaguuaucagagguggaguguucccucccuucccagcaggggcuaaagggcuugcugcccugugaccccagcuccugggcuggacuuuggguggcuuuccaaauucacagggaauccaaucugagcccggcagggucuucagucaccuuuaaccagaaauauuuaaucacaaaccugugagagugugugucaacgcacuugugcaugcaagcacgugcacacacacauacacacacacacgcugggcccccuggacccucuccccacauaaaaacagcaagguuagugacacguaugauugucacauugccaaaugucaaaugcccacauccagagcucucaacaaauccuuuaaucacaaaacaacaucacaacagcaccagcaauaaaaccacccaaacgccaaagcucuggggguccaggcugccuccccagcaaccuuaacccagaagcagccaggcaaucuuguggacacuggcucucugaccugcaacacgaugcugcccccacuuggcgggucagagcagccgaccgaccuugaggcccccagauccuguugucaagaacuggacagucacaggcagaaaccaggggaacuuuucucaaacaauucuaucauuagcauuuccuuuccugccguuuuggagauauuuuuucuccauugggauaugcccuucucaaggcuucaucaggucaggucauccugauuauuucauagacaagaaaccccagccaccuucacagcuggccccugaaaguacacacucacacauacuccacauauacugaguacaagcccaggagcaaugacaagagucucccauagaaacuacacagcacaggugugucugguugagggguauaucugcuaaaagcccccagugaaacccccauuaauaggcuagcauuucagccacagccaucagugcccaggcuccugagucuucccacuagguagggugcuuuuccaagccucccacccuauucaggucaugcagcccucugacucuguggcuagcaucuagccuccagaaaaguagccugcuuuuucuaugaccagcugauaccucaaccagacagacccuuuuucuaugccccccacccacuuuaccagacuguuaccuuacagaugauucaggcuagcacuccugaaaucagccagagaagacucuuagcugcuccagcuggcccucccuuaaggaggaguuggacagcucccaccaacccccacucucccaaagcacucucccccaaucacagugcuucucccucagugccucagugguacuacgcuaccaaucagggugccauugccauuuaaccucuggugagggucacggcaaaggccacccauccuuguccugaccccugccagguacccuccagccagccccacuuguuggcucccgacugggcacuggggcugcuucucaaaagccugucccuuugggcugcuagccagcuagagaaaccugcugcagcuuccccaucaccuaccggccugccucucugcucgggugccuccaguagcagugagcucucucuccccagccgcuugcuugggggcucacguacugagacgcuccucucagcccuccccugucuuuuacaucagccuccgcagcuccaacagcagccugcuuaugucucggcccucaggucuuuagaggaggcaagcucccucucuucaggguccucucugugcugucgucaauagcaaaacccccacccacccugagaauaaauuuggggccucuuccaccugucugggggugcuucuccuaugcucucuugccauugguuacugagccuuuugcccugcuguucuuccagcagcccaggggagggcguggugcuccccuuaggggagggggggcagcugcucugucucuagcucuuaaucagcucugagacccucucucccucucucucucucucucucugucucucugccccuucaccaguugcuagggagaagccucugaaugcaaagcccccuguuuucuauuuuuuuuucuuuuuccugacugagcaguggcugccuggccagcuccguuugaccugcagaagugggagcuacaagagcagcugcaguagagccagggggcucucaagcugcacagcuaagcuugacucucccucuguagccgugaggccacacaauucccuuuaguuuucagagucucgggcuuucccugugaaaugaagaugagaguuuuucucucaccggcuugaagugaggacugaagcagaugagaguagcuuagccuccaccagacacuuuauaaacgcucguggagucgccagugggauccaggaggagggugacauguaacaagugucauaagagagacaacagucuggcuuuucaaagcuccaugcugcauacacgcuacaacaucuccuggcagaguccccucugcaggcuuaaucacacaaaucaagccagcccggaggcagcucuuagccugaggaacucacaggagaugugggagauguggcaggcagcagaaagcccugcagagcccacaucugcauuuacuagcauuugcaugguuuauaacaagcauuuggguuuauaaagcagagagacacauacagagauauuccuucccugucucucccuugaagugacagcuaagauaaggaggcagcaugcuuagggcaugguauagccucugggaaauggcuaacucuccacucauucacaccagacacugcaacacucuuaccuccuagaucacuagggugagguuaggguuaaaaugaugaugucaguuggccggucggccgaucgcucggucugucagucagucggucggucgaucggucggucggucagucggcuuccugucuucgaacugcaaucauucuuaugagaaaacaaacaggaaauacuuugccacacaccaaugcaaucagggugggugauggcagucgggauucaagucacccuaguugaagcccugagcugggugggcugucuguccagaacucacaugggaaauuucacaaagaggaaaagucucaugaucuccauuggauuggugaagacaccauggcacagaaaagcaaagaaguccaauacucacagucucccagcuggugugagguugggccaggaugaaacccaaggcucuccgaggcuccccaccacacccugcugcugaagacugccuagcaaggcugugccgaguggugugggugggcaaaggauggauugacuaguuauaagcaccucccagaaguccuugagaucucagcuauuuuguggcccaaucccuuugaagggcagggucaaaauuagguguaggcaccuaccuauuagcggaggcuuaugaaaaugacauuauuaaccugaugcagagagggcccuauucaucuguaauuaaauuauaaauagaguuaguggggggcuagggucucuguguauugacugcagucuagagugcucagaauuuuccagggcucuggugaacuuuucgaugaaaagugucaccucugagcaucuggggcuuaaagcugggaacagagaccuccuaaggcaagccccucacacuagggaugugcccuauacugaccccuuuauggugggagagcccccgaccaccuccucaaacacaaacuuagacccugaccuuccucucaucucaaguugccaucugugagagagaaauggaaacugaaccuucugagagacaaucccauuccugugugauaagagaggggaaccaaacauccuucaaagagacagccuucucccagaaacuuuccugguuauugcuacgguugccagacaccugucugcuugucagagcuguauucaacaggauaacucuggcaacuucccuuccuucagagggagauguggauggggauagaggaguggagaggggacucuuaaaaaggagcagaaagcagaguucugcauccgauagaaguugggccacuuaagauuugugccaacucacggugcaguggaaauggucugaaaucuuuaaacagcagccaagagucuguggcgcccccaagugccacaagggggcugccugggcuacaguuuuugcguucccaaaugaggaggggggagacacgaagagggaccuacgcuuuggauuucugcggcagcgcuuuuaauugcagcagaugcagaggacgcaggcaggcaggcgggcgggcgggcgggcgggcgggcaggcgggcgggcggggggcgacagugucccggguggcuucaggcugcaccucucccacagagacugugcugcagugcagcaggagcugcggcgggcgaguggcugagggucggagcuguccagugucugcuuuccaaagugaggaaugaaagaugaaggagagggcuugcaggcagugcgaaguggccaggagcccaggaaacccaagggaagagugaagaagagccugugguuuuugcaggagggccagaaaagugugggcucugggaacgauggagagucauaagggguuaguggaccagcaggucuuggggucucaaggugagucaguuugcuguccugugacugagcgcaaacucaggcggggggcugagagcagccgaggcggggcggcugcaaacagcgauagggggaaaagcaucaauucuuaccuuucgagcaaggcuuaauuaaaaaaaagaaagagagaaagaaagaaaaaaaacgaaaacuagacagugugacugagccaguuacucgaugugugugacaggugacagugcuguucucuuaacuaaauuggcacagugucccagcagaaagauacgcagguugcugguuuugcccuaaggagagaugcugcugcggggucuuugcagcucaguggggagggucuggcggugcuagaggucccaucagggaguagauggugugaaucuggugggugucuguuucuagagugccccccaacacuuucccuucaguccacccaguuugcagggaguguuucuucggucccgugcuguuucagauccuuguaaaccagccucaggaugcuguguuuccuuuauugaguacccaaagcccccuccgagcuguuaagcguuucucuggacgccgucggcaccucugcacuccauuuuucacuuguugauuaaaaagaaagucagauuuuauuaugcuuuuuuuuccccagacaccacaaacggauaaaacaauguguucuuaaacagcacaguuuuaaccuguauuucaucuuccagauguagugcccaucaaauucacacacaccccugcuucaugugagcccuggacaccccccuccccucccacuguuaaaguccucaucuuuugcacugguuugaagcuaauucuagagaucauauugucucuucuguguaucucagaauauuuaucucuaagcaaagccguuuuccuuaauaaaaacauaaagauauccauugccacaaucuguaaaauaaaaauacgugggaugccauuaccacaauuaagaaauuaacagcuuuuccuuucugccaucuaaccucuaugcaguguccaaaucugccugaugaacucauaaauuacuuuuaugauuggcuuauucagauuucuguccaaagugcuuccugcacuuucaaggggacuguggggguucucuaagguaaguacagccugaaacgcagggcuuuauaccaaauacaaucucagugagccucgguuuuucucccugaaaacggagccaauucucagagccucccagggccaccaggcaaauuagagacagguacacacgcaucccccagccucauuucaaacggaaagcagacaccggcagccaacagcuguuacuugaauuaucuguuuuucccggaaaccucuaaaggaguuggacuggauagacgagagagcuggcuaucguccacaaaacaaaaggcuccuggcaggccauggccccugagugauuuagccacuugggagcaagggucgccugcacuccugggggcuagguccgggacccccacagggugcugguccacuagauggcacuaucugcuauguguccaggaccaggacagaccacuccccaagaugcucaggccacagccgaaauaucccagcccaggugauucuaaaacaucauuuuccacaugcugugcaaagugcagcggcuuuucucccugcaucccucccagcccaguagcagaaacgcagcgagugaacauuucacaacaauuugcugagaccaaaacacuauucugcccacccuccuuuuaguucccagcccggcuacaucugauugcucauuauuuuacagacaaggggaugagaaggggucaagcauuuuucucaagaucagcuaguuagcagaacccagggcugcagcccagguuugucuaauuccuuugcaaaauagagacagaggaaggauggagggucguucugauggauggguuucugcgugaggaugcaugagaugugcagggaggcagcuguauggaugauaaaugcuggagagaugguauauggagaagcacaggucagaaagcuucccugugcaugggagacagacagauggaugaaauaaaguaaauaaacaguuucucaccaagaucaaaggcuucccggcucuuccaagaguauuuuuuccuaguuaacugcuuggggaacccuugccuucugcucacuuucugacuguaucaauuaucucagguguuucugagauaacaggugaccccuugacccggucacuaggacccagucgcagcucuggcucugcagcagcucucuggcagcucuccgucucugcugcucucacgugugugugugcugaggaacagcaggcugcugccucuccacagcucuccuggaugacuaagcccagagcccuggccucacgcucagcccuccucuugaacuucguguucuuuuauuaugcuagaucaucacagccacccuccaugaugguauuuuccacugucaaucaaaagggggacgaagcagaggcuuagagaugauaaaagacuguccccaacgucauccagggggcugauacagacccagccugcuuuuuuuuuuccgucuaaacccacacucugacagauuuccuuuccucugugaccaugccuggaaaaaaaaaaucuguguuccuuaauucucccugcugucaggggcccccuuugggggcuaaacuucucauccaaucaaauuuuaguuuauuuucuaagcagcaucuucucaagugcguucuaucuguaauuaucacgcaagcaggggccacacguacucuggcauccugagggaaaauugagcuaguuuuccugcauuuucuauucugacugaaugcuaauguagcagguguaaggaaaggcuccucagcccagagggguugcaaggcaaggagagacucugagaauggccccucugcacaacuggcuuagcuuuggcagguaggguuugaaaaacugcaucuggaggugccaggaucugucaggguuugucaaugagcuuucugcaugcacaucaaccugaaugccucaguuuacccaauuuucgcauggaaaugcaaaaagcaccuuuucauuuugagacagggucuugcuguuuagcccuggcuguccuggaacuggguagagcauccuggccucaaagacacagagauccaccugcaucuacuuccugggugcugggaccaaaggcaugaaucccauugccuggccacaggaacuggcauuuaaagugacuugaggggcugagagaaugguacaguuuccuacuuuuccagaggacccaaguucaguuccaaaaccucaccucaggcucuaccagccccguauagauucuacacccucuucucaauucucuaacuacugcaaaucuaccuaagugcaguuuaaaauaacaaaaauaaaugaggugaacugaacccauauaauccagaaaagaagcccgggauguaguucaguugguagaauggcugccuaguauucauaaagcucugaguuugccucccagcaccauggaaaagugggaggcagaagcaggagggagagauguucaaguucacccuugacuauguagcaaauucaaagccagcuugggguacaugaaacgcuucuguccccaaaagguauuuuuaaaaguaaucauuuuauuuuccauauaauuauuauaacuacugagauggggcuuaauaccuuccuuaagacuccucacccacaugguguauuuacagccugguucugcuucuucccugcugugugacgaccagcaagucacuuaacaucucugaggcucaauuugccaaagcauaaauuaggacuucucaucuucauccaaaucucaccaccugagugaggcugucucccuggauagcugcucugccacagcccaggggccccccaauccugaauguuacucugucagcccauaccuugcauuuauucagucugaguguucuuuuuuccuggcuuuccccacagggcuggucguccuuacaggauuuucccuuguucucagcaucuagacccguaacgcccacuucagaaugggagggaggaugucugcugcccugucgucuccacacccgaggaauguccguguguguguguguguggugugcacagcgggcugcacacagcgggcuccacggugcucgguacagugucugcauucaguaacuauuggcuaauuaugacuaauugacaggacuguugugggaacgaaaccgugugcugagcaguccgugcugggugcaggacaaacaaugccuguggcugggggcccacagggggcucguucgcuugacaccugagggcccccccaccccccccccccccccccguccugggagcagcucagagaacuaacuggcuuggcuugguuacugggagccuccuuccacuuagaggggagcaauaugcacugggagaguuucauggcaguauggggcugggggaaguguaacucaguugagagugcuugcuuggcguucaggaagcauuggguucgaaacccccagcacuguauaauacugggugcucugaaccuugcacucaagagguggaagcaggaagggucaugaauucaaaaccauccucaggccagccaggucuucaagagaccucuaaagaaaaccaaaguaaaaccagugauccuacagcacagacucccugcaaugugguucaguuuucagaagugagucccuguggguggauccuuuuuuuuuuuuuuuuuuuuuuuuuuaaaacuaugauaucuugaccacaaaggaacagaucccgguaaugucucggccaaggucaggcauagaguucagagcauagagcgaguuugacugucuaauuuuuaggagaccuguugagcagauaggugugugggguggguggagcuguguggguaugcaaaggguggguguggcuuugaggaucagucaguuugucagucuauccuucagucugccugguccaucgguuggucggucggucggucgguaguccuucagccuguuggacccaggaaggugcugcuguucucagucgacaaauccuacgaguccggggccuaagacggagagaccaggucacgucucugcaguuacacagcucaugagugccugcugggguggaaccugguuugucugucugucugucaccaucgcucgggugcugcugcugcugcugcugcugcugcuacugcggggggcaaagauuugugaaaggggcuuagaguugcugugggagggcuucugccuggcuuugaggagaaggauuaucuuugcuaagggaucagaggcguggauguuugguagaugggaacagagcacagagaggcuucucaauugauguagaugucacccagcaaguuagaauuaaaggcugaguuuggggguggguaucauuguguggguauuuuuguaggcuaugcuagccucaugacugugaccagacguagaaguagccaaugugugugaggaccugguuucgaguccugucaccaaaugucaaauggacaugucaagcuguauaucuucagcagaccaugggcucuugaaaagccuauuucaagaacacacaucugucuccaugcuauguguauaaaagcaggagggacaagccauuguuaaaaacauuuguguggccagcaggacaguggggucaaaagggugggggccaugcgugguuaguccuaagugguucgaauacuaauuaauaagacccggauaaggccugaggacaagugugggcugugaaccaugagauguguuaacucaguacaaggggcuaacauggaaagagaacucagaggggaauugggcugcucauguuauauuaaaaauuagaaaagaacaagaaagacuguccucaugccuuggauccaucagccgugagacuuucaaauaaagucaaagagugacccaggucugcuaaccugacauuuaugagaaaacggguccagcagccauuuccugccauucugugccuucauguggccacuuuggauagguagcaggccugggaggucuccuuucaggaaguaauaaggaaugguauaaaguuauguauaaaagaaauuaugcaugauuuaaauuaauugugcauaaaauuaaagagccucauagguagacccgaagagguauuuuuuuucuguccuguugguuuaauugacaaauaaaaauguauguauuuaagcucugauguuuugugccuaguaccccacucuguaauacuuaugugggaggagaauaucuuggacccuccguguuaauucucaauauacgucacuguugacuagaauugccacucuguacguacauuagccacugagaacuuaauauucuugcgaaugcgaguuguauugucugacccacuccuguuccucacacccacugaccucuaccaacugcccuuccacucugaguuugugugaaguuauugagagaccaaccgcagccguaggccgugaguaagauggcccccgcgugagcagaacugucagggguacugcucuguuugccuacuucaacugaauuuggccugcauuaaaagaggaauuaaaugagucaguaaauaauggccaggugacaggaucccaggagugggccacuaaaaauguuuuuuugaccaaaagguuaauuuuuauucguugauguauaauuguagccuuaaaaaacuucuauuuuaccucuauguacuaagauguggugagauucgaacuaggcucaucuguguuuauuguauuuaaaauguaugaaaacacugggaagaccaaauaggcaaugaugaugagauuguaucuguaaucaaagauggcugugucucuuacucuguacugggucuguuucaaaaagggucuguuguuuccuuuguggucaggacauauaggaucaauguuuauaaaaaagaacugcuuugggguuggggguuuuuuggauagugaauuuguacacauucauuaaaaugauaagaaaugauaaaugaaugaaugaauuuaugaaugaaugaauaugugcuugggccuguaugaugauccuagauuaagauaaucugcccugcucacuaauggcuuugaagcaaguguuucuacuucguccuuuuuaaauaucugccuuguguucuacagaauggaggcccuaaugugaauggagacuagccugcugguagagaccuuggcagugaccgcugugggcaaugagccaugggccaacaaugugaguaauggcuaguuuuguuauuuugaacuuggguaguuggcugauggguguuuauugcauuauuaaacaugauugaguuuguaaauaaaaccaaagauggccaaagcccuagccaguguggagacugucaugaaccaaggguaauuaauccaauuaggcauaauaauuaccgaauuagaaguaauauaguaagcuauuucguauggggaaaauaucaaaggaaaagggaauuucuuaugcuugggugauaguucaauuguucaugugcuugccuuauaagcaaaugggccugcaguugaucugguggccauauauaaaaaacuggucacgguggcauucuuagagucucaguccuaaggagguagagacaggaagaccucuuagguucucuggccagacagauuacccuacaugguguguucuaggcccaugauaccguaugucacagauagugccuaggggacaacuuucaaguuugaucucuggccuuaauauguauguacacauacgcaccugcacagagugagcacaccacccaaaagaaguaugcauaugcuuauuugcauacacccauacggcauaugugugucauauguuaaguguugcauauucuuuuaucguucucagggugggguguuuaugcaucuucaugauauauuuaaaauuugaugcccuuauaaaacaaaaugaaugggcuaaagaugccaugaccuaugcuucucaucuagacaugugcuuaugugugaaacauaccaauucaguaaugguacagcuuucuauaugcaaggacacaauuggaagcuccugaauguaaaaacaaaacccgacugguccacccauaggccauuaaggcuaauaauguaaaauaauuaagcuuaccaauuaaucccaugcagguaugagucucugacaguuaucucagaucauagguucccaauaacuucuuucuauuacauagaguggguauauggugauuuauuuaguccuguaauauuuguggggauuaggacucuuauuuggagacaagguacauaaaggauaagugagaguauucauguuuacaaacaacuuuaaaauguauuuucuuugcacaaguuuuuugucugaaucuauguacaugugccacaugaugccuguugcccauggaagucaguagagaggguauuugguuccuaaaauggaguaauugauauuugugaaucacuacacgggugcugggaacugaauccaggucuuuuggaagagcaaccaaugcucuuaaccuguagucccugucuuauuucacaaucuuuagcuagagagucaaagauaauucaucaacuagcaagcaaaugacacauggacucauugacacagcuaagugcucgcuaagacuuuaugauaucucucaacaucucaggauggauacuuagucaugggugauacaauugagcaucccuaggucuuccaggacauagaauugacccaugaaaggcacacugaaaaguguccccauaguauuccaucauggcauggcuaaauuucauagauauuuucuugacagagcucuguagaccacauuaaaagaagauaaaccacuuaauacccucauauuauaguccuaauuaugaacaucaaagguccuuuaaaguauguugauuagggaauuagucgagacauuuauaaccaugcaaacacagugcuguguuggauguuaauuuuaguauucaauguaaauaauuacaccaaggcacaaaagaauugaaaacccaaaacauggacugguaaggagagcgggccaagugugaaaggauuugaauuuaguaauauccuaaccacugaagcaacagccugcucauuccguucuguucuccaucuguucuggguuuucuugugauugcugcaugauguguuaaacuuuugaccauaacuaaaguccuaggcuguuuauucuuugaguaaggagugggaagaaagagaugagaggccuuggccaaguaagaagucucagaugcuacuugcaucggugaaccuugcuugcuaacauuuccuuagacacaaugaaaucuuagggcuagagagauugcuuagugguacggauugcagaucccagcuccccugugucaggcagcucacaauuaccuguaauuccaguuccagggggccgagaucacuuuguuggucuccaagggaaccacaagaaugcacacacacacacacacacacacacacacacacacacacacacaagacaaaaugaaucuuuuaaaacagagaaaugaucaaaucaaauggaagagaggcagugugaacugcagaugauggugcagugucuccagcuccugacuaguccaguuaagcucauuaagaaaaguacucucccauuacagggauaaagagcagacccuacuucugucucuuggaucuuugugcagagaggagaaugucugugauugccacucugaagugguagaauguagcuucauagaacuguugaauacuugauguaaggaauggaaauguucuuuuucucaauuuuuuauuaauuuaaauuuaaauaacccaguauggcuaaaggcuuuccccuaguuguauuagguaauugucucauggggagggggcuuuagaaauacuauacaugaauaaauaaacacauaauuuaaaugaaugauuauuaauuuuaagcuaauagcugaauuacuacaaagaauuauuauaauuaauauagugcugcacagcugaauuuugugucuaauucauguauuuauuguuuuuuuuuuaacuuuucaauauuuacuugacuucauaccccauagucuaugugaaauugucucuaauauugaaaauuuauauauuuuagugggcaagaaucaaaaagguauugucaaacuuguuaauggcauguuaauugucuuuugaguguauucuauauauuaucaaauggccucaacaaaugaguagugaauucuaaugggucaggaauguagcucacugaaugaauauuugccuggaauguggggcguccuagguuucaucaccaauccaacaaaauacaagacuacagucuaccuguaccacaacaaugauaguauaauuucugacuaacucagagcaacagaaugcaaucuauaaaugaaugaauguccacuuuaacacaacuucacuccaguaacagauacuaaggccacuuaauugguuagcauucagucauucacauuacuuugacaccaugguugacuuaauucaguaaaaauguucagaauagcuugugugaucaacuuugaaucccaaacaaaugaagggaucagggguggggagucggggagggggaagaagauaaguuaguggugagugugggguaccucuagugucaagaguauuuccugugagccuagcaugggcucaugccuguacuccuagagcuuuugagacuuugagguuauccugggcuaaaaagagaggcauucuccaugccccccaaaacaaacaaacaaacaauagagaaaugaaaacaaauaaaaggaauauuaguguagugguauauacuaggauuaucagcaagaaagcugaaguagaaggaaagaauguguguucaagguuagcauagacuacauagagauuugggagggagggagggagagagaauauaggaaaagcugagggggagggggagcgggugggggaggaggaagauuauguaaagaaguaccuguuuguuugggaaguuagcccacaggcacacacuauccaauagagcgaccacuagcagcacuaaacaggcucacuguauuuuaaaugagaugugcucuccaucugaaguuccuaauguagcuaucaguucuugauuaagugucuagauugauaagauguaucuacuuauuuauuacaucauuuacucagccacaaugauaccuuuuagaacaaacaaacaaacaaaaagagauaagcagcuuucuuuguuuucaaauuccuggcagcugauucuuugagauucaggacaaugugucagaguucuaagcaauuucaaaauuaugauuauuuuaaacauacaucgaaauugcaugcuuaaagaauaaagcacauuauauuuucuuguaguuacaaagagcuacagccuacaagaauauccaaauaauguaacugcauuucauauucagaucuuucaggaagguaacagccccucauggaauuauauguggauaaugccccuuucaggacuuacuuugaauugaagccgugcuagauauugagaguauucaaaucacucacacgaacccauuaguaugggcuuuuuuacuauucaaucuuuuccuucuuucuucauauuauauucuacccauacacaugcacuuuauauauaauacauauuauauauaauacuuucauacacuauagauacauuguauuagaggaucuguauauaagggaguuauaaauaaaauuacauaaauuacuaauggaagaagccaauaaauaagauaugaauuccucuuuggcuaaucauguguauguguaaaagccgugguuuuauagagugugaauuaaaagcuaucagauugagggccaagcugguguugcuccugaauuuccugaaaccuguaguuuuuaaaauucaaauuuuccaaaauuuauacaaaucaugcuaauuguuucuaaaauguuugucacccuuuugauaaauauuauugccacuuacuaaaauuauuuuuaacccacagauucaaugcuguguaccugauggaugguuacugucugagacugaggcuuuuugggccaggaguaaaaggacuuggguaaguucaaugcuugggguccugguguguugagugauuugugccaugcguggguagguucaccucaaaaggaugaauaacaucuaccaacaggcauaaaagcaaagguuaggcaggaacgauggcugauggcucacucuucuuauucuaguacuggggagacugaggcaggaggauuguuuagagccguccugggcuacauauugggaucuuaucuaagagagagaaagaaaacagacuccaaaccaaaaccaaauagcuguagacaaaaccagacaaagcaaaacaaaaccuaaaaggagcauuaaaaggaugccaugauuggagaagaugugaaguguuuuuagcacagaugugacaaucacauagugcagauauuagcuagcuagaaauuagucauuuugugguguuuaaguccuugaaacaucaugugcacacuuaaugugcacaauuuuaucuuucaguuauaaaagcaaaccaagaacaaaaugaaucaagcugccaggugucagcuguugguggguuugagauugacugguuuuagccuaacccagguccucuagagauaagucuggggcugucacauuuguccacacagucuucucaaaggcuauucugucuuuaugugauucuagcccaucaguagagaucugaguaacuuaguaggguccucaauguggucuguggcucuccagcuucacagucuguuggguacccucucgccccauugaaugaauagcagugugggaagaagcaaugugauugugaucggguaauuuaucuaccugggccuuagguccaauuaauauggcaccuuauuuaccugcuuugugaacaugagcaggacaagagcaaaaagauuuuuuuuuuuugauuucugugauucaugggcacuaagauuuuuaauuagagaaacucugaaugaagaaaaaaaaucaguaaauuaugcagaaacagucguuaacauacagauaaauaaaugaggcaaacgcauugagcgugaaucaguaaugagugguucugaggcuuaugcaucaauacuuuugauucaaccguaaacugaagucuauuagaaauacacauaauuggcggcuucuggggggugcaaaugcaggccaguguggccucuggcucuuggcccccaguggcaccuguaggaaugugggaggaaaauguucauuguuaccuuugggucaguuaggacaucacgauaugaagcaauaguuguuagucacucuuuuuuuuuuuuuuuuuauuuuauuuuauuuuauuuuauuuuauuuuaaggguuuuuuugagacaggguuucucuguguagcccuggcuguccugggaacucacucuguagaccuggcuggccucaaacucagaaaucugccucccucuuucuaaugcuacguucuccuaugcuauaccaauaaaaccugcugcaccuccaggccauguuagaccaauaggcauacagacauacguauguguauuacacauacauagguguauuaaagugucccccauagacauuuuuggcgugguaggaggaagagaggaccaauuacauaaaugaacaauuuuauaaguauguaguggaauagaagcaaguguggccagcagagagaauguuuucuauaaugucagacaucauuuuucucucauauguggaaucuuuaaaaacaaacaaacaaacaaacaaacaaacaaaaaacuaaaccagaagggacuccuguauggggaugggaagaauguggguaaugggaacagaguauuguuugaauauuugguagacauguuugaaaccguccuuugaaccccaguguuagugaaauaaguacgcacugcugaaucuaaccauaggcucuuuuauucuuuugaaaguuuguacuugauugcguccuguggaugcuugccuaccaacugacucauccugacgugccaaagguccuggcuuuccccuguguggguaagggaagaagagaguucugugaguaauagcuucgguuguauguucuuggcuugggaaguugacucaugaguggguguugcuugcauuuuucuaagguaaaaaaaaugguuauaauucauaagcaaaauuuauaaaugccaguguuaggcagugauaggaacaucaucagacuaaggccugauaauuaauaugauuuagcacuaugaaaaauccaccaaaagaagagaagcaguuuuucauuuccaggguugcuuacuauucuauucuauauauuauugaaugugauuuauuuauguaccuugucacugauaacacuuagagguuauuaauuuccugaugagaaaggauagagaacaaugacaaaagucacuuguuaauuuuaguuguguagaucauggcccuuugcucauccauggcaccuucuuuaaggccaaaagagggcaaacuuuagacuauagagaugguaggagauaagaacccugaaugauuuaaauguggaaaacaugcacagauauuggggaaaacgacuacuaauucuguggggaauggacacuugauagauagauguauuauucaguauuuggugcucucgggcauuuugauuuauuaauucaucacauauauauauaaacacaucaaugaauaaagcagcaagcacugggagaaaguauaucaauagguauauagagcagcgaguuuucuaagaugugugaaucaaagaguuuggccuaaauaacucacagguauaucagaacaagaaaccauccugguguaagccaugcuucuaacacagcuggauauauugaaagaacuuggucuuagcuguccacaucugugacuuguauuauaaugggacagauucaggaaugaauaaagauggccaauuuuuaaaaagcaaagacaagaaugaaaagaaacaaauauuaucauucguuguuguuaucuucugacccacugagcuucauucuccacauagaucaagucuuuuugaccauuccccugaaggacauguccugggucaugaaccaugauguugcuauuugaauuguguugggcagcuggcggcugguuuuauuuagacaagagacaaauuauuuauaugaaaaugauuguuugaauaauugucuaauuggaagaaggccaagcacggaugacuucuguacacaugauaauaagcauuaucaaucuaauucuguccaccaaagacaacauucaauuguaucucugauccccaggucucugugcguagcuaaugguuugguccacuaucaguuuuuuuuaauguaccccuaaagaugaaugaaagaaugagcucaucauuuaauugcucacagggagcacauccaggggcaguuggaagcaaguuuuuuaaaacagaaaugugcacugguaauuuuccuuuuauuaugauugugaagccaagcacauaugcuaccaugcauguguggugguccaaggaccauguuuucuggaguucuuccucuccuuccuguggugguaauaucacaguagaacuucuuuguuguggaucucucagugccuuuaaccacugagucauuuugccagcccagagaucugauuaauuuagacugauuaaugauaaauaaaagcccuccaucuuuaacggacuugaguuguauuaaccagaaauuuuaauuucuaugccuguuccuagauuauauuuucucauuuucuuccuauguugguuauuuaugccuuagaaauaaguuacugauaaaccaccuacaccaaagauaggaacucuagaaguacaaaagucccuuaaccacucaggcagaaagcaacauuuucauccuuacugaacaauuacaucaaccaugguauucucacucuguaaaguacaauacucucugugaagaauagaaaguguuuuugcucugugaaguacaacauacacucuacaaagaauggaacccacaggcuuaaauccuuuaauagacugacucaugagagauugggugacuaauccuaacuugguugcuauuacauucccauuauugacucccgaauaacucucuuucuuauguaaugacuuauguacucuuuaauuuuuaauacaacagaaacuaaaaucucccaccccacacaagagaaauaaaugcagccauuaagacugucugugcugcuacccacagacacccucaucucauuuaucuuuuucaagggaccucgcugugcauuguugagggucuaccuugcaacagcgaucucagguccccuaauuuacacauucgcugacuggcucauuaucuuuauucuguagguagcuuauuuauuccuaaauuacacccugggaauagaugccuggauaugaauaaaagaaaagaaugcuugucagaccagcacacacuuugugguuuuuaugaucuugcagagcugaagucugcuaaucauggaggcuuuuuauuuguucucuggguuuuucaguauuaggauuuguuugaugucauuagcaauuuacacauuucaucaaugguaaauaucugggccaugcacucccugaggugggcacaugcagucugagggagaaggcaauguuaauguccuuguugugacuaaagaacaguuccugguggcacagucuuaucuccucuaaccugaaaagccacaaagguucuugaaucugagaugaauaggggauggucuucguuucuuccuggaaccucguuuugagauaguucacuguauuuacugaaauauuacaaaacuuggagcguaaaaccccaaauuugaaacauuuaccgugucaaggaugugagaaauaggaggaucagcugugacuguuguagucucuagauguccuggaguggugacccagugaugucaucgcucaaaguaugaagcacauuguuucuuucucacaguucccacaaagccagaacucgggaguuucuaugugugaucucucgucaguuugcuugugagaugucaggugauguggcgguuugucuaugcgugggugaucugucugcaagguucauguucauggcuggcugcugauggggaccacaacuuugccacaagagcuuucuucagugaguguccuugggacaugguaguuaauuucccuagagagaucuuugcagaacagaguuagguacauccuucguaaaacacacaaaccaucucccuaaagcacaaacuucuccagggcucuccugcucacauggugagccgugaucccaggugaauagagguaaaccaggacuuuuugugccacaggcugugguucccccaccugcaaucucuuagaggcugacuaaguaccucuaaguuaguuaccuaccccuaaguuaguuaccuaccccuaaguuaguuaccuaccucuaaguuaguuaccuaccccuaaguuaguuaccuaccccuguuaguuaccuaccccuaaguuaguuaccuaccccuaaguuaguuaccuaccucuaaaaguuaccuaccccuaaguuaguuaccuaccccuaaguuaguuaccuaccccuaaguuaguuaccuaccucuaaguuaguuaccuaccccuaaguuaguuaccuaccccuaaguuaguuaccuaccucuaaaaguuaccuaccccuaaguuaguuaccuaccucuaaguuaguuaccuaccccuaaguuaguuaccuaccccuaaguuaguuaccuaccccuaaguuaguuaccuaccucuaaggauaguucucauggacuauccuuaacuuucagacaaaguuaauuagaaacuccuugaagugaaggagcugagcuaucucaugugcucagaaccuuuguaagagcgcuccccagagugaaccaucagaggcaucucagaguguaaggagcuuguuuucagauucauauuucauguuuauugaauuuauuagugguuaauaaaugaccugauauacaaaguuaggacuaacuaaaccaaagacauccacucucugaccaaugaugagaauucuggggugucugaaucaaugauuaugauuaacccugucgcucugagugagguccauuagaugcggcaggugagauggcucagugccuuaaggcacuuacuugcugacaaacccaaguucuuggguucaaucucccggacccacuuggugaaagaagaaaacugacucucagcagugucuucugaucuccacaugugugccucugagugugcaaauagacagacacacacacacacacacacacacacacacacacacacacacacauacacacacacacucaaauauguaaaaagaauaaacuucaguaauacauuuucaguaauguuauuggaaauuagaaacuuuaaacauuuuuuucuuaagauuuuuacauccauaagucuguguuguuucccuguaaguaagcuaggcaaauauuuaaauaaauacauauuuaaaugaucaugggcagaaagauagcuguauguggucuccuugugcaauugccuaacuuauguacguuuguagauacauuugaaacagucaauuccaacauaaauguauuaaaucugauuucuagacauuugcccgggccaccaauugcauugaucuucauuacuaaggagagagugugaucuagugggcacagccuugcugagguucaucccugggacacugacauucacuggaaggaggcaguuauaguuucaauguucacaauauuguguuuguuauuguugggguugucacugucuguugguuuuauucuuguuugugagugagggaaugacaauugagaaacagacccugggaucagucagcaagucugaaguucugagucucacugugaggggaaacagccaccauuguuaugggaagugaaugggggaaggagcagguuuuuuuguuuuuguuuuucuguuuuucuauugagaugcuuuaguucaaauuauauuuuuaaauuaaaucaauagaugaauaaaggaaugaaaucuguaagugcauggaaagaaaugaagcagagccauggguggucggaucaguuaugaugacguggauuugaaagagaggaggaggaggaggaggguuagucugcagucagccugccuguucccugggcuagucuauggguuucuaaggaaagccugucagaguuggcuccugggaugaguagggggaagggagauuggaggaagggaacuugugugauccuuuggagaagggggcagggaucuuggaagaagugggaggagggguagaaggcuaaggaggggguggugugaaggcuugcuguuagcucacccaugcuacuggcuggagauggcuuuguauuuucgauuuuauugauuuuuuccccccucuaauuucuguuauuuucuuucuuuuuucauuugaucucauuugcuuucuuugucuaguuuccuucuagguaccaacauuuuucucuugucugaaacuuucuucucuguacucaugaaacuucccauuucuucugucuaccaaagauacuuguaccugccauucagguuucacaggauguacauaggaauuuaaguauaugucagagauuacagucagaauauaccauuaaaugguggugaccauuuauccaauacuaucugaagacggcccaauaaaagagagucauagccuauaugaaccugggugaggggguguauuuugaauagcugcuauauuuuuaauagugacagggcuugggggggaauuuugaauagcuauauuuuuaauauugauagggcuuauggguuaauagauccuacagugucuuuuacauggucucagagaagcccuaguucauuaaaaagaaaccuaacuaggcucucuuugaauuucuaaaucuugcuaaguguauuuuucuuccacaaaaugcucacagacagcugacuuacugaguuuuacuaagaaacaaaaucacacacgguauagcucuacacauaaggaacagagaggauguugggagugagacaccagguucguggucucccuugggaugcuuuguucaugaaccuuuagugguacuucaaaaggauacagcuuucaaacaauaaguuaagcucuguaagaauggaccgguggugaggaugugcuaggacccauuuuuuuuuuuuuuuuuuuaaagauucaucuaauuugguguaguggcaaggaucuuuaaaaaauggcaauauccuguaaaggagauuuugccccuggaacauuguguuguguccuauggacuaaugaguuggcccgacgagggguggaagggagauguggaggaaggaagguuugucuggaccggugaugaguuccacaggguaucugaaccaggauauugugagaacuguuuacuguuguuuuuaauuuccuaccacauugauuugaagauuugccuaucaguguggcccuggcugauaaggagggcgucacaagugguagaagaugcuggcgucauuaucuuccaucagaugucuuuagacaagggcagauucacuuagugcaagguccagcagagcagcagucaaagcagacagagaugagcucugggugcuggugaaggucucucuuccccgagcuccuugguuaaggaagauggaugccuucaguaaagggagaguuuggucccuggaguauuguguuguguccuauggaauaaugauuuaacacgagaggagagauggaggaaggcuuuucuggaucagugaggagaacuugggggaucugaacuaagauauuguaacuaaacccauguaugucucugaggucuuuuacaacucucccuucuuuagggaacacuuuguggggcuguguccuaggcugauagacauguggauacauugguuucuuuauuucuauacuagcagugaggugggugguggcagagcccaacaagcuacagucauucccagcuaggguuuuacuuuucuaaugaaauuagccuguggaucuuuaaaaaguaugaauaaaaaaagaggacaaaauggucaauuauuacaaaggaguauaaugagacaaagguuguuguuaaaucuacucaacaguuggggcuuaagaaccauuuuguuuagggguacauggucauuaaguguuuguccuauguugguaacuggucucccauaguuguuccuaguucacuucaaccccacgauccuaagcacaccuguaccugcccuggaaucccucagccauguuugucccacagagcaucacuaucaaacaguucacuguggacuccucguagcagaaguacaguaggggacagcaagugucagcuccaucaggugugugcaaucuuguguaaccuacuuuguagcuuuccaucaggcuuuagggacagacaggcacccaucaugagacagggcuugacaaucucagccgggcgugguggcucacgccuuuaaucccagcacuccggaggcagaggcaggcgauuucugaguucgaggccagccuggucuacaaagugaguuccaggacagccagggcuauacagagaaacccugucucgaaaaaccaaaaaccaaaaaauaaaaaauaaaaaaagaagccagucucuaaccaguggcccucagauauaaacaaugcaggccauugguucuacaagaaaagagcugcugaugaaguaaucaugacuuauaaauccaugagcagcuucaccaacucacgacaguguuuuugaggaauaggcagccauaccugggugucugaugccuguugguggcccugucugagucaacacuuuuggcaacgccuggguaaagucugaggucauuugcucagugagagacugacacuacuuuuuuauagaaauuaucuuuguguagaagucugaaaaacuuagccaacuugccccugggcuuuuuggcucagugguauguaaucuuuuauuucaagaguauuaguauauaaauaggaaauagguacauaaaauaaugaagacacauugauuugugcaauagguagugcaagaagccaaagauaacucaugcuauugccuacuaaaaagcaagugugcuuguuaauuccaaguaacauaggauagagucugcaacccucuuucauauugaguauauuaguagcuguacuuaauagaguugcuuggguguuuguuggucauuaagaaaagcaaagugcacaagcuagccauguguuaacuauccaccugcuugacagaugguuguaaaugcuguaagacuuacucuuggacauucaccacauugaaaaucagaacuuugauauuaacucuaaacuuuauuauuacauaguucugcuugacccacuaaauucuaaaucuucucuucccucuugugcugaauguaggaccccugauuuaauuauuuacuguggaaccauuguccugagucaggaggauagaugaggaaagguaaggcucuuaguucauggccucugucuggagucuuguuuauggcugcuagcugaucauuuucaaaaucaguaauggucaccuaccuaaaacaguuaacuuacaaaaucauguuuaauccaaguugcccuaauagacaugauuuuaaaagaaaaaagcaguuauauaacuuguccccagaacuuuaguguuaccuuuugcauugugguugagcucugcuccccaacaguaguucuuugggaaggcccccauauaaaugcuagcucacgagucuaugaggauuucugagguggaagaugggaugggagcuucauuauguuugauggagccaaauuugacaucuggaugaauuaaacaaaagugaaccacacaaaaauuagauguggauuggauccaaaacagagacacuagugugccuuggagcaugugcccuaauggaagcaauguggucuggauaucccgagaagagagccccaacccaaagaucuuguuuuagggacuguguauuguuaacugugaaucaaucagucaaugaaugacgcaaacacccagcauaggccaaugaugaggagcaugggguuucugaccgaggacagugauuaaacccuuaugaaaucugaggacuauugcaaacuggugucugcauccuauagagaggaguccccaaagcccgaucuuuguggauucguggcguaacccacauuccuguaauaaaauuagucauaaauaaagaauauguuaaugaauaaaagauaaaaaagauaaaauuggcaaagcugguuaguuagccuugaaacaaacauaaaacaaagcaacaaaacaaaauaaaacaaaacaagcaaaccccuaaaaauagggcagguagaaugguucacaagagccuuggaaaggcccugugagcaagccuggugauccagauuccaccucugaaaucucauagagaagagcagagucgccauacuguccucuuaccuguacagacagacagacagacagacagacagacagacacacacacacuacacaauacacaacacacacacacacacacacacauauacaaacauacacacacacagacucacagacacacauagacacucacauacacacacacagacacagacucauacacacauagacgcacauacauacacacacauacacgcauacacacacaaacacagacucacacacacacacacacacacgcgcauacacacacgcaugcaugcaggauguaaaugaacgauuuaaaauaagacaaaaaggaagaaccugauguuacacaugcacuuuuuaaagcauuuaaugcaguguggguugguauuaauuuugagauucuuagucaagaugcuuagcuguguuagaaguuaucugaugauugaugaggaggcaaguugaggcaaguugcccagugccaaggaauaggagauacauuucuguaacuagugguugaaugcaggacacuuacacacaaagcaacagcaagacuuccacacaccccaccaggugauugauaaaaguuugccacacuugagcacugguauagcacaccaaacagccccacuuagggggcugauccggaacggggcacucaaaucuaccaaagucuaugaagggacgcauucuuaaauguguaucucaaccaguuguuuguuuguuuguuuauaaauugaggaauucagcauuggaaccaugcacuccugacaugcacaaggcagagacuuucccgaccuuuccagucaugcguuuaggaauuuaccuuaugaguguuccagucuugguuugguagcuguaaacuuucaaauucugcuagaaaaauuauccuaugagaaauuaaucuugucaguuaaugugcaaguuagacaggggcugggcggucaucuucugaggacugucugccacaguugucaugcucacaugugaacauacauccacaugcaugugcaagugcacauauaaacacacaccccggaaaauuaagcuuaggccauaacagagauuauaccauaugguaaaccugucaccuccaauuuugaauuucaaagucccaccuaaaagacaaccuugcucuuaauguauguugggaacaaacaccagauguuccuaauaauuagaguuauuuuucuucuucuuacugcuggguucagugguguucauuacauuauuuaaaauaaaacguaugcagguucauaaauauaaagugcuguucucgcuuagaccccaugagguaauaaauauaaaggaguugcugccuucccaaguguuccgagcggaacgcaaaccuaagcuuauggcuaauugaucacccccaacugcaguuccccccaaaacuaaaugacaccaauucauuugaauguuugccuuuuacucuccagaaugagagcguggcuggcaucgcuucaugauuacauucugggaaagaucuugccuguuaaccucuagagaaggagggacgauacagacguaagugggcaucaaacuucaugaccuuugugagagaggggcaccaucaugcccaucgaaugauucuugaggaacagauucaaaguggucaugagcugaccauugaugagaauguugugugaguuaauguugugugaguuaguaaggagugauccacuucagucccaacaaauugcucucgaccaaaaaguguauuucaaccauuucuagaacguuuuuacgugauuugggucauaauacauguggauacuucaucauuguauugccuuccugguccccucccagagaggagaauauagugaaacaaugaaucuucucaucauaugguaguccauugugccaucuuuauauagauauuaagugagagaaguggugugauugacagugauugauagcaugcacagaucuggauucagucagauuucccauguugaggcucacagcagaaaggccagacuuuagcucugugggauaugcacugucaagauguaucuguauuuccaaguauuguuccucccuuaauucauggauauugauuacauuauuauugaaucgaugaauaagucaagacuaguaugacugacuaaaagcacagacuuccaggucuaugaggagugugcaugggguaucugaauucagugucccgauuaaauauggucugugaggucuacugugucuaugggaacugugccuuuggcuuuuccauuguucauaugugugcaguuacucgucugucgaucaauacuuuaguaaaaggcagaaaguccccaccucauccucuuuugaguugugaaaggggcuaaugaagcaaagacuacuguucuuuuuuuucugcgaggacuuagcuaagcacucuaugcugcuguuugggguuagugcugagucgcucauugcauggcuuauuuuaaaacaguccaauaaaauacauguuauguauuuuguauaacaucaaaccagugaaaauaauauaaguaggaauauucauuaauaacaauacaagucauuuuaauaaacacauuaauauaaaauauuuugaugaacagcacaauuaacaaaaccucaaagacacaugucuagcccuuggaaguugggcgcugucccugcuugaauccugaaauaaauguuuaucacagucuugcacucacuucuuuucaucuggaaagaacaaugcaucccaguaguaugguugagaaacguaacuguucuuuuuuuaaagcuaauuuguggaucacuucauaacaaaugaguguacaaauaugaacagaacuuaauucccauuauucugaguauucacaugaaugguugcuauuauuauaagagacuaaaagagcagcuucauguuugauuucaccaccagggauuagaaugauggucgauguuuguaaguuuaauauuuagguggcugaggcaggaggauuacuaugaguucuuagcucuuaguucuagccuuaacuauauaacaagaccuuaccucaaagcuaauguaauuuuuuuuaauuuaaaaauuuaaaaaguaaacaaauacaauggugggauuagcagaggugccugaauaaaagaugcuauggugaacuccuauggaacucugaggucuuuguuuuaaaaguggccuccuguguccaauaaagaaaugggccuagagcuuggguauguggaccagggauguucacaguucaugcugauauagacugccauucuuuucaaugagaaauuguuaagauaugagauauauaacugggucaauauagaacgaguucggugcagggcaucaugaagcauagaguagacugucauugccaauucauagaacauugagucccuucugaggcuguguguguuuaguuaguaguaggaucacaaguucagggccaaccugagcuacauaaucaauacuuggucucugccccuccuuucacuuaaaggaaaacaauacauccagaauguuuugucuuuauauucagguuucauuuucuuuucuauuuuuaugauuuacuucucuuuuuuuggauaaaugugugcuaauuauacauucuggaggaauauacuguaaauucauucauuucuuucaaaacuagucaauuggaaaagggauucuugugccucuaaugagacccuuagacaggcaggcacacucuugaucaguccuguuuccaagugaugaauugaacuugauucauuuuaucuuuucaaagucacaguuagacaaaugaaaagguggccuauuguugggucagugaaaaaaaugggaauugucgucaugaauauuuuagaguuaaacuaaugcuguuuaaagugaucuaaauagcucacuguuuuaaaaccuggcauuugacaccauagaaugaagacuauagcagacugaauuacucucugagaugaggacuuugcuauugccauugcagguaagauguuuuaugacuccauaaucagcaaagaauccugucaguaaggucugauuucuucgcaguguucauuggaucuuuuaagucuacaaaccaaugauacaaaugcaauaugaaacaauugcuaggaagcuaauuggcauauuuuacucacagcccauuuuauuuucgcacagcaguguacuuaaguuuucuacuuaauaaucucagucugcauguccaauauggcugccaccauacacacauggcugcuuauauauaaaguaauuacugugaagugaauuguaaaauucaauuucucuguugcagugcucacacugcaaguucucaguagcuaccugagccuuuggggcacuguguuaggaucagguuucuauuauucugcaaagagcuauuggacagcucuucacagagaaggcugcacacaggaagagggaagagagacagaugugacugcuuugaggcaggcaugcgaauugauccauccaugguucacugaaggccccuggaaagagaaucaggaagagaacucagcaaugagaaaagaaagaaacuguaaggagaccccagucccaagcacaaguucuucucacuucaugaauauuuauccuauugcccccagggaggcuaugaaugggucaauaaacaaaacugucccugaaagaaaaagacagaggucaaagguggcucauguggaucacugaugaguacccuggggugucugaauggagggcuuugacuaagcccugucacucaggagguccaucgugaaaaaucccauuuauuaucucuuucggauaugagcuuagucuggcuaucuaaaauaacaugggcuguauucuugggcuucugugcacuaaagcaguguaugaaucaaccaagaacccuauaaaugaacacuaacaaaaugggucauugcucuuucaaauauguggguaguacaauaagaaucuuuacuaauguauuuaugaagcuugacauucuagcaauguauugaucaaggcugaugccauggggcaaggaacauuuggauagauguuuguucuuuugacauauuguguguuuuuuaaagggaagagcaaaauauuuauuuaagaugauuauuaacuaaauaaaaucugaguagaagagggcuuauacaugaaucuaggcugacagcucgccccagaugaacaauuaggguuucuguucuacuuuccacuguauuucaauucugucccucacuuuaauuuaaauaguuagagacauguguuaauccuuccaugacugaacauacaauguaaucuggaauuaaucuauuguuccauuuuuguggaaucacaguuguaauggcauuaucauauauagaaaaaggacauuacuaucucaauuaaucaagcuaagcugcaggaccuuuuauuaugagagaaguagauaguuacaguaccaacgaaauuagagaaaccuaauaaguggagcaccucacauuuuuccuauuuuuuuucuauuauuuauuuagacauaauacaauauuauaaaguuuuuguuuuguuccuugaaguugcagggucaaagaguuacauaugcaaccacauauauauuauaugcauauguaugcauaggcuccuguagagacaccuugccuagguccagucagaauauuucacucuugacagacccaugaaccagucuugguguucauguuuguaucuaguuugcaguuauuggaaaguuacuacuuauuguaaucucaguggcuuugccagcaagcuuauuccuuagucccaucaauuuuuguugaguuauaauaaucugaguacuuuuggcuauaaaaauaugaguuuagacuugagcuuccuaucugaccaucuguacaaugaaauaguaauuuucauuuuguuacugcuuuguccucagaaugcaugcaccaguccccauuguucucagguuaggaaggaauggauguuuaucguccugagucuucuuugcucauaaccacuggcuucccaauucacugucggucucuguucuaauaucagaggggaaaaaaaagaagacauucuuaauuucucaaacuugauuagaaaaauguugcaaaaaccucaucacacgcucaaaucagaccccaaacacauaaauuucauuagaugacaauacauagcuauuaccacagauuuacaaacaucuucacaaaaaguuucaaaaaacuuccacaaguuaaaucauccaauuuucaucccaugugcuuaucccucagaaccacugguggaaguuguuguuaaacagugggucuugcaugcaagcucuacaguuaugcacaguauuuccaugacaucccaagccaugugaguaauauuaaaaauuauucuguuugcugauugagugcaucccagcaagggauugcauuauucugaagaacaaaauaaaauuguucuuaggcuguucuuauucauagacauuuuuauuaucuauaaauugguguguuaaucaacacacaugcauauguuacuagagaagaaaacuguaaauauggaccaaugaugaccuugucuauauuauaagucauagacgaugacaacauacuggauucugagguucauaccauaagaugucucaagugccccucuuggacagcuggcaaaaguuagacaugugcaguauauacugugcacaagagucaggcacucucauaauuuucuuauauugugaucaaugaauuacgauauaaacauaaauacacuugcagauaaauuacuagagccaucaacuaauuaugaaaauaaauauuugaccccaaauacuacuaauucauuuggaaaaucugaaagucuguuaagaaaucauuggcauaaagauguauauaaccuuuauccaaauugacauauucgguguaauuaauggcuuacccucuagugaggguuaaggccuucauuugaaauguuauuugauuucuuaagaaacuuucauaguaauuugaaucuuaaguaacaaguaauggaaagagaaauguagaaagaauuggaaaguaucaauuuuuuuuuuuuauucucuuugcucuuuuguccuaccuggauggaugcugccuaacaccuuguuuccuggcuaggagguucaugcugccauaucccccuguuuaacaaguguggaaacugauguaaguggagucaaagucuugguuuggguggccaucguaaauguuccugcuaagauaggcauaggcuccaguaagaucaacucaacaugaucauaaauaccauguugaggauuuccaaaauuuagagaaaugacagagagucacaggggcacaaacucuguugaugaacuucaauacaccaagaucuugugcaaggaucugugaugaagaguuauguaaauauucuaauugauccauauaguuguuaauaaaaggggaaagugugagagaaguugaaggacaguguugagucaaugauggccagugaugauguaugaaucgggaucauagcuacaggucuggucgucagagguccacacccaaacacguguaguguggagcugugauauagauauuggauguaaauuaguguguuaaaauccuuagguucaucuguuuucauucuacccggacuuagauuaaacuaaaugaaagaggucaaagcauucucuaauuauuuaaauaacaccaaguaguacuacuaacaguaugaauaucaaaguuuagaaauucauuaguaauaaauggccagaguuagaaacccuuagcugagaauuuugugugcuguuuuaaauggcggacaaaauucucguuugguuaagaaccuggucuccuguuuauuuucuagagaagaauguaucacagcuucauguaacucgagggguaaaauaaaaaaaugaacuacuacaaggaucauaauugcauagaacauaauuauguuuauaaucguuucuccuuuucaucucuguaucuuuucaagcugcauuaccuauccauuucgaucauggagucuauggcuagccuauggucuugggugcacaguaggcucucuaaguauaguucauguucucggguucuuacagauucugccauacuuaagaauuacacccauaauuaaugacagauacaguuuguucagggcaugcuucauuaauaacuuuaagaugaaaauugaucugaugacacacugaaucaccaauguccccuuagacagcucuaaaacauacuuaguaauauaauccauuagcuuuuauauguaugauauaaucuguuauuaauaucguacaauaucugugcauggacagcaguaauggcacuaucauaaauauagaaaaagcauauuauuauuauuauuauuauuauuauuauuauuauuucaauuaaugaagacagagugcaguccauugaggaccuuuucuugugagacaaguagauaguuaauucaauccacuacaccaugacuccagaaaaggcaggccuuuugcaauggugacugcaucuauuuacuuagacaaccuuccaguuguaggaacaaaccaucccauaugcaaccagacagcuccauucuguuuucaccggcccugugagaucuacacacucaguucugggugagaagacacagguggguccuugggacuugguggucagucagcugagcuuaagagacaagcugcaggccaaugaaagaucacaucuccugagaaacacaugaaguugacaucugacccccccccccacacacacacaugcagacauuuucauacuuauggaaaauuugcaaagauuuuauugugaaguaaugcaacauucaugacauaaauaauuuuuaagugacaguugauuuaucuuccacugucaugcuaagacuuuagaguucuguccaauauacaagcucaugcuaaagucucaguggauuuaguaagacuuauaugacuauauagaaagugcauucauucucauaaccuguguuuucccccccagaauggacucacaauugcugauguauagguucuaauguuuucuauuguggacacgggacacccagacugagguucguggauuuuugaaauuucuaauaauaagauaaauuugugacuuaauuuugaguggaugaacuugauuuguugugguuauauuguucaguuaguauguaaguaaauauacaaauaaaugaaaaagggguuggccaacuaucaauguauagagcacauugauagcaaaguuguuuacauaacuuacacuuuuaguccuuaaauaccauacgaauugagcauguuuuaucucuccuucugagaucauuaaaugggucauuaaauauagggacuauaagcaacugucaauauugauuaggguaguucaauguuaacauuguugauuuuugaagcuuuauuaugaacuuggaagcaaaggcgccacacacugaaauuaaggagauccaaagacuuacuuugauaauagaaaauucauagcgauuaucauagguucauaugauaucacauuaauuguuaugcaaaacuuauucuugugaguucucaaagguaguuauccucucuauucaucccacagaaccaauggcuccagucugauuuaaacauggguccgugcucacacacucaauaccuacccucugugcucacaaguccugugugaguaagacuccaaauuauucugucuuguuuuacucaaugguaugcucuaccuuauuauagaguauaccauguauugagacaagaaugccagucauucugagaaacaaaaugcaaccauuaguugucauuuuaauuagugacgaauaguugugucaaucaucaaacaugcuuguauaauuggaugagaagagguguaacacgggccaaugaugacgagguuucgggauuauaagucacggacgaugacuacgucacuagaggucugagguccauagcagaagaugccucaugugacccucucaugcagggguugcaugucaggcaugugcauacaguagauauuagccaugcacucucaccauuucauaguagaucacagaaucaagauacaaaucuccaugcacggaaaggauuuaaggcauugaucaauccugaacauaaauauuuggccaucaaugauauuuacgcacacacugaaaaaucuauucagaaugacuuacacaaagguuuauauaaccuuuaucaaagguaauuuauauaguaagauucauggcugaagucuucaugauggucaaggccuuaauuuuuaaaauuaucaauuuuuuucuuuucuuuuuuuuuaacuugaauuuuuuuuuaaugaaaacuaucaugacaauuugucucuuaaaugaaaggagaaauguaaaacuaaauggacaaauaucaaccuuuuuauuaucuuugcuguugugcccucccuggaugggugcuggcacaugaugucuugccugcugguccgugguugcacucucaccauguggauggagcucggcagcugaaguaagugaagccaaagaucugcucuucauuugaguuucuuugauaagacaccccugcugugguaaagccaugcauaggcuccuuucagcccuauucagacugugugcucaacgcaacaugaccacaaacacuggguuaagaauagccaaaauuaagacagagaggcaggguggcacaagaucuguuaguuauucaacaaacgaggauaggaauuugugaggaagacuuuacaagugagaugaauaguuaggcaauccaucacaacuauaggucugagagucucagguccacaccagaacacagguacagcuacagcugugagcuagauaucagaagugguuuaauauguuaucuugaucuuuauauucaugaguuuucauuuuauuuuuauaagguagcuaaaauauaacaaacaauagcacauugcaaucucaaauuaugaacaauacacacauccaaauuucuaagugcauuuugaauauguagacgagaucuuuguccagugaucgauuucuuauauuggcagagcaguucuuauaguuaucuucccuuccccagaaaagaguaccaugcauuauguuuguggaaaaaaacacaaaacaacauaauuaucauuggaacgaauauaauuaugugccuagucuguuuuguuuacaucuguaugugauaucucaagcugucuucccuuuccuaccuaguccugacaccucugacuagccuugggucuuuagagcacauuaggcuguguaaaugcaguucauguucuuuucuuacuaugaacacuucuccuuauugacaaaugaaucccuaauaacucaaggaugacacccauguuuaaugacagauguagcaugugacagauuuuauuaauauucauaaaauuaggauagauaugaugacacacgaaauaagcaaagauccuuuagauagcucuaaagcauauuuaagaauaucaauuaaaagcuuuuauaagucauguuuaucuaauuaguauaaaacaauaaggaucucaauaaauaaauauaaagauuaaugaaaauuuguagggcuuauguuggauaaaugauaaccccugucgcauaugaaucaaggaccaugacuccugggcugcucuuacaucuuaaagccugugguucaugcuuggcauucugguuauagaugccagaugaauguuuguguugauuaauuuuacuauauuccauaccugaagucugcugaaggagucauugaugaaauaaccccaaaguaaauccaguauuuuuauuuguugacuggaaaauaaauacaugacaaauucuagaaauaugcacaaaauaacugcacuuaagaguaucuauugaugugauugguaccauguugaacuguaaguugggaaucuuagagccuguccauuaucaaauaaaguucgggaagaaaccaggggauaaauauggaggccuuuacugaagcagagaucacagaggaauguuucucguucuucauaacuuucauagcuuguuuuuuauagcuccaaagaguauuuaacgcacaccagauccuagcaagcacuuauuucuuuaggugcaucccaaaauauauccaaauauucgaaaauauacccaaaaauggaguguugguaaugcuuuucugguuucaaaguucauguguucagaauauaaggaucaauuuuuaugucauuaauggauguacacugaaauguaucugugcauugagaaauuaaugauuacuguggguggaugaugacucguggucuggauaucaaagguccauaucuuacacuaucucauccauaacccugauacuaguggcagagucuaggaauagucuuccuuuauaauuagacaagaacauuaacagaaguaaguuuguaagucacuuucuaacaccaaacuacuccagagacuagagagacagauagcucaguggauaaaagaacuuacuguucuuguagaagacccacagugggcugaaucgcccaugugacagccuguaacucuaguucuuauguaucugguaccaucaucuggucucuuuaccacauacaugugucacaaauacaaaaugcagauuaaaaaaaucauuaaauagauaaaaauaaaauaaauauuugagaaaauaauuccacaugaguuauuaaaauuaguuauaccaucauuauauuaaaaaauacaguaauuuaugaaaacaggaugacugaggaguagacaggaaagaaaacuguaagaaccuucuuaguaugguucagagcuauaugucuaguguuuuacaucauaauagaacauauaguagugucacacauacagauguuugagaagaggugcgaggcaaguacacagaucaucugaacaaaggaacaaaauaccaauuuucuuuuguugaucucuucuguuuugaacucucagaaugcauucuuccaccaagaugauuuacacagccuagcuggaucaggagcccccuaauaagcugcuucagauuguaauauagacacaguguaaguacaguccauauucugcugucgcuucauguugcauuuaaaggccauuuacuguauugauaagggcacuaucuguuuuaggaagaacagucaaguaaaggcugcguauggcauguguuugacgcacaagguuuaaugaaguuguuucaaauuaaggauauguauugaaaacugcuucauaacucaaaaagaaacugaggaacucugaaguuuacuggaaucucuugucuuuaguuuuuugguguuuuuuuggugguuuuuuuguuuuuguuuuuguuuuuuuuuuuugugaaucacaaugaucccaguaguacuuguaaucguuugcacacuaaagaugccuacgugaguagagaagcagagacugauguuggaucaaugaugacugugggugcuguaugagucguguauuaugacuaugcgucugagagucugagguucacaucguaauauauguagagcauccuaugaucuuagugacagauguuaggaguagucuacauuuacauguagauaaaauggugauacauuuggaaaucauuucuaauaagacauaauuccauagcaauaauguuaagcacauagacuaaauaguguuucauucagauaugauaacuggggguuccccaugagugaucuaaaauuguuagcaaaguucuugcucaccucagagccaugcccauuugaucuguaaugcagagauaguaauagaauaaugaagaccucaugagggauaugguggagaaugacccagagaagcagacggaaugcaguuaccuaaacagaaucuuaaccuuuuuauaauuuuucugcuuuuugcucucagaauguaugccugcaggaugagucccaccuucuucauuagucuugagguuugagauucccuguuugugucugcaggauucagauagugugaguauagucuguguucuuguguuggaauucuuuugcuugcauaaaaacaggguagaaaauauuucuggggcuggugagauggcucagagguugagagcacugacuguucucccugauguccugaguucaauucccagcaaccccaugguggcucacaaccaucuguaagggcucugaugcacucuucuggugugucugaugacagcagcaguguacuccuguuccuaaaauaaauaauuauuuuaaauacauuauuaucucugaagagcagauguagccauaggcauauaagauguauaugaagcacaauguuuaauaaaauuuuaccaaauuaagauugugcaacaauagagauaggcaucagugcagaagaucccguagagguuuaacugcacucacggaucuuauaguuagggcuugucuccaguggagauuuucgcaaugguccuagucauccauugcucaauaauuuuacauagauuaguagggaagaggaggacugauguuggaucaaugaugaaugucugugagcauucuuagagucaugaaucaugacgacaaauuuaauucugagaucaacaucauaaaguauccagugacagcuauaagaaguagucuucuuuuauaagucaguaaauguaaauaaaaauugacuaggaagucauuuaaucaaaaggcagcucacaaagaagacuacauauauguauauauguauauauguaagaagaaagugugacagaguaaugaccauggaggugagggauaagaugaaaugagcagaagcaggcagaauacauagauaagcgaacggaacaucaaucucuuuauaaccucuucugucuauacuucaagaauggauauccugcaagucggcuucguagagucucccuugaaaguggaccucaugaucuagccuuuauguccguggauugacacugugugaguaucaucagcgugugugccauuguuuaugguacuuacagauggcccuauaagcuagaagagaaaucuugagaaaaugauaaacauggcuauuguguguaguacauuguuaauuuucccaaauuuaacaacaaauuaauuuugccaaauuuagugcauauaaauaaauacucaguuugacaaaagguccuuuagagaucuaagucucacucaaggaucuugcuguuugagauuugugagucauaauuaucugcauagugucuuuaauuacucaaaaaaaaaaaccacauacaaauuaauagaaaagaggagggugcauguuggaucaaugaugaccagcgguagccguaugauucauggaucaugacuacagaucugggagucugaguuccacaucucaauaggacaucaucccccaagcacuguuaccguuaugagugcuagucuauuuauauaauuaguuuaaaacauagauauaaauuuguagcauauacuccacuuaagauguuacuucuuaggaaaaguuuuaaggauauaucccaaggcaugacugaggauaccguaugaaccauaauuaaagacaauguucauggucagauguagagcugccuuuuuucucaagaagcacacauauuagugugaucuacauuuuggauaauagucaaggagaaaguagcaagacaagcagguagcagucauggaugugugaacagauuaaaaaucuuuuuuauuaucucuucugcuuuacauucucaggauggauuccccccaaguucauuuagauauucucucuuauucauaaaugucacggucagcucuguucuuauagauaccaggugaguauagccaacguucuuuuguugcuucauguugcuuuuuaauggcugugcauauacugagaaaagaaaguccaguuauuaucugggaagagcaucccgcuuaaaguguuaaauggcaguuagaugaaacagaauguuuaugaguauuuccagaagaggaauguauaacagaaaagauucuaaucauggcaaaagauccugaggaccuucagaguacacgcaacgaucuuguccuuagauugugucauuuauuaucaucuuagaggcacuagugagauuaauugcucaaaaaaaaaaaaaaaccauugauaaaucaauagagaaggauagagcugagguugggucacugaagacacacuguguguaggagucugagguccauauuaugaauauaguuuguacccauauucuuagacaaaaaugggaaaggcuuaugggaaacaacacuauuuuuuauuuaauugaacaucuuaaauuuuaauugucaaguaauuuucuaaguaagauaucauucuauagaaaguguacuaaaauuacauaccaaacucaguaguuaauaaacagugguuaauugagcuugccauguaauguguuacuugguagguucauagccauagccauuucuuuucucauaaaauauucauuauaguaugccauacacuuagaugagugacaaaaagcacagggcugugaaugcaauggucuguagacagagugucauggguuuucuuuaauaauuucuucugcuuuugcucucagaauggauaccccaagguaagcuauggucaucaccuucacaaucugauuccuuacaaguguauucagugugcaugucuuucuugacauugcaucuaaagauuggguacuguauuguugaaacccuaguuaugacccauugguuaauaugacauguauguaaauacaauauuucacaaaauuuugcuaaauaaaaauuuauaauauaagauaugaucaauaggagaaaaaauuacauucaggucuaauauauacugaagaaucuuuuucuuugauuuuugugauucauaaucaucucaauaaucauugggaaguugauaggaauuggaguccugaggguuagucuugaccucugguagcacacgauuuguggaugauggguacaggucuggaagucugaagucuauaucuuuaaacucuuaguaugaacucaugucaauuauuaggaauaagcuacaguuagauaaaauaucaauaaaauaaaucccuaauucauguucuauucagcacuuacuugcccaagauuguuaaaauauacaccaaacguaauacuuuuugagaugugauagcugaggaugucacaugaauuaaauuuauuggcacuguuccuuguagguuagaauaauggccauuuguuuucucaauaagaacauaguauuagagugcauauguagauaagcaauaagaaagaggguauuaagacaagcaaacagagagcauggaugagcgaagggaccuccaguccuggacuugcccuaaguugauucucacuuggauauaagcuccauuuugcucuuugagucaauggaucuggguuggcucaugguuuuuucacugacuguguauacauugaugaaaagcaauaaucauuugagaggacagccuuugccauaugguuauuaccgaaagugggucaaacacaauguuuagagguuuuuuuguguuuuuguuuuauuuauaauguguaauaaaaggggcacuaauaauggcaaaagguaucugggaacacuggcauauacuuaaggaucuugucccuagaucuuugugaguuauaauuaucucaguuguacucauaguuaaugucucauaagucaagagcagagcggaagaugaucguggauuaaugauggccgcuagugcugcaugcauaguggauugugacuauaagucugggaagcugauauucacauccuuaaauacugaauauauacccaucauucuagugacaagcugaguaguuuacuuuuauaauaaaaaguauuagugacuacuaauaaauuauauuuagauaaauuagaaaaaaauauaaaaauuggaauuuauguuuuaaucaaguauaguaaauguauacauuuacuauacuuacauuacaaacaguaauucauuugaauuugauauaugagaauuucauacuacauccaaaagacuauaggcaauggucuugguagggucagugccaugcuuucuuuuuaaaaagagcacacuguagcauauuguauccagagaggaguaauaaagagugggguuauuuacaguaggcacaaagugaauaucagucuuuuuauuuucucuucugcuuuguauuuagaauggauaccccuaagcugauguauauacacccuuccucgguugugagauuccugcucuggugguuguagucauaagauauacaucguugcguacaccuugguugugggcacgcacacuacuguugaauuaccaccuuguccaagugguaaguaagccucugccucagauguuuaacgagauuuuugccauguaggcaacauauaauuaaaccauuacuauaggauaaaagagcccguggcuguuggucauauacucagugauguuuuccuuagauguuuuugugaugcaugaucacuugauaacgauauagauauuaaaagagauagaggggucugauguuggaucugugaugacaaaggguggcguaugaguuguggaucaugaguacaugucuggaagucugagauucacaucaugaaagaucuaauauauccucaugaccuuagggacagauguuaggaacaaccuauuuuuacaaguaaauuggcucaugguauaaacacaguaaauaguuucuuccagucaagacauccuucuacagcaagaguccuacuaauguaaaccaaacagagucacacauucauacuugcugacauuggaugacacaucaaguaaaaucaauggcaauaauuuugccaugguuagagacuaguuacguguuuucucaaaaaugauauauaauaguguauaguauacuuauaugagugaaaaaauaaaaaaaaguaaacagggaaaaagcacuggaucaggaaacagaacauccauacuuuuauagccucuucugauauguucucucagaauguauuaucagccuaauucauguguugcugcucgggaguuuucugcccugcauuccaaaucuuccaaauauagccgauauucaauucucauuugaguuacagcuaaagacaguuuaauuuauugauaaaacccugguugguaaucuggaagaucaaccugguucaaauaguaaccauggcaucugugugaaauaaaauuuuuaacaauauuuuaccaaauuuaagaauguauaugagaugcugaagaagacaaaagauucuauaaaggugugaaguucccuaagaauuuuguucuuggauuuuugugaaucauaauuauuucaauaaugcuggaaauauauugcuugauaaacauuuauuaauuaauagagggcgguugauuuuugauuuauaaugaccaguguuuguagaauucugaguccgcagcauagcauguagcuuaugaccaugcacaugaccguggcagcagacuuguaugaucuucccccucuacuaauuaaggacuaauuccgcagcaagagucaucgcaauauauaccaaaccaaagucacauuuauuugauagcauuauucaggaugccauauaaacaauaaugcucauuguguaagagaaccauggccaaauauuuuguccagacauguacaaguauaaagcagacuuagcugagagcuagagaaaaagacgcuaaauacacagacagaacucauggaugaguaaacacaauuucagucucuauaaucucaucugcuuuguacucucaggauggaugcccucaaugggauuggcacuuucuccauugcuccugcacucuguuaucagcacuucggguucauaauguacacacagcgugaguauagucaaccuuguguugauuuggggugcucagaaaugcucacacuguguugauaaagccggcuuaucauuugagaugagaagccauugccaaugacuaauaugccaugugacuuaagauaguguuuaacaguuuuuuuugucaaauuaagaguuaguuauuuuccagugaaaaguauuuugauaaagcuuuucauuuuauaaauauacugaguuaauaccccauccaaaaauaagagaguaacaaaaucuauacucagcauggcaauaucuugaauaauaucuugaauacguauuuuuaagggccuuauucuuaaaucuuugugauuccuaaucauuuccauagcaguagugaucacugcuuaacaaagaugcagacauuaauagaggagaggaggcugauguuggaucuaugaugaccucuggugccguaugagucggggaucaugaucacaggucugggagucugagguccacaucuuaaaauaucuagaauaugccgaucaucucugugccaaaugcuaaaacuaauuuauuucuagaauuagauaaaauaucaauaaaaauaaauuugaaagucauuuucuaaucaagacauaaauuacauaacaagaauacuaaaacuaccuaccaaacaauagcucuuucacacuugaugccugcgaugccaugccccgugagcucaaauuggagacaaugcuuuugguagggucagagccaugaaauaguauagguuauuauauauuuaggugggugaugagcagagggguaauuucaaguauuaaaaugugugaauaaauuaacugaaugccaauauuuuuauauucuguucuacuuuaaacucucagaauggauuuucugcagcugauuuucuauauucuguuuucuucggguaagcagagugaguauaaucuuguuguuuuguuuguuugucuguuuauaguauuguugaaaguuuuccucucuucuggaagaaauagcuugcccagaucauaaauauagcaucugcgugucaaauuaauaauguguaaggaaagaaauaugccacagggcuaaugaccugucgcuccccaaauuaaacuaaaaaucuuguuuuauuuuuuugugauucacaauuauuucaguaucacaauugaucaguugcucaauucacaucaagaaauaaauacagaagagaagggcugauguauuugugaugaucacuggugccagaugaguuaugcaucauggucacaggucugcgaguccgagguccacauuauaaaacaccuaaauauacugaucaccuuagugacaguugauagguguagucaacuuuuacaguuuaauaaaauacuaagaaauuggagagaauuuuacaauccuaauauacagaaagaguauauacacuacauauaccaaacacagucgaccuaugggaaguaagaaugccccauuuuauuaaaauuauaaucaguaaucuuaguggaacuguaagccaugacaauauauuuuauuuuaaaaaaugaacaguuguguaacacauuuagaucacaaaccacucaccuuuguugaccuuggauccuuuauuuuuaaaauuuuacuuuuuucacaagguauagccugaucaagguuucuucuccuucaucuccccccaaguccuccuucacacucaucuagcguuuccccuucuugcucugucucuuuagaaaacaaagacucaaacaauaccaaaacagacaaaccaaaauagagccaaaucagccaacagaaaaaaagagaggaagauaagcaccugaagcucacucauacacagauacaaaugcagacauagacaacccacaaaacgcaaagcuagaaaauuaaaauuauauauaauuaaaauuaauauuauauaaguauaauauaauauagugcaaaaauuaaaaauauaaguauauauguauguauguauauguguauguaugucuguauauaugucauaccugaauaagauuaaagaaaauguccaugacacuaaaucuuccaaauuuaccacugaguucuuagugaguuguccuuuguugaacaaugaaauaaaagauuguguguauauuagagccccuucacacccuguuuucuuuuguacccucagaacagaugccuuccucacuggucaccagguucaaggucccucauaugugucaggugcauagucaccaacguaagucgaaguucuugguuugaauucuuucuucuguuuuuauaaaggcauuuccuagaauuuaaagaccauuggucuagggagaaguaugcuguggccaugaaaugcuugguugacuaauuaauauuauugaaauuaaguuuaauuuaagcagacauaauaaccuuaggcaaaggagcuaaaauauuuauguaaauuauaauuaaagauguuuuucaugauuaauaauaaucagcuaauaaacaauaauaaugaaaguuuaucggagaaaccagaggcggagguuggaucaguggugacaucuuguuggaggugagcaguggagcaggagaacagguccggaagucugagucccaucccuuacaggcaucuccugugcuuuccuccgaggugugcucaaacaagcauguuaccuuuccgauugugaaagugugaaaauuauguaauguguacauuagaacaaagccggucagcaguguugagcaugagacucuugccaacugagacacaguaauaauccaggaaaccaugugcauuuagaaauaaauaaguacaaauuacaauaaaaguuaagcaaacaauaacaagagaaaugaauuucuuaaugauacuacuagcuaaggacaaugcauuuaccaaaaauaauggcaaguccuugucuuguucagggcuuaagcauuuauuauugccuugucaagucaacaaaccuaagagaauuuugcuccugcccaugugacuaauaaaauagaagggggaaugagagaauaauuggcuauaauacaagucuccuucuugguacugucagcauagacgcuuucguugugauauucacauuaugacuccccagaacacagagacucauguuagaaugcucaaauccccugacuuaauuugggagguuuuaaaagcuuaaaguaucacgcagaaucuauuaaaaccaacuacacugauuagaaauaagcauggccuuccaccacuaagcucauuaaagcuugcacaauugagaaccacaaagaaaaacaaagagaucucaucuaaguaguaaaagacacugugcaugacuuaagcaucuugucccuaacucuucuugauucguugucaccuaagugucauuaggaaaauuucagauuuauuaacuaacaaauguagaaaucaauggaacuagaccuaucuuggguuauggacaaccacuguauuuacaguucuguauaucugaaguccacccugacccuuagacaugguucuccacacagaugugagaacaguagcaccauuauauccugucucguaguauuaaugggcucacaagaauaaaaugcagauaagaaagaauucuucuauuaaaagaacaaaauaagauugaagguaauuccuacuauauuuuggaagugucagguuuuuuuucuuaguauuuacaauauauuccucuugucucaugacaaggcuuauagucuuaaugaucaauguuauuauuuugaguuauuaaaauauucuguccuauucugucucugaagagaaaguaaaucugaguaaacaauuuguagguaaauugacuggugaaccgcaucucaguuuauucuugucuguucugugccuuccagaaaggccaacuucacaucaauggguggaucguaccucggccuaagcuccaggauugauugugcuguuagagucacagcuacaaccgugaguaauaauuacagucucacuuucugaaugucauuuaaaaaggauauuccauacagauauuugaucugcuuauaguguccagaaaaaagcuuguugucaccaaccuagcuagcacuaccuauaauuuguacacacacacauacaaaaaaaugccagaugucuuggacacaaaagucaaagugaacuuggguccccuugauaguucuguguugcguuggugacaggauacaagcauuguguuauugauuuugguauucaugggcuucgcuucuauuguugcaauuucauauauuaaaauuagaaaaagaaucaaugaacaaguauacauuucaacaguuaagcauuauucaauuauguaaaugucacaaaggaaagcaaccuaucaagcuaaauuaaaaauauugaaaccaauucaggguaacuuggggaaaagggccguugauaguucagugguagagcccuugucuuggauccgugaagcgcuggguucuauccucaguaucacaaaaucaaagaaauaaaaagauaauaucuaggaauguuaguuuuuuuggacagugauuuaaaaaggcaguacaugguguacuaauuaugaauaugaauauaugaaugauuaaucaaucaaucauaaccauaaucagcacacauaccguauuuauuuugguuuggaaaccuaauauaccucugaacaauagagaaaauugaggcauguccacugagagcacuguaucagauuuucaaaccuccuuuucacuuuguucccuuacuuaccgaugugccaaagauggugguggcugccucuguguuugucucauugagauuagauuaguaaugucucauuugccugaauaggcaauuucuaaaaguaucuauccccucuuaccuuggaacacucaguccuaacugagaugucuccaucaaaucccuuccuucagggcucagggaacccaguggaagaggagguggagugugagagccaauuggaauggaagacagugaggaaacaaggccuucgagacacaagaggacugcugagcucacaaagacugaggcagcacccucaggaccugcacaggucuaagcuugaugcgaucugaguacugagagggcaacuggacacaauucuauauugauaacccagaagcuuucuccaguugauaaacucuuucaaaggaaaaacuuguuuucuaccauggagugacacuggauauagaaacuaccguuaacagcagacuccauggcucagacuuccaauacaauaugaacucaguugcaauuuuuugcaagguuuuucgacucauaguucuuugucuggguacuuuuucacccuacagagaauuucuguauauauuaucguuucugauucuaguguuuugaauuuucgcugggucuaaauaucucugucucagugucaguauguguuucucaugauuuuucuuugcuucucuuuuuccuauucuuugcuuguauucccugguuuguguuugagugucugggaacucugagggucugguuggugauauuguuguucuuccuaugggguugaaaaccccuucagcuccuucagccuuucacuaaguccuccauuauuaugauuccuaugcucaguccagugguuggaugugagccccccccccccucugcauuugucaggcuccggcagagccucuaaggagauagcuauauuaggcucuugucagcuuuguuuguuuuuauucugucuucucuauacuguuuauuuuagauaacuguguuuauucuaauguaugaaugaauaaauggguguguguuuggguggguggggaauuggggaggguggggguggaugugggaggggaaacuguaacacaaauacauuguauaaaaguacauuuuaauaaauguauuucuucuaugacuaaaaaaag

SEQ ID NO: 6833 - RNA, 8719 nt, Mus musculus
agcauaugaaagaugaacgaaaugagacacuguauaaaaugaaggucaccagguuugggaaagcguggcaguccacagugaggggaggguuaguauuaauguguuuuaggcgccggacgcccacuaggcaugcaguggagugggggaggcugccuuuuggggguauggguaagugguuuuagaaaugacauggaauagucaggauucuuacuuuggguccaggaagauuucagguaguugaauucucaggaaaaaaaaacaacacaacaaacuaaaacaaucaaaaaagaaacccaaauaaccauaucccaaaguaauaaauaauaaaaugacuagcaaaguuacauuugaaaggcacguguuaauggaaugacucucaauaguguguggguuuuuguuuguuuguuuguuuguuuguuuccuuguuuguuuugauuguuguuccuuucagagagguucucacuuuguaggucuuauaggccuggcacuaacucaguaugcagaugcaucuggucuugaccucauagagaucuaccuaccucugccuccugggugcuguacacuuggugucucucaauauuuuauuagcaucauuuuacaugugcuucagaauaaaugcaccuacuaaaguagggcccugaaaucaacgugcugcaaagacagagauggaaaucagugauaaauaaggcaauuuuuucccaauauuuaguggcaggucuuuauuauuguuuaccaguugggaaaguaacagauaaauguagaagagggagaggaaggaaugaaauccugacccagaaugaugacagugccugaguaucuguaccaugaguaaugaauaauucaugucagaaaaaucugguuuaguucagacagagauuguuguauuagcuuugcugggacuaauccuguggagacgucagcuaucccaaaugucgugugcuuugggguuuggugcuucaugaauuuugauuguuauuauaagaaaaaucagugaccaaauuuacacuuugauuacauaaaaaaaacaggaugaaggaauaguaagaaauauuauuaauauaacuugcaaauacugaagucccuguaucagugguucuggggagcuuucuuauuucccagagaugcaaagacaggugggcauccuagccaguccuguuguucugagucagucauuuggacccuggugguaguggugguuguugucgcaauacugaggcuuuacacauuaauucuuuucuuccuauggguugguauuaaaucccagauuguucuuuugcuuaggagaaaauuaacgaguuauaaaauguuaauaaaugugugcauuggaggaucgagacaggaaaauccccuagugcuuugcuucaucaccucagugccuugguuucagagcuuuguggcuucuuccuuggcacaggcucaguggacgccauauucuuagcacaaguguagaggucggguagccaacacucucuguguaguuuguuugguuugucuccugguuuucacuauagguuugcacagucucacacagagcugagaacuacauuuugccaugauaccaaugugaacugaagacuucuugucuugucuugggugaccaagugucuaucagguugcuaauuauggccaacugaauaccaaugguacaaauaggccuugcaugaacauugucauucauaauauaaauauggaaaccaucauaaauuaaugcaaugguaggucaauguuagaaagaggguccauuaacagauuagcaauaauagcuauaauaauaauaauagccccuacuuugggaaugaaaugggucauaaggcuuauaauuuuaauuauuauucaauaugaaaaguagaaauguuauagaaaagaggccacaauccugaaccaauggugaugaauguugccauaugaggcauagacaaugcacucugggcccaguuuucuguaauucauuccaugagauggaaaguauuuguuuuuaguuuacauguucauuuauuuccauccuguuaguuugaaagcauugaucccugcauagaaauaacuuuuguacuuuaaagucuucuuugacuagagaugagguagacaguauaauuaauagcuaauagacaaugucugggucaaggaaaaaaaaaagcaacaaagggccuccaaauaaugacuucuuucauggccauccgaaggaaggaggagaagcaaaacuaaaauagguuaggccauguuuuaaugagcugcucugcuuugguguccugggcucggaugcccugagccaggggacgaaucuuuccaggagcuugaguuccaugguuacgugcaucuucagaagcacgaaaugcuucaucauaauaaccacugugaugguuucggcuuucgaaaagcauuaaaguuacugaaaugugccuacgguaaacauuagacuuaaauuauauauugcacugagcccuuuguaugaaccccugagcuugauuuauacaauacaucuggacucucuggaagcaauuaauuauauaggaacauccuagagauuguucaagagucuacuuuucauuacauuuauauauguuuuuuuauaagauaugaaauaaucaagaaacuaaugugcaguauagaaaaaaaggccauucuacuugucaccuuacgaaguauaccacauucaagcaccuaacugugacucaguacccauggauccaacuuuaccacccgugccucccucuuucccaccucaccugucccugggaaccaccagucaacucucaucuugccugggauuaguuucaaugcggaugcacucaugcaccuucuaugcaccuucugugccugaauuauuccucugaauucuauuuauucugucuacagugucuuuuuaaaaaaaaauaguuuaugucuaaauaagaucugaggagggcuuagugcuuuaguagugugaccaugcucaagugguuagauucacauucacacacauuuggguaacuaauuuuagacugcaaauguuauauuaaaaaaaaagaaggagccauaaaguugagagagacacaagguucaucccagaguaaguaggguguugcuuaugaacaaaauauauuguguaaauguacgaaauucccuuagaauauaucuaaaauuuuaaauccauaauaauauagaaaaaauacuuaucagaaaaagaagcaauaauuugauuuagaaugcaaaguggccucugugucucuuuggaagccagggagguuggacguguccagcaucauccugagcuuaugaaucauguuuacugauauauuuuaauuaauagcuuagagaaaaaauagaaaugcuguaauuaaacaggcaaacaugaaccagugaugguggcugaugucaauuugaauaaaauaugcccggacucuggaaucaagugcaaaagaaauacaggccauccccucaugagacaauguacucacgaaagaguuggcaacauccaaggaucuugguccuggcuuuuggucaaaguuagaugaaugagcauaucagucauucgauuaaugaaauauugucuaacuacaacaauaaauggacaggcacauuaugaugugugaggaaaccagugugguccaggucugaccgacugacucugugacuccccauuuuguguuuaaacaugauauagacaccauaugguaaagaccagugcucuaagaauauggaaaauuuuaaauucucuuuucuguucguuaaugugguucucaaccuguggguugcauccccuuugaggaggggucaaaugaccuucauacaggggcugcauaucagauucuuuuuuguuuguuuguuuuguuuuguuuuguuuuuuugagacaggguuucucuguguagcccuggcuguccugauacucacucuguagacuaggcuggccuugaacucagaaaucugccugccacugccucccgagugcuaagauuaaaggcgugugccaccaccacccagcauauaucagaugcuuuuaauuaccauucauaacaguuaugaaauaggaacaaaguaauuuuaugguugggugugucacgagaagguguggaacugaauuaaagugucacagcauuaggaaaauugaagaccacugcucuaagcuaaagacgaaguuaaaguccaauguuuucucuaaacacuuuuuuaaaucauguguucuuucuccuauuguuccccaugguccugugcgagcgagcugauggaaucuuaauggcagauuucccucuggucucucucugucgggaucccggaggaugauguaaguaauauuucuaauuccuucuuugguuugggugguuuauuuagggagaaugcacuguauuuuuacaguuuuaggaugcagacaaacugaagccauuuuuacauuucagaugaaacugaauacguaauacugaucacuauuaugcauaaagagcuaaagacauauuuugacccagacauuauucuggauuauaaccagccaugaccuuguugguuuuuguuuucuuuuuuuuuuuuucaaucaugggcuuuuagaaacauuauuaguuacugaauagauuggcuaacacagaggauaaaaauaagugacgggguauugggucucccugagagacaaaugucagggcugaaugccaugugagguccaacaggauggguaugcuagugagcaaggauuagaggaggugaguguaguuuuucagccucugcucucaucucuacucuucagaauggagguuuuagagagaauggaaucuucucugguccucuccuugguguucacaucccucuucuucauugugaacaauaguuaaguuuuuggguuuuuuuuuuuuuuuuugguuuguuuguuuguuuuucuguauuuucccacagguugauagaaacauuuagucauuauuccauacaugaagaaaugagcacugucaccaaaagauguagugguugacagguuuaaucuuuuggggaccuucaugcauaucauuuuucuauuauguaguuuauauaauuuucucucuuaaugaaacaauucacaaagccagaauguauugugaauggagauacaugcagcaccugaugcccccggauugcuguggcaugugaggcauguauguugaauaucauaugucuagaacucugaucuaaaacgaaugggcagguccuuauuuaaauuuggguccuguguucaaguauccauuucaaggaucucauuuaauaucuuuguuuuccuuucuguaaauauuauuguaaaagaauaaaggcaguuugaauaaacguaugcauagagaugacaaagguaaaaaauuugcucauuaucaaaauacacaacuaggauauaaguauuaggauuucuaaugaagucucucuauacagaccaggcugcccucaaacucucagcccugcuguguaguucagucaaaugcuagacuuuuauucauuagucaccaaaccuuuuacaagagaaauuguucugcacuaaagaugaugcagacaagucauugucaaucauuaaacuguaucaauuauaaauguaaagcucauuaagaagaggauggcuagauaggcuugcagugauucugcagaaggugacgguaaugucauaguaauaugaguggaugcagacacccucgccaccucccucuuuguccuccucagauggagguguuaagcugagcugggaacuccuugucuugcuguguguuugcacugugaauagcaaucaacaauuuuauuuuccugguuuaauugauuaaaggugaccauaguguuaauuauguuuuuaaaguuguauacaguggaguggggcuggggaggugaagcaaugugauucgaccugaaagaacuaucuuuucuuccccuuacucugccugauaccaaccagaaaugaucuugaacaaagugaugccugcaggagucuaguuacauacuuacuguauauaaguuuccagucaagauaaccaugccuguucccucaucaauuccucauuauccugaaacuccauuauccucuucccuagcccguuaagauauuaagaaacuaucaucuagaguugcuccacaauacauacauaaggucaacgaacuguaacuaagcaacuuuucuucauuuuucucuucucucucuaccaucugguaacuaucacuccacagucaacucccaggaaaugaacccuuucgugucccacaugagugagaccauauuguguuugucuuuuugugcuuagccuauuuccuuugauaugaucaucuccagugccagcagaucacuaaaaauuauagaauaccauucuccuuuaugccugaaagaaccuagcguguuucuuacaucuaaagcagugcuuuccagccuuccugaugcugcgcuucuuuuaguuccuuguguugugaacucccagacagaaaauuauuuucauugcuacuucacaaccauaaguuugcuacugugaugaaucauaauguaaauauguccacuuucugauaguguaggaugaccccugugauggagucauuugaccccuaaaggggucacaacaaacaguuugaaagccacugaacugaauuagacuaaaacccaaaacccaaaacaguagauaagguucaguagauauaagcaugcauaucgcuaaaaagaagcacucaaauaaccaagaagucugugcucgaaugcucagagucaucaauugcagaaacaugcaaacccauaucccagcaagguaacuccucccucauuccaguuaggaagacuguuaucaagaaaggcuaguuuuaucacugacuggcuauaggguagguaucagauuuccuuuguacauuguguauggggauauaaauuaaucuaauauuauagaaaacagcaaaaaaaaaaaaagcccccaacacgcugaauugucugauaacccaagcaauccucuaguaggucugcauauaaagaaaauggugaugccccugucucucucucucucucucucucucucucucucacacacacacacacacacacacacacacacacacacacacacacacacacacacacaccccuggccuuccauauucucugcagugaucaauaauacaagguuagaaagacuugaguagcccucaacugaugaguggaaaagagaaugugguagacaccuaccugccugggacacugcucauccauauaaaagccuaaugagagaucgauuccaguuguugagauuccugauggaucacugccacacugaggccaauuaacaaaagaaaaggucucaagaggaguaagauucuacagacagauguuaaccugccaagcuucguguucuuaacgaguuucgugagcugaacuaguucauucuaauuuguaacuuagaauaaaguaaauccaaauuagaaagcaagcggcuaaaacauggacuagugauaauggcaguugagagugagucucauauguugcuggaaacauaucugaacucuaauagccaacauaaugcacaauaguucauuuucuugguaaaagacauccuugagaccugcucaacaugugggucaacaugugggucacggaccuucgacccuuucacagggucacauaucauguuuacacuaugauucauaacaguagcaaaauuacaguuacgaaguugcaacaauaguauuaugguugggggucaccucaacaugaggaaguguauuaaaguguuccagcuuuaguaaaguugagaaccauggugcuagacacauuuaguaauauucaagaaccaugaggcugguaucuguguugauauaguuaauuccgucauuagaauuaagcaguucaacuauaauucaaccaauaacugauguguuaaucacauacaacaugcagugugucagcggugcuuugauauguuauguaaaugguaaggcacagggaguaguggucagaacucacacauucacccuuugcuacuguagacagcagguguuugagccuugccuaucagcugggugugacgauauguuaaauugguuucuaauuuaaaucauuucaacaucuuuugguaagauuagagcuucagcuguuaaauuaaugagugaauaaguuaauucagaaagcaaagcuaaaagccaaagaccuguggaaagacucuuccuucccauuuuucaucuucuuuauguucaccugcucucuucuguucucuuuccaaugcucucccacucgagcuggggcuggauuuuccauggucggggcuccgcggugcaucucucccaggaaccuguguaaguaauaggcauagaucuuguuuccuuggacaauuuugcucuguuuucaaaauaggcagugauagaaguucuaguguacucaucuugggacugugaugaauauuuuaacugaguaacugguguagugaaacaauaagcucagucaauuaaaggauggggguguuguaucccaaauaguauauucuuguuacaucugucuauguaucuuuaucuaucuaucuaucuaucuaucuaucuaucuaucuaucuaucuaucuaucuagacuaucuauuauuauagauacuauauauauuacaauacaaguaauuuaaauauaauauaauauaauuuaaauauauaugaauacacacagacagacacacagacacacagacacacagagucacacgugugaccuugucuacuuuaaugucaauuugucagaagcacauuacuaauuguuccauguauaugguacugaggaaagucauugagaaauugauuuucuagca

SEQ ID NO: 6834 - RNA, 8719 nt, Mus musculus
ugcuagaaaaucaauuucucaaugacuuuccucaguaccauauacauggaacaauuaguaaugugcuucugacaaauugacauuaaaguagacaaggucacacgugugacucugugugucugugugucugugugucugucuguguguauucauauauauuuaaauuauauuauauuauauuuaaauuacuuguauuguaauauauauaguaucuauaauaauagauagucuagauagauagauagauagauagauagauagauagauagauagauagauagauaaagauacauagacagauguaacaagaauauacuauuugggauacaacacccccauccuuuaauugacugagcuuauuguuucacuacaccaguuacucaguuaaaauauucaucacagucccaagaugaguacacuagaacuucuaucacugccuauuuugaaaacagagcaaaauuguccaaggaaacaagaucuaugccuauuacuuacacagguuccugggagagaugcaccgcggagccccgaccauggaaaauccagccccagcucgagugggagagcauuggaaagagaacagaagagagcaggugaacauaaagaagaugaaaaaugggaaggaagagucuuuccacaggucuuuggcuuuuagcuuugcuuucugaauuaacuuauucacucauuaauuuaacagcugaagcucuaaucuuaccaaaagauguugaaaugauuuaaauuagaaaccaauuuaacauaucgucacacccagcugauaggcaaggcucaaacaccugcugucuacaguagcaaagggugaaugugugaguucugaccacuacucccugugccuuaccauuuacauaacauaucaaagcaccgcugacacacugcauguuguaugugauuaacacaucaguuauugguugaauuauaguugaacugcuuaauucuaaugacggaauuaacuauaucaacacagauaccagccucaugguucuugaauauuacuaaaugugucuagcaccaugguucucaacuuuacuaaagcuggaacacuuuaauacacuuccucauguugaggugacccccaaccauaauacuauuguugcaacuucguaacuguaauuuugcuacuguuaugaaucauaguguaaacaugauaugugacccugugaaagggucgaagguccgugacccacauguugacccacauguugagcaggucucaaggaugucuuuuaccaagaaaaugaacuauugugcauuauguuggcuauuagaguucagauauguuuccagcaacauaugagacucacucucaacugccauuaucacuaguccauguuuuagccgcuugcuuucuaauuuggauuuacuuuauucuaaguuacaaauuagaaugaacuaguucagcucacgaaacucguuaagaacacgaagcuuggcagguuaacaucugucuguagaaucuuacuccucuugagaccuuuucuuuuguuaauuggccucaguguggcagugauccaucaggaaucucaacaacuggaaucgaucucucauuaggcuuuuauauggaugagcagugucccaggcagguaggugucuaccacauucucuuuuccacucaucaguugagggcuacucaagucuuucuaaccuuguauuauugaucacugcagagaauauggaaggccaggggugugugugugugugugugugugugugugugugugugugugugugugugugugugugugagagagagagagagagagagagagagagagacaggggcaucaccauuuucuuuauaugcagaccuacuagaggauugcuuggguuaucagacaauucagcguguugggggcuuuuuuuuuuuuugcuguuuucuauaauauuagauuaauuuauauccccauacacaauguacaaaggaaaucugauaccuacccuauagccagucagugauaaaacuagccuuucuugauaacagucuuccuaacuggaaugagggaggaguuaccuugcugggauauggguuugcauguuucugcaauugaugacucugagcauucgagcacagacuucuugguuauuugagugcuucuuuuuagcgauaugcaugcuuauaucuacugaaccuuaucuacuguuuuggguuuuggguuuuagucuaauucaguucaguggcuuucaaacuguuuguugugaccccuuuaggggucaaaugacuccaucacaggggucauccuacacuaucagaaaguggacauauuuacauuaugauucaucacaguagcaaacuuaugguugugaaguagcaaugaaaauaauuuucugucugggaguucacaacacaaggaacuaaaagaagcgcagcaucaggaaggcuggaaagcacugcuuuagauguaagaaacacgcuagguucuuucaggcauaaaggagaaugguauucuauaauuuuuagugaucugcuggcacuggagaugaucauaucaaaggaaauaggcuaagcacaaaaagacaaacacaauauggucucacucaugugggacacgaaaggguucauuuccugggaguugacuguggagugauaguuaccagaugguagagagagaagagaaaaaugaagaaaaguugcuuaguuacaguucguugaccuuauguauguauuguggagcaacucuagaugauaguuucuuaauaucuuaacgggcuagggaagaggauaauggaguuucaggauaaugaggaauugaugagggaacaggcaugguuaucuugacuggaaacuuauauacaguaaguauguaacuagacuccugcaggcaucacuuuguucaagaucauuucugguugguaucaggcagaguaaggggaagaaaagauaguucuuucaggucgaaucacauugcuucaccuccccagccccacuccacuguauacaacuuuaaaaacauaauuaacacuauggucaccuuuaaucaauuaaaccaggaaaauaaaauuguugauugcuauucacagugcaaacacacagcaagacaaggaguucccagcucagcuuaacaccuccaucugaggaggacaaagagggagguggcgagggugucugcauccacucauauuacuaugacauuaccgucaccuucugcagaaucacugcaagccuaucuagccauccucuucuuaaugagcuuuacauuuauaauugauacaguuuaaugauugacaaugacuugucugcaucaucuuuagugcagaacaauuucucuuguaaaagguuuggugacuaaugaauaaaagucuagcauuugacugaacuacacagcagggcugagaguuugagggcagccuggucuguauagagagacuucauuagaaauccuaauacuuauauccuaguuguguauuuugauaaugagcaaauuuuuuaccuuugucaucucuaugcauacguuuauucaaacugccuuuauucuuuuacaauaauauuuacagaaaggaaaacaaagauauuaaaugagauccuugaaauggauacuugaacacaggacccaaauuuaaauaaggaccugcccauucguuuuagaucagaguucuagacauaugauauucaacauacaugccucacaugccacagcaauccgggggcaucaggugcugcauguaucuccauucacaauacauucuggcuuugugaauuguuucauuaagagagaaaauuauauaaacuacauaauagaaaaaugauaugcaugaagguccccaaaagauuaaaccugucaaccacuacaucuuuuggugacagugcucauuucuucauguauggaauaaugacuaaauguuucuaucaaccugugggaaaauacagaaaaacaaacaaacaaaccaaaaaaaaaaaaaaaaacccaaaaacuuaacuauuguucacaaugaagaagagggaugugaacaccaaggagaggaccagagaagauuccauucucucuaaaaccuccauucugaagaguagagaugagagcagaggcugaaaaacuacacucaccuccucuaauccuugcucacuagcauacccauccuguuggaccucacauggcauucagcccugacauuugucucucagggagacccaauaccccgucacuuauuuuuauccucuguguuagccaaucuauucaguaacuaauaauguuucuaaaagcccaugauugaaaaaaaaaaaaagaaaacaaaaaccaacaaggucauggcugguuauaauccagaauaaugucugggucaaaauaugucuuuagcucuuuaugcauaauagugaucaguauuacguauucaguuucaucugaaauguaaaaauggcuucaguuugucugcauccuaaaacuguaaaaauacagugcauucucccuaaauaaaccacccaaaccaaagaaggaauuagaaauauuacuuacaucauccuccgggaucccgacagagagagaccagagggaaaucugccauuaagauuccaucagcucgcucgcacaggaccauggggaacaauaggagaaagaacacaugauuuaaaaaaguguuuagagaaaacauuggacuuuaacuucgucuuuagcuuagagcaguggucuucaauuuuccuaaugcugugacacuuuaauucaguuccacaccuucucgugacacacccaaccauaaaauuacuuuguuccuauuucauaacuguuaugaaugguaauuaaaagcaucugauauaugcuggguggugguggcacacgccuuuaaucuuagcacucgggaggcaguggcaggcagauuucugaguucaaggccagccuagucuacagagugaguaucaggacagccagggcuacacagagaaacccugucucaaaaaaacaaaacaaaacaaaacaaacaaacaaaaaagaaucugauaugcagccccuguaugaaggucauuugaccccuccucaaaggggaugcaacccacagguugagaaccacauuaacgaacagaaaagagaauuuaaaauuuuccauauucuuagagcacuggucuuuaccauauggugucuauaucauguuuaaacacaaaauggggagucacagagucagucggucagaccuggaccacacugguuuccucacacaucauaaugugccuguccauuuauuguuguaguuagacaauauuucauuaaucgaaugacugauaugcucauucaucuaacuuugaccaaaagccaggaccaagauccuuggauguugccaacucuuucgugaguacauugucucaugaggggauggccuguauuucuuuugcacuugauuccagaguccgggcauauuuuauucaaauugacaucagccaccaucacugguucauguuugccuguuuaauuacagcauuucuauuuuuucucuaagcuauuaauuaaaauauaucaguaaacaugauucauaagcucaggaugaugcuggacacguccaaccucccuggcuuccaaagagacacagaggccacuuugcauucuaaaucaaauuauugcuucuuuuucugauaaguauuuuuucuauauuauuauggauuuaaaauuuuagauauauucuaagggaauuucguacauuuacacaauauauuuuguucauaagcaacacccuacuuacucugggaugaaccuugugucucucucaacuuuauggcuccuucuuuuuuuuuaauauaacauuugcagucuaaaauuaguuacccaaaugugugugaaugugaaucuaaccacuugagcauggucacacuacuaaagcacuaagcccuccucagaucuuauuuagacauaaacuauuuuuuuuuaaaaagacacuguagacagaauaaauagaauucagaggaauaauucaggcacagaaggugcauagaaggugcaugagugcauccgcauugaaacuaaucccaggcaagaugagaguugacuggugguucccagggacaggugaggugggaaagagggaggcacgggugguaaaguuggauccauggguacugagucacaguuaggugcuugaaugugguauacuucguaaggugacaaguagaauggccuuuuuuucuauacugcacauuaguuucuugauuauuucauaucuuauaaaaaaacauauauaaauguaaugaaaaguagacucuugaacaaucucuaggauguuccuauauaauuaauugcuuccagagaguccagauguauuguauaaaucaagcucagggguucauacaaagggcucagugcaauauauaauuuaagucuaauguuuaccguaggcacauuucaguaacuuuaaugcuuuucgaaagccgaaaccaucacagugguuauuaugaugaagcauuucgugcuucugaagaugcacguaaccauggaacucaagcuccuggaaagauucguccccuggcucagggcauccgagcccaggacaccaaagcagagcagcucauuaaaacauggccuaaccuauuuuaguuuugcuucuccuccuuccuucggauggccaugaaagaagucauuauuuggaggcccuuuguugcuuuuuuuuuuccuugacccagacauugucuauuagcuauuaauuauacugucuaccucaucucuagucaaagaagacuuuaaaguacaaaaguuauuucuaugcagggaucaaugcuuucaaacuaacaggauggaaauaaaugaacauguaaacuaaaaacaaauacuuuccaucucauggaaugaauuacagaaaacugggcccagagugcauugucuaugccucauauggcaacauucaucaccauugguucaggauuguggccucuuuucuauaacauuucuacuuuucauauugaauaauaauuaaaauuauaagccuuaugacccauuucauucccaaaguaggggcuauuauuauuauuauagcuauuauugcuaaucuguuaauggacccucuuucuaacauugaccuaccauugcauuaauuuaugaugguuuccauauuuauauuaugaaugacaauguucaugcaaggccuauuuguaccauugguauucaguuggccauaauuagcaaccugauagacacuuggucacccaagacaagacaagaagucuucaguucacauugguaucauggcaaaauguaguucucagcucugugugagacugugcaaaccuauagugaaaaccaggagacaaaccaaacaaacuacacagagaguguuggcuacccgaccucuacacuugugcuaagaauauggcguccacugagccugugccaaggaagaagccacaaagcucugaaaccaaggcacugaggugaugaagcaaagcacuaggggauuuuccugucucgauccuccaaugcacacauuuauuaacauuuuauaacucguuaauuuucuccuaagcaaaagaacaaucugggauuuaauaccaacccauaggaagaaaagaauuaauguguaaagccucaguauugcgacaacaaccaccacuaccaccaggguccaaaugacugacucagaacaacaggacuggcuaggaugcccaccugucuuugcaucucugggaaauaagaaagcuccccagaaccacugauacagggacuucaguauuugcaaguuauauuaauaauauuucuuacuauuccuucauccuguuuuuuuuauguaaucaaaguguaaauuuggucacugauuuuucuuauaauaacaaucaaaauucaugaagcaccaaaccccaaagcacacgacauuugggauagcugacgucuccacaggauuagucccagcaaagcuaauacaacaaucucugucugaacuaaaccagauuuuucugacaugaauuauucauuacucaugguacagauacucaggcacugucaucauucugggucaggauuucauuccuuccucucccucuucuacauuuaucuguuacuuucccaacugguaaacaauaauaaagaccugccacuaaauauugggaaaaaauugccuuauuuaucacugauuuccaucucugucuuugcagcacguugauuucagggcccuacuuuaguaggugcauuuauucugaagcacauguaaaaugaugcuaauaaaauauugagagacaccaaguguacagcacccaggaggcagagguagguagaucucuaugaggucaagaccagaugcaucugcauacugaguuagugccaggccuauaagaccuacaaagugagaaccucucugaaaggaacaacaaucaaaacaaacaaggaaacaaacaaacaaacaaacaaacaaaaacccacacacuauugagagucauuccauuaacacgugccuuucaaauguaacuuugcuagucauuuuauuauuuauuacuuugggauaugguuauuuggguuucuuuuuugauuguuuuaguuuguuguguuguuuuuuuuuccugagaauucaacuaccugaaaucuuccuggacccaaaguaagaauccugacuauuccaugucauuucuaaaaccacuuacccauacccccaaaaggcagccucccccacuccacugcaugccuagugggcguccggcgccuaaaacacauuaauacuaacccuccccucacuguggacugccacgcuuucccaaaccuggugaccuucauuuuauacagugucucauuucguucaucuuucauaugcu

SEQ ID NO: 6835 - RNA, 2304 nt, Mus musculus
guuuuuuuuuuuuuuuuuuuuuugagacaguguuucccuauguagccagucuggccuugagcucaugaucuuucuauuucuaccucagccucccaagugcugggauuacaggcaugcacuacuaugucuggcuuugauggacaaguuuauaaaguccacagaaaaucuagacuguuuuaagauucacaguaucguuaaaauccaccugaaaaccaaaucacacuaaaaggaggaaaaauuuaaaggaagacuauugccacugaacaaugauucaauauaacauaauucaugaaaauaaacuacagcuggccuaagaauuuaguaagccaauacaagagaguaaaaucaacacaggaaucaaaacaguagaggcauauauagggggcuggagacaugacucaguauuuaagagcacuagcacucuucuugcagaagagccauguuugguuaccacaugaugguuuacaggcaccucuaacucuaguuucauggggaccaauaccucuuaaguccccaucagcauugcacaggcauagugcacagauacacacagccaaaacacuuacacacauuuuuaaagaugauaugcaaugcaguaaagguagaaauaagauauuacuauaaugaauuaaugguauaaauguugaaauagaagacauaaaauuauagaagucuagaacaaaaugacuauaugagcuuuguuauugaaauaccuuuuuauccaaacaaaaaugcaaaugaagaaacuuuaaggaaaaagugaaaugauauauuucuuuaaccuaacaauuuuuaacuuuaagaguuaguuuaauauuuucaugugugugugcauguguaugugcucacaugggcaugcucauguguaugagggggaagagguaucaguguguaugugugcaugcagauacaugugcacacauaugcaugcaugaagauacaaccagugcuagaaaggaccaucagaucucauauagcucuagggaaaaagugauuauaagccacccaccaugggugcugggaaccaaacccugguccuguauaagaacaucccaagcucuuaacuguuaauccaucuuacuaacaccacaauuuuagaauaaaagacuucauggaaaauaauuaaauguaaauuuaagaaagaaaggaaggaaggaaggaaggaaggaaggaaggaaaggaagaagagagggaggggaggaagcgaaugcugguagcauuugaguaaaaaugaauagagcaauauuggagagaagaccuuguaacacuauacaaucagucaaagugauuccauauacuauuaaggugcacaggggaggaaagagagugaaaaauuagcuucaaggaguaaaagagaaaguuuuggaucaaaaggaagaaaauagaagagcauauauccaaaucaacauagaagcaaugaaauucucauacaaagagagaaaacaggaaaauacuacauauucccucaagacaagggcuuauggcuuuucacaguaggccuggaagcuagaagacaaggcuuuuugguagacuguuguucaucuccaucucucucuaauuuucuuacccugagaguuucuaaccuguuuuuucccaaguccauguauuucugaaaaucugagggaaagacucuguaacugagaauuuuauaccuagcugauuuaucaaugucaauguggacaauugacuaugcaaaacuuuuuucuggauauucuaucaaaaugggaauagcaccccuccccccaaaaagaauaucauggcaucuauaaaaaccagcaacccaucuaagagauagaaaaauaaaggaaccuguucuuaggaggagaugggaagaucaagauggugucagccuaaagaggagcuagcccaugagaagauuagaagcugacuccaggaagaaaguucuucaacaugauacacauauguaucgaacacuucauguuuuuuguauauaugggaaggcugugaguuaaccugaguuacacaaaacaaaacaaagcaacacacacacacgcacacauacauauacagacuccagaagagaaaaaaauacgagggagaagauaaauacucagguccagguuauuaugcuuugugagcguguucauacucaacaagggguguaaccucucaaguauugauaaagcaagcaagcauuucaaaauaaucuaucgggaggauaguacaggguugugugugcagggugaagacaggggcauaugaaaaaaaagcuaaaugcuugucuucaacaauagagcaaucaaaaugaugccuaagcuuaaaaaaagaaaaaagaaaaaaauc

SEQ ID NO: 6836 - RNA, 37057 nt, Mus musculus
cauggucuacuucuucucaauaucacaucucgccuuggaagacuuccaggaggugacaucugcuuugaggaagagccagugucccggucuuccuacugcugcugcuugguacuuggagagaggugguccguggcgcguucgcuucauuuauggcgcacauuacacggucgaccucuuugcgguaucuaaucccgccuugcgagcuuuccuggagcuaacaccagcugugggguggggacacuaaaugugugugcuagcgcaacccagccagcggguuugucuuuucuugugucugacaauaacucuuguguggcagccuucuucucagcaaauuucucuggcuuggcagcuucgugggcagggugacuugcagaccaggaaaguggcaucgacaugugauacacgugugggugcgugaggugguugaccagagagcacacgcuauauuugugccguuugugaccugguccacuaacccucaguaucuaaccuucccuuggagaacuuccuggaagagaucucaacuuuuggggacagaggcaauaagccagcuguacgcuguuagacuuggagacagcauccucaguacuugcaacauaugugccuguuaugguaguauuggaugggcuuccaaugcuguccuauacuuggaucccuuccuugauauggggccauccaaguucaagaaacguaccauguugucagacaugaccaggguguguguaugccauuuauauauggcacaggucgcaggucaccuuagcacacuugcaugcuaaaucugugggaggaaucaucuuugguuugggggcaucugugccuuucugugguuacccaaaauggugguaaguccuauagccagucucuacugcgccacugcucucugguugugacauaacuucaggaucaugccauggaggucugcuguacuggggcaugugaugggauggcugucagauauauaucaacuaauggcuugcuugagcacuuugacuaacauccagugugcaacccugcauucaacaggccugccaggucugaaggucacguuggggaauuaccgagguagucuugucaguguucgcuucugguaccggaagagagguuuucugggucucuguuucuuugaugagaaugaaacacacccagcuaaccuuuuuuucaguaucaaaucccaucuuggaggcuucgugguccagaucccagucucagggaaggaugguccugucagcauccagccaggggacaggaauaacugguucuccacaaagccagcgaguggauuaucguucugaaugguguccuuuguccucuaaacccucccaggccugccaggucugaagguccaguuugggaaggugucauuguuauuguuaacugaggauguggaagagggguuucuguguuugaaacacauuuggucaaccucucuucccaucagaacaaacuauggaggccuucugguccauaccucagccucagcugaggacacacuaauaguuaugaacaagugagugacggacaaaacccaucccauacaucagauuucuguugccugugcuucuaaccuucaguaucuuguccauucucaggaggacuucucaaccaauaugguguuccaaaguuggggaagauggcagccaccgaggcaacucuaccccaggucaucacagguagguugcacccacuuugcuucuaacagguuagacacagccacccccacacauguccagcaugcuuuggaggcacggugaugggcuuuuaaucagccaaccccugcuauaggacugucuauuguagagaacacccacugugucagaugguaccuagauccaugcuauucacacacacccacauccuuguaauaagagacuuggaaucagcaguguucuagcaguaggaaagcaaaccugaaauuggcacacacauuugcccagugagcuuuaagauaugaaaucuggagcggggcagugguggcgcacgccuuuaaucccagcacuugggaggcagaggcagguggauuucugaguucgaggccagcuuggucuacagaaugaguuccaggacagccagggcuauacagagaaacccugucucgaaaaaaaccaaaccaaccaaccaaccaaacaaacaaacaaauaaacaaaagaugugaaaucuguucuuaguccuuaacuccacccaggguuguggucagcaguagagcuuucugugggguuccagguagaacacaauucucaucugcaaaucaugagcccuuuucauaggcauuucauaucagauaucuacauuaugauuuauaacaguagcaaaaucacaguuaugaaguaacauugaaaauaauuuuacaguuggggauuacccaacaugaggaaguauauuaaagggucacagcacuaggaagguugagaaccacucgaccaggggguggaacugccugccccugccugcugcuucuuuauacuaccacaugugcuggcacacauuuaccuuccuacuaacuuuauaaugugucugcuuuuagaaucuuaccuucccuggaaacuacccagacucacaaccagagggcugggucgcuucucaucacccaccuaccucuuggaaccagaauccgaggcucauuccugaacacccccaauguacuguacuuguugaaguugagagcuacuauuccccuguuaucuccugaggcacaauuucuggggucccugguucccuucagugacccccccuaaaccuggagagauaaggaaugcagguggucuguguuguugguaaauagucucaggcaauucuguggacugucaaauugcacagggguuuugguugcucuccagggcccacagaagcagacacuucugacaaggcaccuggcacuuuccagcugccuuuguuugcuuucugaccagugcuaauugauacuugaaggagagguuguccguguugucuucucuuuauuuaugaugaaacauacacgggaaaccucuuuuuuaguaucaaaucccacccugggggcacucccugucccugaugacgccuucagggaagggaccuggacugcuguucccuggacucugggacaugggacaugggaguauggcaucaggacucagcccuggaaggaaagucauuugaagaagggacaggguccccgugguggccugaggcuacucccuauggcuuuggacugugaggugacucuuggugugugauggcuuuucagcaagguccuccucacaguagcuauaaggacgugccagcaucgugacugaagggacaaugaugcccacuguucucgggguagcuguguggaugguagaccggugacguacacuucauuuaugcuguaggucacccguuuuacuauccaccaacacccagaccaucugugggaagacaccuuggugcacacggcagcuaugaagaagauguuggugggguugaggccagcgugaaacuaaaauauuucaagcagaguuagcuuuuaagggggauccuuuuucugcuuguguguguacauauauguguucaagagagagaguguguguguguguguguguguguguguugggggggggcuaccaugggcgugacuuucauuuuaugauccuguaucuuugcaguaaacaacgccauccuggaggauccccugaaugugaagcuauaucccaagcuggggcacauuucuccuggugggugagugacaggucucucuagcccagcaucaagcccacaucugucacuuauggcauaggcuucguuguucuugcucaucuccaugucuguucaauuuugcuugucuucugaggauucaaaucauuggcugcuucccagcacaaguaccugacuaggagauguauuucagauaugacaucuccuuagggaaggacaccagaguccucaucaauggaaaagguaugucaugguguucugucugaaagaauauauuauauuuucauguguguccuucuuuacuaaugcugaguaugccuuccauaccuaggacgaccuccugauguauugcuacccugggggugaagguggcuuccuugccccuccuccaggcuccuggcaagugguucuugcagccauggcagagacauagaaaguaaguaggaacucuccgacugagauuaggaacuacugugauucugcucauguuucauuggucaagccaaugaaggguggggaggugcccuguagccaugucaugagggagagaacauguguacaagcauaggcaaccaacuaucuaccuggaacaccuaagaagucuaucuuuauucauguucuuuuuuuuuuuuaaucucaauguuccauuucccagcaaguggagggucaacagaaucuguucucagaacaccacaugccacuuacauauauuuuuguccaggagacauugucucguucugacaaaggcucagauaucuuuuuguuucccauuucaugauaaccuccuugcaucagggccuccaccguggaacauagguugauguccuccccucuagcagauggguggugaccucgacugagaggucacgggacccaccuccucucuugucacggauccagagcuggacuuugggaagcaaagucaggauuauuauaucauucucugauguuugaggagacuccaaagaccuccccaaaggaugaccaauccaaagccugucuacaagauccugauucugccugcguggagcgggcacagcugugagagcccccuagguacagcggggcugcagcgugaucgccugcucacgcacaggaagugacgacagcgguacucaagccacaggaagugacgacagcgguacacaagugguacacaggguuccaugcugcugacguacggugcuuaaugagaaguugcccgcguguuuuucgcuuuauaugugacgaaacauucgcggugcacuucuuuuucagcauccuauucuacguugaagacuucggggguucaacuacuuacugacuucagggaagccauguuagucuaggaaaguagucuauguagugagccuggguugugugaguuuaucucccuucuugaaugguccucugaccuuucuuaaugagaauggguuuggguugguuggcuccugcucccuccucccuccuccacaacacagugucaaaggaaccaguugaccagacauuauugauuccuagaugagaccuuagcccacagggagauguuugcugagacuucugggaggggaaugagucuucauuucugugagagaugucugaguggaucucacuguucccugaguuugaaggccagcuagaauucaagaggacaguacccagggcuguuuagacagagggggaagugccugucccagaggaaccaugggacauuugaguaacaguacaaucugggaccugcauccgacacuccuugaagcucaacacgucacuguaccuuuaaguuauauuagccuggaugccuccuuuguguguaagucagcuugaggugggccuuuccuuacuaugagaggaauggauggcuccuuguugaguggccugucaaugaguguaacuggcauucuuuggaugguauguucucuugcucauuauucccauuguccagucuaagguagguaguugguaccaagucacuuuccuuugugguucagauauauugcuguaguguuguaaccuuccaguaacgguaacacacacuaaucaaugcguuuuguuuucagggaagggucggucauaugucccguucaggacagccgcaagaugaugaacggacauugcauccccagacaucucacacgcucagaauccuggagccucccauuucaaccuguucuucugcuucccaguacccugugagcucuuuguuguauuugucuacaucguaagucacuucugggugcgggagaggggggaccucagagggcaucauccaggcacucacacagcugguuuaggcugcccuggauuuugccaccuaguucuuugacuuuuuuuuuuuuucucagcuucagaagaggauccuggaacugagagaggagauucugucuuggaguuuggcaccaucccauuucccccgagugacacuucagaaugacuggcaaggaugguaggcaacaucucagaaucuucagucuucgucccaggucuuccugagauccugagguagaggggguuugggcuggauugcuauggcagugaugaguacugagccacuccccuugccucaggacccccaucccugucccccucccggccaaguaucugccucacccaccaucccuuccuuccgccugucccucagcaucccuucacacucaggcacacugcuggaacaagcaagagcucagccgugguaccugaaaagaaguugcccauguuauuuuucgcuuuuauuugugacgaaacaaacauggugcacuucuuuuucgauaucaaaucucaccuuggagagcuccccauggaccagagggaggacgggaggccaggggguuugggucaccaugugcacaggggcauuuaccucaaagaagcacaauuucaccugccccucuuggcucugugcauuguuagguccagaaugcccaccuccugggacaggcacagucaguaagggaaaccaggaagcgcacuuuuaggcucuguuguaggauggaguucagauaagagaagcccagaaaauuauaaaauccaaacaauagcaauuuaaucaaacagccaauacaagccaaaccaccaauuccuucuggagacaugugucuagaugucagcugcaggugucuuuaccaagauaugucaguuggugagugucacauaacacuaugacucuagaaaagccugggccccagaucagcucuuuaccagcauccugccaugucuacgggcugugcucuuugaugccauuagcaaggccuugaggacuggugggugcuggcuacgauugggaccagggaacagcaagcugucaucagccacugcugccugucucuuaucucugauacugguaccccugcccucuggagugguagauguaaggcggcacuucagaccccuuuucccuagugaacuucucuuuauggcuaacauucucugguagccuccucauggcaucaaaauugccuuugagugugguuguuugagcagggcccuuugguggcucucuugugagagugggagggaggauacaauccagagaguaugagaacaccucauccauccaucuccccuggaggguuuccgaagcugagccaguacaagauaugggaucacucuuaggcaacccuuugcuaggauacuagcuauuucuuucuuugcucaaguuggaauaaaagcuuuguuuauacuuacguggcucaacaaccauagcgcaucaaaacccagugcaaacuccaucuaagagguaccaggauuagccacacacuuagcucuuaguuucuacuggcucagugaugcccuugggcuguggcuguaccuguguuuuggcuucugccuauaaaagauggaaacaccuuuggaaaagcagcaacucucccuuuauacccauggagaaaggcuaaggggcauggaacaagcauggucaacccauuuucuuagguugaaaaucccuuuccaucuaguggguacuggccucggugcugguggagcagugagcacgccauacauuauaucugugacaccugccacccagcccaaggccccuaggcccacaaacuucuggaggggaguuugucuuggauucauccaaggaaugcaaaggacaccuggacagaaaugccucugguggucaucccaagguaaccggacuuguucaguuccauuucacauuuagcuuugugcuuuauuggcaggcuucuaagggcugcuauucaccccuacaucccagguacguauaggcccagagggagccuuccaucuuugaggguagaauauucucugggcacaauaccucaccagcugucuuuuucacaggagaagccugggcaggauugccgcagcuguuccaagaggccccaagggacaguguccacaucaugguguuuguucguggaagauauuaaacgcugaccucuuuuugagcacaaaaucccuccuugaagggcucucuguacccggugucagguucaggaacacgaugugggcaucagccccuugcugaugguaugugagcagaugucuggccagauggcaagugcuuuuguuuauuuauuuucuuauuuugagacuugagaguuuauugaaugaaucauccuauaauccaauuucccaaggcaaaucuguacauaaaaaucuaguuucuaucacaucgcuuccuucuuaauugauugacagauuugagcaaaaacaugucuagccugcauuucagauuuugagaauuuuaaagaauauacucugcccuucccagguucgccuggaucuaaccaaacggacaagcucaaauaucaaaugaaaaaugaugagagcaagaugaaggugggaaucucuaugaauauguggcacccauauugauuuuuuuguauaacucauuuaauauaacaauuuucgauaacauuuuuuuuguagcaaguuuucauuguaacccaggauaccuuugaauuucuuagguagcugaggcugacuuugaacuccugcuugccucugccuuccaaacgcuggcaucaaagguauguuaccauaaccagcucaaaacuguugcucuugcagaggaccauaguucaguucccagcaccuagacuggauggcuacaaguuuagcuuuagggauguauucuucuugccuccuugggugugcccacaugcauacacaugcacgcauggauagugagacuacagaaggcaacagaccuugaucuccuaccucuacacauaggcaaagcaagcauacuggcaccaccacacgcgcgcgcacacacacacacacacacacacacacacacacacacacacacacaugaaccuaaacguagcuggacauuguuccuaaagagcagacccaguucacacacagcuacauuugccguugcugcuccuagggucaggacagaugaacacauuugcucccguaaccagcuaucagauccccuaacgaauucuguccugcuucuuucuagggucuccuggccucauagggcacuaugaaaggaagcagguguagcccacugguaagugaccuauccaugcacuugaagguguuugugagguuuucugcuuuaacaagcuguagauacaaggaggggccuuggcucuuuggggcgaggccucagcauccuuggguccucuugucuuugguuacccagcuuuaugaaacucucuggccaguuccuacuuuauuaaaacaugacccaugacagcaccacuauuuggacauauaugggagggcuggucacagagcauauguucuauguguggggacuaucaccuggccuacuugucuucggccucaaggcuaagaugacgaagauguuggaguuaauuagcugaguugggguuuucaguccuucuuugcuuuuuuuuuuuuuuuuuuuuuuaaccaaagauuuauagugucgguacugguaugccucugugucugauguacucaaaaaagauuggacaggaacuugagcuaaucuuguaaggaccugguaguguggugauaguaagucaugaauguccugcuuagccaugucucaaggugucuuuuauaccuauccccaacagugucacacuaaugcauugagccuguguguuggagccuucuggacuuagcccauuuccuagaaaacuuccuugaugucuccagugcuccguggcaccuacguggaugccccagcagccaccuugaugacaucucucccaaggguacccaggaugggcuguauggguguggaacugguuuuggaaaucacaagggaacagauuucuugucauaaacucucuaagaggggguggggguuuacaguaacucccuacuaggcugugugacaaccagggcuauguuuaacuguacggugggcucuagauacacuucugucgcucacuuucugauauucaaaaggugagugcuccucuaugccucugguuaaucauagagguaacacccacauuuucaguaucucaagugguucugggauguuucugaauacaaagugcccccuaggacaaagcagguuauuccagucuucccccacccagagaacaaagggagagauggguuccacagccugugcuuuccacagccagguuguuccuggaaucuguguccucugggggcugugccgagggcgccugucugcugccuucuucauuucugacggauuaggccucggcucuuucucuucaggacuaaaucuuuugguauuuaaaagguggauauuccuucuauguuuaugcuuuuugugauuaaacauagaggaaauuucacguuuucagugucaaaugcugcuggguaaugggccugagcugaagccaccaccagggcagugacaggacaggugcacccucuuggguaaguggggggucagugguccacagagcauguccucaggugcccaagggccaaugagcaaucuugagagcuucccucaugggcugccaacucagccagaggucaggggucucguucuggaaucccccacagcuaacaagucuuucccauugugucccuucugucgcagauaggacuguccuauuggaugucccaagaguuuaagucugauaucuaaaagguagauuucccuucugugguuuuauguuugcuggucaaucugauggguuugccugaguuuugagucucaugugcuuccugggugacaugauccaccagggagaugaggcugggcgcagugcccuccucgguaagugggaagaugguaagcugcagaacauguguguuucucaugucauaugucugcugaccaucaccuuugggucucugccuguggagccagcuuggcacagaggccgaggcgccuuucaacauucuguuuccucugccugagaagcggggauuuuuuuuuuuuuuuuugucuuguaaucuguuucagaugagccaagcagcaagccugguccuucccggaacucaguccuucuuugguauuuaaaagguggauauuccuucuaugguuacgugcuuccuggauaaucauagaggaacauccacuuuuucaguaucaaaugucgcucuggaacuauuucuggaagauucuguagggucuggggcugggggggaagaucauguaauaaugaguggggcguggccagaaauggccuuaagaagccaacugaguguuagucugaucugggucugauauaccgccucuuugggcagccugcucacucugcccaguggacuuccauuucugucgacacaagcacaagcucacagcauccuggaucgaguuguucuuugauauuuaaaagguagauucuccuucuaugaguacaauauuaaugacuaaucguagaggaaaauccacguuuucaguaucaaaugcugcuugggaaaccaccgaggacaugacaucuucaccgaagaaagcgugcuauccgucgucuuccugggcuuggcggggauagauagauuugugacuugugugaugugugccuauaugccagccucucccagugauguguucugagaccacuguguucuuuauaucccuucucugaccucaaaugaaguuguuucucugugugcucaccauguguauguuuucuggagucggcuucuuuuuucuguagcgauaugucuuggagagcuccugggugggccaucauuuuggguaagggcgccuuggguaacccuuuggggggugugcggagaagggggggcaugugaaucaucuggaaguguaaccuccaaaugugcccccucaggcucacauccggaccgucaucgcaucugucaucgcaccggaccagcucuccccagcgcuccuuaucguuugcuacuugaagagagguuauccuuuguguguuugcuuuacgcgaaaugaauaugcaagggcaagcucucuucgaggagcaaaugcugccuggaagcauggcuggcggcggccugggccuagcagaaggguguggucucuccaggguaaguaaaugcauggugggccaccgagcuugagcuccuucuucgucugacccuacagaucucacacaugcuucugagaacuuucuagaaaaaaaugcugauccuaagggcuguucuugguagagccuaggaaacugugccuccccuucugacagcccuucgcaguguggugugcaugccaggucgucuucuaaggccaaaagagugucagcagcaagccagugcccauuuagauguggguuuucugcccaccauugccaaccuguccuuacaaucaccuuuaaggcuucccauccacuuaagggaaaggggguugguggauauccaaaguaaagaugcucccagaggcuaccaagaccauuaagccuccuucuccagguguccucuucaccuugugugucacagcaugaauuuauguuaagguugucuaaagaaccuugguucugggggucggguggagguggggcaucucaccucccuccggugagccuugcaugggucugauguuuauagugauaagucucccauaguccucugaacuccccaagaagggcagaaggaagguccagaggucuccauacugcuccaguuuggggaagagggugggggcuuucagagagcuaguuuuccgguuuuucuucuuucuugaaugaugcauguugcugugcguacuaauccugcucuuucgaugaccaucuggaggacuuccuggaggcugcagcugugggcacagguggaggcuuucuugccaggguggcuuugcaggcucuggaaugccaaucauucucugucacuuuuuuguuaaguuacacagaauccccacccccaccccaccccaugcccauccucccaugccccacccuagucuuuuggaagaucacccuguuuuggagugauacugagaaguaaacuaacuuuagggcuggguaccagugugcagaguaugcagccaauuccagagccagccagcugaggcuugcuucaccagccccugugcucagcccaggcucacaggugcuucacuguucccuggcccaacucuugguucauguaaagaggauagccuccgguauguucucuuuauugaugguaauagacugcaagaggcacuuguccucacaucuaacucuaucugggaacuacuccagcccuguuccaucuuugggucaggucuccugauacaacgugacuucugacuuucucggguauguaccaauucuugguucuaagaugggaccuuuggcuaagcuauuagucucugguccuccuuguccucuuggugccugaucuuuugcucuugagggugggagaggguacuguggugccuguugcacuugcauugaacauaaucacccaacaguggcuugcuuguuaaaagacaguggcccucagaccugccgucuguuuguaccaagccaucuccagagccuuguugcucacagcauucaccuuagaagauaaagcaugauguuagacuaucccagcuuugauacaaguacugguuuauacaucuuuauuuauaaugauuucaggccugguccaccccucuccaagugaggacuuccuggaaguggugucugucuuugggaagaggcugaaguuucccauuccgugcggucuaucugguguucuucuguggcuauaccuagaucagaagggggcaguuuuaacagcccgcaccuauggaagcaacccaucccgucaaaaaaaggugaguguuuuuccuugccaugauucagugcaaaccuguggccauuccugccugcucuuuucuggggaagaggucccaaaaaggaaagaugguuccaucauucaguggcauguggaguuugaccccuguauggcaucaacuuccuucuaguucugucccauuccacuaucgggcagaauuaguggggcaggguccgguccugggagugacacugauacccguuacugggaaggcagaaaggauuggcuuuaaucacuucuauaaauuccugggguccuccuguccucugugugcaguguacagccaggugggcaucauagagaaagugcuaaggauaagauuguaguccuaaccaggguuuaccuacagaaagcaaaaaucugaguucuguauuuccugagagagugaaaaucucaaucuguuguaacaucugccaguaauaucagaaaaaggucccccccaccccccaaguaucugucccagcccaagcuccuuggauggagagcugaccagugggcacacaucuggcaggugguguuugccauguaauuggcugauuccgaaucucccaucaucccuccccaggcuaagucccaggagacgaggcugaccccgugaaugcuagagcggaaccugccccaugcuauuguuugguacuuaaagcgagguugcccuuuguauauucgguuuauugacauggaauauacaagggcaagcucucugugaguaucaaaccuuaucuuggaucccguccacacucagcgagggaugugguaugugugugcaugaccguguguauccaucuugugugugacaaacugcuuccuggguuuccuuuaugcaccaacggcuucaugggcgcaagaugacuucaggaaagaccucggguacauccccucuccuuguccauauggguuggucccaaagcaugcucucuguguguagccugggucccugcuuucccaggcugauggucaggucugugcuggugugggccguuguuuuuugaugugcugccgugccgugguacccaagugugcauguucuugcuuggugugugugacccagucugcuaacgcucagcgucuaauucguccccaggacccuaccuggaagacguagcacgucuaccugaggcgguggcuuugcuuuccaggccgagcuuugguacuuggagagugguuaucccuguccucuucgcuucacucaugccgaaucguacagggucauccacuuuuucaguaucaagugcgcagacucugcagccuggcuuccugcgccuggauccugccacugccacuucccaucacacauccuuggacaagggugucgccguguuaugcuccuugucucgugugucacucgcgaguccucuugggguccaaugcauauggcucucgggggcugggagagaucaggcucuuguagggacuaggcucauuauugaccaugugccagcccaaacuuuugucugcugggagcugacugcuggcagcuaugauggugauauacaaaccucuccuuggauuugggagcccauguugagacagacauucucugucagucaugugaguggguguuggagcuuagaguuugugcuggacuuacaagguggugcuugugacucggcagugacaucauuucuguagcagcuucuagaacagaagaccccaugccgggggucagcagggccacccacaaugcuugcuccacuuaagauggacacugccuggcuucuugaccccagccaccauuacccuuagaagaggcuaacgugagguugucaugcugaguccuggggagucauuucuauagccucucaccucccuggugcuuagaauggccaucaguaguacugcaugcauggugcauguauguauugggugcagccacgugugaggaguggugaucacucccaagaggccuauggaugcugguauuccugcugugcuacuguuucauacuugaggagaaauuauccuugguguguuggcucuuuuggaugaaucauacaaggauaauuucuuuuugaguaucaaauacugcccugguggacuuccgggaugacgagacgguuguuuaaagaggugccuggugcaugaugcauggguuagccuuaccugggcacaaggcaagagagcacagaacugauguguaagagcuacacucugaucccaagucaggaucuugcuugaagaguccagggguuccuacguggcuuggucauggugagauagcacaguuuucaugacuuggcaaaucguucuuuuuuuuuuuggaugggcagccaaucucacagauagucacuggggucaggccccggccccuugcucaagagugugacugguuccacaagcaugugcuugaaugacagaggccggcgagcugucuggucuggaucgugagaggagguccugcgguuuuucucggugcggugguucucugacauuugcaggguggcuaucaauagugugcucgccauauuuauggagauuaauugggacgaccauuguuugccccauaucuggauuugcuuccgaagguccuagagcacaguggugacuucagcuaauggacauugguaccugcugcaggagagggagaauuuauugaggcagaguaaccucagaaggcacccccccccccauguacucucacagugacagcuuugagguggcaacagcuuugguggcuugcuucuuugugcuuggucuggagaacacugagaauaacucaccugucuguuguugcuguuaagucuuaguucagaggaacuccuugagaagguacugggucaagcaucucuuuagguagacagaacuuggccagggucuucuagguccagcacccacucuccucagcauccauucugagcauagacuuccugugguuaauacagguguuaauaaggauacuuccugccgccgccgcugccuuaagucacucucuaucuguuccuauggcuuccuuugggcugacuuuuucuuagacauaccuggucaauagcauaccauuucagcucauuccauaaucuggugugugugugugugugugugugugugugugugugugugugugugugccugcaugcaugcuuguacaaauuguugguuaguguagggccucucaaacugcucaacgcugcuaagauauucgucaccuagggaucuuguuaaaaagcagagucugauugaggggccaagauucugcauuuuuagcaagcucucaagugaugcuaaugcugccgguccguggacaacacauguagccacugggggcuggaggugauguugcauguuccuuguagugugugugcuccaucuccuccauccaccccgcauuauccaucaugagugagcauugagccaauaugcuaccuuuugaugaucaaacuguggucaguugugaaaggccaccugcuguacaaacaccauuauugauuauugauuauucuuucaaaucaaagcaugccucuaugggcuucccagauauaagagcuacuucaaggaggggcugccuaugucagccaacagcaggacuugucagcaccagguuauuggugacugagaccaucugacucuguaacucuccauuuccagucaauuguaaggagcacaguucuggaaccacagcuucuggggaaggaggaguccuaucugucguaucuaccagcaacccucgacguuaucgagagagguaaugcccauggugccauugcccuuccaugauauucggccagcugcuggcuucuugccauccagcuuaccucucagggaggaccagauagacuuccauuuuguuucuaaauugaccugccuuaggaagcucuugugggaaugaguuuuuccgucagaccagauuuuagcccuaggaccaauguguagcagugagugguugcugucagcucaugugcuuucuuacagacuaugggaauucaccucucagagucuaggaauucaauuugucauuggaagaaucuucuggaaggagagaggacaguagacaagaggccccgguuuuccugucagagaucucugagaauauuugaggucauucauguucuguuugcuuauugugaacgagacacaguuagcuuccuuuugacuaucaaacucugcuuuuuugaagggcccccugcacaagcgauaugagacugccugccuugugugagccuuggaugagcccugcagcuccuucgagaugcuccuuggauauuccugauggagaagaccaaccccgaggaagcuugguccugcuugcgaugagcuugcugugcuuucacggacacccuucguuucuucuaccaguuuucagugccagggugcgcuugaaaggagagcugaugccagggcuauagccuuccccagccagagcaugugggccaaacccuuucuggauggcuaggcaguggggagaagccaugagaugguugagaaguagucacaacuccccuggggacagacugguuuucaggguuacauccauucaaaaacaccccccggaauucaggcuugugaaagacaagcuaacuugacccuguuccuuuguucucacugagguccugucccuggcauccccuuccuccuguggacaccacugaggugcagacacuaccccgauggggcuucccguccugcuguucggcucuggaagagacuugauuccuuuucuuuuugugcugguggagaucacacacaaaagguaagaugaacccagcuguuugggauucuggaagaaggagguuggccuguaucccugcuguaagggaagaugcuguucuugggcgucucccuuucagggaugaugccgguggcggacaggaagcccagcuccugccgccuggaugacucuucccuugguggggaccaauccuggauggaaucaguucaagauggaugccagcuucauacaagagcccuaucaggauuggccugaggucuguaagaguauauuuggcccagguaaauccaggugcuagggauaucugauacccuauagcacaugcacgccaucuuuagggcauuucugaggucaggaugcuucagcucucaccccugcuuccucucuuugccagagagaagugcuaucagcuacuaaaagugaauacuaaauggccuaucuaugucagagggaagcccaaagcccaggaagaaaugauggaccagaaacaacaggacaugcucguaaggucacaggcuucuuuguuccagacucucagcacccaggcuacccuagugagguccccagaauugaaugcacguuaaucccccugccucagacuuugggaauaggcuauucugagcuuagaguucuuccaaaagaacaauuuucuccugaaguaucuauucagcaccccucccccacccacccaaccccugcccaaaucuaugguuagcuuucuugaugcugaguccuauaagggaauauugaucuuauugaggaagggcuauugaccucagccaauucagggacaguuguucacuuggcuagagggaaaaacaagguguguagccaauucuccuaacauuugcuccucaauccauucuuaggaagacuugcugcaugguggauggcccagagacggcggggcucacagauggucacguuuagugcuugcagauugguaaugccugugcccuuggcuuuguuuauucuggucaaccaguugucagugcugccaucgagggcuuucuggacagcauggcaccuuccguaaggagaccuuggcuucaguagcuaguccagguauguacaaugacagucacacacucgcauuaugauguauagcggugcugugcuuccugacaagaaccuaaccacugaugaaaggguugugauauuugggagggugcugguaucauuuccagaccaucaugggagggagagaaucaugcagcagauaaugugugucuccugcuuugggugagcccuacuccuugaugauuugaauaagucuguggagucaggcgaguguaaggguguucugguguuacccugguagaaacacgaguaucagcuggcacguaauuggucacucuuccugcuuuugcuccagagaugauuccuugaccgacacaucuugcugacaaaugucgggcugucuugcuucauagugggaaguucacugggaacuaccuggguuuuguuucugaugccuagcacuuggcuugcuccucugcaggagaguuguuauccuaacggaugcugggagaaggcugaggucuucccaugacccucuuuggggauuuuugauuuuauuuaaguuaaauuuuuuuucaaaaguuaaauucuuauuaauaucccaacuucaugcuccacaaauuggucaagaacagugacaagagaauccaugcgggcuguugugcagguuuuagagagcugauaaagauaucacgaggaugagcaaucuucccaacuggaagaguggagacugggggugcucuuaaaguagggcuagccgguguacccagggacuggaugagccaacaucagaugugaacauguaggaagaggaggggccaaaguaguacaaccguaauguugguggaaccacaaucccugaaugauucggugggcugcagggagcauccuugcugcuaucauggcuaucucagcuaaggcaaugacccuggaugcucugaaaggcugcuaagauggaagaaaggguaacagaaaaugaggaagucauaggaccaauguuggggaucuugaugauacaucaacaaaugaauguuacacugggaaacaaaauagaggugggguacuaccgccugcuagccagaacuguaggaaauaagaugaauacuuuccauguccucaggagagagccagguuuccaucacggugaaagguggggccauggaaaagaagugaagccccaagggacuuugcuagugaaauauguuuuaugaaaccauggaggcaggugggacacggaagggugagagauggguucuuacuagggcuuugggaagcuauccuaaggaagcuuccuaguggcgagccacuagaaucuggaaaugcuaacugguccuucucgugcaagguugcuuguaggaguugguuacgccauuugugauggucuucuucuucuucuugaaacugauuucuuagagaugagacagugggaguggaggaucaccugggaucauguagagcucaaugaaccuucucuugauucauaugaggaugcuaguagccuugguugggcuuuucugcagugggacuuuuauaguccccucaggaccuugaugugacuaaccauaugugcaccauugagaaaugcaaguccccauucacauaccccagggucuauauaccugcagaggacuucugaccuacagcaagugggcucccuucucaucuugaaaaccuuccagugugaacucuagaaccaaggaagacagagaaaggggacaaugucagcaucguugcaagggaggugagugaccaccccugccccacuccaguguguuucuagagcacuugcccccaccucacuaacacucagcauccaaucugccugcagguuggugguuggaaaccauagcccuuggagaaauggaaggggcccuuugucugucuugucucugcuuuucugugguacuugaagagaaguuguucgugguggauucgcuuuacuugugacgaaucauucacggacaacacuuuuuucaguaccaaaugcuaccucuaaggauuuccuggacaugauggcaacuugcagaaagauggcgguucagucaagcugguagagaagccaaguauggauguuuggccacggacagugugcuugagcuagcuguaagucaccuggucggguuaccugagcaucugauccaccuguaggccucucaucagugggccgugccaaccuuggugaggcagcuguggcucugcccccaaguaucagcuuacaagacuuugaaaagaggucaucuuccggaagagauguuggugccagcaccauucagggugugugacugguugaccagaggggcgugcacucuguucacccugugggccaccuagucaccaacccucagcaucaauuccacucaaagaagacuuuccagagauccuaccaaguuuggggauaugucaauggacuugauggcugugccugcucaguggaccaggaugaacuguggucuuagggguguauguuuacauaagaugccaugaggcauccgugguagcugcugcaucacugucacagccuccuugaaauguugacuucagauguggacaugauguugacuucccaugagggaccugaagucccuucucuccugggugugugacugaauuguacuuuacuaagcaugugccugugccuuacuuaucugauggaucuaucuuccaguugucuaaccucaauauccugucucuacaggagagucugugagaugauaccaaccucuagaagcaggcaugguugucccgacaucgccacacuaccacaggagcuuccagaauacauucucuucauggaaacuguggaaccacgcccccucugguccaggaggacuaaccagauucaaggcuaucaccaucccccuucagguaagugugccucgggugagcaugcacuuaauguagguguaugucacucggcucggcccacuacccaaugcugucccaccccuucuucacaggacaguggaagcagccaccuuuucgagagagucgauguguucuucaccaguguucuucgccagugaucaugugugauacuuggagagaggcuggccgugaugaauucgauucaucuaaacgagucauacacggcucuccucucuucuagugucaaacucugccucagaggucuucucaagccacuacuguucccaagguggguuucuggauggcuaaacccaugucaagugccuuuauccaauuguauauuucacacaguuaucccaguguccaagcuaacccacacacgacuuccuaggacauuucugauuuuuuggaaagaccagagacacuguugggagauucuguuuaaauguuuaaacauacuggcuggcuucuguuuugguuaguaccuaauucuaccauggaagaacaacuagaagcagccuuggcuaguuaaccuucaggauacagacuagaaugggacccggaacauugugagccuguguugaguuaucuguagccauuccauacccugaagugaagucucugaagaugagcucagcuucacccagcauccccaggacaaccugccuugcaaacuuguguuugcuguggguauggcucugccaccuuugacuuaguaaacauugcaugacgagucaaaaaucaccuuccucuuggcgcuuauuuggggcccauaaaccagagguuggccagagagcaugggucugauugggacuuaagccacuugguucacuuauucucagaguccuguccauucugugucuacucccaaggugucccccugugaagaagaugcaggagugcugugagaagugccauccccugguacuuggagggagguugccucauagugagcuugcauuauuuaaugaugcccaauacaggauagaccuguuuucuguaucacaucuuaccaggugcuuccuuggaccugauaucaaucaugaggaagccacgauccuggugggguuuauaccaucguccuugaacaugugguuccuuccaguguccccugaccccauccagucccuccauggagggcauugucagcauugagguagauacccauguuauaaacuuaagacauggaugugguggcgcucaugguaccucuggcuuuuuuuaucuauuuguaaagaaaaguaacaaauuuugcucccccacgucuccacuaguuaaucucgucuuauagggaggacuuagaccuguugagaaauccuggagugggguccaggggucagcauuuuuugggguggggauauaagugaguggugauuuuccuugucuguuggcugggaucucagaagaaauuugaggacaguagaagaacuauuuuucauuucuucauuuucuuuguaaaaggaggauuuauucuacuuauuacuauuuuauuaaaaagauguaugcucgugauaaaaauaaaagcaauaugaaacaauuaaauuaaagaaauuagaaaaguuucuacccacacauaaauaacuucaggaauaucaaacuccuuucugagacuuauauacaaauggaaaggggaguaaagagagaaauauuuuacaggauaaauauucccugugucuaaucauuuuauuucaaauauaaaucaucauuucacuugugcuuaaccuaaggaacgaugucaggaagacuuuauagauguguccaaaaagaucccagcccagcugagaaagcuuaaguugaaagcauucaguagcucaaucagauuuucugcugcuucugacugcuacaagauaugaaaugccccacgacauugcuuucuuuacuguugcaauguguuuuaauuuuucuguugaaaaaaaaugcaaauguaagucuuacaaguguuugagacggguccucaguauuacaaacagcuucacucguggcuacuuguuugcuuuaaacgggggcuucuauuucucagcucuuaguguaucucagugcaaugaggauuuuugucauuccuacaaggauggcucccagaugcuaccuacccuuccucccucucugcccucucucuacugcccccucuccucuucuuuuuucuuuuuuccaaaauggggggugguggggugggguggaacucagaccuucacgcacgcacagagaagacccacucacugaggcauacccacgcauagcuucuguccuugcucuaauccauauccugggaacccuccagaaugcccccacccauaggucccuagggcagggagagagcguguuuugaguuaaguucucucuuccuuaacacaagggucuuccuuucuuucagauguagcugugcauuauacaccgacuagcuugagcugugggugacugucuccccagaguuuuuacacauguguggcgcuuuccuuaugcagucuuguuacuggguugagccuuuagcugaacaguggguuaaccuggguagcauuccuguguuccuucuccuuugcugucugcuggucauagccuuaguguagccugcuugauaccugaugucugaacuacaguccuuccucguuuguuugguuuuuuuuuuuuuuuuuuuuuggguucuaagacuuuccuauugggcacuggugacuuugccagaugauaacccagccaguguuuucccaucauuuuuuuuucucgauuguaauuuucauuucuucuuuauuagaguuaguuguagccuuuaaaagacguucucugcgguucuuuucuugacuuaaaagauccaaauugucuguguaguucuuuagucagucuccgcccccuacugccaccuucccugcaucccucucuggcauccuuugcaucaugaauuuauuugauuaaagguaucaguuccccuuucccacuguuauuuucccccuuggcaggaugccuaauugcaaugccagcuucuggggugaacauggacccacugucaucgggcaaggucuaggauggacauggagacccaccaucugggagauuccagaguggacgugaacccaccaucaucaggcagguuuugggauggacaugggcccacugucgucagguagcuaugugaacuuacugucaaccaagcaaguuuuaguguucguuucuuuguugucucauuuucaguggaucauaagcuaaaaaguacaaccuauuauuaggaaaacacccugaaaguuugcucaccccaagggacgaggccaugacuugagugucagugccauuuagugcugaccuuaccuuuauaaugaguauugccaagucagccucucugugaacuuuucaggaaaucccuagaaacaaagccuauguaaggcgagggucauugguguuugccucaaucucaguaugaagcuaggaacuuuccacuccuaugaugaacacaggaugaaaucugugcaucuaggaccuccaucaccagacccuuguaaggacccuuagacacuguauccuuggcaguggugccaagacuagauaaccaugggugucagggguuggggaggaauggguuggaccuggggugcgugaugccuucucaagcccucucacagucaaugcaguaaccugcuguguucacugugcuugggggacuuccuggaggaagccagcuucagagaagagaugcugguacccacgugcggugcuugaagauagguuauccguguugccuucgcuuuauucgugacgaaucauacacgguugaccuauuuuucaguaccaaaucccgccuuggaggaauuucuggggugggacugugguguuagcgucuuuccaggguaagugaagggaugguucaccaugguuggaucuaguaagagguaugcuguccaugcccaguguaucccugguucucugguggacucagggagggacauacuuuggaaugaucuggaguauucuguagucauccacuuuauuacuuugacaaaucacauaaaguccaccuucuaagguguaaaaugugucccucaaacauauuagggaaaggucaaggucagaacuaggaauugcauucacagcaucuaccaugaugacuacaucagccccucuggccauguagucugagcucccuagaagaggcaguugaguucccuggugguguuccgauaagaagccuucccaacugcucacaacugacacauccaugugggcguggcaagcuccuguggcuucuucuggucagugauacuaaccaccacaugcaggagacaagaagugaccccuaggccacauggcauaugucauauagcuagaauauguagccaucugcccaacucucagggacuccauccucagaugccugagauguaucaacacaagcucucgaaaucaaguguucgaauggagguugcccaugguguguucauuuuauuuaugaugaguauuacauggccaaucuccuuucggcacuaaaaucuuccugggagagcuucuucgacugugcggguuaaggaaauaaauuguucccuguacuaagugcugucugggacuuaugucaccugguugucaaaguaagauuucccagaaaugacaccaacuauuucggugacucuaucguuguuuggccauggcuaucaagagcauagugcauugugucaagcacuguauucagaugagaaaacaucacaguguuaggcaugcuguagggaagagcaaaugucagucaccagugggguggggcuagcuacaagccacucaguuacucauuccuuaccaguuucaccaguccagggaagaucucuaagaaguagaaccagaugucaggcuggugaauggggagagguggcucacagugacauuuagugacaugagaaugcugauguccuuucccugcuccagugucccuugggaaggagagaacccagcagcauucauuaccacccgaugcuugcuaauggugugaccuugaaugagucagccugucaccugucugugccuccguuugucugucugagaguguuaauggcugcuuauaagguauguauucacgcugaauguguguucaguauuuugagagugccugguuucccccagaaaguuggaaaaccauuggcuuuuauaaugauaguuguugcaugaauguccuuacucuguggaucucuucccacccucuagaacacagguuccuugagcucagaaaccccaucuaaugcucguaggugcacacaggacgaaugaugcugagugaauggcaguuggacauguuuucuuuguugaacccucuuugaggccucucagaagccagagagaauagaggacggugcagacaccuuguacccugaugcugcugguuugucugugcggucucucaggauacugccuuggaaagggaguuauccucuuuuaggucagccuucauuggugggcaggauggacccuacuacacagagagucaugguuucuucuaugucaaaccuaccucaggacuucucuaggagaaacacuuugggauucagacuugguguccgugugcuucugggugagugaccaguuucuggccaaagccuggaugucuguacaagucucuggccaccuguaggcaggagagaacucugcaagucaguccauugcuagucugcuuugcaguuggaccugggggcucaucggagguaaugccagccucccuagagggugggagucagggagccagagccgagggaggcagggcugccuggggaagaggcgcccugcucaacucucggccugugcugacguuugauucuugagcagagguugcccuuggugaauucgcuuuauugauguugaaucacacaaaggcaacuuuuguuugaguaucaaagccugcuugggguggcauuggggacacguuacaaaguucuggggucucugcaaaugucaugugcuagaauggaagguguggauauggggauggucaggaagggguguggcucagaacgccacgugaccagacauguagucccaggaaccaauggagagaugccaauaucuacucccugacucuucucagccugaauccucuuugucacaccagcaccuagccccccuaguugcagacacacucgcuguucuaucucuacucugaagauaccuugacaaaaugaacucuguccuuugacagugucaaggacaauggcagccuucccuccccacccccuuccucuccucaacucacugggucaggagugcucacauaccaucuguuuuuccccccucccaccccacccccucaacacaccucugucuguuucucuuucguccucaucgcucaccaaaccuuguucuccauuuuuggauggguuaggaaaugaauagaggcgaccagcauuucaucccguuuacauuaaauaauagugauaaaauaaucacaaaauaacaccacaaacuaccagaauagcuuggaggaaaauguguucaauugacuacaaauuggcagaagaauccaauuuucuugacaacauuugagcugcgacauuugaccuggggaaacaguacucuguagacauggcagccgcaaggggcagcuucaguaguggcggaugcuaugagcaguaauauuugugguagaugaacgcacauugaggaaucaaaucuucguucagauuuuuaaaugggaaagaauugauccuaaugaaaaugauuugaggaaauaacaagggaaauaaaagaaaugaaaauggcccaacagcacagucaaggaagcuaaacagggaauuggauuaguuuaauggaauuuacuuuaaaaaaaaaaaaaggaaagaaaugcauguuuuuuuaugaaaaucaaugugggugugguguuugagauggggaaaucuauggauauagacuagagcuaguggggugauaagaaggacuggucaccauguggguuuuuuuuuuuaauguggcuaaacuuuauuuucccaucccaaaccuuuacagagagcuucauggaguauucagaagcuggcgggugucaccuggaggaugugacuggguaccagugccagagcacgugcccacugagcagucuucuucacuuuccucgauccucaugaaacauuccggguaagacacugguucuggggagucugcucuugccgagcaguugguaccuggaacauucuagggccugcccuuccuuggguuuccauguugccagcucccagggcuaggcuuaaagacguacccauuguuggugcugaagggcuaggcccguacgggaggucauuuuagaguggauguauccagggucuaauauacuaucuggggugugaugagcaccagguuucaugguggcucucuuuccaaaaggaucuuuaccucaaaggacuccagaggcuacaucauugucuuggaacuggucaguggcuggagcucucuccaggacaagugcuuggaggaagaaccuggacaagcuucccuccccauacuguugacuggaucuuguagcuaccguuagccaccaucaucgccauugugugccucuuaggagcauuuccaggaggugaugccagcuggggaaagagccucugucccacaggucaguuuccagaacaccuacaugaagcugcccguggcgucuuuuccccguaugacacacugcaugugaccagucucuugcugcccugcagcaaggcuagaagccugugugaacucuugccaaaaucagagaagggauucugauguuggucacacuccaagaguuuuaaaaugaguggcgaacacagaauccauacucugcuuauggccuaagucaauggauccugacccuuacuggagagcccucccuggcgugcucgugcggggcagccauacacacuggcacaaggggacccugcgggaucuccuuccgcuguucuuucucuccucccuccauguuuaucuuugaagcauuacuugcuugguuuauaggacuggauggucaagcaguucuugcuaugacaucaccguggggggagggggcaggugacagggcggggaugccagggucguggggcugcagugguugggugggcccaaggaggagcaucucuggaugaugcagucauugccuccucgcuucuggaaggcaucgucucugggaggguggugugguauaugcgcagggucucagcaucucccuaucuccagcuuacaaaggagagauagaguaagcagaguucugcacccacuucugccccgagucagcuccucgcuaccugggucucaagguugucugggaaggcuuuagauauucuuggaaggugaaagggugguagauugcacuggggaggugauggaauaauugcuuucacgugguggaggguggcuccucacugaauggggaguuauaaucucugaggggcuccaggaugguucuucuggaaacucagccaucggccucguucugagcauccgagccucuccgugguacucggagagagguuacccgagcaacuuugcaucuggaggacgaauguugcucggugaaccccuuuucgguaucaaaucccuccagggaggccaccucagggaagaccauggacucaucucgcucugggguaugggacggauggucgaccagcuggaaaguaauuguuucuaauguacuucaccugguccacuagccgucggugcccgcugcagccugcgcccaggaugucacagccucagcucaacaccucugcugguacuugaagggagaucgaccguguuauauucgcuuggcugacuucgaauaauacaugguugaucuuuucucaguaucaacgcucagcuuggagaagcucuuggaguugcagccccuguggggguggggacagcauggugcuucuagguugcugccuccgcggggaacugggcuggguggaacaggcugugugcugccugugucaacccuacucaccauuuauaugcaaucccccccuuccccccaggacagcuucagguggugauuccagcuccaggguugcugcggucaacacuggguacuugaggagagguugucugugaugaguucgcuuuauuaaugacgaauauaacacagauggccuguuuucaauaccaccugccacuccggucacucggcaguacauaccaggugucacaccacugcccgguagguaaaugcauggacucuguaugacgcuugucacccccucuucacugaaccucagcucugaggagccuccugggaucgcaccaaccuuguaggcugggccacgaagcauuggccagaugugcaauggauggcuguccacuuuccaugccucuuucccgccacaacaauggguguuugucccugucuaaggcuuccaccgagggcugcaugcucaaaugcccuguacccugggugcuucucaauaccaugagggcuuggaggggcuagcaugauacuuagggaagagccaggccaguugguuacacgugcaguuccuaguaucugaggugagauugcccgugacggguuuccauucuuaaugcugguacagugcauggucaccucucuuuaucauuggcucuuacugugugagcaugggugucaggggagggacacacuuugcugacccacuggacaccacugauggucaggcauguagcugacucauccugacccagagccucacaucuccugagguggggguugggaaguccagaagggcaucuuagaggaagaagcauccuaaguagaguccgugcuggugguaccugagcuagcuugucucugagacguuuguuuucuaucugaugacuaucccacagccuacuucucugcaccauguccuacccuagaccauuucuacuuugaggcauugaugccaagaacugaagccuuuguguugguugacucucuagucuguaugugagaccaucccuuggccugucuuguccucagugccacccuguuggaaauagcacagaauguccuccugagucuacaaggcagugauacccaagcucugucccugcuucacgagcacagggggcccaguagggauuagccugcacuucuuuuuuuuuuuuuuuuuuuuuauuuuuuuuuuuuuuuucauuuuuuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaauguagccugcacuucuucauguuuccuccaacuuaacacucuggcucugucagacuccugugagcuuacuguagaggcuugaccuagagucucaaggaccccagaaaguaccugaucacacccaguaggagccuuugaaagacaggcuauagauuuuugguauuuaguaaggcuccccaggguggcaaagagcucuuucugauugggcuugcuccccauuggagcaaguagcacccucacccuggcaacuccacccugcaugcuuuuucuccucuucugggccuccucagcagcaaaaugcucuuccaacagagauaguggcugcgcacccuggcuuguaccuagcacauggucuccuuuagauuucuucucuuguucaggauggucugcccaggcgcccucucucugggaguugguccugguuacugucucccacaguccaucccccuuccuugguccucaagcuuguaggcccccuccacaggaguucaagacucggaggggaucguguucccugcucugcagugacagugcaggcagccugacacucuuauccagcuccuuccuuugugauaugacaucagacugcuugucagcuauggcuccccaggugccugcuuucccaaacugccuaguaccuugguucccagccucucccugaccccaaccaaaacaaaacaaaacaaaacaaaacaaaaaaaaaaaaaaaagaagaagagaaaagaaaagaaaagaaaagaaaagaaaagaaaagaaaagaaaagaaaagaaaagaaaagaaaagaaaaaagcuuuaagauuucccaaggcagacgaggaccuuuccuuugcgucuuuucucuuuccucuguuuuacucccuaccccuucccucccucccaucuuacuucccugacuuaucuucugcuguauucuaagccuuaggauccaggccaggucuauagugacagaauaauggagugugcugauugacuaauagaguccccaaaggcagaaaccauauuagguuaauccccaggaagguggugagcaugaagcaggaauuccauaagaugugguggcugauuccauaaauauagaagcuggguucacuuagucuuugcauuuguuagaggccucccaccccagcuagucaccgauuuuugagacguacagcgauaggggacagacaggucagcuaugucugcgggcuuuucuuuacuuuuguagcugggggucucaugcuaggcuucaaauucaucugagcacaacccccacccuccacuccgugaacgucuccguggcagcaagccagaggccccucagaggcccucgugcagcaggccugagcugcugucagggcuaauauuuuaugcauggaccuaagcaaaugggaacauuuggagauggaaauugcuguuaaugacacaucuuuggaauauauuaaacgcgugcaagaaggcugcugaucucuccauuuaauugcuccaguguaagcgcagucacaccacggcauccacagauaggcuaccccuagucucugcaucaccgauggggaaagccccagguaccucagccaccaagggaguauuauguacaagauggaaugucagcuggggugccaagcaaccaccgacacgcacacuccaaauucauuggagacccuaagaggauggucccuccugcucggugcagacuuuuauuaaaagcaaaauuacuagauuuaucuauuguuugagaagaagaaaagacaaauaaaggacuuuucucauccagugagucaagugaaaaugucugccccucaggcagacaggaggaaagccucuggggugggggacuuucagaggucagagaauucaccauucccaagauagcguguuaaccuaaugugccaaggucacaggacacaggcuaguucaggugaucaagucaguuugccuaucccacaguuccuuggggugugguuagacuaaggcaguggucuguuccuuuacuauuuucaaggagaugguguguagcuuguguguguguauguguguguguguacuggcuguccccaauaagcauguguggagggugaggaaagauuggcucaaagagguggaguugucuucccaggaucacacagcuagagacagggcuccaggcuggauguccuuaagaucuuugcuuguacuguuuugugucucuccagagaagaccccauguuccauaggugauagacagcucauugacuugcucccuguucuuucugaacagugaggcaggauuacuuuccccaagacauugcuugcuggaauugucaggauugucguuuuccccuuuuaguuuaccuaaguuaacuaagaugcuuucuuucauguguggccugaggaggggcugccugcuccaucacaaaaccgccaugugugugcgggugugaaccugaugcaucuggucaauggcuagagagcuacacacccuugugugcugagcuggcuagggcuguccuagagauagagugagucaguaaaguuucuuugucaagacuugaggggcuguggcaaccuguguaccccucgagcugcucauagucgaugcucaggagaugccugucuuccuugcaucaaauggguuuaggcaucagcagcaaggaggugaaagauggauggcugugggaaagcucagagacuguuuguggaaugaauaaguaaaagcacacccuuuuugaggaaauuaagaaacagggagaggaagaaacguccagggaaagacaacauaaaucucuagcaacauuaccaacaccacagcugggccuguugaaaagacccuguggaggugguggggucauuugucaugggcaaggacaggcuuaagggcugggacauggggccugauggaggcucguccaucauuuucucauuaucccugcaacguggagggcagcuagcagaucacagaacaacagccucccaaugaagguggcagggcuguugagugcgagggaccccgagggagggcaggcugccccaggcccugcccccuccaggaagccuucuugcuccagcccaacacacaaucucacuuuguccucggauguucaucaugugaucuuuuaucaacgcaacuguggcggggcccuugcuaacuugcuuccgcgugaaccugugcuugccuacgugugguaaagcggaaacacugugaacacuucugaccuugucuuuucaauuuuaggcaggugacaacgcugaauugguccucaggagcggauguucaaggaacccugccuaugcaccaugcuagcugccaguccuagguugggacauuccacuggggacauccaugggagagcuauggccauuaacaaguccugagcccugaccugaagccaucaguggccuaggugaguguuugcccucaggauuuauacuuaauuuauagcuuggagcaggggugggguuuucccagggcacaagggguccagaaguuguguagaaaaugcacacaacgggguugaaggcacacgucccagcccuacacacacacacacacacacacacacacacaccaccccacgccccgaugccgccaucugcgacagcuucguuuucucuaacacucaaaaauacaugguucugcuccguucuccuuggcaggcaggguagccagagcuguggggcugccaaggccugggggagccgccagccugcaaaguuuacuguacaaacaguugggguggggggugccucucuguuaacucaaaauccccaucaguaaacaugccaguuuaaaaguguaauuaacucaggccggaaaagaauucugauuuggacugcuuuucacaguugagauuguuuuucuuuuauuuauuuaucucuuuccgggugugguggugucuguggaggguuuuagccaggaaaaauagaaauggggagggcuuggugggaugagccaguugggacugagaaugcuggcagggaggggcaaggggagaugggcuugccacaggaagccuggggucugaaucugguuucuguccugggcggugccuguggcuccuugaagauggaggaacuaugcuagaaggugugccaaggccacugacugagagggacacagguaacuuagggauuauaggguucuggggugacucagagaaccucagggcucccucuaaugucuccuugcuucugucucacggcagcugcucuaccugacuuuguggccucccuuccuggaucucucgcuuacgacaaccgacaacaaagauguuugacuccagaagaugcuccccgcggcccaccugagaggacuguccacaccccaccccacugcgcccugugccaucuaccucugaguccccaacuucucacccauguuucaacucccaccccagagccuuguauuccagaucugagcagcccuugcuuaggaaccugaggugggggguggguaggcagacccaggggacugagcagggaggggaaggagggguuucugcucuuggcuuucaaaguucucaguguguguagcccuuugaauaauaaacauaugucauauaauguaaau

SEQ ID NO: 6837 - RNA, 2147 nt, Mus musculus
uaggaaucaagguccuagccucagaucacuauucugcagaagcccugcuaguuuccagggucuagaaacgccacacuacccucuaagcagccacuuccagccucacuugugguccccugacccccacugacccucccugccacaagcaggcuuucuccugacucaucgagguauagauacccugcaaggcggaggucagccgagcagccuccuggccagcucuaaggagcacucugcauaaacagcccuaccacuaaugagagcuuccaaaguagccugcucccuggggacccggacuuccaguucucagcagccaugugggaagggaaauguuccagaggcauccugguagagguagucggagccuaaggugagaacaggagaggaaggaauccuaagaaggguugcaagaggaaugccgcucugccuugggaguccucaugccucccacccccgaugccaggucaacacaacgcuugcccaucacaggaucagaguugaagggaugccagagucauggaucugggaaagaggaccugggccucggccugcugcauagugacaaggcugucuggggagcugcugaguaugagcaagcguacaguccugacaucuggagagacgucugucaguuugggccacugugaggguuauaauuccucagaagagcagggcuccaaugacguggagccucagagccucagcucuggaccucugcuuacccuguccagcuccgcugcacaacagaaguuuuccuccagcacaggaaguccagaguccauggccuuagcgggaagcucaucugccuccuguacaaguuugcuuccucuaauaaagggcuggggacccugagguccaucgcccggccugggacaggccccuagaggaagguauugggguccuacuccaccaggggcagccuaagcagagccucuucuucacaccccuagaguguuauagggacccugguacagcagagccucacucccucuguuagaaugcccccucccgcugaggcuguuguaaggaggucucuugcuuuuuuuccccuccaucucaggagcaauuucagucaacuccugaaaaggaacucagaaaggacauagaaaaaaaaaaauauauauauauauauauauucuucucagaagccccuuuuacccaguauccagucuauguaaguagacauauaagaaagagguauagaggguuaaggaccccuaaaacuuaaggcucgauagggggaaacguaaugguacuccauaccugaggccccugaagauagagaaauuacuaccaccuauugcugcuccuuauaucugguucuggggcccugagcugguucaucugggaggaccaccacaaacugucuuugcacccugcuucaucaaccucaacagcccagcugcaaugcccaaaaccgcuucaugucccagucuauguggccuguuggucagucccucccaaagcuaacccccucccuuauaugcccagagucuuccaaacagcuuugccuuugcugagagagguggaugagccaacagaguaaacaccaggagaaguggcguggcccguuuggacugccauggggaaaggagagucccuuccagccagagggagacauggaaguuuggauucagaucuagaucaugaaguaagggagguuuugacauccaucacucagaacaauguggaccagaaggaccacaugagaagaccaucagacuuguagaagcuucaagcaccugagucccacacuccuacccaagagcuaucccaggauggccuccugccacucugcucucccaggggucagccugcagggaagcagcuacaaccuacaguggggaaaugggaaaugggcaccaucguaccagcagugacucgagaguuuagcugccugggguaagagguacaggguggaacagggaggguagguuggauuuggaauccauccgcaucugcaagcccgagccaccuuucacccugcaggggccuaccuucuaccccaugcacacagugcucuguggagugaugcuaacaagcacgggagcuaguacuuuguuuucuguuuucaauguucuuucuuggcaaaacagaaagcuggcacccggagacaggaacuaaacuugauuuuuugaaauuuuaau

SEQ ID NO: 6838 - RNA, 1565 nt, Mus musculus
uaucaguuuugguagguauuuauuuauuaacgaaacccuuaaacuuucuuauauagggacuggagagauggcucagugauuaagagcacuggcugcucuuccagaggacccagauucaagccccagcccucacguggcagcucacccugguugcaggggaccggccuuagucauugaucuauugcuaugaagagacaccauagacacucuuagaaaggaaaacguuuaguuagggcugcuuuauaguuucagagucuuagugcauuaucacugggcagagaacauggcuacacauaagcagacacagcgcuggagacggagucaagguucuacauccagauccacaggcaggaagagagaaaugaaacccaggagcccacccccagugacacacuuccaccgacaaggccaccccugcuaauccuuucaaauaccaccacucccuaugagccuacaggggugaggugggggugggguggguguggggggcauuuucauucaaaccacaacgugauccagucccauaauucuggcuucuccaggagccaggcccacaucuggugcaccgauguacaaacagaccaaauagccauacacauaaaaauagaaaugaccuuguuuuaaaguuaaggcuaucagcugaggguggugacacauaccuuaagauccagcacucagggaaucaggaagguggaucucugugaguucaagaccagucuggucuacagaaugagcucuaugacagccagggcuacacagagaaacccugucucgaaaacaacaaagcaaacauaaaagcccucuauaugguaaggccaugcuaucugccauagcuucaguuugguugcccuugauuucccucucguguuggaucguucugucuaggacuauagcaugcuuugaguaagagugugaggauggcguccuccuguugcuccugaccucaaggaaugcuuucagcucuucccacucaguacacacagccuuuguugugaaaugugucccucugugccuguccuuucuucccucugucucucuguuuucccuuccuuuuuuuuuuuuuuuuuguacuggaaccuguaagggucuaucauucucugaagaaugauacccuggacucaaacuauguaaacacaacgaguguuuuauucugcacaaguccagcaugcuggggucucccauuacccgaauagagagacacacaggugagcucacaggccugauuuaaagcacguuagggaauuucuggguaggugaccucuguguuaaucuguuggguccaucucuaugcagauuccuuuaccuggguguaagggcugggaaccugcuguggaaggucuggaagcugcugcugacccauuguccuugccucaggccagaugaugggcggggcagcuucuggggacuugccuggacuugcccgguucucagaaacagagauuugggccuagucuccuuaacucccaaugugaagccuaucaaagaaucagccuggccuucucagaacccacuaaaguagaaauuaaaaguauguugaccaggcuggccucagacucacagagccc

SEQ ID NO: 6839 - RNA, 12419 nt, Mus musculus
auuuuuuuuuuuaauuuuccuugugggcuugggagauagcuugguagguuguagugcaggaaacacaaguuuggggacccaaguucaggccuccaacauccauguaaaauucuggguguggcuguaccugccuguaagaccagccucuagggucagaguugggaguggcuagugaugugacagaaucucugggcaucuggcugucuaccuagaugaaaaccagcaaggucuagguucaaagagagacucugugcugaaggaauaaagcagagaacaauauaggaguacaccugacaucucagcuggccuugguacagguacacacaagcacacgugugcauaugcacacacacacacacacacacacacaccccacauauguguacacauauacacauacauguauacacaugcauacaugcacacaugcuuacaacacauguguacauacacauacuggguauacauguacauacauccauacccugugcacacauacuuguauggauguguguacauacauguauugcacagacacacacacauacacacacacgugugcuuacuuacaccucuaauacccacauccaaaagaaaugucuuaccacuugaaaauauucugcuauccucuugcauguacugucaaacucuuuucuuuaaauagagcaaacaccgguguuuuccagccucugucagaaaaacuaacaccagcaguugugacaucaagcucauaaugucuucuuucugcgcgccucuuuauuuuuaugaugugcuaaucaccauccucaaauauuuuuaacaaaucgaggccuuagaaugaaaguccuccagcaggcuuuguuuguuuuucuugggccagaauccuuuugccaaauacuugcaguuugggaauuccuuaagccgugacacuugacuaauaaauagucugccgagccagcugcuacucagcgccccacucccccuuguaggugcucuaaguggaggcugucuuggcuggaguacaucaaaggugaggcugugugacucaggcgaugacauuuuucuucacuguggaagcaacaucaucuguguuggccuagcagaagugauggugcuggccgacugcucucugucacgcagucacauccccccuaugcaaugcagaaagcgcaggaauagcuugugagguccacucuguuguccugaccaugaaucccacaucagucagccauacaggaaugcuucguggccucgcuaaucccuucagagucaggaguggagugggcuaacagacauuauuuucuuaccaacuagauauaugaaaacuaggcuaggcauuauucugacuuuggauuaccaguuuccucugaaccuuuuaugcgugacuauuuuauuaucguugauuucaucuuucuuucuaauguuaaaaugcaggauuucaacccuacccaugccuuuaaaaaaauuuuuuuuagcuuaguguuguuauucauuuuaugugcauggaugauuugucugaauauauacacgugugccaugucugugucugguggcuguggaggucagaaaaaggcaucagaucuccuaaaacuggaguuacaggauaggagccuaccugugucgggccuccagaccacguuggccugccaguucccauuguagcccacaaaggccuucagccacaacugcucccugccaaugggagggaaagagacacccuauaaggaagcagacucagaaagcuggcaaccagcauagcuguccccaaacuacacagauaagcugauaggagcuaaacaaagaaagaguggucagguaagggaccugggguaugacuagggaggcucaaacccagauccucugcaagagcagggagugcuuccaaccacugagcuaucucuccagcccagccuauguauuuuuggauguguguguguguguguguguguguguguauguguauguuugcauauguacauuuauguguagagcauuggugugacugaccaugguacguguuuggaggucauaggauaacuuaggugucacccuucgacuuccaccuuccuugaaugaaggucuuuuguuugaugacacacacaguaagcuagcuggcccaagggcuuccugucucccaucucaccauagaaccacuggaauuacauggaucccagcgauuugaacucagucucucauacuagcauggcaaggacuuuacccacugagccaggccccugccuccuaccuauuuuugauaccuugauuucuggcauagugaggcaccucccaggcugguuauauuccucccucucucaggccugcaguggagggugcuuugaagaccagaaucuggggugaggugggggaggggugcucauugucacugggacacaguacuuucaaggaagggacaucaaguguacaguguuaaauugacauucauuuguuguuucuauguagauuuuauaauguuuucuuagauuuucauuuuuaucucuuacuaaauggaucuugauuccucccauccuggauauaauuguggcugugugcccuacuaaagcaauugcaacaucaaaaaugcugacauuguagaccagcacuuugaguugguucaucuuauuguagaagaacuguugacauuugaauugggucccacuaaaauguuaggaaucuagugagugggguagggauacaacucagaggagagguaccugccuaccacguguaagaaccccaguuccagccucagcacacguggugggaggaggcaguggagagaguuggccuuguaggauacuuacacacuuauucagaguauaccaagccucuccguuugcugagaccacugucaccuccuugccagucucggcacugcugaccgcucuguucaggguccuugugccucccaggcgucacaggccgacucaucugugagcuuaucuguaacauuuguugucgcuguucgugucuuggaaccgcuccuuacaugacuucagagggaagcgucugacccauagcagauuguguccacauaacucccagauuagugaugucccccuugugugggagaugccugucccucugugcuuguucauugcugggucauauaaaagccucagucauuugaggugugaagggugcuuuguaauuuaaccucagagguugauuauagucucaggccugcucagugaaacauuaguccaagucauucccuucacuugguguuuggggucuggaagauaaaagugccaaauguuaaaugaaacacaacuuuuuuguuuguuuguuuguuuuuuaaagaaacuuaugaaaguagaaaauuaauuacgacuuauuucuugagucuguuuucuguguuggguaugguggugcacacuuguagucccagaagucuggagggagaggcaggcagaucucuaugaguuugauugaggauagccugagcuacauagugagaccguaucucaaaacaguaacaacaacaacaacaacaacaacaacaacaaaaacaaaaaaccaaaaccuggcaaagccaggaggaggccagugugggcccugucaugagccagaagcccugcaggcaggucgcugaguauggggucucucuccuuccuugaccugacuggcaggaucccucagucuggcuuuucugaagggguaauuccugcccucauccguggaagcgcugugguccaccuuccuucacagacuuuacauccggccaucauuaaaaguuugcagcagacacguggccaaggagcgaaccccgaguucccaaggcuccucugcccaggcuuuuaucuccucccuucugauuaccuguguguccugugagcuggugccaggccacagugaauucuuaacuaccaugggugaccacaggugaccccuggccgacaccauaaguaauagccagcauuuugucagacagcuggaccugcagccaggcccuccccguaaaaccugaacagcaucucacaacucacguggugagcaugcgugugcgugcgugcgugcuugugugcgugcaugagugcgugcguguguguauguacauuauuccuuggacauucacccucuguccucuccuuccaccuuaagaccugguucccagacaaccugcucuccccugugguaucccauggcccaucgcuccugcugcccagugucuccugaacuucccuggcucagaccuuacuuuaccuccucuuagagcugugguaagauguacacugugagcucagcaugugaccuacacaccacaggugugccuucagcagccuacggggucccgaccugacccuccugacaggcccgugcauacugacgucuccccacacugaaucccccucgcagaagcuuugcccugcagcagcccccaggccuccugagcucugcugucucuggguuugaugacuaggggucuccuccugcauuguccuccaucugguuccguuugcuucagcaggaggcccucaaggcucuccagcacaugacuccuuucugaggcucagugaugucgaauugcuuaugcugacaccuccuuacucgacagcugcggagaaagugcucaaacguguuaccccuuaccucaugccggccaucgccccgcugucugugagggcgggcgggccugugucuguucuagauccaggaaacacuuguugcauuugcuggaggagggaagagcacugcagcucuggccuguccaccccuguccucucagggacugcugugacugcuguggugccaccucucaggauacccagggugcccaagaugcccaggcauaggcucucucauggcucccuucuccuugcucugccucggggcucuugaaaaggagaucagcagcugaggguggaagcagaccguauaaaacagcugguguggaaacucugagacgcuugaauccuuucuauagaguucauggguuuccugucuucucagaacaaaaaaagaugugagcaccugcucuggucugaaaggcaucccagcccagcugcgaggauuuaaagugggcccgggucugcgugcaggagcuggaguaggcaagcuuuguuagguaagcuuugugagguaagcucugguggcucugcucagucacuggagacuugcucgaaucaacagggccacccgagccugucccuuuguccuugaugcuggcaacggacuuuuccuggcagccuuugagcagagcugcguacuagggagcuuugaucugucuaaggaaagucuauuuugaacuacaagugaaggcagagguuuuagguuagacuucuuccccaacaggacccauaacagcuacacucacacaggugccaacacuggccagccugaugccacacacugccacugcaguaccacagacuugccaguaaaugccagauugcgguggaugagaaaggaaaaccaaagaaaaccuuuggcucaauuuagaaaucaagauuugaagguuuuguucagaacuacuuuguaaaauuaaaaucagugggauguauuuacaggcagguguuuuguuuuguuuguuuguuuguuuuuaguagacaacaaaacagcgacagaagagcagaggaugcaggcugaguucuggucucuuccgcaguuggaagcggccagagccuucaugggccgcuccagcuccccuggcacuuguccuguaggaggccuguccguaccagcccuggauaguguagccauagcaacugagaaucaguguagacaguuguagcacugggcgggugauggcuaaggcacaggccacggccucgccugcgguaugggagucuucuucacaaccgcggguggugcucugacugccgggaugcagcagcauguccucccucuuagucuugcacugccaggaagagaugugagaguagucaaggcacucugaccagauggggggcugccgagugcucaaccuguucuugccauacacuaacagagcacccuccaggcacuauacacugucugagggcucgccugcgggaggggggggagccacgcccccagaguggucaagcccaguggccacuccaggguuagucuccacauagguucuauaaguggcucugcuguguccccaaucaucacguggggaccuuccgguauucaguugguggacagaggcguguucugaggcgagcaauggcugcaccugccuucugcugaccuuguuuggacugggcuuaguggcauccugccuggguccugcacuuugguuugaacucagcaaggggaucacuauggcguaucggaacuucuaauagcauucugcuaaccgauggaucagugucuuguucagccaucaucagggaagcuuccuccugcagcagacaggcguggcugcagagaccuacagucauacguggcacacacaggaucacacaggcaugcugcuucauucccagccaaagaaggaagcuucgugggccauugacggcucccucuuuccagugcccuccccccucccccuucagcuccggagcaaacgacuuuagcaaugcugacaauagugagagcgcuaaagaguggccagugcauccgugccacccucaguggccuccuagacacugagaaguugugucaccuuuuccgcucauauuucuaauuuuuacacguguauggcuguauaaacuucacaaccuuucucaguuccuuugacauuaaauuaguuuacagugucuuagaaucauaaauaacaggucauauucucaacgaauaaauuucuuaggaauuucuuauuaaggaguugagaaacuccucacuaaaaacucuaagacacccagaacagagauagaagacagugcugaagagaggagggugucuuaguuaggguuuuauuucggagacaccucgaccacagcaacucuuauaaaggaaaacauuucauuggggcugccuuacaguuucagagguuuaguucauuaucaauaugucgggaagcaugguggcaugcaggcagacauggcgcugcuggagccaagaguucugugucuuggcccgaagacagccaaaggaaacugaaauuucacacuggguggagcuugaacauaggaaaucucaaagcucacuucaacaguaaugcacuuccucuaggccacaccuacuccagcaaggccacacccacuccaacaaggccacaccuacuucaacaggaccacaccuacuccaacaaggccacaccuccuaacagcgccacucccuaugggacuagcauucaaauucaugagucuaugggagucaaaccaccagaggagcagccaaugcucuuggauuggaagccuaggguuguuaagggaucagugccagccuagggaccuacagaugcaggcaguccuaccaagaggugaaugguuucaucuagaaacagaaaaagucaucguaaaauccacugggaagaccaagacauuccaaaucuugaaaaaggaaagggcuggcaccuuacgcaucuugauuuuaaagcaacaaaguuacaguaaacaggaugacuguggguuuccauaacaacacccaaggcuaaaccagcauagagagccaggaguaaagccagcucagagcgggaaaguacuggaaacuggaaguccacaaacauaauuaccucagaaggcgucaaaauccuaagugcugucaaccaaaaguauaaaaagucuuugaaggaauuggcaguggggaguucaugguauuagauuccagugaauuuuuggacacguuguuaaauauuguagauaauaaaagacaaacuagguaaacugugcuaugucacccuuaaaaccucagugugugugagggugcacagucgucagaaugggcagccuacagaggagagggaaauauuugcaaaugacaagccugauaacagauugauaucuugaccauaugaacuccuacacaugcacaacagcgaaacaacuucauuuaaauauauagaagacucaaguggacauuucucagaauauacacuaaugacccauaggcccaagcauacaggcucagcaucacuaaucauuaaugaugcaaaugaaaacuaccucgagauuacacgcaaaccaguguugcugacggaagaggacggggacuugugugcuguugguaggaacagcagaugguacaagaacuuuaacaaccauauggagguaccucacagaguuuagaguggauuuacuccauuccacgucagggcacccaucugaaagauucuagaccacugaggugcacacgugaaaaugguuaguuaggauggggcuggcacgguggcucaggagaugacacaugcuagaagaaaaggucugguuccuguagguggguccucuguuucauggcgugguaugugugugugugugggggggggggggcacagacccagguaaauguaauaaagaauagauuuuguguuacgugucauauuucagcccaguuguaaaauauguuuuuagugaacuguuucauccaugguuauuuuauuucuagaauggguucuuucuuuuuuuuuuuuccccccgagacaggguuucucuguguagcccuggcuguccuggaacucacucuguagacuaggcuggccucgaacucagaaauccgccugccucugccucccgagugcugggauuaaaggcaugcgccaccaagcccggcuuagaauggguucuuaaaguaaaauuacuaagcaaagccucucggugccuguugccugacuguuuucuaagccagugagcagucgauagcucuguugucaaagcucuggcacaacgcaguuacuguucucuguaucauuagaguuggguggauaagauggcucagugggcaaaagugcugcugucaccccuaggcucugaccccugggaccgacauagcaggaaaggggaacugacucuugaacuguucucugacccucacauuugucccuugacaugugugcacuaaauaaauacagacauuuguaaaaaaaauuaucauugcccuaauagauaaaaacacucugccuugcaguuucugauuguucauaguuuuguuuuuuuacacaaacuugaucauuuaaauccuaagggcuuaauguuuuucuaauaaauuuuauuaaucuguauuuauauuuucuuugguuggagggagauguggaaaaggucaggguuauuugaauuggucuuaauucuggugaguggguauugguggcacacgccuuuaaucccagcacucaggaggcagaagcaggcagaucucuugagaccaggccagucugguacacagagugaguuucaggacagccagggcuacucaaagccuaccuggaaaagcaaaaaccaacagaguagauucuugugagacacagaguaacuguuuucagaucugcucaggguccaucaggcgcuggccuauagcuguaggguugaucccucauccugucugaagaucccucuucuuguaaaagcugugggguuggagaagucguggcuugucuugguuugcuugucucauucccagcggguuuuuuggugcgaggaagggcuugaguugacuguuugcgaaucacuuacgugcugucuucuggggacuguucauaugauuccccccauccgucgacuugguuuauucuucauggucugagagcguuuguugguguugggucacugcuccuguccccugcucuccugugauguaugucucuuuuuguauaggcuuacuguguagucuguccugaguuccuccugccucagcuggaugcugagaguauggugugccugccuuauaucuagugcggcauguuuuauagucuuagaagucuuuaaaaacuacuuuguaugccuaagguuuccaagaguaugggagaaaucacuaauaagguuugaaauccuuugauguaagaucauuaggaaaaauacaucaaaaagugucuucgcucuuuugccuuugaauuugucuauguuauauaaagcuguuaggcaucuccucuccugccugucuguauuccaguucaugagcauagcucuaguguaugcuagcccccaucucaccucggaugacauaggaaauuauuggcaggcagaagugucugcuuguggccccuuagccccuucccacauugcuguuugugucugcugagucccucuggaucacuccucacucagggggugacuugagggaagugacguuugcccucagcaccaccugcaggucuugagaggcagugggggcggggagguuguagggauggaguuaguugagaaacuccuggagacaagugggcaggcagaaucucauuuacauuaccuugcuauccaagcagcagcugcuccagucgcccacaacugcagugcagagaacaccaucaggcgucuuccacuugaguguuagagagaguacacuaggacugaggucacucgccuggcaugcccugcccccaugcucugcugagcuguagaaucccgcagcaucuuuggcucugaaggaaagaggagagggauucagauagacuuuuuucuuccuguugaacuaccuuagcagcuacugagaagguaagauccguucuuguuggugaauggcuguaaguguucguucauucacugcaguguaucaggcuagacccacagacgucauggagccgugugucagacgugucugggaguuaaaggcguuuauuugucccguucuugaauugagcauuauaaaguggcacagcauaauuccagagauguuucuccgaagggaagacuuuuccugaaaaguccugaaagcggucuccucccacucucacugccucccugcagaccggcagcaggcauuaucuugccagcauccugacagugcucugacuccgaaaggcucucuucucugagaauaguuuuuuauguuaauucuuuuuuguuuuaaaaauaugaauaguaguauaauaaaugaauagaaaaaaccucuuaauuaauuuaaagaaagcauaacuuaaggaaucuaacauaauaacauuuuuaaacuacaaaaaauagaaugggccagacagacagcuuagugaguaaaggcauuugccgccaauucugaagauccaaguuugauuccugggaccaaggguggaaagaaagaacuguuucccacagguuguccucugaccuccacaugagcuguggagacacacacacacacaccugacauuguguuuucuucucaugcccccgccucuguuuugugccuuuuaaagguuuucauagcuguggaguagacacaccuucgucuguagcacuuccugacuauuaacuauuaagcagcuccuccacagauuuuuaacccucauuuuucugggcugggggaggaaacaaggucucaggaagaagccgguguccgauuauagaucccucaguugcccuggugauaguaaggaggcugagcacaaggcagagcccagaccgguuggucggucgguuggagcuuuuaguauuuaaauagauaaccccuugcuuccuggaaacuggggugccagcaugcucugcucaggcuggaagucuagcaauggcagagguuugccuagugagcaccaggcccuaggcucacccccuaguucuguuuuaaaaaaaaggagaaaaaaacccuaaaugaauaaaauaagagcugagagguagagggcacaggacagguuggcguacggcaccacugaacuggggggaaccaguuuggggaacgguagaucuuggagacggagcgugccuguguuccuuucuucuggccgcucuuggcgucauuuaugugcucucugacggggcugcggcccccggugccacccucuaagagcugggauucuuaccuaaaaguuagugagaaaugaagacucuggaaagccggaaaaugcccagguuuuuaaugcacacacacugacagccaaacagaacgcucuuuccgcuugcaggcuuuuuuuuuuuuuuuucccccagugucauuuuaaguugcagcuucuggccaaucagcgagcuccaugccuagugacaucacgaagcagccaguucccuccagcugcagagagcuucaguuugucuuuuuuuuuuuuuaaacuaaaauggaggcugguuucuugccuuaaggaguacagcgcccuucccgcuggagccuagauguugacauguaauaaagcgggcagcgggauggugguggaugcggccagcuccaacgggccuuuccagcccguggcccuucuccacauucgaggugaguuauuguguguucuacugaccggaaccuuccguggguaguuaauaaauggcuauugugcuuuggaugggaaaagcaggaagucuaaccagcagaguccccuucacguugacgggacugcgccugggcaggccaggggugucaccuccaaucggugggcauuuuacacauuacuuacggggccugaggcucaggaggccuugcacgcagaguucaaagcugguuuuucugcuuucucgcugcucucccauccc

SEQ ID NO: 6840 - RNA, 2281 nt, Mus musculus
ugaccaucgccuguguacuguaucuguugcugaguacuggcucccucuccuuccugcacagccguccgugcucaucagcaguuguuggagagaguugggauuggguccuccugcagaaggucaagcagagguuuaacuucuccagguggcugagaugagggcuuagccaccugacaucuccuaacagcuuuugaaaaucauuuaaaguggguaaaugaucuuuucuuauuuggauuuucuguguuacaguuuguuuaggauauaacugauaucccaaauauugaaauugccuuugaaucuguuuuggagcaacaaccaauccucgagacuuuaaagcuuguuauagaagagccaaggcuuacaguaaaacucuucagaaggaucagcuacuacaacaucauccauauaaugaauaacauacacagaaagauucaaaguccuaaccuuuuguauugaagcagcaacaaauuuuugacauaaaguaaggccauuagccauuccuugaggcaaaacuuuccaaugauauugcuccauggguucuuuaaaauuacaagcaggcucacuaaaugcaagccuuuuagggucuuuuaaaucuauaauaguugauacauauuuuuuuggaauggcagcuggagucaguaagccaggcuguaaugcucccauaaguuccauaguuccauugaccuuuggcaaaucuugcagucaucuccacuugcccgaauugucuucauaauuacaaaugugggugaguuccgggggguuagaaccuggagcuugugacuggacuguaaacugccaaucuccccuuagcuuuaugcauauuuaacuauuuaacauaaaaaguuucuuuugcaauaucagagcauuaccauaauuuuggaaggcaagaccaauuuuuaacaguguaaacaauccagucucucuaaaaucaauaccaagugcauuauuuucauguuacaaaguuuggcugccaguuauuguaaaugaaugugcgacagugcagcuuucaauuuuuaauaccucauuaaagaaacauuguuuuaaauccuaucuuuuauaagucugacuucuagaucaaagaauuacauaaaauauuauuccaauuuagaggcaucuuuagagcccuguuucccuagguuggcucaugccauguguuguugcuagaaugacuccaacccugaguuaccaguuuuuguuuguuugguguuuguuuguuuguuuguuuguuucgagacaggguuucucugugcagcccuggcuguccuggaacucacuuuguagaccaggcuggccucgaacucagaaauccaccugccucugccucccgagugcugggauuaaaggcgugcgccacuaugcccgacugaguuaccaguuuuaagccaauuuuggguuaccaacauuacaaauuuuuaaccauacccaaaaacuuauaugccaauaaucuauaaccaacacaugcagaacauauuuauacaguuaaaaccagucagaagccaggcguggugggcacgccuuuaaucccagcacuugggaagcagaggcaggugaauuucugaguucgaggacagccuggucuacaaagugaguuccaggacagccagggcuacacagagaaacccugccucgaaaaaaccaaaaaacaaacaaacaaacaaaaaaaaaacagucagaaacaaacaugaagugguuauauacauuuacauaguuagacuagacagacaaauuuuucuuacuuuuucuagcuguaauuucaugggaggagcacccugccaccugcugaacccaaauguuccagcagauaaaguuuuaaccauuuuuucuuuugaauaugaaacacaaagcaacagucaggcaacaaaacaaagccacagacauaaacugacagacauggacagacugacacaccgaggacaaacaauagacagagggaagagaacuggaugucccaccaaaggaacccagauccaggacuaggcaucccccagugggagccagagaggaagcaagcuaucuccugaacuccucuugucccuagcguaccucuaagcauuugugcaaaaagcauuuuacuagcccugucccauuucacagacuuuacucacugcuggcccagauuuuuguauuuuccuuugugugagcuuccucuucugccaugcccuucacugaaccccucguauucgagccucaacauugagggcaccaccugaccaacccagcucagucagucagcaaggucucaagggaaggagugaggcuuaaagagagaaaagacaauuca

SEQ ID NO: 6841 - RNA, 604 nt, Mus musculus
uggggucucacgaauguuuauugaauaaauggagaagcgaaugccagcguguccucuugauaccuaaguucucauuuugccucuucauugacugcucuucagugucacaaccuagacuguuagaauugacggcauuggugauaauugugugauccaguauaacuugcuguauucacaggucucgcagugggaguguuugccuuguaccucuguacgggucaccaacaccugugcaccccugucuugcagguggccgagcgggcgcucuauuacuggaacaacgaguacaucaugaguuuaaucagugacaacgcagcgaagauucugcccaucauguuuccguccuuauaccgcaacucaaagacccacuggaacaaguaggaacuggaggacgcuagcuccuggucaccuuuaaauagugcaugccuugcugugacugcgguuaugccucagcuuuuuagaugaacagccguuucuuugugacuuuuguuguuuuguuugggguggugguguuugguuugauacguaguuucucuguguagcccuggcuguccuggaacucacucugcagaccaggcuggccucgaacucagagauccgccug

SEQ ID NO: 6842 - RNA, 519 nt, Mus musculus
agaauggccaccgcuuuaauuaaacucuuugaaagcugugaucugagaggggcagagaaauucaucaggccagggccacacugcacucuggccagcucccaaaaaggucuggucaaaagcucuggugcugcucccaggugugccuugucucugcacagagcccguccuuagcccucuucucucuggcuuuaggauccuuuguuuagguucuuugagagagaaguaaagaugggggccaaguuacuccaagaugugcgccaagaucuugcugacgucguucaagugugcgaggggaaaaagaagcagacaaacuaccugcgcacgcucaucaaugagcuggugaaaggugcugauggggugugcggcugggagcuggucugccacuguccacaccccaugugcgggcacacugcaguccccaggccacacgugucucuuucaggcuuccucaauagugggggucuuagcaacgccccugguuuucccuagguuuuccacaggcagcuccugugacuuuca

SEQ ID NO: 6843 - RNA, 1123 nt, Mus musculus
gcccaacccucgcuucgcucgccccgcgcccgccucgccgccgccaccgcuccuccucggcggccauugccgcauccccggccuggggcguagauaugaggcccgccuggggccuagggucggaagccauggccgcccaccuccgcgggcugagggaacucggaugguggccccgcugccgccgcggcgccagcaaccuacggcccugcuccccaagcccccgcuaaguccgccugcgccaucacucaccguggcugaaugaacacgcacgagacgugacgcuccgcaccaggacacugaagcaacuggcgcgccgcccccugcgccggccuuauauagaggcgggcccgcccagcgcgcggcgcuucuuuccagaagccuccggaaccuuccggaagaacccuccccaaccgucgccucggccgcgcgcccgcgccugcgcaauggacgggccccgccccuccaccuggagcgcgccgaacccgcgcggagaacgaacgcaagccccuccuccacagccaggugcucugcacaugcgcaguccggaacgcucggcgggccgggcgccuucccgggccgcacgcgcgcgcgcggacgggccggccagcgcaugcgccugaagccuccaugugagcccuguggucuaaggcuucuuuuccccggcgcucuguaaaagggacguccccaugggaacgcgcgcguguugugugaaccucgcgguccucugcggcgcuuuagguccuugcaggcaaaaggucccccuucgggcucccuuugggaacgcggaccccgcaggaggcgagucccgcccccccccuggcuuccaccuugauggguggggcgccucccggacugggguucugguugcguagucugaauuucagggcugaccccgcuggaguguguucugaagccuuacagugggcuuacugagagaccuuacacggugggucuuacaaauccguccagagugcuuggggauuucucuuugaccaaaagcuaugacccucaaauugggcguugugagggauuuuguaucaaauuugugcuaccuuaauuuacuguaauuuuggggcuggaaagauggcucuuccaguaaaggugcuuggguuugauaucugcc

SEQ ID NO: 6844 - RNA, 1107 nt, Mus musculus
cggccucgcugucaccgcccagcucccggccucggcccgcgccgccggcgcgcccccggugacgcccgggucgguaccuugcggacccccuuguagauauagaaguagagcucccggcccacauugaagcagaggcggucgccguugccagacuggucguugagguuuacgaaggagacgcggacaggguuggaucccugcgaguugaagggcacccgguugggccggcuguacuccgagugcugcagcagcuuguacagaccuucccggguggugaauugggucuuaaucucguucaucuccuucccuccucccuccgucgccaucuuggaaagcagcguucauccugcccuaagugcccggaucacgcccaccgcgcaggcgccguccucggccgcucgcuuucuccacuccccacccccuucuccgcggccccgcccacuggcgagccagcccccacgaaggcgggccgaagcgaagggggcgggcuaguuuuuaaugguccaacugcgcacgcgcgcucaccuggcgcgcuccacccggaggggcgugcgcaagcuccuccccugggugccgcccuccuggugcgggucgaagcgagcgcgcugagcguuggugcggggcuccugucucgcucugcagcuucgcugagggacccgaucccuaagagacgccaccgcguuggccuuggccagcugguggucccggcagagccugaggcgagcagugaaguccgguguuuggacguguaugucccagcuguccgcgauccucccugggaagcuagggaggacuccgacgguccgcuugggugcgggguaccgaugccuggugacaagccccucuacgucucacagaagauaucgauggauugggcuuuauuacagcucaggguuugguuugguuugguuugguuggguuggguuggguuuuguaggcggggugggaagaaccgcaugaauguacaggacuuguguuuucaagucucaccugaaaccuuccuggugagcauuggcuuguucuugagaaaguagguucugucggaacuucugucuccugugccucuuaauaaagguuaagcuaauugauuuucuuaaagccucaaac
